United States Patent 12,747,451 (RNA ENCODING AN ANTIBODY) - sequence listing, part 10

SEQ ID NO: 51196 - RNA, 1473 nt, synthetic construct
  misc_feature 1..1473: note = derived and/or modified sequence opt6 from anti-influenza_Chain
  source 1..1473: mol_type = other RNA
atgctttcctttccaaaaggatttaaatttggatggtcacaatcaggattccaatcagaaatgggaacaccaggaagcgaagatcctaatagtgattggcatgtatgggtacacgaccgagaaaatatagtatcccaagtagtaagcggggatcttccagaaaacggaccaggatattggggcaattacaaaagatttcatgatgaagcagaaaaaataggactaaatgcagtaagaatcaatgtcgaatggagcagaatatttccaaggccattaccaaaaccagaaatgcaaacaggaacagacaaagaaaattcaccagtaataagtgtggatctaaacgaatcaaaactaagagaaatggacaattatgcaaatcatgaagcactatcacattatagacaaatattagaagatttaagaaatcgaggatttcatatagtactaaatatgtatcattggacattaccaatatggttacatgatccaataagagttagaagaggagattttacaggaccaacaggatggctaaattcaagaacagtatatgagtttgcaagattttcagcatatgttgcatggaaactagatgatcttgcatcagaatatgctactatgaatgaaccaaatgttgtttggggcgcaggatacgcctttccaagagcaggctttccaccaaattatctaagttttcgattatctgaaatagcaaaatggaatataattcaagcccacgcaagagcttacgatgcaataaaaagtgtttcaaaaaaatcagtcggaataatatacgcaaatacaagttactacccactaagaccacaagacaatgaagcagtagaaatagctgaaagactaaatcgttggagtttctttgatagcataataaaaggtgaaataacatcagaaggccaaaacgtaagagaagatttaagaaatagattagactggataggagtaaactattatacacgaacagtagtaacaaaagccgaatcaggatacctaacattaccaggatacggagacagatgtgaaagaaattcattatctttggcaaatctacctacatctgattttggatgggaattttttcctgaaggcttatacgatgtactgttaaaatactggaaccgatatggactaccactatacgtaatggaaaatggaatagcagatgatgctgattatcaaagaccatactatttagtatcacatatttatcaagtgcatagagctttgaacgaaggagtagacgtaagagggtatttacattggtccctagcagataattatgaatggtcttcaggcttttcaatgagatttggattattaaaagttgactacttaacaaaaagactttactggcgaccaagcgcattagtttacagagaaataacaagaagtaatggaatacccgaagaattagaacatctaaatagagtccctccaataaaaccattaagacat

SEQ ID NO: 51197 - RNA, 1473 nt, synthetic construct
  misc_feature 1..1473: note = derived and/or modified sequence opt6 from anti-influenza_Chain
  source 1..1473: mol_type = other RNA
atgttatcatttcctaaaggatttaaatttggttggtcacaaagcggctttcaatcagaaatgggaacaccaggatcagaagatccaaatagtgattggcatgtatgggtacatgatagagaaaatatagtaagtcaagtcgtaagtggtgatctaccagaaaatggaccaggatactggggaaattataaaagattccatgatgaagctgagaaaataggtttaaatgcagtaagaataaatgttgaatggtcaagaatttttcccagaccacttccaaaaccagaaatgcaaacaggaactgacaaagaaaattcaccagtaatatcagtagacttaaatgaaagtaaattaagagaaatggacaattacgcaaatcatgaagcactatcacattacagacaaatactagaagatttaagaaacaggggatttcacatagtcttaaatatgtaccattggacattaccaatctggttacatgatccaataagagtaagaagaggggattttacaggaccaacaggatggttaaattcaagaaccgtatatgaatttgctcgtttcagtgcatatgtagcatggaaattagacgatttagcaagcgaatatgcaacaatgaatgaaccaaacgtagtatggggagcaggatacgcatttccaagagcaggatttccacctaattatttatcattcagattatcagaaatagcaaaatggaatattatacaagcacatgcaagagcatacgacgccataaaaagcgtatctaagaaatcagtaggaataatatatgccaatacatcatattatccattacgtccacaagacaatgaagctgtagaaatagccgagagactcaatagatggagcttctttgattcaataataaaaggtgaaataacatccgaaggacaaaatgttagagaagatttaagaaatagattagactggataggagtaaattactatactagaacagtcgtaacaaaagcagaaagcggttatcttactctacccggatatggagatagatgtgaacgaaattcactatcattagcaaatttaccaacatccgattttggatgggaatttttccccgaaggtttatatgatgtattactaaaatattggaacagatatgggttaccattgtatgtaatggaaaatggtatcgcagatgatgccgattatcaaagaccatattatctagtgtctcacatatatcaagtacacagagcattgaatgaaggtgtagatgtaagaggatacttacattggtcactagcagacaattacgaatggtcatcaggattctcaatgcgttttggtctacttaaagttgattaccttaccaaaagactatattggagaccaagtgcattagtatatagagaaataacaagaagtaatggaataccagaggaattagaacacctcaatagagtaccaccaataaaaccattaagacat

SEQ ID NO: 51198 - RNA, 1494 nt, synthetic construct
  misc_feature 1..1494: note = derived and/or modified sequence opt6 from anti-influenza_Chain
  source 1..1494: mol_type = other RNA
atggcatcacaaggaacaaaaagaagttatgaacaaatggaaacagatggagaaagacaaaatgctacagaaataagggcaagtgtaggaaagatgataggaggaataggtagattttatatacaaatgtgtacggaattaaaactgagcgactatgaaggaagattgatacaaaatagtttaactatagaaagaatggtattgagtgcatttgatgaacgaagaaataaatacttagaagaacatccttcagcgggaaaagacccgaagaaaacaggaggaccaatatatagaagagtaaatggaaaatggatgagagagttaatattatatgataaagaagaaattcgaaggatctggagacaagcaaataacggtgatgatgctacagcaggactaacacatatgatgatatggcatagcaatttaaatgacgcaacatatcaaagaacaagggcattagtgagaacaggaatggatccaagaatgtgcagtttaatgcaaggaagcacattaccaagaagatcaggggcagcaggagcagcagtaaaaggagtaggaacaatggtaatggagctagtaagaatgataaaaagaggcataaacgacagaaacttttggagaggcgaaaatggaagaaaaacacgaatagcgtatgaaagaatgtgtaatatactaaaaggcaaatttcaaacagctgcacaaaaagcaatgatggaccaagtaagagaaagccgtgatcctggaaatgcagaatttgaagatttaacatttctggctagaagcgcactaatattgaggggatcggtagcacataaaagctgtttacctgcgtgtgtatatggtcctgctgtggcttcaggatacgattttgaaagagaaggatatagcctagtgggtatagatccttttcgattgctacagaatagtcaagtttatagcttaatcaggccaaatgaaaatccagcacataaaagtcagctagtatggatggcatgtcacagtgcagcatttgaagaccttcgagtactatcatttattaaaggaacaaaagtagtacccagaggaaaattaagcacaagaggtgtacaaattgcatctaatgaaaatatggaaacaatggaaagtagtacattagaattaagatcaagatactgggcaatcaggacaaggagtggtggcaacacaaatcaacaaagagcatcagcaggacaaataagtatacaacctacattttcagtacaaagaaatttaccatttgatagaacaacagtaatggcagcattcacaggtaatacggaaggaaggacaagtgacatgagaacagaaataataagaatgatggaaagtgcaagaccagaagacgtaagttttcaaggaaggggagtatttgaattaagtgacgagaaagccgcatcgccaatagtaccaagtttcgatatgagcaatgaaggaagctacttctttggcgacaatgcagaagaatatgataat

SEQ ID NO: 51199 - RNA, 1494 nt, synthetic construct
  misc_feature 1..1494: note = derived and/or modified sequence opt6 from anti-influenza_Chain
  source 1..1494: mol_type = other RNA
atggcaagtcaaggaacaaaacgatcatatgaacaaatggaaacggatggagaacgacaaaatgcaacagaaatacgagcaagtgtaggtaaaatgattgatggaattggacgattctatatacaaatgtgtacagaattgaaattatcagattacgaaggaaggctaatacaaaatagtttaaccatagaaagaatggttctaagtgcattcgatgaaagaagaaataaatacttggaagaacatcctagcgcaggaaaagaccctaaaaaaacaggtggacctatatataaacgagtagatggaaaatggatgagagaactcgtactatatgataaagaagaaataagaagaatatggcgacaagctaacaacggagacgatgcaacagcaggattaacacatatgatgatatggcatagcaacttaaatgatacaacgtatcaaagaacgagagcattagtcagaacaggtatggatccaagaatgtgtagtttaatgcaaggaagcacattaccaagaagatccggcgcagcaggagcagcagtgaaaggagtaggaacaatggtaatggaattaatacgaatgataaaaagaggaataaatgacagaaacttttggagaggagaaaatggaagaaaaaccagaagtgcctatgaaagaatgtgtaatatactaaaaggtaaatttcaaacggcagctcaaagagcaatgatggatcaagtaagagaatcaagaaatcctggaaacgcagaaatagaagatctaatatttttagcaagatcagcattaatactaagaggaagtgttgcacataaaagctgtctaccggcatgcgtatatggtccagcaatagcttcaggatataacttcgaaaaagaaggatattcattagtcggaatagatccatttaaattactacaaaattcacaagtatatagtctaataagaccaaacgaaaaccctgcacacaaatcacaactagtatggatggcatgcaattcagcagcttttgaagacctgagggtactatcatttataagaggaacaaaagtaagtccaagaggaaaattatctacccgaggtgtacaaatagcctctaatgaaaatatggatacaatggaaagctcaacactagaactaagatcacgatattgggcaataagaacaagatcaggaggtaatacaaatcaacaaagagcatcagcaggccaaataagcgtacaacccgcattttcagttcaaagaaatctaccatttgataaacctacaataatggcagcatttacaggaaatacagaaggacgaacaagtgatatgagagctgagataataagaatgatggaaggagcgaaaccggaagaaatgagttttcaaggaagaggagtatttgaactatcagatgaaaaagcaacaaatccaatagtaccaagttttgatatgagtaacgaaggaagctacttctttggggataatgcagaagagtatgataac

SEQ ID NO: 51200 - RNA, 1494 nt, synthetic construct
  misc_feature 1..1494: note = derived and/or modified sequence opt6 from anti-influenza_Chain
  source 1..1494: mol_type = other RNA
atggcatcacaaggaactaaaagatcatatgaacaaatggaaacaggaggagaaaggcaaaatgcaacagaaataagagcaagcgtgggaagaatggtaggaggcataggaagattttatgtacaaatgtgtacagaattaaaattatcagatcaagaaggaagattaatccaaaatagtataacaatagaaagaatggtattaagtgctttcgatgaaagaagaaacagatatttggaagaacatcctagtgcaggaaaagacccaaagaaaacaggtggaccaatatatagaagaagagatggtaaatgggtcagagaacttattctatacgataaagaagaaattaggagaatatggaggcaagcaaacaatggggaagatgcaacagcaggattaacccatatgatgatatggcactcaaacttaaacgatgctacatatcaaaggacacgagcattagtgagaacaggaatggatccaaggatgtgtagcttaatgcaaggatcaacactaccaagaagaagtggagcagcaggagcagcaataaaaggtgtcggaacaatggtaatggaattaatacgaatgataaaaagaggaataaacgatagaaatttttggaggggagataatggaagacgaacgaggatagcatacgaacgtatgtgtaatatattaaaaggaaaatttcaaacagccgcacaaagagcgatgatggatcaagtaagggaaagcagaaatccaggaaatgcagaaatagaggatctaatatttttagcgcgaagtgcactaatactaagaggatcggtagcacacaaaagttgtttaccggcatgcgtatatggtttagcagtggcgagtggatacgacttcgaacgagaaggatacagcctagtaggcatagatccatttagattactccaaaacagtcaagtttttagcttaataagacctaacgaaaatcctgcacataaatcacaattagtttggatggcatgtcactcggcagcatttgaagacctaagagtaagtagctttatacgaggaacaagagtaataccaagaggacaactaagcactagaggagtacaaatagcaagtaacgaaaatgtagaagcaatggactcaagcacattagaattaagatcaagatattgggcaattagaacgagatcaggaggcaacaccaatcaacaaagagcaagcgcaggacaaattagtgtacaacctacattctcagttcaaagaaatctaccattcgaaagaccaaccataatggcagcatttaaaggaaatacagaaggtagaacatcagacatgaggacagaaattataagaatgatggaatcagctagaccagaagacgtgagctttcaaggaagaggagtgtttgaactatcagatgaaaaagcgacaaatccaatagtcccaagtttcgatatgagtaatgaaggatcgtactttttcggagacaatgctgaagaatatgataac

SEQ ID NO: 51201 - RNA, 1494 nt, synthetic construct
  misc_feature 1..1494: note = derived and/or modified sequence opt6 from anti-influenza_Chain
  source 1..1494: mol_type = other RNA
atggcaagccaaggcaccaaaaggagttacgaacaaatggaaacagatggagaaagacaaaatgccacagaaataagggcctcagtaggaaaaatgataggggggataggaagattttatatccaaatgtgtacagaactaaaactttcagattatgaaggtcgcttaatacaaaattcactgacaatagaaagaatggttttaagcgcatttgacgaaagaaggaataaatatctagaagaacacccatcagcaggaaaagatccaaaaaaaacaggaggaccgatttatagaagagtaaacggaaaatggatgcgagaattaatattatatgataaagaagaaattagaagaatatggagacaagcaaataatggagatgatgcaacggcaggactaactcatatgatgatatggcattcaaatctaaatgacgcaacatatcaaagaacaagagcactagtacgaacaggtatggatccacgaatgtgtagtttaatgcaaggtagtactctaccaagaagaagcggtgctgcaggcgcagctgtgaaaggagtaggaacaatggtaatggaattagtaagaatgataaaaagagggataaatgatagaaatttttggagaggcgaaaacggcagaaaaacgagaatcgcatatgaaagaatgtgcaatatattaaaaggaaaattccaaactgcagcacaaaaagccatgatggaccaagtaagagaaagtagagatccaggaaatgccgaatttgaggatttaacttttctagcaagaagtgcactaatattaagaggaagtgttgcacacaaaagctgtttaccagcatgcgtatatggaccagcagtagcatcaggatatgatttcgaaagagaaggttatagtcttgttggaatagatccatttcgattattacaaaattcacaagtatacagtctaataagaccaaatgaaaatccagcacataaaagtcaactagtatggatggcttgtcacagtgcagcttttgaggacctaagagtactaagctttataaaaggaacaaaagttgtaccaagaggaaaactaagtacgagaggagtacaaatagcaagtaacgaaaatatggaaacaatggaaagtagtactttagaactaagatcacgttactgggcaatacgaacaagatcagggggtaatacaaatcaacaaagggcttctgcaggacaaatcagtatacaaccaacctttagcgtacaaagaaatttaccttttgacagaacgacagtaatggcagcatttacaggaaatacagaaggaagaacaagtgacatgagaactgaaatcataagaatgatggaaagtgcaagaccagaagatgtaagcttccaaggaagaggtgtgttcgaactatcagacgaaaaagcagcatcaccaatagtaccatcatttgatatgtcaaatgaaggatcatacttctttggagataatgcagaagaatacgacaat

SEQ ID NO: 51202 - RNA, 1494 nt, synthetic construct
  misc_feature 1..1494: note = derived and/or modified sequence opt6 from anti-influenza_Chain
  source 1..1494: mol_type = other RNA
atggcatctcaaggtacaaaaagaagctatgaacaaatggaaacagacggtgaaagacaaaatgcgacagaaataagggcatcagtagggaaaatgatagatggaataggacgattttatatacaaatgtgcacagaacttaaactaagcgattacgaaggaagactaatacaaaactcattaacaatagaaagaatggtattatcagcatttgacgaaagaagaaataagtacttagaagaacatccgtcagcaggaaaagatccaaagaaaacgggaggaccaatatataaaagggtagatggaaaatggatgagagaattagtactttatgataaagaagaaataagaagaatatggagacaggctaataatggagacgatgcaacagcaggattgacacatatgatgatatggcatagtaatttaaacgatacaacatatcagcgtaccagagctttagtaagaaccggaatggatccaaggatgtgcagtctaatgcaaggaagcacattgccaagaaggagtggtgctgccggagcggcagtaaaaggggtgggaacgatggtaatggaattaataagaatgataaaaaggggaataaatgacaggaatttttggagaggagaaaatggaagaaaaacaagaagtgcatatgaaaggatgtgtaatatactaaaaggaaaatttcaaacagcggcacaaagagcaatgatggatcaagtaagagagtccagaaatcctggtaatgcagaaatagaggatttaatatttttagcaagaagtgcattaatattacgagggtcagtagcacacaaaagctgtttacccgcatgtgtatatggtccggctatagcatctgggtataattttgaaaaagaaggatacagcttagtaggaattgatccgtttaaattactacaaaactctcaagtatattcattgataagaccaaatgaaaacccagcacataaatctcaattagtatggatggcttgtaatagtgctgcatttgaagatctaagagtactatcatttataagaggaacaaaagtcagccccagaggaaaattaagtacaagaggagtacaaatagcaagtaacgaaaatatggatacgatggaatcaagtacattagaattaaggtcgagatactgggcaattagaacaagaagcgggggaaatacaaatcaacaaagagcatcagcggggcaaatatcagtacaaccagcattcagtgtacaaagaaatttaccatttgacaaaccaacaataatggcagcatttacaggaaacacagaaggaagaacaagcgacatgagagcagaaataattagaatgatggaaggcgcaaaaccagaagaaatgagtttccaaggtagaggtgtattcgaactatcagatgaaaaagcaacaaatccaatagtcccaagttttgatatgagcaatgaaggaagttactttttcggagataatgcagaagaatatgataat

SEQ ID NO: 51203 - RNA, 1494 nt, synthetic construct
  misc_feature 1..1494: note = derived and/or modified sequence opt6 from anti-influenza_Chain
  source 1..1494: mol_type = other RNA
atggcatcacaaggaacaaaaaggtcatacgaacaaatggaaacaggaggtgaaaggcaaaatgcaacagaaataagagcaagtgttggaagaatggtaggaggaataggaagattttatgtacaaatgtgtacggaattaaaattaagtgatcaagaagggaggttaatacaaaatagtataaccatagaaagaatggtactttctgcatttgatgaacgtagaaataggtatttagaagaacatccaagtgcaggaaaggatccaaagaaaacaggaggaccaatttatcgaagaagagatggaaaatgggttagagaattaatattatacgataaagaagaaattagaagaatatggaggcaggcaaataatggagaagatgcgacagcaggtttaacacatatgatgatatggcacagtaatctaaacgatgcaacatatcaaagaacaagagccttagtaagaacaggaatggatccaagaatgtgtagtttaatgcaaggaagcacattaccaaggagaagtggagcagcaggggcagcaataaaaggagtaggaacgatggtaatggaattaataagaatgataaaaagaggtatcaatgatagaaatttttggaggggtgacaatggaagacgcacaagaatagcatatgaaaggatgtgtaatatattaaaaggaaaatttcaaacagcagcacaaagagcaatgatggatcaagtaagagaaagtagaaatccaggaaatgccgagatagaagatttgatatttttagcacgttcagcattaatactaagaggaagtgtcgctcacaaaagctgcttacctgcatgtgtatatggattagcagtagcaagtggatacgatttcgaaagagaaggttattctttagtaggaatagatccatttagattactacaaaattcacaagtatttagtctaattagaccaaatgaaaacccagcacataaaagccagctagtatggatggcatgtcattcggctgcatttgaagatttaagagtaagtagtttcattagaggaaccagagtaattccaagaggacaattatcaacaagaggagtacaaatagcttcaaatgaaaatgtggaggcaatggatagtagcacgttagagttgagaagccgatactgggcaataagaactaggagtggaggtaatactaatcaacaaagagcatcagcaggacaaataagcgtacaacctacatttagcgttcaaagaaatttgccattcgaaaggccaacaataatggcagcatttaaaggtaacaccgaaggaagaaccagtgatatgagaactgaaataataaggatgatggaaagtgctagaccagaagacgtaagttttcaaggaagaggtgtatttgaactaagtgatgaaaaagcaacaaatccaatagtacctagctttgacatgagtaatgaaggtagttatttctttggagacaacgcagaagaatacgataat

SEQ ID NO: 51204 - RNA, 1530 nt, synthetic construct
  misc_feature 1..1530: note = derived and/or modified sequence opt6 from anti-influenza_Chain
  source 1..1530: mol_type = other RNA
atgtttcccgaaaaattcctatggggagtagcacaaagcggattccaatttgaaatgggagacaaattaagaagaaatatagatacaaacacagactggtggcactgggtcagagataaaactaatatcgaaaaaggtctagtaagcggagacctaccagaggaaggaataaataactatgaactttacgagaaagatcatgagatagcaaggaaactaggactcaatgcatatagaattggaatagaatggtccagaatatttccatggcccacaacatttatagatgttgactacagttataatgaatcatataatttaatagaagatgtaaaaattactaaagatacattagaagaactagatgaaatagccaataaaagagaagtcgcatattacagatctgtaataaattcattaagatccaaaggattcaaagtcatagtgaatttaaatcacttcacattaccatattggctacacgaccccattgaagcaagagaaagagctctaacgaacaaaagaaacggatgggtaaatcccagaacagtaatagaatttgcaaaatacgcagcatatatagcatataaatttggagatatagtagacatgtggtcaacatttaacgaaccaatggtcgtagtagaactaggctatctagcaccatactcaggctttccaccaggagtcctaaatccggaagcagcaaaattagcaattttacacatgataaatgcacacgcactagcatatagacaaataaagaaattcgatacagaaaaagctgacaaagactcaaaagaacccgcagaagtaggaataatatacaacaatataggcgtagcatacccaaaagacccaaatgatagtaaagatgtaaaagccgcagaaaacgacaatttctttcacagtggactattcttcgaagccatacataaaggaaaattaaatatagaatttgatggagaaactttcatagacgcaccatatttaaaaggcaatgactggataggagtaaattattatacaagagaagtagtaacatatcaggaacctatgttcccatcaataccattaataacatttaaaggagtacaaggatacggttacgcttgtcgaccaggcacattatcaaaagatgacagaccagtatcagacatcggatgggaattatatccagaaggtatgtatgactcaatagtagaagctcataaatacggagtaccagtatacgtaaccgaaaacggaatagcagactcaaaagatatattaagaccttactacatagcatcacatatcaaaatgaccgaaaaagcattcgaagatggatatgaagtcaaaggctactttcattgggccttaacagacaactttgaatgggcattaggatttagaatgagatttggcctatacgaagtaaatctaataacaaaagaaagaataccaagagaaaaatcagtatctatatttagagaaatagttgcaaacaatggagtcacaaagaaaatagaagaagaactactaagaggt

SEQ ID NO: 51205 - RNA, 1530 nt, synthetic construct
  misc_feature 1..1530: note = derived and/or modified sequence opt6 from anti-influenza_Chain
  source 1..1530: mol_type = other RNA
atgttcccagaaaaattcttatggggagtagcacaatcaggattccaattcgaaatgggagataaactacgaagaaatatagatacaaataccgattggtggcactgggtaagagacaaaaccaatatagaaaaaggattagtaagtggagacctaccagaagaaggaatcaataactatgaactatacgaaaaagaccacgaaatagcaagaaaattaggattaaacgcataccgaattggaatagaatggtcaagaatatttccgtggccaacaacatttatagatgtagattactcatacaacgagagctataatttaattgaagatgtaaaaatcactaaagatacattagaagaactagatgaaatagcaaataaacgagaagtagcatactacagatcagtaataaactcattaagatcaaaaggatttaaagtaatagtaaatcttaaccacttcaccttaccttattggctacacgatccaatagaagccagagaacgagcattaacgaacaaaagaaatggctgggttaatccaagaacagtaatcgaatttgcaaaatatgcagcatacatagcttataaattcggagacatagtagatatgtggtcaacatttaacgaacccatggtagtagtcgaacttggatacttagcaccatactctggattcccaccaggcgtactaaatccagaagcagcaaaactagctatactacatatgatcaacgcacacgcactagcctatagacaaataaagaaattcgatacagaaaaagcagacaaagattctaaagaaccagcagaagtcggaataatatacaataatataggagtagcatatccaaaagatccaaacgacagtaaagatgtaaaagcagctgaaaacgacaatttctttcactctggattattctttgaagcaatccacaaaggaaaactaaacatagaatttgatggagaaacctttatagatgctccctatttaaaaggaaatgactggataggcgtcaactactacacaagagaagtcgtaacatatcaagaaccaatgtttcccagtataccactaataacatttaaaggtgtacaaggatatggatacgcatgtagaccaggaacattaagcaaagatgaccgaccagtatctgacataggatgggaactttatccagaaggaatgtatgatagtatagtcgaagcccataaatatggagtccctgtatatgtaacagaaaatggtatcgcagactcaaaagacatactaagaccttactatatagcatcacatataaaaatgacagaaaaagcatttgaagatggatatgaagtaaaaggatactttcactgggcactaacagataactttgaatgggccttaggctttcgcatgagatttggattgtacgaagtaaatttaataacaaaagaaagaatacccagagaaaaatcagtatcaatatttagagaaatagtagcaaacaatggagtaacaaagaaaatagaagaagaactattaagaggt

SEQ ID NO: 51206 - RNA, 1536 nt, synthetic construct
  misc_feature 1..1536: note = derived and/or modified sequence opt6 from anti-influenza_Chain
  source 1..1536: mol_type = other RNA
atgaaaagaaaagtaaaaaaaatggcagctatggctacaagtataattatggcaataatgataatattacatagcatacctgtcttagcaggaagaataatatatgataacgaaacaggaacacatggcggttacgactatgaattatggaaagattacggtaatacaataatggaactaaatgatggaggaacctttagttgtcaatggagtaatatagggaacgctcttttccgaaaaggaagaaaatttaactcagacaaaacatatcaagaactcggagacattgtcgtagaatatggatgcgactataatcctaacggtaatagctacttatgcgtctacggatggacacgaaatccattagtagaatactacatagtagaaagttggggaagttggagacccccaggcgccacaccaaaaggcactataacacaatggatggcaggaacatatgaaatatatgaaacaacacgagttaaccaaccctcaatcgacggcactgctaccttccaacaatattggagcgtaagaacaagtaaaagaacaagcggtacaatttcagtcacagaacattttaaacaatgggaacgaatgggaatgagaatgggaaaaatgtacgaagtagcattaacagtagaaggatatcaatcatcaggatatgcaaatgtatataaaaatgaaataagaattggcgcaaaccccacaccggccccatcgcaatcaccaattagaagagacgcattctcaataatagaagccgaagaatataactcaacaaattcatctacactacaagtaataggaacccctaataatggaagaggaataggatatatagaaaacggaaacacagtaacatattcaaatattgattttggcagtggcgcaacaggattttctgcaactgtagcaaccgaagtaaatacaagtatacaaataagatcagattcaccaacaggaacattacttggtacattatatgtttcctcaacaggatcatggaatacataccaaactgtaagcacaaacatttcaaaaataacaggcgtacacgatatagtactagtattctcaggaccagtaaacgttgataatttcattttcagtcgatcaagtcccgtaccagcaccaggagacaatacaagagacgcatattcaataatacaagcagaagattatgattctagttatggaccaaatctacaaatattctcactccccggcggaggatccgctataggatacatagaaaatggctactctactacatataaaaatatagactttggagacggagcaacatcagtcacagcaagagtagccacccaaaatgctaccactatacaagtaagactaggatcaccttccggaacattattaggaactatatatgtaggatcaactggctcctttgatacataccgagatgtatctgcaacaatttcaaacaccgccggagttaaagatattgtacttgtattttcaggaccagtcaatgtagattggtttgtattctcaaaatctggtaca

SEQ ID NO: 51207 - RNA, 1536 nt, synthetic construct
  misc_feature 1..1536: note = derived and/or modified sequence opt6 from anti-influenza_Chain
  source 1..1536: mol_type = other RNA
atgaaaagaaaagtaaagaaaatggccgcaatggcaacctccataataatggcaataatgataatcttacatagtataccagtactagcaggcagaataatctacgataacgaaacaggcacacatggaggatacgattacgaactatggaaagattacggaaatacaatcatggaactaaatgacggaggaacatttagttgtcaatggagtaacataggaaacgcattatttcgaaaaggaagaaaatttaattctgataaaacatatcaagaattaggagacatagtcgtagaatatggatgtgattacaatccaaatggaaactcatacttatgtgtatacggatggactaggaatccgttagtagaatattatatagtagaaagttggggaagttggagaccaccaggagcaacacctaaaggaaccattactcaatggatggcaggtacatacgaaatatatgaaaccacaagagtaaaccaaccaagcatagacggtacagcaacattccaacaatactggagcgttagaacttcaaaaagaacatcaggaacaataagcgtcactgaacattttaaacaatgggaaagaatgggaatgagaatgggaaaaatgtatgaagtagcattaacagtagaaggataccaatcaagtggatacgctaatgtatataaaaatgaaataagaatcggagcaaacccgacaccagcaccgtcacaaagtcctataagaagagatgcttttagcataatagaagctgaagaatataatagtacaaattcttcaaccctacaagtaataggtaccccaaacaacggacgaggaataggatacatagaaaacggaaatacagtcacatactctaacattgactttggaagcggagcaaccggattcagtgctacagtagcaactgaagtaaatacatcaatacaaataagatccgatagtccgacaggaacattactaggaacattatacgtaagctcaacaggatcatggaacacttaccaaacagtaagtacaaacatatcaaaaataacaggagtacacgatattgttttagtattcagtggaccagtcaacgtagataatttcatattttcaagaagttcaccagtaccagcaccaggagacaatacaagagacgcatattccataattcaagcagaagactacgatagttcatacggtccaaatcttcaaatatttagtctaccaggtggtggttcagcaattggatacattgaaaatggatatagcacaacatataaaaacatagatttcggtgacggagcaacaagcgtaacagcccgagtggcaacacaaaacgccaccacaatacaagttagattaggaagcccaagtggcacactactaggaacaatatacgtaggatcaacgggatcatttgacacatatagggatgtgtcagcaacgatatcaaatacagcaggagtaaaagatatagtattagtattttcaggtccagtaaatgtagactggttcgtattttcaaaatcaggtaca

SEQ ID NO: 51208 - RNA, 1539 nt, synthetic construct
  misc_feature 1..1539: note = derived and/or modified sequence opt6 from anti-influenza_Chain
  source 1..1539: mol_type = other RNA
atctgtataggctaccatgcaaacaacagtacagaacaagttgacacaattatggaaaaaaacgtaacagtaacccatgcacaagacatactagaaaaaacacacaacggaaaactatgcgacctagacggagtcaaacccctaatactcagagattgctcagtagctggatggttattaggcaatcctatgtgtgacgaattcataaatgtaccagaatggtcatacatcgtcgaaaaagccaaccctgcaaacgatctatgctatccaggtaactttaacgattacgaagaattaaaacatctactatcaagaataaaccatttcgaaaaaatacaaatcattccaaaaagctcctggtcagaccacgaagcatcctctggagtatcaagcgcatgtccatatcaaggaacaccatctttctttagaaatgttgtatggctaataaaaaaaaataatacatatccaacaattaaaagatcatacaacaatactaaccaagaagatctacttatactctggggaatacaccactctaacgacgccgcagaacaaaccaaattataccaaaatcccactacctacatatccgtaggcacatcaacactaaaccaaagactagtcccaaaaatagctacaagatcaaaagtaaacggtcaaaatggtagaatggactttttctggaccatactcaaaccaaatgatgccattaacttcgaatcaaacggtaactttatagctccagaatacgcctataaaattgtcaagaaaggatacatacccgaagcacctcgtgatggacaagcctacgtacgaaaagacggtgaatgggtattactatcaacctttttaagatcagacaaaacacacacatgccccccttgcccagcacctgaactcttaggaggtccctctgtattcttatttccccctaaaccaaaagacacactaatgatttcacgcacaccagaagtaacatgcgtagtagtcgatgtatcacacgaagaccccgaagttaaattcaactggtatgtcgacggcgtagaagtacacaatgcaaaaacaaaacctagagaagaacaatacaactcaacttacagagtagtatcagtcctgacagtcctacatcaagactggctaaatggaaaagaatacaaatgcaaagtaagcaataaagcactacccgcaccaatagaaaaaaccataagcaaagccaaaggacaaccaagagaaccacaagtatacaccctacctccttcaagagaagaaatgacaaaaaaccaagtatcactaacatgtctagtaaaaggattctatccatccgacatagcagtagaatgggaatcaaacggacaaccagaaaacaactacaaaacaacaccaccagtactagactcagatggatcattttttctttactcaaaattaaccgtagacaaatccagatggcaacaaggaaacgtattctcatgttcagtcatgcacgaagcattacacaaccactacacccaaaaatcattatcactctcaccaggaaaa

SEQ ID NO: 51209 - RNA, 1539 nt, synthetic construct
  misc_feature 1..1539: note = derived and/or modified sequence opt6 from anti-influenza_Chain
  source 1..1539: mol_type = other RNA
atctgcataggatatcacgctaataactctactgaacaagtagatacaataatggaaaaaaacgtaacagtcacacacgcccaagacatactagaaaaaacacacaatggaaaattatgcgatctagacggagtaaaacccttaatactccgagactgctctgtcgccggatggcttctaggaaatccaatgtgcgacgaattcataaatgtacccgaatggtcatacatagtagaaaaagcaaacccagcaaacgacctatgttatccaggtaacttcaatgattacgaagaactcaaacatttattatcacgaatcaaccactttgaaaaaatccaaatcataccaaaatcatcatggtcagaccacgaagcatcatcaggcgtatcatcagcatgcccatatcaaggtacaccatctttttttagaaacgtagtatggctaataaaaaaaaataatacatacccaacaatcaaaagatcatacaacaatacaaaccaagaagacctcctaattctgtggggaatacaccactccaacgacgcagcagaacaaactaaactataccaaaacccaacaacctacataagcgtaggaacatcaaccctaaaccaacgactcgttcccaaaatagcaacaagatcaaaagtaaatggacaaaatggcagaatggactttttctggacaatattaaaaccaaatgacgcaattaacttcgaatcaaacggaaacttcatagccccagaatacgcatataaaatagtaaaaaaaggatatataccagaagccccacgagacggacaagcatatgtacgcaaagatggagaatgggtcctattatcaacattcctacgatcagacaaaacccacacatgcccaccatgcccagcaccagaactcctcggaggaccatcagtattcttattcccaccaaaaccaaaagacacactaatgatatctagaacaccagaagtaacctgcgtcgtagttgacgtttcacacgaagacccagaagtaaaatttaactggtacgttgacggagtagaagtacacaatgcaaaaacaaaacctagagaagaacaatataactcaacgtaccgagtagtatcagttctaactgtactacaccaagattggcttaatggcaaagaatacaaatgcaaagtatccaacaaagcattacccgcacccatagaaaaaaccatatccaaagctaaaggacaaccacgagaaccacaagtatatacactcccaccatcaagagaagaaatgacaaaaaaccaagtttcactaacatgcttagtaaaaggcttctacccttcagacatagcagtcgaatgggaatccaatggacaaccagaaaacaactataaaacaacaccaccagtcttagacagcgacggatcatttttcttatactcaaaactgactgtagacaaatctcgatggcaacaaggaaatgtattctcctgctcagtaatgcacgaagccttacataatcactacactcaaaaatctctatcattatcaccaggaaaa

SEQ ID NO: 51210 - RNA, 1593 nt, synthetic construct
  misc_feature 1..1593: note = derived and/or modified sequence opt6 from anti-influenza_Chain
  source 1..1593: mol_type = other RNA
acactatgcataggataccacgcaaataatagcacagacactgtagacactgtactagaaaaaaacgtaacagttactcacagtgtcaacctattagaagacaaacacaacggaaaactatgtaaactgcgcggagtagcacctctacacttaggtaaatgcaatatagcaggatggatactcggaaatcccgaatgtgaatccctcagcacggcatcaagctggtcatatatagtagaaacgagctcatcagataacggaacatgctatccaggcgactttatagattacgaagaactacgcgaacaactaagttcagtaagttcatttgaacgattcgaaatattccctaaaaccagttcatggccaaaccacgactcaaacaaaggagtcacagcagcatgtccacatgcaggcgcaaaatcattctacaaaaatttaatatggctggtaaaaaaaggaaacagctacccaaaattatcaaaatcatacataaacgataaaggcaaagaagtattagtactttgggggatacaccacccaagcacatcagcagaccaacaatcactataccaaaacgcagatgcctatgtatttgtaggcacatctagatattcaaaaaaattcaaacccgaaatagcaatacgaccaaaagttcgagaccaagaaggcagaatgaactactattggacactcgtagaacctggtgacaaaataacattcgaagcaacaggaaacctagttgtacccagatacgcatttgccatggaacgagatgcaggatcaggaattatcatatcagacacaccagtacacgactgtaacacaacatgccaaacacctaagggagcaataaacacatcactaccctttcaaaatatacacccaataacaataggaaaatgtccaaaatacgtcaaatcaacaaaactacgattagccacgggactaagaaatgtgccatctatacaatcaagaggattatttggagccatagcaggatttatagaaggcggatggactggaatggtagatggatggtatggataccatcaccaaaacgaacaaggatcaggatacgccgcagacttaaaaagtacacaaaacgcaatagacgaaataacaaacaaagtaaactcagtaatcgaaaaaatgaatacacaatttacagcagtcggtaaagaattcaaccacctagaaaaaagaatagaaaacctaaataaaaaaatagatgacggcttcttagacatatggacctacaatgccgaactactagtattattagaaaatgaaagaacactcgattaccatgactccaacgtaaaaaatttatatgaaaaagtcagaagtcaactaaaaaacaacgcaaaagaaataggcaacggatgcttcgaattctaccataaatgcgacaacacatgcatggaaagtgtaaaaaatggaacatatgactacccaaaatacagtgaagaggcaaaattaaaccgcgaagaaatagacggagtaaaacttgaatcaacaagaatctatcaaatattagcaatatattccacagtagcatcatcattagtactcgtagtatcattaggagct

SEQ ID NO: 51211 - RNA, 1593 nt, synthetic construct
  misc_feature 1..1593: note = derived and/or modified sequence opt6 from anti-influenza_Chain
  source 1..1593: mol_type = other RNA
acattatgtatcggataccacgcaaacaactcaacagatacagtagacacagtactagaaaaaaatgtaacagttacacactctgtaaatcttctagaagacaagcataacggaaaactctgcaaattgagaggagttgctcccttacacctcggaaaatgtaacatagcaggttggattctaggaaatccagaatgcgaatcactatcaacagcaagtagttggtcatgtatagtagaaactagctcttcagacaacggaacatgttacccaggagattttatagactacgaagaattaagagaacaactttcaagtgtaagtagcttcgaacgtttcgaaatattcccaaaaacatcatcatggccgaatcacgatagcaataaaggtgtaacagcagcctgcccgcacgccggagcaaaaagcttctacaaaaacctaatatggctagtgaaaaaaggaaattcatacccaaaactatcaaaaagctatataaacgacaaaggaaaagaagtattagtactatggggaatccatcacccttcaactagtgcagaccaacaatcactatatcaaaacgcagacgcgtacgtcttcgtaggaactagtagatattcaaaaaagttcaaaccagaaatagcaataagaccaaaagtacgagaccaagaaggaagaatgaactactactggacactagtagaaccaggagataaaataacattcgaagctacaggaaacctagtagtaccacgatacgcatttgctatggaaagagacgcaggatctggaataataatatcggatactccagtgcacgattgtaatacgacatgccaaacaccaaaaggtgctataaacacaagtttaccgttccaaaacatacacccaataacgataggcaaatgtccaaaatatgtaaaatcaacaaaattaagattagccactggattaagaaatgtaccaagcatccaatcaagaggattattcggagcaatagcaggattcatagaaggaggatggacaggaatggtagacggatggtacggatatcaccaccaaaatgaacaaggaagcggctatgcagccgacttaaaaagtacacaaaacgcaatagacgaaattactaacaaagtaaactcagtaatagaaaaaatgaacacacaattcacagcagtcggaaaagaattcaaccatctagaaaaacgaatagaaaacttaaataaaaaaatagatgacggatttttagacatatggacatacaatgcagaactactcgttttactagaaaacgaaagaactctagattatcacgactccaacgtaaaaaacctatacgaaaaagtacgatcacaattaaaaaacaatgccaaagaaataggaaacggttgcttcgaattctatcacaaatgcgacaatacatgtatggaatcagtgaaaaatggaacatacgactacccgaaatactctgaagaagccaaattaaatcgagaagaaattgacggagtaaaactagaaagcaccagaatatatcaaatactagcaatatactcaacagtagcatctagcctagtactagtagtatcactaggagca

SEQ ID NO: 51212 - RNA, 1593 nt, synthetic construct
  misc_feature 1..1593: note = derived and/or modified sequence opt6 from anti-influenza_Chain
  source 1..1593: mol_type = other RNA
acattatgcataggataccacgcaaacaattcaacagacacagtagacaccgtactagaaaaaaacgtaactgtaacacacagcgtcaatctattagaagataagcacaacggaaaattatgtaaactaagaggagttgcacccttacacttaggaaaatgcaacatagcaggttggatactcggaaatccagaatgcgaaagcctatcaaccgcatcatcttggtcatacatagttgaaacatcctcaagcgataatggcacttgctaccctggagatttcatagattacgaagaactacgagaacaactatccagcgtaagttcattcgaaagattcgaaatattcccaaatacatcatcatggccaaatcatgattcaaataaaggagtaacagcagcctgcccacatgcaggagcaaaatcgttttacaaaaacttaatatggctcgtaaaaaaaggaaactcatatccaaaactatcaaaatcctacataaatgacaaaggaaaagaagtcctagtattatggggaatacatcatccaagtacatccgctgatcaacagtcattataccaaaacgccgatgcctatgtatttgtaggcacatcacgatactcaaaaaaattcaaaccagaaatagcaattagaccaaaagtaagagatcaagaaggaagaatgaattattactggacactagtagagccaggtgataaaataacatttgaagcaacaggtaacttagtagtcccaagatacgcatttgcaatggaaagagacgcaggatcaggaataataatatcagatacaccagtacatgactgtaatacaacatgccaaacaccaaaaggagccataaacacatccctaccattccaaaacatacacccaatcaccataggaaaatgcccaaaatacgtcaaaagcacaaaactaagacttgccacaggattaagaaacgtacccagtatacaatcacgaggactatttggagcaatagcaggattcatagaaggaggatggacaggaatggtagatggctggtatggataccatcatcaaaacgaacaaggttcaggatacgcagctgatctaaaatcaactcaaaacgcaatagatgaaataacaaacaaagtaaatagcgtaatagaaaaaatgaacactcaattcaccgcagtcggaaaagaatttaaccacctagaaaaaagaatcgaaaatcttaacaaaaaaatagatgacggattcctagacatatggacatacaatgccgaacttttagtactacttgaaaatgaaaggacattagactaccacgattcaaatgtaaaaaacctatacgaaaaagtaagatcacaactaaaaaacaatgcaaaagaaattggaaatggctgcttcgaattttatcacaaatgcgataacacatgcatggaaagcgtaaaaaatggaacatacgattatcccaaatattcagaagaagcaaaattaaatagagaagagatagacggcgtaaaattagaatccacacgaatctaccaaatactagcaatatactcaacagttgcaagttccctagtactagtcgttagcctaggagca

SEQ ID NO: 51213 - RNA, 1593 nt, synthetic construct
  misc_feature 1..1593: note = derived and/or modified sequence opt6 from anti-influenza_Chain
  source 1..1593: mol_type = other RNA
acattatgcataggataccacgcaaacaattccacagacacagttgacacagtattagaaaaaaacgtaactgttacacactctgtaaaccttttagaagacaaacacaacggaaaactatgcaaactaagaggagtagcaccattacacctaggcaaatgtaatattgccggttggatattaggcaacccagaatgcgaatctcttagcacagcatccagctggagctatatagtagaaaccagttcaagtgataacggaacatgttatccaggagacttcatagactatgaagaattaagagaacaactatcatcagtcagctcatttgaacgatttgaaatattcccaaaaactagctcatggccaaatcatgactcaaacaaaggagtaacagcagcatgcccacatgccggagcaaaatcattctataaaaacttaatatggctagtaaaaaaaggaaatagctaccccaaattatcaaaatcatacattaacgacaaaggaaaagaagtattagtattatggggaatacatcacccttccacttcagcagatcaacaatcactctaccaaaacgcagatgcatatgtatttgtaggaaccagcagatactcaaaaaaattcggaccagaaatagccataagaccaaaagtaagagatcaagaaggaagaatgaattactactggacattagtagaacctggagataaaataacatttgaagcaacaggtaatctagtcgtacccagatacgcattcgcaatggaacgagacgccggcagtggaataatcatatcagacacacctgtacacgactgtaataccacatgccagacacccaaaggagctataaacacatcattaccatttcaaaatatccacccaataaccataggaaaatgcccaaaatacgtaaaatcaaccaaactgaggttagccacaggcttaagaaacgtcccttcaatacaatcaagaggactatttggagcaatcgcgggatttatcgaaggaggatggacaggtatggttgatggatggtatggataccaccaccaaaacgaacaaggatcaggatatgcagcagatctcaaatcaacacaaaacgcaatagacgaaataacaaacaaagtaaactcagtcatagaaaaaatgaatacacaattcacagcagtaggcaaagaatttaatcacttagaaaaaagaatagaaaatctaaataaaaaaatagacgacggtttcctggacatttggacttataatgccgaacttttagtacttctagaaaacgaacgaacgctagattaccatgacagcaacgtaaaaaacttatacgaaaaagttcgatcacaattaaaaaacaatgcaaaagaaataggaaatggctgctttgaattttaccacaaatgcgataacacatgcatggaatctgtaaagaatggaacatacgactatcctaaatattcagaagaagcaaaactcaatagagaggaaatagacggagtaaaactcgaatcaacaaggatatatcaaatattagcaatatactccaccgtagcatcaagtctagtactcgtagtttctctaggagcg

SEQ ID NO: 51214 - RNA, 1593 nt, synthetic construct
  misc_feature 1..1593: note = derived and/or modified sequence opt6 from anti-influenza_Chain
  source 1..1593: mol_type = other RNA
accctctgtataggatatcatgccaacaactcaacagatacagtagatacagtacttgaaaaaaacgttacagtaacacattcagtaaatttactagaagataaacataacggcaaactctgcaaattaagaggagtagcaccattacaccttggaaaatgcaacatagcaggctggatcctaggaaacccagaatgcgaaagtttaagtacagcatcaagctggtcatatatcgtagaaacaagttccagcgacaatggaacatgttatccaggcgattttatagattacgaagaactaagggaacaactaagttcagtatcaagctttgaaagattcgaaattttcccaaaaacaagcagttggcctaaccacgattcaaataaaggagtaacagccgcctgtccacacgcaggcgcaaaatcattctataaaaatctaatatggctcgtaaaaaaaggcaattcatacccaaaattatcaaaaagttacatcaacgacaaaggaaaagaagtcttagtgctatggggaatacaccacccaagtaccagcgcagaccaacaaagtctataccaaaacgcggacgcatacgtattcgtaggaacctcaagatacagcaaaaaatttaaaccagaaattgcaataagaccaaaagtaagagaccaggaaggaagaatgaattattactggacactagtagaaccaggagacaaaattacattcgaagccacaggcaatttagtagtaccacgatacgctttcgcgatggaaagagatgcaggaagtggaataatcattagcgacacacctgtacacgattgtaacacaacatgtcagacacctaaaggagcaataaacacaagtttgccattccaaaacatacatccaataacaataggaaaatgcccaaaatacgtaaaatcaacaaaactaagattagcaacaggattacgaaatgtaccatcaatccaatcaagaggtttattcggagcaatagcaggatttatagaaggaggatggaccggaatggtcgacggctggtacggataccatcaccaaaacgaacaaggatcaggatacgcagcagacctaaaaagtacccaaaatgcaatagacgaaataacaaacaaagtaaactcagtaattgaaaaaatgaacacacaattcacagcagtcggaaaagaattcaatcacctagaaaaaagaattgaaaacctaaataaaaaaatcgacgacggcttcttagacatatggacatacaatgcagaattattagtattactcgaaaacgaaagaacattagactaccatgactcaaacgtaaaaaatttatacgaaaaagttagatcccaattaaaaaacaacgccaaagaaataggaaacggatgttttgaattctatcacaaatgtgataatacatgcatggaaagtgtaaaaaacggaacatatgactatccaaaatacagtgaagaagcaaaattaaaccgggaggaaatagacggcgttaaactagaatcaaccagaatctaccaaatactagcaatatacagcacagtagcctcatcattagttctagtcgtaagcttaggagca

SEQ ID NO: 51215 - RNA, 1593 nt, synthetic construct
  misc_feature 1..1593: note = derived and/or modified sequence opt6 from anti-influenza_Chain
  source 1..1593: mol_type = other RNA
acactttgtatcggataccacgcaaacaactccacagataccgtagacaccgtcctagaaaaaaatgtaacagtaacacactcagttaaccttcttgaagataaacataacggcaaactatgcaaattaagaggtgtcgcacctctacacttaggcaagtgcaacatagctggatggatattaggaaacccagaatgcgaatccctatcaaccgcttcatcctggtcatgtatagtagaaacatcaagctcagacaacggcacatgttatccgggagatttcatagactacgaagaactaagagaacaactaagtagtgtatcatcttttgaacgattcgaaattttcccaaaaacctcatcatggccaaatcatgactcaaacaaaggagttacagcagcatgtccacatgcaggtgctaaatcattctacaagaacctaatatggttagtaaaaaaaggaaatagttaccccaaactatcaaaatcatacatcaatgataaaggaaaagaagtactagtattatggggaatacatcacccaagtacaagcgcagatcaacaaagcctatatcaaaacgcagatgcttatgtcttcgtaggtacatcaagatacagcaaaaaatttaaaccagaaatagcaataagaccaaaagtacgcgaccaagaaggaagaatgaactattactggactctagtagaacccggagacaaaataacttttgaagctaccggcaatctagtagtaccgagatacgcattcgccatggaaagagacgcaggctccggaatcataatatctgacacaccagtccacgactgcaacacaacatgccaaacaccaaaaggagccatcaatacaagcctacccttccaaaacatacaccctatcacaattggaaaatgtcccaaatacgtaaaaagtacaaaattaagattagcaacaggattacgaaacgtaccgagtatacaatcacgaggattattcggagcaattgccggcttcatagaaggcggatggaccggaatggtcgacggatggtacggataccaccaccaaaacgaacaaggatctggatacgcagccgacctaaaatcaacacaaaatgcaatagatgaaatcacaaacaaagtaaactcagtaatagaaaaaatgaatacacagtttacagcagtaggaaaagaattcaatcatctagaaaaaagaatagaaaatcttaacaaaaaaatagatgacgggtttttagacatatggacatataacgcagagctattagtattactagaaaatgaaagaacattagactaccacgattctaacgtcaaaaacctatatgaaaaagtaagaagccaactaaaaaacaacgcaaaagagatcggaaacggatgcttcgaattctatcataaatgcgacaacacttgcatggaatcagtaaaaaatggaacatacgattatcccaaatatagcgaagaagcaaaactaaatcgagaagaaatagatggagttaaactagaatcaacccgaatataccaaatcttagcaatatactcaacagtagcatcatccctagtactagtagtttcactaggtgca

SEQ ID NO: 51216 - RNA, 1593 nt, synthetic construct
  misc_feature 1..1593: note = derived and/or modified sequence opt6 from anti-influenza_Chain
  source 1..1593: mol_type = other RNA
acattatgtataggttaccacgcaaataattcaacagacacagtagatacagtattagaaaaaaacgtaacggtcacccacagcgtaaacctactcgaagataaacataacgggaaactctgcaaattacgaggagtagcaccactacacctcggaaaatgcaacatagccggatggatactgggaaacccagaatgtgaatcactttcaacagcaagttcatggagttatatcgtagagacaagttcaagcgacaacggaacctgctacccaggcgacttcatagactacgaagaactccgcgaacaactatcatccgtaagtagctttgaaagatttgaaatttttccaaatacttcatcatggccaaaccatgatagtaacaaaggagtaactgcagcatgcccacatgcaggagcaaaatcattctacaaaaaccttatatggctagtcaaaaaaggtaactcataccctaaactatcaaaaagctacataaacgacaaaggaaaagaagtattagtattatggggaatccaccacccatcaacatcagccgaccaacaatcactctatcaaaatgcagatgcctacgtatttgtaggaacatcaagatacagcaaaaaattcaaaccagaaatagccattagaccaaaagtaagagatcaagaaggaagaatgaattactactggacattagtagaacccggtgacaaaataacattcgaagctactggaaacctagtagttccccgctatgcattcgcaatggaaagagacgcaggttcagggataataataagtgacaccccagttcacgattgtaacacaacatgccaaacccccaaaggagcaataaacacaagtctaccattccaaaacatacacccaataacaataggaaaatgtccaaaatacgtaaaatcaaccaaattacgactagcaacaggcctaagaaatgtaccatcaatacaatcaagaggactattcggagcgatcgcaggatttatcgaaggaggatggacaggaatggtagatggatggtacggctaccatcaccaaaacgaacaaggctcaggttacgctgcagacttaaaatcaacacaaaacgcaatagatgaaataacaaacaaagtaaactccgtaattgaaaaaatgaatacacaatttacagctgtaggaaaagaattcaaccacctcgaaaaacgcattgagaacctaaataaaaaaatagacgacggattcctagatatatggacatacaatgcagagctactagtactcctagaaaatgaaagaacactagactatcatgattccaacgtaaaaaacttatacgaaaaagtaagaagccaactgaaaaataatgcaaaagaaataggaaatggatgctttgaattctaccataaatgcgacaacacatgcatggaatcagtaaaaaacggaacatacgattatcccaaatatagcgaagaagcaaaactcaaccgagaagaaatagacggcgtaaaattagaatcaacaagaatatatcaaatattagcaatctactcaacagtagcatcttcattagtattagtagtatcattaggtgcc

SEQ ID NO: 51217 - RNA, 1593 nt, synthetic construct
  misc_feature 1..1593: note = derived and/or modified sequence opt6 from anti-influenza_Chain
  source 1..1593: mol_type = other RNA
accctatgcatcggataccacgctaacaattccacagatacagtcgacacagtactagaaaaaaacgtaacagtcacccacagcgtaaacctactagaagacaaacataatggcaaactatgtaaattacgaggagtagcaccactacacctaggaaaatgtaacatcgcaggctggatactaggaaatccagaatgcgagtcactaagcacagcctcatcatggtcatacatagtagaaacatcatcatctgataatggaacatgttaccccggagacttcatagactatgaagaactaagagaacaactaagcagcgtcagctcattcgaacgattcgaaatatttcccaaaacatcctcttggccaaaccacgatagtaataaaggagtaacagcagcttgtccacacgctggagcaaaatcattttataaaaacctaatatggttagtaaaaaaaggaaatagttatccaaaactaagcaaatcatacataaacgacaaaggtaaagaagtattagtactatggggtatccatcacccaagcacaagcgcagaccaacaatcactctatcaaaatgcagacgcatacgtatttgtcggaacctcaagatacagcaaaaaattcggaccagaaatagcaataagaccaaaagtaagagaccaagaaggaagaatgaactattactggacactagtagaaccaggcgacaaaataacattcgaagcaacaggaaatctagtagtaccaagatatgcattcgcaatggaacgtgatgcaggaagtggaataattatatccgacactccagtacacgactgtaacaccacatgccaaacaccaaaaggagcaataaatacaagtctaccattccaaaatatacatcccataacaataggcaaatgcccaaaatacgtcaaaagcacaaaactaagacttgcaacaggcttaagaaatgtaccaagcatacagagccgaggactatttggagcaatcgcaggattcatagaaggaggatggacaggcatggttgatggttggtatggatatcaccatcaaaatgaacaaggatcaggatatgcggcagatctaaaatcaacacaaaacgcaatagatgaaataacaaacaaagtaaacagtgtaatcgaaaaaatgaacactcaattcaccgcagtcggaaaagaatttaaccacctggaaaaaagaatagaaaatcttaataaaaagatagacgatggatttctagacatatggacatacaacgccgaactgctagtactcttggaaaacgaacgaacattagactaccacgactcaaatgtaaaaaatctttatgaaaaagtacgatcacaattaaaaaacaatgcaaaagaaataggcaacggctgcttcgaattctaccacaagtgcgataacacttgtatggaaagcgtaaaaaacggaacctatgattatccaaaatacagtgaagaagcaaaattaaaccgagaagaaatagacggagtaaaactagaatcaacacgaatataccaaatattagcaatctactctacagttgcatcatcattagtactagtagtatcattaggagcg

SEQ ID NO: 51218 - RNA, 1605 nt, synthetic construct
  misc_feature 1..1605: note = derived and/or modified sequence opt6 from anti-influenza_Chain
  source 1..1605: mol_type = other RNA
gcaaacgcggacacattatgtataggatatcatgcaaacaattcaacagatacagtagacacagtattagaaaaaaacgtgaccgtcacacacagtgtaaatctacttgaagacaaacataacggaaaattatgtaaactaagaggagttgcaccactacacttaggaaaatgtaacatagcaggatggatactaggaaacccagaatgtgaatcactctcaacagcatcatcatggtcatacatagtagaaacttcttcatcagacaacggaacatgctacccaggagactttattgattacgaagaactaagagaacaattaagctcagtgtcatcattcgaacgattcgaaatcttcccaaaaacctcatcatggccagaccacgattcaaacaaaggtgttacagccgcatgcccgcatgcaggagccaaaagtttttacaaaaacttaatttggctagtaaaaaaaggaaattcatacccaaaactttctaaatcatacataaacgataaaggaaaagaagttcttgtactttggggcatacatcacccctcaacaagtgcagatcaacaatcattataccaaaacgcagacgcatacgtttttgtaggaacaagtagatacagtaaaaaatttaaacctgaaatagctattcgaccaaaagtccgagaccaagaaggcagaatgaactactactggacactagttgaacccggtgacaaaataacattcgaagcaacaggaaatttagttgtaccaagatatgcattcgctatggaaagaaatgcaggaagcggaataataatctcagacacaccagtacatgactgcaacacaacttgccaaacaccaaaaggagctatcaacacatcactaccatttcaaaatatacacccgataacaattggaaaatgtccaaaatatgtaaaatcaacaaaattaagactagcaacaggactaagaaatgtaccaagcatacaaagtagaggcttatttggagccatagctggattcatagaaggaggatggacaggaatggtagacggctggtacggataccaccaccaaaatgaacaaggatcaggatacgcagcagatctaaaaagcacccaaaacgcaatagacaaaataacaaataaagtaaattccgtcatagaaaaaatgaacacacaattcacagcagtaggaaaagaattcaaccatctcgaaaaaagaatagaaaatctaaacaaaaaagtagacgacggattcttagacatatggacatataacgcagaactactagtattactagaaaacgaaagaacactcgactaccatgactcaaacgtaaaaaacctatatgaaaaagtaagatcacaactaaaaaacaacgcaaaagaaatcggaaatggatgcttcgaattctaccataaatgtgacaacacatgcatggaaagcgtaaaaaatggcacatatgactaccccaaatacagtgaagaagcaaaactaaatcgagaagaaatagacggtgtaaaactagaaagtacaagaatctatcaaatactagcgatatactcaactgtagcatcaagcctagtactagtagtaagtttaggagca

SEQ ID NO: 51219 - RNA, 1605 nt, synthetic construct
  misc_feature 1..1605: note = derived and/or modified sequence opt6 from anti-influenza_Chain
  source 1..1605: mol_type = other RNA
gcgaatgcagatacactctgcataggataccacgcaaacaactcaacagacacagtagacactgtactcgaaaaaaacgtaacagtaactcacagcgtaaatttactagaagacaaacataacggaaaattatgcaaacttagaggtgttgccccattacatttaggaaaatgcaacatagcaggatggatactaggcaacccagaatgcgaatcattatcaacagcatccagttggagctatatagtagaaacatcatcatcagacaacggaacctgctatccaggggattttatagattacgaagaactaagagaacaactatcaagcgtatcatcattcgaacgatttgaaatatttccaaaaacaagttcatggccaaaccacgactcaaataaaggtgtaacagcagcatgcccacgagccggagccaaaggcttctataaaaatctaatatggctagtaaaaaaaggaaacagctaccccaaactaaacaaatcatacataaatgataaaggaaaagaagtactagtattatggggaatacaccacccatcaacaaccgcagaccaacaaagcttataccaaaacgcagacacatacgtctttgtcggtacaagtagatattccaaaaaattcaaaccagaaatagaaataagaccaaaagtaagagaccaagaagggcgaatgaattactactggaccttagtagaaccaggagacaaaataacattcgaagcaacaggaaatctcgtagtaccacgctacgcattcgctatggaacgaaatgcaggatccggtataataatatccgacacaccagtacacgattgtaatacaacatgccaaacaccaaagggtgcaataaacacatcactaccattccaaaacattcatccaataacaataggaaaatgcccaaaatatgttaaaagcacaaaattacgactagctacaggattaagaaatgttccatcaatacaatcaagaggactcttcggagcgatagcaggatttatagaaggcggatggacaggaatggttgacggatggtacggataccatcatcagaacgaacaaggaagtggatatgcagcagatttaaaaagcacacagaacgcaatagacaaaataacaaataaagtaaattcagtaatagaaaaaatgaatacccaatttacagctgtagataaagaattcaaccacctagaaaagagaatagaaaatctaaacaaaaaagtcgatgatggatttctagacatatggacatacaatgcagaattactagtactactcgaaaatgaaagaacactagattatcatgactcaaacgtcaaaaatctatatgaaaaagtaagaaatcaattaaaaaataacgcaaaagaaattggcaacggatgctttgaattctatcataaatgtgataacacatgcatggaatcagtcaaaaacggcacatacgactacccaaaatactcagaggaagccaaactaaacagagaagaaatagatggagttaaactagaaagcacaagaatataccaaatactcgccatatactctacagtcgcaagtagcttagtattagtcgtaagcttaggagca

SEQ ID NO: 51220 - RNA, 1605 nt, synthetic construct
  misc_feature 1..1605: note = derived and/or modified sequence opt6 from anti-influenza_Chain
  source 1..1605: mol_type = other RNA
gcaaacgcagacacactatgtattggataccacgcaaacaattccacagatacagtagatacagtcttagaaaaaaacgttaccgtcacacattcagtaaacttactagaagacaagcacaacggcaagctatgtaaattaagaggagtagcaccactacacttaggaaaatgtaatatagcaggatggatattaggaaacccagaatgtgaatcattaagtacagcatcaagctggtcatacattgtagaaacgtcatccagcgataacggtacttgttatccaggagattttatagactatgaagaattacgagaacaactatcaagtgtttcatcattcgaaagatttgaaatattcccgaaaacatcttcttggccagatcatgattcaaataaaggagtcacagcagcatgcccccacgcaggagccaaaagcttttacaaaaacttgatatggttagttaaaaaaggaaattcatatccaaaattaagtaaaagctacataaacgataaaggaaaggaagtacttgtactatgggggatacatcaccccagcacaagcgcagaccaacaatcattataccaaaacgcagacgcatacgttttcgtaggtacatcacgatactcaaaaaaatttaaaccagaaatagctataagaccaaaagtaagagatcaagaaggtagaatgaactactactggacattagtagaaccgggagacaaaataacctttgaagcaacaggaaacttagtagttccacgatatgcattcgccatggaaagaaacgcaggaagcggcataataatatcagacactccagtacacgactgcaatacaacatgtcaaacaccaaaaggagctataaacacaagtttaccatttcaaaacatacacccaataacaataggaaaatgcccaaaatacgtaaaatcaacaaaactaagattagcaaccggattaagaaacgtcccaagtatacaatcaagaggattattcggtgccatagcaggatttatagaaggaggatggactggaatggtagacggatggtacggataccatcatcaaaacgaacagggaagtggatacgccgcagacctaaaatccacacaaaatgccatagacaaaataacaaacaaagtaaatagcgtaatagaaaaaatgaacactcaattcactgcagtcggtaaagaattcaatcacttagaaaaaagaatagaaaacctaaataaaaaagtagacgacgggttcctagacatatggacatataatgccgaattactagtcttactagaaaacgaaagaacactagactatcatgactcaaacgtaaaaaacctatacgaaaaagttaggtcacaactaaaaaacaacgcaaaagaaataggtaatggatgtttcgaattttaccacaaatgtgacaatacatgcatggaatcagtaaaaaacggaacctacgactacccaaaatactctgaagaggccaaactaaaccgagaagaaatagacggagtaaaattagaatcaactagaatctaccaaatcctagcaatatactctactgtggcatcatccctagtactagtcgtaagcctaggcgca

SEQ ID NO: 51221 - RNA, 1605 nt, synthetic construct
  misc_feature 1..1605: note = derived and/or modified sequence opt6 from anti-influenza_Chain
  source 1..1605: mol_type = other RNA
gctaatgcagatacattatgtataggataccatgcaaacaactcaactgacacagtagatacagttttagaaaaaaacgtaactgtaacacacagtgtaaatctcctagaagacaaacacaacggtaaattatgtaaattaagaggagtagcacccctccacttaggtaaatgtaacatagccggatggatactaggaaatccagaatgcgaatccttaagcacagcatcatcatggagctatatagtagaaacatcatcaagcgacaatgggacatgttacccaggagattttatagattacgaagaactacgcgaacaactttcatcagtaagctcatttgaaagatttgaaatatttccaaaaacaagctcctggccaaatcacgattcaaataaaggagtaacagcagcctgcccaagagccggagcaaaaggattctacaaaaatctaatctggctagtaaaaaaaggaaactcatatccaaaactaaataaatcatacataaacgataaaggaaaagaagtcttagtattatgggggatacaccacccatcaacaacagcagaccaacaatccctatatcaaaacgcagatacatatgtattcgtaggaacttcaagatactcaaaaaaattcaaaccagagatagaaataagaccaaaagtaagagaccaagaaggaagaatgaattattactggactttagtagaaccaggagataaaataacattcgaagccacaggaaatctagtcgtcccaaggtatgcattcgcaatggaaagaaacgccggaagcggaataataataagcgacacccctgtacacgactgtaacaccacatgtcaaacacccaaaggtgcaataaacacatctttaccattccaaaatatacatccaataacaatcgggaaatgcccgaaatacgtaaaatcaactaaattaagattagcaacaggtttaagaaacgtcccatcaatacaatcaagaggactcttcggagcaatagcaggattcatagaaggaggctggactggaatggttgacggatggtacggataccatcaccaaaacgaacaaggtagcggatacgcagccgacctaaaatcaacacaaaatgccatagataaaataacaaacaaagtaaattcagtaattgaaaaaatgaacacacaattcactgccgtagacaaagaattcaaccacctagaaaaacgaatagaaaatttaaataaaaaagtagacgatggatttctagatatatggacatataacgcagaattattggtcttactagaaaacgaacgtacattagattaccacgactcaaacgtaaaaaacctatatgaaaaagtaagaaatcaactaaaaaacaacgccaaagaaataggaaacggatgcttcgaattctaccacaaatgcgataacacatgcatggaatcagttaaaaacggaacatacgactacccaaagtattcagaagaagcaaaactaaacagagaagaaatagatggagtaaagcttgaaagcacaagaatataccaaatactcgcgatatactcaaccgtcgcaagcagcctcgtactcgtagtaagccttggagca

SEQ ID NO: 51222 - RNA, 1644 nt, synthetic construct
  misc_feature 1..1644: note = derived and/or modified sequence opt6 from anti-influenza_Chain
  source 1..1644: mol_type = other RNA
caaaaactaccaggaaatgataacagtactgctacattatgtttaggacatcatgctgtaccaaatggaacaatagtaaaaacaataaccaatgaccaaatagaagtaacaaacgccacagaactagtgcaatcatcaagcacaggtgaaatatgtgattcaccacatcaaatcctcgatggcgaaaactgcaccctaatagacgccctattaggagacccacaatgcgacggatttcaaaataaaaaatgggatctattcgtagaaagatccaaagcctattcaaactgctacccatatgacgtacctgattatgcatcactaagatcacttgtcgcaagctccggaaccctagaattcaacaatgaaagcttcaattggaccggagtaacacaaaacggaacatcaagcgcatgcataagaagatcaaacaactcatttttttcaagattaaattggctaacacacctaaaattcaaatatccagcacttaatgtaaccatgcccaacaacgaaaaatttgacaaattatacatttggggagtccaccacccaggaacagacaacgaccaaatcttcccatatgcacaggcatctgggcgaatcactgtatctacaaaaagatcacagcaaaccgtaataccaaacataggatccagaccaagagtcagaaacataccatccagaataagcatatactggacaatagtcaaaccgggagacatactactaataaacagcaccggaaatttaattgcaccaagaggctacttcaaaataagaagcggaaaatcatcaattatgcgatcagacgcccctatcggaaaatgcaactctgaatgcataacaccaaacggaagtataccaaatgacaaaccattccaaaatgtaaacagaattacctacggagcatgcccaagatacgtaaaacagaatacactaaaattagcaacaggcatgagaaatgtaccagaaaaacaaacaagaggaatattcggcgctatagcaggattcatagaaaatggatgggaaggaatggtagatgggtggtacggcttcagacaccaaaacagtgaaggaataggacaagcagcagatctaaaatcaacccaagccgccatagaccaaataaatggaaaactaaatagactgataggtaaaacaaacgaaaaattccaccaaatagaaaaagaattctcagaggtagaaggcagaatacaagacctagaaaaatacgtagaagacaccaaaatagacctatggagctataacgctgaattactagtagcattagaaaatcaacacaccatcgatttaaccgacagcgaaatgaacaaactattcgaaaaaacaaaaaaacaattaagagaaaatgcagaagacatgggaaacggttgtttcaaaatttaccacaaatgcgacaatgcatgtataggaagtatcagaaacggcacatatgaccacgatgtatatcgagacgaagcactaaacaacagattccaaataaagggagtagagctaaaatcaggatataaagactggatattatggataagctttgccataagctgtttcttactatgcgtagcattacttggattcataatgtgggcatgccaaaaaggcaacataagatgtaacata

SEQ ID NO: 51223 - RNA, 1644 nt, synthetic construct
  misc_feature 1..1644: note = derived and/or modified sequence opt6 from anti-influenza_Chain
  source 1..1644: mol_type = other RNA
caaaaactaccaggaaacgataactcaaccgcaacactatgcctcggacatcacgcagtacccaatggaacaatagtaaaaacaataacaaacgatcaaatagaagtaaccaatgccacagaactagtacaatcatcatctacaggagaaatatgcgattcacctcaccaaattcttgatggtgaaaattgtacattaatcgacgcactattaggagaccctcaatgcgacggctttcaaaacaaaaaatgggacctatttgtagaaagaagcaaagcatatagcaactgttacccatacgatgtaccagactacgcatccctaagatcattagtagcatcaagcgggacactagaattcaataacgaatcctttaactggacaggcgtaacacaaaatggaacctcatcagcttgtataaggagatcaaacaactcgttcttttcaagattaaactggttaacccatctaaaattcaaatatccagcattaaatgtaacaatgccaaacaacgaaaaatttgacaaattatacatctggggagtacatcaccccgggaccgacaacgaccaaatattcccttatgcacaagcaagtggtagaataaccgtttcaacaaaaagatcccaacaaacagttataccaaacataggatctcggccaagagtaagaaatatcccttcaagaataagtatatactggacaatagtaaaaccaggagatatactattaataaactcaaccggaaacctaatagctccacgaggttactttaaaataagaagtggtaaaagctcaatcatgcgatcagacgcacctataggaaaatgtaactcagaatgcataacaccaaatggcagcataccaaatgacaaaccattccaaaacgtaaatagaataacgtacggcgcatgcccaagatacgtgaaacaaaacaccttaaaattagcaacaggcatgcgaaatgtaccagaaaaacaaacacgaggaatatttggagcaatcgcaggattcatagaaaatggttgggaaggaatggtagatggatggtatggatttagacaccaaaactcagaagggataggacaagcagccgacttaaaatcaacgcaagctgccatagatcaaatcaacggcaaattaaacagactaataggaaaaacaaacgaaaaattccaccaaatcgaaaaggaattcagcgaagtcgaaggaagaatccaagatctagaaaaatacgtagaagacacgaaaatagacctatggagttacaacgcagaattattagttgcattagaaaatcaacacacaattgatctaactgatagtgaaatgaacaaattatttgaaaaaacaaaaaaacaattacgagaaaacgcagaagacatgggcaacggctgcttcaaaatatatcataaatgtgacaacgcatgcataggatcaataagaaacggaacatacgatcacgacgtatatagagatgaagcattaaataacagattccaaataaaaggcgtagaactaaaatcgggatacaaagattggattctatggatatctttcgcaatcagctgctttttactatgtgtagcattactaggtttcataatgtgggcatgtcaaaaaggaaacataagatgtaatata

SEQ ID NO: 51224 - RNA, 1647 nt, synthetic construct
  misc_feature 1..1647: note = derived and/or modified sequence opt6 from anti-influenza_Chain
  source 1..1647: mol_type = other RNA
atgttaacatttcatagaataataagaaaaggttggatgtttttattagcattcctattaactgcacttttattttgcccaacaggccaaccagcaaaagcagcagcaccatttaatggaacaatgatgcaatatttcgaatggtacttaccagacgatgggacactgtggacaaaagtagcaaatgaagcaaataatctatcatcattaggaataacagcactatggttacctccagcatataagggaacttcaagaagtgatgtcggatatggagtatatgatttatatgatttaggagaatttaatcaaaaaggggccgtccgtacaaaatatggcacaaaagcacaatatttacaagcaatacaagcggcacatgcagcaggaatgcaagtctatgcagatgtagtttttgatcataaaggaggagcagatggtaccgaatgggtagatgcagtcgaagtaaatccaagcgatagaaaccaagaaatatcaggaacatatcaaatccaagcatggacaaaattcgattttccaggaagaggaaatacttatagtagtttcaaatggagatggtatcattttgatggagttgattgggacgaaagtcgaaaattaagtagaatatataaatttagaggaattggaaaagcatgggattgggaagtagatacagaaaacggtaattacgactatttaatgtatgcagatctagatatggatcaccctgaagttgtaacagaattaaaatcttggggaaaatggtatgtaaacaccacaaacatagatggatttagactagacgccgtaaaacatataaaatttagcttctttcccgattggcttagtgatgtaagatcacaaacaggaaaaccactttttacagtaggagaatattggtcatatgacataaataaattacataattatataatgaaaacaaacggtacaatgagtctctttgatgctcctcttcacaataaattttatacagcaagcaaaagtggaggaacatttgatatgagaacattaatgaccaatacattaatgaaagatcaaccaacactagcggtaacatttgttgataatcatgacacagaaccaggccaagcattacaatcatgggtagatccatggtttaaaccattagcatatgcatttatactaacaagacaagaaggatatccctgtgtattttatggagattactacggaataccccaatataatataccatctttaaaaagtaagatagacccattactaattgcacgaagggattacgcgtatggaacccaacatgattatctagatcattcagatataataggttggacacgtgaaggcgtaacagaaaaaccaggaagtggacttgctgcactaataactgacggaccaggtggttcaaaatggatgtatgtaggaaaacaacatgcaggaaaagtattttatgatttaacaggaaatagaagtgacacagttacaataaattcagatggatggggagaatttaaagtaaacggaggtagcgtatctgtatgggtcccaagaaaaactacagtaagtactatagcatggtcgattacaacaagaccatggaccgatgaatttgtaagatggacagaacctagattagtagcttggcca

SEQ ID NO: 51225 - RNA, 1647 nt, synthetic construct
  misc_feature 1..1647: note = derived and/or modified sequence opt6 from anti-influenza_Chain
  source 1..1647: mol_type = other RNA
atctgcataggctatcatgccaataactcaacagaacaagtagatacaataatggaaaaaaacgtaacagtaacacacgcacaagacatattagaaaaaacacacaatggcaaactctgcgatctcgacggagttaaacctctcatattacgagactgctccgtagcaggatggttactaggaaacccaatgtgcgatgaatttatcaatgtacctgaatggtcatacatagtcgaaaaagctaatcccgcaaacgacctatgctacccaggaaacttcaatgactacgaagaactaaaacacctgctatcacgaataaaccatttcgaaaaaatacaaatcattccaaaatcctcatggtctgaccacgaagcatcatcaggtgtttcctcagcatgcccataccaaggaactccaagtttttttagaaacgtcgtctggttaatcaaaaaaaacaacacataccccacaataaaaagatcctataataacacaaaccaagaagatcttttaatcttatggggaatacatcattccaacgatgcagcagaacaaacaaaactataccaaaacccaacaacatacattagcgtaggcacatctacacttaaccaaagactagtaccaaaaatagcaacaagaagcaaagtaaacggccaaaacggacgaatggatttcttctggacaatactaaaaccaaacgacgccataaactttgaatccaacggaaacttcatagcaccagaatacgcatacaaaattgtaaaaaaaggagactccgcaatagtaaaaagcgaagtagaatacggaaactgtaataccaagtgccaaacaccaataggagcaataaactcatcaatgccattccacaatattcacccactaacaattggagaatgcccaaaatacgtaaaatcgaacaaactagtattagcaacaggtctaagaaactcaccactccgctcagataaaactcacacatgcccaccatgccctgctccagaactattaggaggcccatcagtattcttgttccctcctaaaccaaaagatacactcatgatatcacgtacaccagaagtaacctgtgtagtcgtagacgtatcacatgaagaccccgaagtaaaattcaactggtatgtagacggagtagaagtccacaatgccaaaacaaaaccccgagaagaacaatacaactcaacttacagggtcgtatcagtactaacagtattacaccaagactggcttaatggaaaagaatataaatgtaaagtctcaaacaaagcactcccagcaccaatagaaaaaacaatatcaaaagcaaaaggacaaccaagagaaccacaagtatatactctaccacctagtagagaagaaatgacaaaaaatcaagtatcactaacatgcctagttaaaggattctacccatcagatatagcagtcgaatgggaatccaacggacaacccgaaaataattacaaaaccactccaccagtactagattctgacggatctttctttctatattcaaaattaactgtcgacaaatctagatggcaacaaggaaacgtattttcttgctccgtcatgcacgaagcactacataatcactacacccaaaaatcactttccttatcaccaggaaaa

SEQ ID NO: 51226 - RNA, 1647 nt, synthetic construct
  misc_feature 1..1647: note = derived and/or modified sequence opt6 from anti-influenza_Chain
  source 1..1647: mol_type = other RNA
atatgcataggatatcacgcaaataatagcactgaacaagtagacactatcatggaaaaaaatgtaacggttacacacgcacaagacatcctagaaaaaacccataatggaaagctttgcgatctagacggagtaaaaccactaatattaagagattgttctgtagcaggatggttattaggcaaccccatgtgtgacgaatttatcaacgtacctgaatggtcctacatagtagaaaaagcaaacccagcaaacgatctctgctatccaggcaacttcaacgactacgaagaattaaaacatttactttcacgaataaaccattttgaaaaaatccaaataataccaaaatcctcatggtcagaccacgaagcatcatcaggcgtatcatcagcctgcccatatcaaggtacaccttcctttttcagaaacgtagtatggctaatcaaaaaaaacaatacataccctacaataaaaagatcatacaataacactaatcaagaagacctattaatattgtggggaatacatcattctaacgacgcagcagaacaaacaaaactctatcaaaacccaacaacatacatatcagtaggcacatcaacattaaaccaaagattagtcccaaaaatagccacaagatcaaaagtaaatggacaaaacggtagaatggatttcttttggacaatattaaaacccaacgacgcaataaacttcgaaagcaacggcaactttatagcaccagaatacgcatacaaaatagttaaaaaaggagattccgcaatagtaaaatctgaagttgaatacggaaactgcaacactaaatgccaaaccccaatcggagcaataaattcatcaatgccatttcataacatccaccctctcaccataggagaatgcccaaaatacgtaaaatcgaacaaactagtactagccacaggactacgcaatagccccctccgctctgacaaaacacatacatgcccaccatgcccggcaccagaacttttaggaggaccctcagtgttcttatttcctccaaaaccaaaagacacattaatgatatccagaacacccgaagtaacatgtgtagttgtagatgtctcacacgaagatccggaagtaaaattcaattggtatgtcgacggagttgaagttcataacgcaaaaactaaaccacgagaagaacaatataattccacttacagagtagtatcagtattaacagtattacatcaagattggctaaatggaaaagaatataaatgcaaagtcagcaacaaagctcttccagcaccaatcgaaaaaacaataagcaaagcaaaaggtcaaccaagagaacctcaagtatacacactaccaccatcccgcgaagaaatgactaaaaaccaagtaagcctaacatgcttagtaaaaggcttttacccatcagacatagcagtagaatgggaatcaaacggacaaccagaaaacaactataaaacaacaccacccgtactagactccgatggaagttttttcctatactcaaaactaaccgtagacaaatcccgatggcaacaaggaaacgtattctcctgctccgtaatgcatgaagcactccacaaccattatacacaaaaatcactatcactctcaccaggcaag

SEQ ID NO: 51227 - RNA, 1647 nt, synthetic construct
  misc_feature 1..1647: note = derived and/or modified sequence opt6 from anti-influenza_Chain
  source 1..1647: mol_type = other RNA
atgctaacttttcatagaattataagaaaaggatggatgtttctactagcatttttattaacagcactattattttgtcccacaggacaaccagcaaaagcagcagcgccattcaatggaacaatgatgcaatatttcgaatggtatttaccagatgatggtacactatggacaaaagtagcaaatgaagcaaataatttaagcagtctaggtataactgcactatggttaccaccagcatataaaggtacaagcagatcagatgttggttatggcgtctatgatttatatgatttaggagaatttaatcaaaaaggagcagttagaacaaaatacggaacaaaagcacaatatctacaagcaatacaagcagcacacgcagcaggaatgcaagtatatgcagacgtagtattcgatcataaagggggagcagatgggacagaatgggtcgatgcagtagaagttaatccatcagacagaaatcaagaaataagcggaacataccaaatacaagcctggactaaatttgattttccaggacgaggaaacacatattcatcatttaaatggagatggtatcatttcgatggagtagattgggacgaatcaagaaagttaagcagaatttataaatttagaggtataggaaaagcatgggattgggaagttgatacagaaaatggaaattatgactacctcatgtatgcagatttagatatggatcatcctgaagtagtcactgaattaaaaagttggggaaaatggtatgtaaacaccacaaacatagatggatttagactagatgcagtaaagcatataaaattttcattctttccagattggctaagtgatgtaagatctcaaactggaaaacccttatttacagtaggggaatattggagctatgatataaataaattacacaattatataatgaaaacaaatggaaccatgtcactatttgacgcaccactgcacaataaattttataccgcaagtaaatcaggaggtacgtttgatatgagaacactaatgacaaacacattaatgaaagatcaaccaacacttgcagtaacatttgtagataatcatgacacagaaccaggccaagccttacaatcatgggtagatccatggtttaaaccattagcctatgcatttatacttaccaggcaagaaggttatccttgtgtattttatggtgattattatggaataccccagtataatataccctcattaaaaagcaaaatagaccccttactaattgcaagaagagattatgcatacggtacacaacatgactacttagaccattcagacataataggttggacaagagaaggtgtaacagaaaaaccaggatcaggactagcagcactaataacagatggcccaggaggaagcaaatggatgtacgtaggaaaacaacatgcaggaaaagtattttatgatttaacaggaaatagatccgatacagtaacaataaatagtgatggatggggagaatttaaggtaaatggaggatcagtatcagtttgggtaccaagaaaaactacagttagtacaatagcatggagcataacaacaagaccatggacagacgaatttgtacgatggacagaacctagattagttgcatggcca

SEQ ID NO: 51228 - RNA, 1650 nt, synthetic construct
  misc_feature 1..1650: note = derived and/or modified sequence opt6 from anti-influenza_Chain
  source 1..1650: mol_type = other RNA
gaccaaatatgcatcggctatcatgcaaataacagtaccgaacaagtagacacaataatggaaaaaaacgtaacagtaacacacgcacaagacatactagaaaaaacccacaacggaaaattatgcgacttagatggagtaaaaccactaatattaagagactgttcagtcgcaggctggttactaggtaatccaatgtgtgacgaatttatcaacgtacctgaatggtcatacattgtagaaaaagctaatccaaccaatgacctatgctacccaggcagttttaatgattacgaagaactaaaacatctactaagccgaataaatcactttgaaaaaatccaaataatcccaaaatcatcatggagtgaccacgaagcatcatcaggagtaagcagcgcatgcccctacctaggatcaccatcattcttcagaaatgtagtatggttaataaaaaaaaattccacatacccaacgataaaaaaaagctataataacacgaaccaagaagacctgctagtactatggggaatacatcaccccaacgatgcagcagaacaaaccagactataccaaaatccaaccacgtatataagcatcggaacgtcaacactcaaccaaagactagtaccaaaaatagcaacaagatcaaaagtaaatggccaatctggaagaatggaatttttttgggcaatattaaaaccaaatgatgcaataaacttcgaatccaatggtaactttatagccccagaatatgcatacaaaatcgtaaaaaaaggagactcagcaataatgaaatcagaattagaatacggaaactgcaacacaaaatgtcaaactccaatgggggcaataaattcaagtatgccctttcacaacattcacccattaacaataggcgaatgcccaaaatatgtaaagtcaaacagactagtccttgccacaggactccgcaattcaccacaaagagaaagccgaagaaaaaaaaggggcctattcggcgccatcgcaggctttatagaaggaggatggcaaggtatggtagatggctggtatggataccaccatagcaatgaacaaggatcaggctatgctgcagacaaagaaagcacacaaaaagcaataggagtaacaaataaagtcaacagtataatagataaaatgaatacacaattcgaagccgtaggaagagaatttaacaacctcgaaagacgaatagaaaacctaaataaaaaaatggaagatggctttctagacgtatggacatacaacgcagaattactagtattaatggaaaacgaaagaacattagatttccacgacagtaacgtaaaaaatctatacgacaaagtaagactacaactacgagataacgcaaaagaattaggaaatggatgttttgaattttatcataaatgcgacaacgagtgcatggaatccataagaaacggcacctataacccacaatactcagaagaagcaagactaaaacgagaagaaatatccggagtaaaactggaaagcataggaacataccaaatcttatccatatactctacagttgcatcatcactagcactagcaataatgatcgcaggcttatcactatggatgtgctcaaacggatccttacaatgtagaatctgtatc

SEQ ID NO: 51229 - RNA, 1650 nt, synthetic construct
  misc_feature 1..1650: note = derived and/or modified sequence opt6 from anti-influenza_Chain
  source 1..1650: mol_type = other RNA
gatcaaatatgcataggctaccatgccaacaactcaacagaacaagtagacacaataatggaaaaaaatgtaacagtaacacacgcacaagacatattagaaaaaacacacaacggcaaactatgcgacctagatggagtaaaaccactaatcctacgagactgctcagtagccggttggctattaggcaatccaatgtgcgacgaattcataaacgtaccagaatggtcttacatagtagaaaaagcaaatccaacaaatgacttatgctatccaggctcattcaacgactacgaagaacttaaacatttactaagtagaataaatcatttcgaaaaaattcaaatcataccaaaatcatcctggtcagatcacgaagcatcatccggagtttcttcagcatgcccatacttaggaagtccatcattctttagaaatgtagtatggctcataaaaaaaaattcaacttatccaactataaaaaaatcatacaataacacaaatcaagaagatttattagtactgtggggaatacatcacccaaacgatgcagcagaacaaacacgattatatcaaaatccaacaacatacataagcataggaacaagcacactaaaccaaagattagtaccaaaaatagcaactcgatcaaaagtaaatggacaatcaggaagaatggaatttttctgggcaatactaaaacctaacgacgctatcaacttcgaaagcaacggaaattttatagcaccagaatatgcttataaaatagtaaaaaaaggtgactccgcaataatgaaatcagaactagaatacggaaattgtaacacaaaatgccaaacaccaatgggcgcaatcaattcatcaatgccattccacaatatacaccctctaacaataggcgaatgcccaaaatacgtaaaaagtaacagactagttctagctacgggattaagaaacagccctcaaagagaatcacgacgaaaaaaaagaggccttttcggtgcaatagcaggtttcatagaagggggttggcaaggtatggtcgatgggtggtacggataccatcactccaacgaacaaggaagcggatacgccgcagacaaagaaagcacacaaaaagcaataggagtcacaaataaagtaaacagcataattgataaaatgaacacacaattcgaagcagtaggaagggaatttaacaacctagaaagaaggattgaaaacctaaataaaaaaatggaagacggattcctagatgtctggacctacaacgcagaactactagtattaatggaaaatgaacgaacattagactttcatgattcaaacgttaaaaatttatacgataaagttcgcctacaattacgagacaatgcaaaagaattaggaaatggatgctttgaattctaccacaaatgcgataacgaatgcatggaaagcataagaaacggaacatacaacccacaatactcagaggaagcaagacttaaaagagaagaaataagtggcgtaaaactagaatcaatcggaacatatcaaatattatcgatatactcaaccgtagcatcatccttagcattagcaataatgatcgcaggattatcactgtggatgtgttctaacggttcactacaatgtagaatatgtata

SEQ ID NO: 51230 - RNA, 1656 nt, synthetic construct
  misc_feature 1..1656: note = derived and/or modified sequence opt6 from anti-influenza_Chain
  source 1..1656: mol_type = other RNA
atgaacatacaaatacttgcattcatagcatgtgtattaacaggagcaaaaggagacaaaatatgcttaggacatcacgccgttgcaaatggaacaaaagtaaacacattaactgaaaaaggaattgaagtagtcaacgcaacagaaacagtcgaaacagcagacgtaaagaaaatatgtacacaaggcaaaagagcaacagacttaggaagatgtggactactcgggacattaatagggccaccacaatgcgaccaattcttagaattttcaagtgacctaattatagaacgcagagaaggaacagatgtttgctatccaggcagatttactaacgaagaatcactaagacaaatactaaggagatcaggaggaatcggaaaagaaagtatgggatttacatattcaggaatacgaacaaacggcgccgccagtgcatgtactcgatctggatcatcattttacgcagaaatgaaatggctactaagcaactcagataattcagcatttccacaaatgaccaaagcctacagaaatccaagaaacaaaccagcattaataatatggggagtacatcattccgaatcagcaagcgaacaaacaaaattatacggatcaggaaataaattaataacagtaagatcaagtaaatatcaacaatcattcacaccatctccaggcacaagaagaatcgacttccactggttactactcgacccaaacgacacagtgacattcacattcaatggcgcattcatagcaccagacagagcgtcattcttcagaggagaatcacttggagtacaatcagacgcaccattagactcatcatgtcgaggagactgttttcattcaggtggcacaattgtaagttcgttaccttttcaaaacataaactccagaacagtaggaagatgtccacgatatgtaaaacaaaaatcactattattagctacaggaatgcgaaacgttccagaaaaaccaaaaccaagaggattatttggagcaatagcaggattcatagaaaatggttgggagggactaataaatggctggtatggatttagacaccaaaacgcccaaggcgaaggaaccgcagcagactacaaaagtacacaatcagcaatagaccaaataacaggaaaactaaacagactgataggaaaaaccaatcaacaattcgaattaatagacaacgagtttaatgaaatagaacaacaaataggcaacgtaataaactggaccagagacgcaatgacagaaatctggtcttacaacgcagaactattagttgctatggaaaatcaacacacaatcgacctcgccgattcagaaatgtcaaaactatacgaaagagtcaagaaacaactaagggaaaacgcagaagaagacggaacaggatgctttgaaatattccataaatgtgacgatcaatgtatggaatcaataagaaataacacatacgatcatactcaatacagaactgaaagtttacaaaatagaatacaaatagatccagtaaaattaagcagtggatacaaagacataatactttggttttcattcggtgcgtcatgtttcatactcttagccatagcaatgggtctagtattcatatgtattaaaaacggaaatatgcaatgcacaatatgtata

SEQ ID NO: 51231 - RNA, 1656 nt, synthetic construct
  misc_feature 1..1656: note = derived and/or modified sequence opt6 from anti-influenza_Chain
  source 1..1656: mol_type = other RNA
atgaacacacaaatcttggcattcatagcatgcgtattaacaggagtaaaaggagacaaaatatgtctaggtcaccacgcagtagcaaacgggaccaaagtaaacaccttaacagaaaaaggaatagaagtagtaaacgcaacagaaacagtcgaaacagcagatgtcaagaaaatctgcacacaaggcaaaagagcaaccgacttaggcagatgcggcctattaggaacactaataggaccaccacaatgcgaccaatttcttgaattttcatcagatcttatcatcgaaagaagagaaggcacagatgtttgctaccctggcagatttaccaatgaagaatcacttagacagattttaagaagatcaggaggaataggaaaagaatcaatgggattcacatattcaggaataagaacaaatggagcaacgtcagcctgcacaaggtcaggatcaagcttctatgccgaaatgaaatggttattatcaaacagcgacaactccgcatttccgcaaatgaccaaagcctacagaaacccaagaaataaaccagctttaataatatggggagtacaccattcagaatcagttagcgaacaaacaaaactatacggatccggaaacaaactaataacagtaagatcaagtaaatatcaacaatcatttacaccatcaccaggagcccgaagaatagatttccattggttattactcgacccaaatgacaccgtaacattcacatttaacggagcattcatagccccagatagagcatcattctttagaggagaatcactaggagtacaaagtgatgtaccactagactcatcctgtagaggtgattgctttcattcaggaggaacaatagtgtcaagtctaccattccaaaacatcaattcaagaaccgtaggtaaatgcccaagatacgtaaaacaaaaatcattattattagcaacaggaatgagaaatgtaccagaaaaacctaaacccagaggactcttcggagcaatagcaggcttcatagaaaatggatgggaaggcttaataaatggatggtatggatttagacaccaaaatgcacaaggagaaggaactgcagccgattataaatcaacacaatctgctatcgatcaaatcactggaaaactaaacagactaataggaaaaactaaccaacaattcgaattaatagacaacgaatttaatgaaatagaacaacaaatcggaaatgtaataaactggacaagagacgcaatgaccgaaatctggtcatataatgcagaactactcgtagccatggaaaatcaacatacaatagacctagcagacagcgaaatgtcaaaactttatgaaagagtaaaaaaacaattaagagaaaacgcagaagaagatggaacaggatgttttgaaatattccataaatgtgacgaccaatgcatggaatcaataagaaacaacacttacgatcacacacaatatagaacagaatcattgcaaaacagaatccaaattgaccccgtcaaactatcaagtggatacaaagacataatactctggttttcatttggtgccagttgcttcctacttttagcaatagccatgggactagtatttatatgcataaaaaacggcaatatgcaatgcacaatctgcata

SEQ ID NO: 51232 - RNA, 1656 nt, synthetic construct
  misc_feature 1..1656: note = derived and/or modified sequence opt6 from anti-influenza_Chain
  source 1..1656: mol_type = other RNA
atgaatatacaaatattagcatttatagcctgtgtactcacaggagcaaaaggagacaaaatctgcttaggacatcacgcagtagcaaacggaaccaaagttaatacattaactgaaaaaggaattgaagtagtaaacgcaaccgagactgtagaaacagcaaacataaaaaaaatatgcacacaaggaaaaagaccaacagacttaggacaatgtggactattaggcaccctaataggccctccacagtgcgatcaattcctagaattctcgtcagatctaataattgaaagaagagaaggaaccgacgtatgctaccccggaaaattcacaaatgaggaaagtttaaggcaaattctaagaagatcaggaggaataggaaaagaaagcatgggatttacatatagcggtataagaaccaatggagcaacgtcagcatgtacaagaagcggaagcagcttctacgcagaaatgaaatggttactaagtaactcagacaacgcagcatttccacaaatgaccaaaagctatcgaaatccaagaaacaaaccagcactaataatatggggagtacatcatagtgaaagcgtatcagaacaaacaaaattatacggatcaggaaacaaactaataaaagtacgatcatcgaagtaccaacaatcatttacaccaaatccaggcgccagaagaattgactttcattggttactattagatccaaacgatacagtgacatttaccttcaatggagcatttatagcaccagacagagcatcattttttagaggagaaagcataggagttcaatcagatgcaccgctagatagcagttgcggaggaaattgttttcacaacggcggaacaatagtatcaagtctcccatttcagaacattaatccacgaacagtaggaaaatgtccaagatacgtgaaacaaaaaagtcttctattagcaacaggaatgagaaacgtgccagaaaaacccaaaaaaagaggattattcggagcaatagcaggattcatagaaaatggatgggagggattaattaacggttggtatggctttagacaccaaaacgcacaaggcgaaggcaccgcagcagactacaaaagcactcaatccgcaatagatcaaatcaccggaaaattaaacagattaataggaaaaaccaaccaacaattcgaattaataaataatgaatttaacgaggtagaacaacaaataggaaacgtaatcaattggacacaagacgcaatgactgaagtctggagttacaatgcagaattattggtagcgatggaaaaccaacatacaatagatttgacagattcagaaatgtcaaaactatacgaacgagtaagaaaacaattgagagaaaatgcagaagaagacggaaccggatgttttgaaatatttcataaatgtgacgatcattgcatggagtcaataagaaacaacacatacgatcacacccagtatagaacagaatcattacaaaacagaatacaaattgatccagtaaaactaagtggagggtataaagatataatactctggttcagcttcggagcgagctgtttccttctactagccatcgcaatgggacttgttttcatatgtataaaaaacggtaacatgcaatgcacaatatgtata

SEQ ID NO: 51233 - RNA, 1656 nt, synthetic construct
  misc_feature 1..1656: note = derived and/or modified sequence opt6 from anti-influenza_Chain
  source 1..1656: mol_type = other RNA
gaccaaatctgcattggttatcacgcaaacaattcaacagaacaagttgataccataatggaaaaaaacgtaacagtaacacatgcccaaaacatcctagaaaaaactcataatggcaaactatgtgatctagatggagtaaagccacttatactaagagactgctcagtcgcaggatggctactaggaaatcctatgtgcgatgaattcctaaatgtaccagagtggagttacatcgtagaaaaaataaaccccgcaaacgacctttgctacccaggaaacttcaacgactatgaagaactcaaacacctactgtcacgaataaaccacttcgaaaaaatccaaataataccaaaatcatcatggtcagaccatgaagcctcctcaggagtctctagcgcttgcccttaccaaggaagaagctcttttttccgaaatgtcgtatggcttataaaaaaagataacgcatacccaacaatcaaacgatcatacaataacacaaatcaagaagacttactagtcctatggggaatacaccatccaaacgatgcagcagaacaaacaagactatatcaaaacccaacaacatatataagcgtaggaacatcaacattaaaccaaagactagttccaaaaatagcaacaagaagcaaagtaaacggacaatctggaagaatggaattcttttggacaattctgaaacccaatgacgcaataaactttgaaagcaacggaaactttatagcaccagaaaacgcttataaaatagtcaaaaaaggagactcaactataatgaaatcagaactagaatacggcaactgtaacacaaaatgtcaaacaccaatcggagctattaactcctcaatgccatttcataatatccacccattaacaatcggagaatgtcctaaatacgtaaaatcaaacaaactagtcttagcaacaggactacgaaactcaccacaaggcgaaagacgaagaaaaaaaagaggattattcggagccatagcaggcttcatcgaaggtggatggcaaggaatggtagacggatggtacggctatcaccactcaaatgaacaaggatctggatatgccgcagacaaagaatctacacaaaaagccatagacggagtaacaaacaaagtaaactcaataatagacaaaatgaatacacaattcgaagcagtaggaagagaattcaacaacctagaaagacgaatagaaaacctaaacaaaaaaatggaagacggctttttagacgtatggacatataacgcagaactcttagtattaatggaaaatgaaagaacacttgacttccatgattcaaacgtaaaaaacttatacgacaaaataagactacaactgcgagataatgcaaaagaactaggaaatggatgcttcgaattctaccatagatgcgataatgaatgtatggaatctgttagaaacggaacatacgattatcctcaatactctgaagaagcaagactaaaacgagaagaaatatccggagtaaaactagaatccataggaacctaccaaatactatcaatatatagcacggtagcaagttcattaacactagcaataatggtagcgggtttatcattatggatgtgctcaaatggatcactacaatgcagaatatgcatc

SEQ ID NO: 51234 - RNA, 1656 nt, synthetic construct
  misc_feature 1..1656: note = derived and/or modified sequence opt6 from anti-influenza_Chain
  source 1..1656: mol_type = other RNA
gaccaaatatgcataggctatcatgcaaataactctacagaacaagtagatacaataatggaaaaaaacgtcacagtaacacatgcccaagacatactagaaaaaacacataacggtaaactatgcgatctagacggagtaaaaccactgatattacgagactgtagcgtagcaggatggttattaggaaatcccatgtgcgacgaatttataaacgtccctgaatggtcatatatcgtagaaaaagcaaacccaacaaacgatttatgctatccaggcagcttcaatgactacgaagaattaaaacacctactaagtagaataaaccactttgaaaaaatacaaataataccaaaatcatcatggtcagaccacgaagcctcatcaggcgtatcatcagcttgcccatacctaggatcaccatctttctttagaaacgtagtctggttaataaaaaaaaactccacatacccaacaataaaaaaatcatacaacaacacaaaccaggaagaccttttggtactctggggaatacaccatccaaatgacgcagcagaacaaacaagactatatcaaaatccaaccacatacataagcataggcacatcaacactaaaccaaagacttgtaccaaaaattgctacaagatcaaaggtaaacggacaaagcggcagaatggaatttttttggacaatactaaacccaaatgacgcaataaatttcgaaagcaacggaaacttcattgcaccagaatacgcatacaaaattgtaaaaaaaggcgactcagcaattatgaagtcagaactagaatacggaaactgtaatacgaaatgtcaaacaccaatgggagcaataaattcatcaatgccatttcataacatacatccattaacaataggagaatgcccaaaatacgtaaaatcaaatagattggtactagcaacaggcctaagaaactcaccacaaagagaaagcagaagaaaaaaaagaggactattcggagctatagcaggattcatagaaggaggatggcaaggaatggttgacggatggtacggatatcatcatagtaatgaacaaggatcaggatacgccgcagataaagaatcaacccaaaaagcaatcgatggtgtaacaaacaaagtaaatagcataatcgacaaaatgaacacacaattcgaagcagtaggtagagaattcaataatttagaaaggcgaatagaaaacttaaacaaaaaaatggaagacggatttttagacgtatggacctacaatgcagagttactagtactaatggaaaacgaaagaacattagacttccatgactcaaacgtaaaaaatttatatgacaaagtaagactccaattaagagacaacgctaaagaactaggtaatggatgttttgaattttaccacaaatgcgataacgaatgcatggaatcaataagaaatggaacatataactatccacaatactcagaagaggcaagactaaaacgagaggaaatatcaggcgtaaaactcgaatccatcggtacataccaaatcttatctatatactcaacagtagcaagcagtctggcactagcaataatgatggctggattatccctttggatgtgctcaaacggatcattacagtgtcgaatttgtata

SEQ ID NO: 51235 - RNA, 1656 nt, synthetic construct
  misc_feature 1..1656: note = derived and/or modified sequence opt6 from anti-influenza_Chain
  source 1..1656: mol_type = other RNA
atgaacattcaaatactagcatttatagcttgtgtcttaacaggggcaaagggagataaaatatgcttaggacatcatgcagtagcaaatggaacaaaagtaaatacactaactgaaaaaggaatagaagtagtaaacgcaactgaaacagtcgaaacagccgacgtaaaaaaaatatgcacccaaggtaaaagagccacagacttaggcagatgtggtttattaggcacactaataggaccaccacaatgcgatcaatttttagaattcagtagtgatttaataatagaaagacgagaagggactgatgtatgttatcccggaagatttacaaacgaagaatcactccgacaaatattaagaagatctggcggaatagggaaagaatccatgggattcacatattcagggatccgaacaaatggagccgcatcagcatgtacaagatcaggatcatcattttacgctgaaatgaaatggcttctatcaaacagcgacaatagtgcattcccgcaaatgaccaaagcatacagaaatcccagaaacaaaccagcattaataatatggggagtgcaccatagtgaatctgcatcagaacaaactaaattatacggaagcggtaataaattaatcactgtaagaagctcaaaataccaacaatcatttacaccaagcccaggaaccagaagaattgacttccattggcttctattagatccgaatgacacagtcacatttacattcaacggcgccttcatagctccagatagagcatcattctttagaggagaatcattaggagtacaatcagatgcacctttagactcatcatgtagaggagattgcttccactcaggaggaacgatagtatcaagcttaccatttcaaaatatcaattctagaacagttggaagatgcccaagatacgtaaaacaaaaaagtttactattagcaacaggaatgagaaatgtaccagaaaaaccaaaaccaagaggtctatttggagcaatagcaggatttatagaaaacggatgggaagggcttataaacggatggtatggattcagacatcaaaatgctcaaggagaaggcacagccgcagactacaaaagcacacaatcagccatagatcaaattacaggaaaactaaacaggctaataggaaaaactaatcaacaatttgaattaatagacaacgaatttaatgaaatagaacaacaaataggaaacgtaataaattggacccgagacgcaatgactgaaatatggtcatacaatgcagaattattagtcgcaatggaaaatcaacatacaatagacctagcagatagcgaaatgtcaaaattatacgaacgagtaaaaaaacaattaagggagaatgcagaagaagacggtaccggatgttttgaaatctttcataaatgcgacgatcaatgcatggaaagcataagaaataatacctacgatcacactcaatatcgtacagaatcactgcaaaaccgaatacaaatagatccagtaaaactaagctcaggatacaaagatataatactatggttttcatttggagctagttgttttatactattagccatagctatgggattagtatttatatgtataaaaaacggcaacatgcaatgtacaatatgtatt

SEQ ID NO: 51236 - RNA, 1656 nt, synthetic construct
  misc_feature 1..1656: note = derived and/or modified sequence opt6 from anti-influenza_Chain
  source 1..1656: mol_type = other RNA
atgaacacacaaatactagcattcatagcttgtgttttaacaggagtaaagggagacaaaatatgccttggacatcacgcagtcgcaaatgggacaaaagtaaatacactaaccgaaaaaggcatagaagtagttaatgcaacagaaacagtagaaacagcagatgtaaaaaaaatatgcacacaaggaaaacgagcaacagacttaggaagatgtggattactaggaacattaatagggccaccacaatgcgaccaatttctggaattttcatcagatctaataattgaaagaagggaaggaacagatgtttgctatccaggaagattcacaaatgaagaatcattaagacaaatactaagaagaagtggaggaataggaaaagaatccatgggattcacatattcaggtatacgtacaaacggagcaacaagcgcatgtacaagatccggatcatcattttatgcagaaatgaaatggctactatcaaatagtgataacagtgcattcccacaaatgacaaaagcctatagaaaccccaggaataaacctgcattaatcatatggggagtacaccatagcgaatcagtgagtgaacaaactaaattatatggtagcggaaacaaactgataacagtaagatctagtaaatatcaacaatcatttacaccatcacctggagcccgaagaatagatttccattggttattactcgacccaaacgacacagtaacattcacgtttaatggagcatttatagctccagacagagcatcgtttttcagaggtgaatcactcggagtacaatcagatgtaccactagactcaagttgcagaggagattgtttccatagcggaggaacaatagtaagttcattaccatttcaaaacataaatagtcgcacagtaggaaaatgtccaagatatgtaaaacaaaaatcactcttattagccactggaatgagaaatgttccagaaaaaccaaaaccaaggggactatttggagcaatagcaggattcatagaaaatggatgggaaggcttaataaatggttggtatggattcagacaccaaaatgctcaaggagaaggcacagcagcagactataaatcaacacaatcagcaattgatcaaataacaggaaaattaaatagactaataggtaaaactaatcaacaattcgaacttatagacaatgaatttaacgaaatcgagcaacaaataggaaatgtaattaattggacaagagatgcaatgacagaaatatggtcatataacgcagaactactagtcgcaatggaaaatcaacatacaatagacctagcagactcagaaatgagcaaattatacgaaagagttaaaaaacaattaagggaaaacgctgaagaagacggtacaggatgcttcgaaatattccataaatgtgatgatcaatgcatggaaagcatacgaaacaacacttatgatcacacacaatataggacagaatcactacaaaaccgaatacaaatagatcctgtaaaactatcaagtggatataaagacatcatattatggttttcattcggagcctcatgctttctcttactagccattgcaatgggactagtattcatctgtataaaaaatggaaatatgcaatgtacaatatgtata

SEQ ID NO: 51237 - RNA, 1656 nt, synthetic construct
  misc_feature 1..1656: note = derived and/or modified sequence opt6 from anti-influenza_Chain
  source 1..1656: mol_type = other RNA
atgaacatacaaatactagcattcatagcctgtgtattaaccggtgcaaaaggagacaaaatatgcttaggacatcacgcagtagcaaacggtacaaaagtaaatacacttacagaaaaaggaatagaagtagtaaatgcaacagaaacagttgaaacagccaatataaaaaaaatttgcacacaaggaaaaagaccaacagacttgggccagtgtggattactaggcacattaataggaccaccacaatgcgatcaattcctagaattttcaagcgacctaataatagaaagaagagagggcactgacgtctgttacccaggaaaattcacaaacgaagaatcacttcgacaaatactaagaagatcaggaggaataggaaaagaaagcatgggattcacatattccggaataagaacaaatggagctacaagtgcatgtacaagatcaggatcatcattttatgcagaaatgaaatggctactaagtaattcagacaacgcagctttcccacaaatgacaaaatcctacagaaatccaagaaacaaaccagcactgataatatggggtgtacatcattcagaaagtgtcagtgaacagactaaattatacggctcaggaaacaaattaataaaagtaagatcatcaaaataccaacaaagcttcactccaaacccgggagcaagaagaatagactttcactggctcctattagatccaaatgacacagtaactttcacattcaatggtgcatttatagcaccggatcgtgccagtttcttcagaggagaatctattggagtacaatcagatgcacccctagattcaagttgtggaggaaattgctttcataatggaggcacaatagtatcatccttaccttttcaaaatataaacccaaggaccgttggaaaatgtccaagatatgtaaaacaaaaatcactactattagcaacaggtatgagaaacgtacctgaaaaaccgaaaaaaagaggattatttggagcaatcgcaggattcatcgaaaatggttgggaaggactaataaatggatggtatggcttccgacatcaaaacgcacaaggcgaaggaaccgccgccgattataaatcaacccaatctgcaatagatcaaataactggtaaacttaacagattaataggaaaaacaaaccaacaattcgaactaattaataatgaatttaatgaagtagagcaacaaataggaaatgttattaattggactcaagatgcaatgacagaagtatggagttacaatgcagaattacttgtagcaatggaaaaccaacatactattgacctcacagactcagaaatgtcaaaattatacgaaagagtacgaaaacaattaagagaaaacgctgaagaagacggtacaggatgttttgaaatcttccacaaatgtgatgatcactgtatggaaagtatccgaaataacacatatgaccacacacaatatagaaccgaaagcctacaaaatagaatacaaatagatcccgtaaaattaagcggcggatataaagatataatattatggttcagcttcggagcttcttgctttctactacttgctatagcaatgggcttagtattcatctgtataaaaaacggaaacatgcaatgtacaatctgtata

SEQ ID NO: 51238 - RNA, 1656 nt, synthetic construct
  misc_feature 1..1656: note = derived and/or modified sequence opt6 from anti-influenza_Chain
  source 1..1656: mol_type = other RNA
gaccaaatatgcataggataccacgctaataactcaacagaacaagtagatacaataatggaaaaaaacgtcacagtaacacatgcacaaaatatactggaaaaaacacacaacggaaaactttgcgacctagacggagtaaaaccattaatactaagagactgtagcgttgcaggatggctactcggaaacccaatgtgcgatgaattcctaaacgttccagaatggagttacatcgtagaaaaaataaatccagccaatgacttatgttaccctggaaatttcaacgactatgaagaactaaaacacctactatccagaataaatcattttgaaaaaatacaaataattccaaagtcatcatggtcagaccacgaggcttcaagtggagtatcaagcgcatgcccatatcaaggaagatcaagtttctttcgcaacgtagtatggctaataaagaaagacaatgcatatccaacaataaaaagatcatataataacacaaaccaagaagacttattagtattatggggaatacaccatccaaacgatgccgccgaacaaacacgattataccaaaaccccacaacatacatatctgtaggaacgtcaacactaaaccaaagattagtcccaaaaatagccaccagatcaaaagtaaacggacaaagcggacgaatggaattcttctggacaatactaaaacctaatgatgcaataaacttcgaatcaaatggaaatttcatcgcacctgaaaatgcatacaagatcgtaaaaaaaggagactcaaccataatgaaatcagaattagaatatggaaactgtaacacaaaatgccaaacacctataggagcaataaactcctcaatgcctttccataacatacacccactaacaattggagagtgtccaaaatatgtcaaatcaaacaaactcgtactagcaacaggcctaagaaattcaccacaaggagaaagaagaagaaaaaaacgaggactattcggagcaatagcaggatttatagaaggaggctggcaaggaatggtagacggctggtacggataccaccacagcaatgaacaaggtagcggatacgcagcagacaaagaatcaacccaaaaagctatcgatggcgttactaacaaagtaaactcaataatagacaaaatgaacacccaattcgaagccgtgggaagagaatttaataacctagaaagaagaatcgaaaacttaaacaaaaaaatggaagacggatttcttgacgtttggacatataacgcagaactactcgtattaatggaaaatgaaagaacattagactttcatgattcaaacgtaaaaaacttatacgacaaaataagattacaattacgagataacgctaaagaactaggcaacggttgttttgaattctaccacagatgcgacaatgaatgcatggaatcagttcgaaacggaacatacgactatccacaatactcagaagaagcaagattaaaaagagaagaaatttcaggcgtaaaattagaaagcataggaacatatcaaatactttcaatatattccaccgtagctagctcactgactctcgcaataatggtagcaggattaagtctatggatgtgctcaaacgggtcattacaatgtagaatatgtata

SEQ ID NO: 51239 - RNA, 1656 nt, synthetic construct
  misc_feature 1..1656: note = derived and/or modified sequence opt6 from anti-influenza_Chain
  source 1..1656: mol_type = other RNA
gaccaaatatgtataggctaccacgcaaacaacagcacagaacaagtagataccataatggaaaaaaacgtaacagtaacacatgcacaagatatactagaaaaaacacataacggaaaattatgcgacttagatggcgtaaaacctttaatattaagagactgctcagtagcaggatggctattaggaaatccaatgtgtgacgaatttataaacgtcccagaatggtcatacatagtagaaaaagcaaacccaacaaacgacctatgttacccaggatcatttaacgactacgaagaactaaaacacctactatcaagaataaaccatttcgagaaaatacaaatcatacctaaatcatcatggtcagaccacgaagcatcaagtggtgtatcatcagcctgtccatacctaggatcaccttcctttttcagaaacgtcgtatggctaatcaaaaaaaactcaacttacccaaccataaaaaaatcatataataacacaaaccaagaagatctcctagtattatggggaatacaccatccgaacgacgctgcagaacaaacacgattataccaaaatccaacaacatatatatcaataggaacatcaacattaaaccaaagacttgtaccaaaaatagccacaagatcaaaagtaaacggacaaagcggaaggatggaattcttttggacaatattaaatcccaacgacgcaatcaacttcgaaagtaacggaaacttcatagcaccagaatatgcctataaaatagtaaaaaaaggagactcagccataatgaaatcagaactcgaatacggaaactgcaacactaaatgtcaaacacctatgggagccataaactcatccatgccattccataatatccacccactaacaataggagaatgtcctaaatacgtaaaaagcaacagattagtactagcgacaggattaagaaacagcccacaacgcgaaagtcgaagaaaaaaaagaggactattcggagcgatagcagggttcatagaaggaggatggcaaggaatggtagatggatggtacggctatcatcatagcaacgaacaaggatcaggatatgctgccgataaagaaagcacacaaaaagcaatcgacggagtaacaaacaaagttaactccattatagacaaaatgaacacacaattcgaagcagtaggaagagaattcaataacctggaaagaagaatagaaaacttaaacaaaaaaatggaagacggattcctagacgtatggacctataacgccgagctactagtactaatggaaaatgaacgtacactagacttccatgacagcaacgtaaaaaatttatatgacaaagtaagactacaattaagagacaatgcaaaagaactaggaaacggatgcttcgaattctaccacaaatgcgacaacgaatgcatggagtctatacgaaacggaacatataactatccacaatacagcgaagaagcaagattaaaaagagaagaaatatctggagtaaaactagaatcaatcggaacatatcaaatactaagcatctatagtacagtagcaagctcactagctctagcgataatgatggcaggattatcactatggatgtgctcaaacggatccttacaatgtcgaatatgcatc

SEQ ID NO: 51240 - RNA, 1680 nt, synthetic construct
  misc_feature 1..1680: note = derived and/or modified sequence opt6 from anti-influenza_Chain
  source 1..1680: mol_type = other RNA
atgtcaaacatggatatagactcaataaataccggaacaatagacaaaactccagaagaactcacaccaggaacatcaggagcaactagacctataatcaaaccagcaacactagcaccaccatccaataaaagaaccagaaatccatcacccgaaagaacgactacatcctcagaaacagatataggaaggaaaatacaaaaaaaacaaacaccaaccgaaataaaaaaatcagtatataaaatggtagtaaaactaggagaattttacaatcaaatgatggtcaaagccggactaaacgatgacatggaacgcaacttaatacaaaacgcccaagcagtggaaagaatactactagcagctacagacgataaaaaaactgaatatcaaaaaaaacgaaatgcaagagatgtaaaagaaggcaaggaagaaatagaccataataaaacaggaggaactttttacaaaatggtcagggacgataaaacaatatattttagtccaatcaaaataacattcttaaaagaagaagtaaaaacaatgtacaaaacaacaatgggatcagatggattttcgggattaaatcacataatgataggacactcacaaatgaacgatgtatgctttcaaagatcaaaaggattaaaaagagtaggattagatccaagcctaattagtacatttgcaggaagcacactaccaagaagaagcggcactacaggagttgcaataaaaggaggaggaaccctggtagacgaagcaataagatttataggaagagcaatggcagatagaggactattaagagatataaaagcaaaaacagcctatgaaaaaatactattaaacttaaaaaataaatgttcagcaccacaacaaaaagcactagtagaccaagtaataggttcaagaaatcctggaatagcagatatagaagatctaacactactagcaagaagtatggtagtagtcagaccatcagtagcatcaaaagtagtcttaccaataagtatatatgcaaaaataccacaactagggttcaatacggaagaatactccatggttggatacgaagctatggccctatacaatatggcaacacctgtttcaatattaagaatgggagatgacgcaaaagacaaaagtcaactatttttcatgtcatgcttcggagcagcatacgaggatttaagggtattatcagcattaacaggaacagaattcaaaccgagatcagcactaaaatgcaaaggattccacgtaccagcaaaagaacaagtagaaggaatgggcgccgcattaatgtcaataaaactacaattctgggcaccaatgactagatcaggaggaaacgaagtatcaggagaaggaggaagtggacaaatatcatgctcaccagtgtttgctgtcgaaagaccaatagcactatcaaaacaagcagtacgaagaatgctatcaatgaatgtagaaggtagagacgcagacgttaaaggaaacctattaaagatgatgaacgatagtatggcaaaaaaaacatcaggaaacgcattcattggaaaaaaaatgtttcaaatctcagacaaaaataaagtcaatcccatagagataccaattaaacaaacgatacccaacttcttctttggaagagacacagccgaggactacgatgacttagactac

SEQ ID NO: 51241 - RNA, 1680 nt, synthetic construct
  misc_feature 1..1680: note = derived and/or modified sequence opt6 from anti-influenza_Chain
  source 1..1680: mol_type = other RNA
atgaacacacaaatattagcacttatagcatacatgttaatcggagcaaaaggagataaaatatgtctaggacatcacgctgtagcaaatggaacaaaggtaaatacattaacagaacgaggaatagaagtagtaaatgcaacagaaacagtcgaaacagtaaacataaagaaaatttgcacacaaggaaaaagaccaacagacttaggacaatgcggattattaggaactttaataggcccaccacaatgtgatcaattcctagaatttgatgcagatctaataattgaaagaagagaaggcaccgacgtatgttacccaggaaagttcactaacgaagaatcattaagacaaatattgagaggaagtggagggatagacaaagaaagcatgggttttacatacagcgggataaggacaaatggagtaacgtcagcttgtagaaggtcagggtcaagtttctacgcagaaatgaaatggttactatcaaacagtgataacgcagcttttcctcaaatgacaaaatcgtacagaaatccaagaaacaaaccagcactaataatatggggagtacaccattcaggatctgcaacagaacaaacaaaactttatggcagcggtaacaaattaataactgtaggatctagtaaataccaacaatcgtttacacccagtcccggagcaagaccacaagtaaatggtcaatcaggaagaattgactttcattggttactactagatccaaatgatacagtaacgtttacattcaatggagcattcatagcaccagacagagccagtttcttcagaggggagagcttaggagtccaatcagatgtgccactagatagcggatgcgaaggcgattgtttccatagccgaggaactatagtaagtagtttacctttccaaaacataaatccaagaactgtaggtaaatgtccaagatatgtaaaacagacatcattactactagcaactggaatgagaaatgtacctgaaaatcctaaaacaagaggattattcggagcaatagcaggattcattgaaaatggatgggaaggattaatagatggatggtacggctttcgacaccaaaatgcacaaggagaaggcacagcagcagactataaatcaacacaaagcgcaatagaccaaataaccggaaaattaaatagattaatagataaaacaaaccaacaattcgaattaatagacaatgaattttctgaaatcgaacaacaaataggaaacgtaataaattggacaagagacagcatgacagaagtatggtcatataatgcagaattgctagtagcaatggaaaatcaacatactatagatttagcagatagcgaaatgaataaactatacgaaagagtaagaaaacaactaagagaaaacgccgaagaagacggaacaggatgctttgaaatatttcacaaatgtgacgatcaatgtatggaatccattaggaataacacatatgatcacacacaatatagaacagaatcactacaaaacagaatacaaatagatccagtaaaattatccagcggatacaaagatatcatactatggttctcatttggagcaagttgtttcctattattagcaatagctatgggattagttttcatatgtatcaaaaacggaaatatgagatgtaccatatgtata

SEQ ID NO: 51242 - RNA, 1680 nt, synthetic construct
  misc_feature 1..1680: note = derived and/or modified sequence opt6 from anti-influenza_Chain
  source 1..1680: mol_type = other RNA
atgaatacacaaatattagctttaatcgcctgcatgctaataggagcaaaaggagataaaatatgtttaggccatcacgcagtagcgaacggaacaaaagtcaatacattaaccgaaagaggaatagaagtagtaaacgcaacagaaacagtagaaacagcaaatattaaaaaaatatgtactcaaggtaaaagaccaacagaccttggccagtgcggactattaggaacactaataggcccgccacaatgcgatcaatttctagaatttgacgcagacctaataatagaaagaagggaaggaaccgatgtatgttacccaggaaaattcaccaatgaagaatcacttagacaaatattaagaggaagtggcggaatagacaaagaatcaatgggtttcacctattcaggtataagaacaaatggagcaacatcagcatgtagaagatcaggtagttcattctatgccgaaatgaaatggctactatcaaacagcgacaatgccgcattccctcaaatgactaaatcatacagaaatccacgaaataaacccgcactaataatatggggagtacatcatagtggtagcgcaacagaacagacaaaattatacggatccggtaataaactaataacagtaggatcatctaaataccaacaaagttttacaccgtcaccaggagccagaccacaagtgaatggacaatcgggaagaatagactttcactggttattactagaccccaatgatacagtaacatttacttttaacggagcttttatagcaccagatcgagcaagtttttttagaggaggatcactaggagtacaatcagatgtaccattagatagtggatgcgaaggagattgcttccacagcggtggaaccattgtgtcaagcctaccattccaaaacataaatccaagaacagtaggaaaatgtcctagatacgtgaaacaaacatcattactactagctacaggaatgcgaaatgtaccagaaaatccaaaaaccagaggactatttggtgcaatagcaggattcatagaaaatggatgggaaggtttaatagacggatggtatggatttcgacatcaaaatgcacaaggagaaggaacagcagcagactataaatcaacacaaagtgcgatagatcaaataacaggaaaactgaacagactaatagataaaacaaatcaacaattcgaactaatagataatgaatttaacgaaatagaacaacaaatcggaaacgtaatcaattggacgagagatagtatgacagaagtctggagttacaatgccgaattactagtagctatggaaaatcagcacacaatagacctagcagatagcgaaatgaacaaactctatgaaagagtaagaaaacaattaagagaaaacgcagaagaagatggaacaggatgttttgaaatatttcataaatgtgacgatcaatgcatggaatcaataagaaataacacatacgatcacacacaatatagaacagaatcactccaaaaccgcatacaaataaatccagtaaaactttcatcaggatataaagatataatactatggttttcattcggagcttcctgctttttattactagctattgcaatgggactagtatttatatgcatcaaaaatggaaatatgagatgcactatctgtata

SEQ ID NO: 51243 - RNA, 1680 nt, synthetic construct
  misc_feature 1..1680: note = derived and/or modified sequence opt6 from anti-influenza_Chain
  source 1..1680: mol_type = other RNA
atggaaagaatcgtattattgctagccatagtatctttagtaaaatcagaccagatatgtataggataccacgcaaataactctacagaacaagtagacacaataatggaaaaaaacgtaacagtcacacacgcacaagatatactagaaaaaacacataatggaaaactatgtgacttagacggcgttaaacccctaatactacgagattgcagtgtagccggatggttattgggaaatcccatgtgcgacgaatttctaaacgtaccagaatggtcttacatagtagaaaaaataaatcccgcaaacgacttatgttacccaggaaatttcaatgactacgaagaattaaaacatctattatcaagaataaaccactttgaaagaatacaaattattcctaaatcatcctggagcgaccatgaagcatcgagtggtgtatcttcagcatgcccataccaaggaagatcatcatttttcaggaatgtagtttggctaataaaaaaaaataatgcataccctaccataaaaagaagctataacaacacaaaccaagaagatttattagtactatggggaatacaccatccaaatgacgcagcagaacaaacaagactctatcaaaacccaactacatacatatcagttggaacaagcacattaaaccaaagattagtacccaaaatcgcaacaaggtccaaagtaaacggacaatcaggaagaatggaattcttttggacaatactcaaacccaatgacgcaataaacttcgaatcaaatggaaactttatagcaccagaaaatgcatataaaaattgccaaaaaggagactccacaataatgaaatcagaattagaatacggaaattgcaatacaaaatgccaaactccaatcggagccatcaacagttcaatgccctttcacaacatacatccactaacaatcggagaatgtccaaaatacgtaaaaagtaacaggctagtattagcaacaggattaaggaactcaccacaaggagagagaagaagaaaaaaacgcggactattcggagccatagcaggattcatagaaggaggatggcaaggaatggtagacggatggtacggatatcaccattcaaatgaacaaggatcaggatatgccgctgataaagaaagcactcaaaaagcaatagacggagtaacgaataaggtaaattcaataatagataaaatgaatacacaatttgaagcggtaggaagagaatttaacaacttagaaagaagaatcgaaaatctaaacaaaaaaatggaagacggctttctcgatgtttggacctacaatgcggaactcttagtactaatggaaaacgaaagaacgctagactttcatgattcaaacgtcaaaaacctttatgacaaagtcagattacaactaagagataatgcaaaagaactaggaaacggatgtttcgaattttatcatagatgtgacaatgaatgtatggaaagtgtaagaaatggaacatatgattacccacaatatagcgaagaagcccgattaaaaagagaagaaatctcaggagtaaaattagaatcgataggaacgtaccaaatactatcaatatatagtacagtagcctcatcactagcactagcaattatggtagcgggattaagtctatggatgtgtagtaacgga

SEQ ID NO: 51244 - RNA, 1680 nt, synthetic construct
  misc_feature 1..1680: note = derived and/or modified sequence opt6 from anti-influenza_Chain
  source 1..1680: mol_type = other RNA
atgtcaaacatggatattgatagtattaacacaggaacaatagataaaacaccagaagaactaacaccaggaacatcaggggcaacaagaccaataataaaaccagctacactagcaccaccctcaaacaaaagaacaagaaacccatcaccagaaagaacaacaactagctcagaaacagatataggaagaaaaatccaaaaaaagcaaacacctacagaaattaaaaagtcagtgtacaaaatggtcgtcaaattaggagaattttacaaccaaatgatggtcaaagcaggtttaaacgacgacatggaaagaaacttaattcaaaacgcacaagcagtagaaagaattctacttgcagccacagacgacaaaaaaacagaatatcaaaaaaaaagaaatgcaagggacgtcaaagaaggaaaagaagaaatagaccataataaaacaggcggaactttctacaaaatggtaagagatgacaagacaatatatttctcacccataaaaataacattcctaaaagaagaagtaaaaacaatgtataaaaccaccatgggaagtgacggatttagtggattaaaccatattatgattggacatagtcaaatgaacgacgtatgtttccaaagatctaaaggcctaaaaagagtcggactagaccccagcttaatatcaacattcgcaggaagcacattaccaagacgaagtggcacaaccggagtagctataaaaggaggaggaactctagttgatgaagcaataagatttattggtagagcaatggcagacagaggactcttacgagatatcaaagcgaaaaccgcttatgaaaaaatcctactaaatcttaaaaacaagtgttcagcccctcaacaaaaagcacttgtcgaccaagttataggaagtagaaaccccggaatagccgatatagaagacctaacactactagcacgaagcatggtagtagtcagaccatcagtagccagcaaagtagtgctcccaataagcatatacgcaaaaataccacaactaggatttaatacagaagaatatagtatggtaggatatgaagcaatggcattatacaacatggcaactccagtaagtatactaagaatgggagacgatgcaaaagataaatctcaattattcttcatgtcatgctttggagcagcatacgaagacttaagagtcctttcagcactcacaggaacggaatttaaaccaagaagcgctttaaaatgcaaaggatttcacgtacctgcaaaagaacaagttgaaggaatgggagcagcattaatgagtataaaattacaattttgggccccaatgacaagaagtggaggaaacgaagtatcaggagaaggaggatcaggacaaatttcgtgctcaccagtatttgcagtagaacgaccaatagcattaagtaaacaagcagtccgaagaatgctaagcatgaacgtcgaaggaagagatgcagacgtaaaaggcaacctattaaaaatgatgaacgactcaatggcaaaaaaaaccagtggcaatgcatttataggaaaaaaaatgtttcaaattagcgacaaaaataaagttaatccgatcgaaatcccaataaagcaaaccattccaaatttcttttttggaagagatactgcagaagactacgacgatctagactat

SEQ ID NO: 51245 - RNA, 1680 nt, synthetic construct
  misc_feature 1..1680: note = derived and/or modified sequence opt6 from anti-influenza_Chain
  source 1..1680: mol_type = other RNA
atgaacacccaaatactagccttaatagcttacatgttaattggagcaaaaggagataaaatatgtctaggacaccatgcagtagccaatggaacaaaagtaaacacactaacagaaagaggaattgaagtcgtaaacgcaacagaaacagtagaaacagtaaatatcaaaaaaatctgtacccaaggaaaaagaccaacagacttaggtcaatgcggtcttctaggaacattaattggaccacctcaatgtgaccaatttctagaattcgacgcagatctgataatagaaaggcgagaaggcacagatgtatgttacccaggaaaatttactaatgaggaatcattaagacaaatactacgaggaagtggaggaatagataaagaaagcatgggcttcacatattcaggcatacgaaccaatggagtaacaagcgcatgcagaagatcaggaagcagtttctatgcagaaatgaaatggttactatcaaacagtgataatgccgctttccctcaaatgacaaaaagctatagaaatccaagaaacaaaccagcattaattatctggggtgttcaccacagcggcagcgcaacagaacaaacaaaactctacggaagtggtaacaaattgataacagtaggatcaagtaaataccaacagagttttaccccatctccaggagctagaccacaagtaaatggccaatctggaagaatagactttcattggctactattagatccaaacgacacagtaacattcaccttcaatggagcatttatagcacctgatcgagcgtcatttttccgtggagaaagtcttggggtacaaagtgatgttccattagatagcggatgtgaaggagattgcttccatagtagaggtacaatagtatcttcattaccatttcaaaacattaatccaagaacagtaggaaaatgcccaagatacgtaaaacaaacaagcctacttctagcaacaggaatgagaaatgtaccagaaaatccaaaaactagaggattattcggagctattgcaggattcatagaaaatggatgggaaggactaatagacggatggtacggttttagacaccaaaatgcacaaggagaagggactgcagctgattacaaatcaacacaaagcgcaatagatcaaataacaggaaaattaaatagactaattgacaaaaccaatcaacaattcgaactcatagacaatgaatttagtgaaatagaacaacaaataggcaatgtaatcaactggactagagactcaatgacagaagtctggtcatataatgcagaattattagtagcaatggaaaatcaacatacaattgacctagcagattcagaaatgaataaattatatgagagagtaagaaaacaattaagagaaaatgcagaagaggacggaacaggctgcttcgaaatcttccataaatgcgacgaccaatgtatggaaagcatacgaaacaacacatacgatcacacacaatacagaacagaatcattacaaaacagaatacaaattgatccagtcaaattatcatcaggctacaaagatataatattatggttttcttttggagcctcatgctttctcctactagcaatagcaatgggtttagtattcatttgtataaaaaatggaaacatgagatgtacaatctgcata

SEQ ID NO: 51246 - RNA, 1680 nt, synthetic construct
  misc_feature 1..1680: note = derived and/or modified sequence opt6 from anti-influenza_Chain
  source 1..1680: mol_type = other RNA
atgaatactcagatattagcattaatagcatgcatgctaataggagcaaaaggagataaaatatgcctaggacatcatgcagttgctaatggtacaaaagtaaacaccttaacagaaagaggaatcgaagttgtaaacgcaactgaaactgtagaaacagccaacatcaaaaaaatatgcacacaaggtaaaagaccaactgacctcggacaatgtgggctattaggaacactaattggaccaccgcaatgtgatcaatttcttgaatttgatgctgatctaataatagaacgaagagaaggtacagacgtctgttacccaggcaaatttacaaacgaagaatcacttagacaaatattacgaggatccggaggaatagataaagaatccatgggatttacttatagcggaataagaacaaacggagccaccagtgcatgtagaagatctgggtcatcattctacgcagaaatgaaatggctattatccaatagcgacaatgccgccttcccacaaatgaccaaatcatacagaaatcccagaaataaaccagcactcataatctggggagtacatcattcaggttccgcaacagaacaaactaaactatacggaagtggaaacaaactaataaccgtaggaagtagcaaataccaacaatcatttacgccaagcccaggagcacgaccacaagtcaatggacaatcaggcagaatagactttcattggctactactagatccaaatgacactgtaacttttacattcaatggagcattcatagcccctgacagagcatcattctttagaggaggatcactgggagtacaaagcgatgtaccattagattccggatgtgaaggcgactgttttcacagcggcggaaccatagtatcttctctgccatttcaaaatattaatccgaggactgtaggtaaatgcccacgttatgtaaaacaaacatcacttctactagcaacaggaatgagaaatgtaccagaaaatcctaaaacaaggggattattcggagcaatagcaggtttcatagaaaacggatgggaaggcctaatagacggctggtatggattcagacaccaaaatgcacaaggagaaggcacagctgcagactacaaatcaacacaaagtgcaatcgatcaaattacaggaaaactaaacagactaatagataaaacaaatcaacaattcgaacttattgacaacgaatttaacgaaatagaacaacaaatcggaaacgtcatcaattggaccagagattcaatgacggaagtatggagttacaatgcagaactattagttgctatggaaaatcaacatacaatagacttagcagactctgaaatgaataaattatacgaaagggtaagaaaacaactaagagaaaacgcagaagaagacggaacaggctgctttgaaatatttcataaatgtgacgatcaatgcatggaatcaataagaaataacacatatgaccatacacaatatagaacagaatccctacaaaacagaatacaaataaatcctgtaaaattatcttcaggatataaagatatcatattatggttcagttttggggcatcatgcttcctactattagcaattgcaatgggcctagtatttatatgtataaaaaatggaaacatgagatgtacaatatgtata

SEQ ID NO: 51247 - RNA, 1680 nt, synthetic construct
  misc_feature 1..1680: note = derived and/or modified sequence opt6 from anti-influenza_Chain
  source 1..1680: mol_type = other RNA
atggaaagaatagtattattattagcaatagtatcactggtaaaatcagaccaaatatgcataggataccacgccaataacagtacagaacaagtagatacaataatggaaaaaaacgtaacagttacacacgcacaagacattctagaaaaaacacacaacggaaaattatgtgacctagatggagtaaaacctttaatactaagagactgctcagtcgcaggatggttactaggcaatcctatgtgcgacgaatttctaaacgttccagaatggtcatacatagtagaaaaaataaatcctgcaaacgacctgtgctacccaggaaactttaacgattacgaagaactaaaacacttactatcacgcataaaccattttgaaaggatacaaataatacccaaatcatcatggagcgaccacgaagcatcaagcggagtaagttcagcatgtccatatcaaggcagatcatccttttttagaaatgttgtatggctaataaaaaaaaacaacgcatacccaacaataaaaagatcatataacaatacaaatcaagaagatttactagtactttggggaatacaccacccaaacgatgcagccgaacagacaagactctatcaaaaccccacaacatacataagtgtcggaacatcaacattaaaccaaagattagtaccaaaaatagcaacaagaagcaaggttaacggacaatcaggtagaatggaattcttctggaccatactaaaaccaaacgatgctatcaactttgaatcaaacggaaacttcatagcgccagaaaacgcatataaaaattgtcaaaaaggagacagcacaataatgaaatcagaactagaatatggaaactgtaatacaaaatgtcaaacaccaataggagcaataaacagttcaatgccattccataacattcatcctctaactataggagaatgccctaaatatgtaaaatcaaaccgattagttctagcaactggcctaagaaattcaccacaaggcgaaagaagaagaaaaaaaagaggtctattcggagcaatcgcaggatttatagaaggaggatggcaaggtatggttgacggatggtatggatatcaccatagcaatgaacaaggaagtggatacgcagcagataaagaaagcacacaaaaagccatagatggagtaacaaacaaagtaaattcaatcatagataaaatgaacactcaattcgaagcagttggacgagaattcaacaacttagaaagaaggatagaaaacttaaataaaaaaatggaagacggcttcctagacgtatggacttacaacgcagaactactcgtactaatggaaaatgaaagaactctagattttcacgattcaaatgtaaaaaatctatacgacaaagtaagactacaactaagagacaacgcaaaagaactaggaaacggatgcttcgaattctaccatagatgtgacaacgaatgcatggaaagtgtacgaaacggaacatatgattacccacaatactcagaagaagcaagactaaaacgagaagaaatctcaggagtaaaactagaatcaataggaacttatcaaatactatcgatatattcaacggtagcatcaagtctagctttagcaataatggtagctggactatcactctggatgtgtagtaatgga

SEQ ID NO: 51248 - RNA, 1686 nt, synthetic construct
  misc_feature 1..1686: note = derived and/or modified sequence opt6 from anti-influenza_Chain
  source 1..1686: mol_type = other RNA
atgccaagagcactaaggagagtacccggttcacgagtaatgttaagagtaggtgttgttgttgcagtattagcgctagttgctgcactagcaaatctagccgtcccaagaccagcaagagcagctggaggaggatattggcatacaagcggaagagaaatattagacgctaataatgtaccagtaagaatagcaggcataaattggtttgggtttgaaacatgtaactatgtagtacatggactatggtcaagagactatagaagtatgttagatcaaataaaaagtctaggttataacacaataagattaccttacagtgacgatatattaaaaccaggtacaatgccaaattctattaatttttatcaaatgaatcaagacttacaaggtctgacaagtttacaagtaatggataaaatcgtagcatacgcaggacaaataggattacgaataatattagatagacatagaccagattgctcaggacaatcagctttatggtatacatcatcagtatcagaagcaacatggatttcagatctacaagcattagcacaaagatataaaggaaatccaacagtggtaggattcgatctacataacgaaccacatgatccagcttgttggggctgtggtgatcctagcatagactggagactcgccgcagaaagagctggaaatgcggtactatcagttaaccccaacctacttatatttgtagaaggagtacaaagttataatggagatagctattggtggggcggaaatttacaaggagcaggtcaatatccggttgtacttaatgtaccaaataggttagtatacagtgcacatgattatgcaacatcagtatatccacaaacctggttctctgatccaacattcccaaacaatatgccaggcatatggaacaaaaattggggttacttattcaatcaaaacattgctccagtatggctaggtgaatttggtacaacattacaatcaactacagatcaaacatggttaaaaacgctagtacaatatcttagaccaaccgcccaatatggagcagattcatttcaatggacattttggtcatggaatcccgatagcggagatacaggaggtatactaaaagatgattggcaaacagtagataccgttaaagatggatatttagcacccataaaatcatcaatattcgatcctgtaggagcaagcgcttctccctcatcgcaaccaagtccatccgtatcaccaagtccttcaccgagcccatcagcctcaagaacacctacaccaacaccaacaccaacagcatcacctacccctactttaactccaacagcaacaccaacacccacagcatccccaacgccatcaccaacagcagctagtggagcccgttgtacagccagctaccaagtgaacagtgactggggaaatggctttacagtaaccgtagcagttacaaattccggttctgttgctacaaaaacttggactgtatcttggacattcggaggaaatcaaacaataacaaattcgtggaacgcagcagtaacacaaaacggacaaagcgtcacagcaagaaatatgtcatacaataacgtaatacaaccaggacaaaacacaacatttggatttcaagcatcatatactggaagtaatgctgcacctactgtagcctgtgctgcaagt

SEQ ID NO: 51249 - RNA, 1686 nt, synthetic construct
  misc_feature 1..1686: note = derived and/or modified sequence opt6 from anti-influenza_Chain
  source 1..1686: mol_type = other RNA
atggaaagagtatggtggaaagaagcagtagtatatcaaatttacccaagatcattttatgattcaaacggcgacggaataggtgacataagaggtataatagccaaattggactatttaaaagaattaggcgtagatgtagtgtggctctcaccagtatataagagcccaaatgatgacaacggctatgacataagcgattacagagatataatggacgaatttggaaccatggcagattggaaaacaatgttagaagaaatgcacaaaagaggaatcaaattagtaatggatctagtagtcaatcacactagcgatgagcacccatggttcatagaatcaaggaaaagcaaagataatccatatagagactattacatatggagaccagggaaaaacggaaaggaaccaaacaattgggaatcagttttttccggaagtgcatgggaatatgatgaaatgacaggtgaatattacctacatctctttagcaaaaaacaaccagacttaaattgggaaaatccaaaagtgcgacgagaagtttacgaaatgatgaaattttggctcgacaaaggtgtagatggatttagaatggacgtaataaatatgattagtaaagtaccagaactaccagatggagaaccacaaagtggtaaaaaatatgcatcaggctcgaggtactatatgaacggacccagagtccacgaatttctacaagaaatgaatagggaagtgttatcaaaatacgatataatgacagtaggagaaacaccaggggtaacaccaaaagaaggaattttatatacagacccctcaagaagagaattaaacatggtctttcaatttgaacacatggatctagattcaggtcccgggggaaaatgggatataagaccctggagcctagccgatctaaaaaaaacaatgactaaatggcaaaaagaattagaaggtaaaggatggaatagtttatatttgaacaatcatgaccaaccaagagcagtgagtagatttggagatgacggaaaatatagagtagaaagtgcaaaaatgctagcaacatttttacacatgatgcaaggaacgccttatatatatcaaggagaagaaataggaatgacaaatgtaagatttccatcaatagaagactatagagacatagaaacattaaacatgtacaaagaaagagtagaagaatacggagaagaccctcaagaagtaatggaaaaaatttattataaaggaagagataatgcacgaacaccaatgcaatgggatgatagtgaaaatgcaggattcacagcaggaacaccatggataccagtaaacccaaactataaagaaataaatgtaaaagccgcattagaagacccaaactcagtatttcattactacaaaaagttaatccaactgagaaaacaacatgatataatagtatatggaacatacgatttaatattagaagatgacccatatatatacagatatacaagaacactaggcaatgaacaactaatagtaataacaaatttttcagaaaaaacaccagtattcagactaccagatcacataatatataaaacaaaagaattattaatatcaaattatgatgtagacgaagcagaagaactaaaagaaattcgattacgaccatgggaagcaagggtatacaaaataagactacct

SEQ ID NO: 51250 - RNA, 1686 nt, synthetic construct
  misc_feature 1..1686: note = derived and/or modified sequence opt6 from anti-influenza_Chain
  source 1..1686: mol_type = other RNA
atgccaagagcattaagacgagtacctggaagtagagtaatgctaagagtcggagtcgttgtagcagtattagcattggttgcagcactagcaaatcttgctgtaccaagacccgcaagagcagcaggcggaggctattggcatacaagcggacgagaaatcctagatgctaataatgtcccagtacgcatagccggaatcaactggttcggttttgaaacctgtaattacgtagtccatggactttggtcaagagattacagatcaatgttagaccaaattaaatcattaggatataatacaataagattaccatattcagacgatatattaaaaccaggaactatgccaaattcaattaacttttatcaaatgaaccaagatttacaaggactaacatctctacaagtcatggataaaattgtagcatatgcaggtcaaattggcctacgaataatattagacagacacagaccagactgttcaggacaatcagctttatggtacacatcaagtgtatcagaagcaacatggatatctgatttacaagctctagctcaaagatataaaggaaatccaacagttgtaggattcgatttacataatgaaccacatgatccagcatgttggggatgcggtgatccatcaatagactggagactagcagcagaaagagcaggaaatgcagtcttatctgtaaacccaaatctattaatatttgtagaaggagtacaaagttataatggagatagttattggtggggaggaaatttacaaggagcaggccaatatcctgttgtattaaatgtccccaacagattagtatattcagctcacgattatgccacatcagtatatccacaaacatggttttcagatccaactttcccaaacaatatgccaggaatatggaacaaaaattggggttatctctttaaccaaaatatagcaccagtatggctaggagagttcggaactacattacaaagtacaacagaccaaacatggctaaagactctagtccaatatttaagaccaacagcacaatatggtgcagactcttttcaatggacattttggtcatggaatccggattcaggagatacaggaggcattttaaaagatgattggcaaacagtagatacggtaaaagacggatacttagctccaataaaaagttctatttttgatccagtaggagcatcagcatcacctagtagtcaaccatcaccttcagtctcaccctcaccgtcaccatcaccatcagcatccagaactcctaccccaactccaacaccaacagcaagcccaacacctacactaacaccaacagcaaccccaacacccacagcatccccaactccatcacctacagcagcctccggagcaagatgtacagcatcataccaagtcaactccgactggggaaatggatttacagtaaccgtagcagtcacaaatagcggctcagtagcaacaaaaacatggactgtatcctggacattcggtggtaaccaaacaataacaaattcatggaatgcagcagtaactcaaaatggtcaaagtgtaacagcacgaaacatgtcatataacaatgtaattcaacctggacaaaatacaactttcggatttcaagcatcttatacaggaagtaacgcagcaccaacagtagcatgtgcagcatca

SEQ ID NO: 51251 - RNA, 1686 nt, synthetic construct
  misc_feature 1..1686: note = derived and/or modified sequence opt6 from anti-influenza_Chain
  source 1..1686: mol_type = other RNA
atggaaagagtttggtggaaagaagcagttgtatatcaaatataccccaggtcattttatgactctaacggagacggaatcggtgacataagagggataatagcaaaattagattacttaaaagaattaggagtggacgtagtatggttatcaccagtatataaatcaccaaatgacgataacggatatgatataagtgattatagagacatcatggatgaatttggaacaatggcagattggaaaacaatgctagaagaaatgcacaaaagaggaataaaattagtgatggacctagtagtaaatcacacttcagatgaacatccatggttcatagaaagtagaaaaagcaaagataacccgtatagagactattatatatggagacctggtaaaaacggaaaagaaccaaataactgggaaagcgtattcagtggaagcgcttgggaatacgatgaaatgacaggagaatattacctacacctattttcgaagaaacaaccagacttaaattgggaaaacccaaaagtacgacgagaagtatatgaaatgatgaaattttggttagataaaggagtcgacggatttagaatggacgtaataaacatgatatcaaaagtaccagaactaccagatggagaaccccagagtggcaagaaatacgcatcaggtagcagatattatatgaatggcccaagagtacatgaatttttacaagaaatgaacagagaagtattaagtaaatacgatatcatgacagtaggtgaaacaccaggagtcacaccaaaagaaggtatattatatacagatccgtctagaagagaattaaacatggtcttccaatttgaacatatggatttagatagtggtccaggaggaaaatgggatatcagaccctggagcttagcagatctaaagaaaacaatgacaaaatggcaaaaagaattagaaggaaaagggtggaatagtttgtacttaaataaccacgatcaacctcgagcagtaagccgatttggagatgacgggaaatacagagtagaaagcgcaaaaatgttagcaacattcttacacatgatgcaaggaacaccatatatataccaaggtgaagaaatcggaatgacgaatgtacgatttcctagcatagaagattatagagatatagaaacattaaacatgtataaagaaagagtagaagaatatggcgaagatccacaagaagtaatggaaaagatatattacaaaggaagagacaatgcaagaacaccaatgcaatgggatgattcagaaaacgcaggttttactgcaggtacaccatggataccagtaaacccaaactacaaagaaataaatgtaaaagcagctctagaagatccaaactcagtttttcactactacaagaaattaatacaattaagaaaacaacatgatataattgtatatggcacgtacgatttaattttagaagacgatccctacatatatagatatacacgaacactaggaaacgaacaactaatagtgataactaatttcagtgagaaaactccagtatttagattaccagaccacataatatataaaacaaaagaactattaatatcaaattatgacgtagacgaagccgaagaactaaaagaaatacgactaagaccatgggaagcaagagtatacaaaataagattaccg

SEQ ID NO: 51252 - RNA, 1689 nt, synthetic construct
  misc_feature 1..1689: note = derived and/or modified sequence opt6 from anti-influenza_Chain
  source 1..1689: mol_type = other RNA
atggagaaaatagtactactcttcgcaatagtaagtctagtaaaaagcgaccaaatatgcatcggatatcatgcaaataatagtacagaacaagtcgatacaatcatggagaaaaacgtaacagtaactcacgcacaagacatacttgaaaaaaaacacaacggaaaactatgtgacttagatggagtaaaaccactaatactacgagattgtagcgtagcaggctggctactgggaaacccaatgtgtgacgaattcatcaatgtaccagaatggagttacatagtagaaaaagcaaatccagtaaacgatctatgctaccccggagattttaacgactacgaagaactaaaacaccttctctcaagaataaaccacttcgaaaaaatacaaataatccctaaaagctcatggtcttcacacgaagcatcactaggagtctcttcagcatgcccgtaccagggaaaaacaagtttctttagaaacgtagtttggttaattaaaaaaaattcaacatatccaacaataaaaaggtcatacaataacacaaaccaagaagacttactcgtactttggggtatacaccaccccaacgacgcagctgaacaaacaaaactataccaaaacccaacaacatacatctccgtaggcacatcaacacttaatcaaaggttagtcccaagaatagcaacaagaagcaaagtaaacggacaaagtggacgaatggaattcttctggacaatattaaaacctaacgatgcaataaacttcgaaagtaacgggaattttatagcaccagaatatgcatacaaaatagtaaaaaaaggagactcaacaataatgaaaagtgaactagaatacggaaattgcaacacaaaatgccaaacaccaatgggtgcaataaactcatcaatgccatttcacaatattcatccactaacaataggagaatgtccaaaatacgtaaaatctaatagattagtattagccacaggattaaggaactcaccgcaacgagaaaccagaggattattcggagcaatagccggattcatagaaggaggatggcaaggaatggtcgacggctggtacggataccaccactcaaacgaacaaggaagcggatatgccgcagacaaagaatcaacacaaaaagcaatagatggagtgacaaacaaagtaaactccataatagacaaaatgaacacacaattcgaagccgtaggaagagaattcaataacctagaaaggcgaatagaaaacttaaacaaaaaaatggaagacggattcttagacgtatggacttacaacgccgaactattagtactaatggaaaatgaaagaacactagatttccacgattcaaacgtaaaaaatttatacgataaagtccgattacaactacgagacaatgccaaagaactcggaaacggctgtttcgaattttaccataaatgcgacaacgaatgcatggaatcagtaagaaacggaacctatgattatccacaatactcagaagaagcaagattaaagcgagaagaaatttcaggtgtaaaactagaatccataggaatataccaaattttaagcatatactcaactgtagcaagcagccttgccctcgcgataatggtagccggactaagcctctggatgtgctcaaacggctcactacaatgtaggatatgt

SEQ ID NO: 51253 - RNA, 1689 nt, synthetic construct
  misc_feature 1..1689: note = derived and/or modified sequence opt6 from anti-influenza_Chain
  source 1..1689: mol_type = other RNA
atggaaaaaatagtattactttttgcaatagtatccttagtaaaatcagatcaaatctgtataggatatcacgctaacaactcaacagaacaagtagacaccataatggaaaaaaacgtaacagtaacacatgcccaagacatactagaaaaaaaacacaatggaaaattatgcgatttagacggagtaaagccactaatactcagagactgttctgtggcaggatggctactcggaaaccccatgtgcgacgaatttataaatgtaccagaatggtcatatatagtagaaaaagcaaaccccgtaaatgacttatgctacccaggtgatttcaacgactatgaagaactaaaacatctcctaagcagaataaatcacttcgaaaaaatccaaataataccaaaatcgtcatggagttcacatgaagcatcactaggagtctcatcagcatgtccgtaccaaggtaaaacatctttctttagaaatgtcgtatggctcataaaaaaaaattccacttaccctacaataaaaagatcatacaataatacaaaccaagaagaccttctagtactatggggaatacatcatcccaatgacgcagccgaacaaacaaaactataccaaaacccaacaacatatatatctgtaggaacatcaactctaaatcaaagactagtaccaagaatagcaacaagaagcaaagtgaacggtcaatcaggaagaatggaattcttctggacaatactaaaacccaatgatgcaataaatttcgaatcaaatggtaacttcattgcaccagaatatgcatacaaaatagtcaaaaaaggagactcaacaataatgaaatctgaactagaatacggaaactgcaacacaaaatgccaaactccaatgggcgctataaatagcagcatgccatttcataacatacaccctttaactataggagaatgccctaagtacgtaaaatcaaacagacttgtcctcgccacaggtctcagaaattctccacaacgcgaaaccagaggactattcggtgcaatagcaggattcatcgaaggaggatggcaaggaatggtagacggatggtatggctatcatcatagcaatgaacaaggaagcggctacgctgctgacaaagagagtacacaaaaagccattgacggagtcacaaataaagtaaattcaataatagacaaaatgaatacacaatttgaagcagtaggaagagaattcaataatctcgaaagaagaatcgaaaacctaaacaaaaaaatggaagacggatttctagacgtttggacatacaacgcagaactactagtactaatggaaaacgaaagaacattagattttcatgattcaaatgtaaaaaacttatatgataaagtaagacttcaacttagagataacgcaaaagaactaggtaacggatgcttcgaattttatcacaaatgcgacaacgaatgtatggaaagcgtaagaaatgggacatacgattatccacaatactcagaagaagcacgattaaaaagagaagaaatatcaggagtaaaactagaatcaataggaatatatcaaattttatcaatatactcaacagtcgcatcatctttagccctagccataatggtagcaggattatcattatggatgtgtagcaacggaagcctccaatgcagaatctgc

SEQ ID NO: 51254 - RNA, 1692 nt, synthetic construct
  misc_feature 1..1692: note = derived and/or modified sequence opt6 from anti-influenza_Chain
  source 1..1692: mol_type = other RNA
atggaaaaaatcgtactactattcgctatagtaagcctagtcaaaagcgatcaaatatgcataggataccacgcaaataattccacagaacaagtagacactataatggaaaaaaacgtaacagtaacacatgcccaagacatcctagaaaaaacacacaacggaaagctatgctcactcaacggagtaaaaccattaatattaagagattgcagtgtagcaggttggctactaggaaacccaatgtgcgatgaattcttaaacgtaccagaatggtcatacatagtagaaaaagattcaccaattaacggactctgttatccaggagacttcaacgattacgaagaactaaaacacttactcagtagcacaaatcacttcgaaaaaatacaaataatcccaagaagctcatggagcgaccacgatgcaagtagcggagtatcaagtgcatgcccctacaacggtcgcagttcgttctttagaaacgtagtatggttgataaaaaaaaataacgcataccccacaataaaacgaaactataacaatacaaatcaagaagacctactagtgttatggggcattcatcacccgaacgatgcaacagaacaaacgaaattatatcaaaatccaacaacatacgtaagcgtaggcactagcaccttaaatcaaagatccgtaccagaaatcgcaacacgaccaaaagtcaacggccaatcaggcagaatagaattcttctggaccatactaaaaccaaatgatgcaataaactttgaaagcaatggaaattttatagcaccagaatatgcttataaaattgcaaaaaaaggagattcagcaatcatgaaatcaggattagaatacggaaactgcaacacaaaatgccaaacaccaatgggtgcaataaattctagcatgccgttccacaacatacatccactcacaataggagaatgtccaagatacgtaaaatcagatagattagtactagcgacaggattacgaaatgtcccacaaagagaaaccagaggattattcggagcaatagcaggtttcatcgaaggaggatggcaaggaatggtagacggatggtacggctatcatcatagtaatgaacaaggatcaggatatgcagcagataaagaaagtacacaaaaagctatagatggaataaccaataaagtaaattccattatagacaaaatgaatacacaatttgaagcagtaggcaaagaatttaacaacctagaaagaaggatagaaaacttgaataaaaaaatggaagatggattcctagatgtatggacatacaacgcagaactactagtattaatggaaaatgaaaggacactagactttcacgactcaaatgtcaaaaatttatacgacaaagtaagattacaactaagagacaatgcaaaagaattaggaaatggatgcttcgaattttatcacaaatgtgacgatgaatgtatggaaagcgtaagaaacggaacgtatgattacccacaatactcagaagaagcaaggctaaacagagaggaaatatcaggagttaaattagaatccataggaacttatcaaatactatcaatatattcaacagtagcaagttccctagcactagcaatcatggtagctgggctaagcttttggatgtgttctaacggatcattacaatgcagaatatgcata

SEQ ID NO: 51255 - RNA, 1692 nt, synthetic construct
  misc_feature 1..1692: note = derived and/or modified sequence opt6 from anti-influenza_Chain
  source 1..1692: mol_type = other RNA
atggaaaaaatcgtactactattcgcaatagtgtcactagtaaaatccgaccaaatatgcataggataccacgcaaataattcaacagaacaagtagacacaataatggaaaaaaacgttaccgttacacatgcacaagatatattagaaaaaacacataacggaaaattatgctcactaaacggagtcaaaccattaatattaagagactgctcagtagctggatggttactaggaaatccgatgtgcgacgaatttctaaatgtcccagaatggagttatatcgtcgaaaaagactcaccaataaacggactttgctatccgggagatttcaacgattacgaagaattaaaacacctcctatcaagtacaaaccattttgaaaaaattcaaataataccacgttcaagctggtcagatcacgacgcatcatcaggagtatcatcagcctgtccttataacggaagaagttcattctttagaaacgtagtgtggctaataaaaaaaaataacgcttacccaacaattaaaagaaattacaacaatacaaaccaagaagatctattagttctatggggtatacaccacccaaacgacgcaacagaacaaacaaaattataccaaaacccaacaacatacgtttcggtaggaaccagcacgctaaaccaaagatcagtacctgaaatagcaacaagaccaaaagtaaatggccaatcaggaagaatagaatttttttggactatcctcaaaccaaacgatgcaattaacttcgaatcaaacggcaacttcatagccccagaatacgcatacaaaatagctaaaaagggagactcagcaataatgaaaagtggattagaatatggaaactgtaacacaaaatgtcaaacaccaatgggtgcaataaatagttcaatgcccttccataacatacatccattaaccataggagaatgcccaagatacgtaaaatcagacagactagtcctagcaacaggacttcgaaacgtaccacaaagagaaacgagaggtctatttggagcaatagcaggatttatagaaggaggatggcaaggaatggtagacggctggtacggataccatcacagcaatgaacaaggatcaggctatgctgcagataaagaatcaacacaaaaagcaatagacggtataaccaataaagtaaatagcataatcgacaaaatgaacacacaattcgaagcagtaggcaaagaattcaacaatttagaaagaagaatagaaaacctaaacaaaaaaatggaagacggattcctagatgtctggacgtataacgctgagttactagtactaatggaaaatgaacgaacactagactttcatgatagcaacgtaaaaaacttatacgacaaagtcagattacaattaagagacaacgcaaaagaactcggaaatggatgcttcgaattttaccacaaatgtgacgatgaatgcatggaatcagtaagaaatggaacatacgactacccacaatacagcgaagaagcccgattaaatagagaagaaatatccggtgtcaaactagaaagcataggaacataccaaatactatcaatatactcaacagtcgcctcaagcctagcacttgcaataatggtagcaggactatctttctggatgtgctcgaatggttcattacaatgtagaatatgcata

SEQ ID NO: 51256 - RNA, 1695 nt, synthetic construct
  misc_feature 1..1695: note = derived and/or modified sequence opt6 from anti-influenza_Chain
  source 1..1695: mol_type = other RNA
atggaaaaaatagttttattgtttgcaattgtcagccttgttaaatcagaccaaatatgcataggataccacgcaaacaattcaaccgaacaagtagacaccataatggaaaaaaacgtaacagtaacacatgctcaagacatcttagaaaaaaaacataacggaaaattatgcgacctagatggagttaaacctttaatattaagagactgctcagtagcaggatggttacttggaaacccaatgtgcgacgaatttataaacgtcccagaatggagctacattgtagaaaaagcgaaccctgtaaacgacctatgctatcctggagacttcaacgactatgaagaattaaaacacctactatcccgaataaaccatttcgaaaaaatacaaatcattccaaaatcaagttggtcatcacacgaagcaagcttaggagtatcatcagcctgcccttaccaaggaaaatcatcattcttcagaaacgtagtatggctaataaaaaaaaactcaacatacccaacaattaaaagatcatataacaatactaaccaagaagatctactagtactatggggaatacaccacccaaatgatgccgcagaacaaacaaaactataccaaaatccaacaacctatatatcagttggaacaagcacactaaatcaaagactagtaccacgaatagcaacacgatcaaaagtaaatggtcaatcaggaagaatggaattcttctggaccatattaaaaccaaacgacgcaattaacttcgaatcaaacggcaacttcatagcacctgaatacgcctacaaaatagtcaaaaaaggagacagcactattatgaaatccgaactagaatacggaaactgtaatacaaaatgccaaaccccaatgggagccataaactcatcaatgcccttccacaacatacatccattaactataggagaatgtccaaaatacgtaaaaagcaatagactagtattagcaacaggactaagaaactcaccacaaagagaaagaagaagaaaaaaacgaggcctttttggagcaatcgcaggattcatcgaagggggatggcaaggaatggtagatggatggtacggataccaccactcaaacgaacagggatcaggatacgcagcagacaaagaatccacacaaaaggcaatagatggtgtaacaaacaaagtaaactcaattatagacaaaatgaatacccaattcgaagcagtaggtagagaattcaacaacttagaaagacgaatagaaaacctcaataaaaaaatggaagacggattcctagacgtatggacctacaacgcagaactactagtactaatggaaaacgaaagaacacttgactttcacgactcaaacgtaaaaaacttatacgacaaagtaagactacaattaagagataacgcaaaagaattaggaaacggatgcttcgaattctaccacaaatgcgacaacgaatgcatggaatcagtaagaaatggaacatatgactatccacaatattcagaagaagcaagactaaaaagggaagaaatatcaggagtcaaactcgaatctataggaatatatcaaatcctttccatatactcaacagtcgcatcatctctcgcacttgcaataatggtagcaggactaagcttatggatgtgctcaaatggaagcctacaatgccga

SEQ ID NO: 51257 - RNA, 1695 nt, synthetic construct
  misc_feature 1..1695: note = derived and/or modified sequence opt6 from anti-influenza_Chain
  source 1..1695: mol_type = other RNA
atggagaaaatagtactactatttgcaatagtctcattagtaaaatcagaccaaatatgcatcggctaccacgcaaacaactctaccgaacaagttgacacaataatggaaaaaaacgtaactgtaacacatgctcaagacatactagagaaaacacacaacggaaagctatgcgatctagacggagtaaaaccattaatattaagagactgcagcgtagcaggatggctcttaggcaacccaatgtgtgacgaattcatcaacgtaccagaatggtcatacatagtagaaaaagcaaacccagtaaatgacctatgctatcctggtgatttcaacgattatgaagaactcaaacatctattatccagaataaaccactttgaaaaaatacaaataataccaaaatcatcctggtcaagccacgaagcctcattaggagtaagctcagcatgcccataccaaggtaagagctcattcttcagaaatgtagtatggttaataaaaaaaaacagcacatacccaacaataaaaagatcatacaataacactaaccaagaagacctattagtattatggggaatacaccaccccaacgatgcagcagaacagactaaactatatcaaaacccaacaacatacataagcgtgggaacttcaacattaaaccaaagattagtacctagaatagccacaagatcaaaagtcaatggacagagtggacggatggaattcttctggaccatactaaaaccaaatgacgcaataaatttcgaatctaacggtaatttcattgcaccggaatacgcatataaaatagttaaaaaaggagactcaactataatgaaatcagaattagaatacggaaactgcaacacaaaatgtcaaactccaatgggagcaataaactcatcaatgccatttcacaatatacatccattaactattggagaatgtccaaagtatgtaaaatcaaatcgattagtactagcaacaggcctaagaaactccccacaaagagaaagaagacgaaaaaaaagaggattattcggtgcaatagcaggattcatagaaggaggatggcaaggtatggtagacgggtggtacggatatcaccactcaaacgaacaaggatcaggatatgcagcagacaaagaaagtacccaaaaagcaatagacggcgtaacaaacaaagttaattcaattatagacaaaatgaacacacaattcgaggcagtaggaagagaatttaacaacttagaacgaagaatagaaaatctaaacaaaaaaatggaagatggattcctagatgtatggacatacaacgcagaactgctagtactaatggaaaacgaacgaacattagactttcatgactcaaacgtcaaaaacctatatgacaaagtaagactacaactaagagataatgcaaaagaactcggaaacggatgcttcgaattttatcacaaatgcgacaatgaatgcatggaaagtgtaagaaacggcacatatgactacccacaatacagcgaggaagccagactgaaaagagaagaaatatctggagttaaactcgaatcaatcggaatataccaaattctcagcatatatagtacagtagcttcatcactagcactagcaataatggtagcaggattatccttatggatgtgttcgaacggatccctacaatgtaga

SEQ ID NO: 51258 - RNA, 1695 nt, synthetic construct
  misc_feature 1..1695: note = derived and/or modified sequence opt6 from anti-influenza_Chain
  source 1..1695: mol_type = other RNA
atggaaaaaatagtactactattggcaatagtcagcctagtcaaatcggaccaaatctgcatcggataccacgcaaacaatagcaccgaacaagtagatactataatggaaaaaaacgtaaccgtaacacatgcacaagatatactagaaaaaacacacaacggaaagttatgcgacctagacggagtcaaaccattaattttaagagactgttctgtagcaggatggttactaggcaacccaatgtgcgatgaattcataaatgtaccagaatggtcatatatagtagaaaaagccaacccagctaacgatttatgctatccaggcaatttcaacgattatgaagaactaaaacacttattatcacgaataaaccacttcgaaaaaatacaaataattccaaaatcgagttggtcagaccacgaagcaagcagtggcgtatcatcagcatgcccatatcaaggaaaatcatcattcttccgaaatgtcgtatggttaattaaaaaaaacagttcatatccaacaataaaaagatcatataacaatacaaaccaagaagacctccttgtactatggggcattcaccaccccaacgacgcggctgaacaaacaagactctaccaaaacccaacaacatatattagtgtaggaacaagcaccctaaaccaaagattagttcccaaaatcgccacacgaagcaaagtcaatggacaaagcggaagaatggaatttttttggacaatattaaaaccaaacgatgcaataaacttcgaatcaaatggtaatttcatagccccagaatacgcatataaaatagtcaaaaaaggagattcagcaataatgaaaagcgaactagaatatggaaattgcaacacaaaatgccaaacaccaatgggagcaataaacagtagcatgccatttcacaacatacatccactaacaataggagaatgcccaaaatacgttaaatcaaatagattagtcctagcaacaggattaagaaactcaccacaaagagaacggagacgtaaaaaaagaggtttattcggagcaatagccggatttatagaaggaggctggcaaggtatggtagacggttggtatggctatcaccactcaaacgaacaaggatcaggatatgcagcagacaaggaaagtactcaaaaagcaatagatggagtaaccaacaaagttaattcaataattgacaaaatgaatactcaattcgaagcagtaggcagagaattcaataacctagaaagacgcatagaaaacttaaacaagaaaatggaagatggattcttagacgtatggacatacaacgcagaactcctagtattaatggaaaatgaaaggaccttagactttcacgatagcaacgttaaaaacttatacgataaagtacgactacaactgagagacaatgccaaagaattaggaaatggatgctttgaattttaccacaaatgtgacaatgaatgcatggaatcagtcagaaacggaacgtacgattacccacaatattcagaagaagcaagattaaaaagagaagaaatttcaggagttaaactcgaatcaataggaatttatcaaatcttatcaatatactcaacagttgcatcatcattagctctagctataatggtagccggactatcactatggatgtgtagcaacggaagtttacaatgtcga

SEQ ID NO: 51259 - RNA, 1695 nt, synthetic construct
  misc_feature 1..1695: note = derived and/or modified sequence opt6 from anti-influenza_Chain
  source 1..1695: mol_type = other RNA
atgagcgatagaaggcaaaatagaaaaaccccagatgaacaaagaaaagccaacgcattaataataaatgaaaatattgaagcatacatagcaatatgtaaagaagtaggattaaatggagatgaaatgctaatattagaaaacggaatagcgatagaaaaagcaataaggatatgttgtgatggaaaataccaagaaaaacgagaaaaaaaagctagggaagcacaaagagcagacagtaatttcaacgcagactcaataggaataagactagttaaaagagcgggaagtggtacaaacataacataccacgcagtggtagaacttacatcaagatcacgaatagtacagatattaaaatcacactggggtaatgaattgaacagagcgaaaatagcaggaaaaagactaggatttagcgctttattcgcatcaaatttagaagctataatatatcaaagaggacgaaacgcagcccgtagaaatggatcagcagaattatttacactaacacaaggagcaggaatagaaacaagatataaatggatcatggagaaacacataggcataggagtcttaatagccgatgcaaaaggtctaataaacggcaaaagagaaggtaaacgaggagtagacgcaaatgtaaaattacgagcgggaacaacaggaagtccattagaacgagcaatgcaaggtatagaaaaaaaggcattccctggaccgctaagagcattagcgagaagagttgtaaaagcaaattacaacgatgcacgggaagcactaaatgttatcgcagaagcaagtctattactaaaaccacaaataactaataaaatgacgatgccctggtgcatgtggttagcagctagactaacattaaaagatgaatttgcaaacttctgcgcatatgcaggacgacgtgcctttgaagtatttaacatagcaatggaaaaaataggaatatgctcatttcaaggcacaataatgaacgatgatgaaatagaatcaatagaagataaagcacaagttttaatgatggcgtgctttggattagcatacgaagatttcagtttagtaagcgcaatggtgagtcatccattaaaattaagaaaccgaatgaaaataggaaacttcagagtaggagaaaaagtatcaacagtattaagcccgttactaagattcacacgatgggccgaattcgctcaaagatttgccctacaagcaaatacatcaagagaaggagcacaaataagtaattcagcagtatttgcagttgaaaggaaaataacaactgatgtgcaaagagtagaagaactactaaacaaagtacaagcacatgaagatgaaccgttacaaactctatataaaaaagtaagagaacagatatccataataggtagaaacaaatcagagattaaagaattcctcggtagttcgatgtatgatttaaacgatcaagaaaaacaaaatccaataaatttcaggagtggagcccatccatttttctttgaatttgaccctgattataatcccataagagtaaaaagaccaaaaaaaccaatagcaaaaagaaactcaaatatatcaagactagaagaagaaggaatggacgaaaatagtgaaataggacaagccaaaaaaatgaaacccttagaccaactaacgtcaacaagttcaaatataccagggaaaaat

SEQ ID NO: 51260 - RNA, 1695 nt, synthetic construct
  misc_feature 1..1695: note = derived and/or modified sequence opt6 from anti-influenza_Chain
  source 1..1695: mol_type = other RNA
atgaaagttaaactattagtactattatgcacattcactgcaacatacgcagacacaatctgtatcggatatcatgcaaataactcaaccgacacagtagacacagtactagaaaaaaacgtaacagtcacacactcagtaaacctactagaaaacagtcacaatggtaaattatgcctactcaagggaatagctccactacaactaggaaattgtagtgtcgcaggatggatcttaggtaacccagaatgtgaactactaatatcaaaagaatcatggtcctacatagtagaaaaacctaacccagaaaatggtacatgctaccccggacatttcgcagattatgaagaattaagagaacaactttcttccgtaagttcatttgaaagattcgaaatatttccaaaagaatcatcatggccaaaccacactgtaacaggagtgagcgcatcctgcagccataatggcgaaagttctttctacagaaatttactttggcttactggaaaaaatggactatacccaaacttatcaaaaagttacgcaaataacaaagaaaaagaagtactagtattatggggagtccaccatccaccaaatattggcgaccaaaaagcattatatcatacagaaaatgcatacgtaagtgtagtaagctcacattactcaagaaaattcacaccagaaatagcaaaacgaccaaaagtaagagaccaagaaggcagaattaactaccactggacacttttagaaccaggagatactataatattcgaagcaaacggaaacctaattgcaccaagatacgcattcacattatcgagaggattcggtagcggaataataaactcaaacgcaccaatggacaaatgtgacgcaaaatgtcagacaccccaaggcgcaattaactcaagtctacctttccaaaacgtacaccccgtaactatcggcgaatgtcccaaatacgtaagatcagcaaaactacgtatggtaacaggcttaagaaatataccttcaatacaatcacgcggactattcggcgcaattgctggattcatcgaagggggatggacaggaatggttgatggatggtacggataccatcaccaaaatgaacaaggttcaggatatgcagcagatcaaaaatcaacacaaaacgcaataaacggtataacaaacaaagtaaattcagtaatcgaaaaaatgaatacgcaattcaccgcagtaggaaaagaatttaacaaactcgaaagaagaatggaaaacttaaataaaaaagtagacgacgggttcatagatatatggacctacaacgcagaattactagtattactagaaaacgaaagaaccttagacttccatgactcaaacgtaaaaaacctatatgaaaaagtaaaaagccaactaaaaaataacgcaaaagaaataggaaacggatgctttgaattttaccacaaatgtaacgacgaatgcatggaatcagtcaagaacggaacctatgattaccccaaatactcagaagaaagtaaattaaaccgcgaaaaaatagatggagtaaaattagaatcaatgggagtataccaaatactagcaatatactcaacagtagcatcaagtctggttctactagtatcactaggtgcaatatcattctggatgtgctcaaacggttcattacaatgcagaatctgtata

SEQ ID NO: 51261 - RNA, 1695 nt, synthetic construct
  misc_feature 1..1695: note = derived and/or modified sequence opt6 from anti-influenza_Chain
  source 1..1695: mol_type = other RNA
atgaaagtaaaactattagtattactctgtacattcacagcaacatatgcagacacaatatgcataggatatcatgccaataactcaacagatacagtagacacagtactagaaaaaaatgtaacagtaacgcactcagtaaatcttctagaaaatagtcataacggaaaattatgtctcctaaaaggcatagcaccacttcaattaggaaactgctccgtagcaggatggattcttggaaatccagaatgcgaactactaatatcaaaagaaagttggtcatatatagtcgaaaaacccaacccagagaacggtacttgttaccccggacacttcgccgattatgaagaattgagagaacaattgtcaagtgtatcttcattcgaaagattcgaaatattccccaaagaaagttcctggccaaaccatacagtgacaggagtatcagcatcatgcagccataacggtgaatcatccttctacaggaacctattatggcttacaggaaaaaacggactatacccaaacttaagcaaaagttacgcaaacaataaagaaaaagaagttttagtattatggggagtccaccacccaccaaatataggagatcaaaaaacactataccacacagaaaacgcttacgtctcagttgtcagtagtcattacagcagaaaattcacacccgaaatagcaaaaagaccaaaagtacgcgatcaagaaggaagaataaactactattggacattattagaaccaggcgacacaattatatttgaagcaaatggtaacttaatagcacccagatatgccttcgcactaagtagaggattcggatcaggaattataaactcaaacgcaccaatggacaaatgcgacgcaaaatgccaaacaccacaaggagcaataaactcatctttaccatttcaaaacgtacatccagtaacaatcggagaatgtccgaaatatgtaagatccgcaaaactaagaatggttaccggactaagaaacataccctcaatacaaagtagaggacttttcggagcaatcgcaggcttcatagaaggcggatggacaggaatggtagacggatggtatggttatcaccatcaaaacgaacaaggatcaggatacgcagcagaccaaaaatcaacacaaaatgcaatcaatggaattacaaataaagtaaacagcgtaatcgaaaaaatgaacacacaatttacagctgtaggaaaagaattcaacaaactcgaaagaagaatggaaaacttaaacaaaaaagtagacgatggatttatagacatatggacatacaatgcagaattactagtactcttagagaatgaaagaaccttagattttcacgattcaaatgtaaaaaacctatacgaaaaagtaaaaagccaactcaaaaataacgcaaaagaaataggaaatggatgcttcgaattttatcacaaatgtaacgatgaatgtatggaatcggtaaagaacggaacttacgactatcctaaatacagtgaagaaagtaaactaaacagagaaaaaatagatggtgtaaagctagaaagcatgggtgtatatcaaatactagccatatacagtacagtagctagctcactagtactattagttagcctaggcgcaataagcttctggatgtgctcaaacggatcactacaatgtagaatatgcata

SEQ ID NO: 51262 - RNA, 1695 nt, synthetic construct
  misc_feature 1..1695: note = derived and/or modified sequence opt6 from anti-influenza_Chain
  source 1..1695: mol_type = other RNA
atgaaggtaaaactcttagtcctgctctgcacatttacagctacctacgcagacactatatgcataggatatcacgcaaacaactcaacagacacagtagataccgtactagaaaaaaacgtcacagtaacacattcagtgaacctactagaaaactcacacaatggaaaactatgcctattaaaaggtatagcccctctacaattaggaaattgctcagtagccggatggatactaggaaatccagaatgcgaattattaatatcaaaagaatcatggtcatacatagtcgaaaaaccaaacccagaaaacggcacatgctacccaggacacttcgcagattacgaagaactaagagagcaactaagctcagtttcaagttttgaacgatttgaaatattcccaaaagaatcttcatggccaaaccacacagtaaccggagtatccgcatcatgctcacacaatggagaatcaagtttttacagaaatttattatggctcacaggaaaaaatggattatatccaaacttatcaaaaagttacgcaaataataaagaaaaagaagtacttgtactatggggagtccaccacccaccagacataggagatcaaaaaacactttatcacacagaaaacgcatacgtctcagtagtttcatcacactatagccgaaaattcaccccagaaatagccaaaagacccaaagtaagagatcaagaaggaagaattaactattactggaccctattagaacccggcgatacaataatatttgaagcaaatggcaacttaatagcacccagatacgcattcgcattatcacgaggatttggaagtggtataattaattcaaatgcaccaatggacaaatgtgatgcaaaatgtcagacaccacaaggagcaataaacagcagcctcccctttcaaaatgtacaccctgtaactataggagaatgtccgaaatacgttagatcagcaaaattacgaatggtcacaggactcagaaacataccaagtatacaatctagaggactcttcggtgcgatagcaggattcattgaaggtggctggacaggaatggtagacggatggtatggatatcatcaccaaaatgaacaaggatcaggatatgcagccgaccaaaaaagtactcaaaatgcaataaatggaatcacaaacaaagtcaatagtgtaatagaaaaaatgaatacacaattcacagcagttggaaaagaatttaataaactagaaagaagaatggaaaaccttaacaaaaaagtagacgacggcttcatagacatatggacttataatgccgaactactagtcctattagaaaatgaaagaacactagatttccacgattcaaacgtcaaaaacctatacgaaaaagtcaaatcacaactaaaaaataatgcaaaagaaataggcaacggatgtttcgaattctatcataaatgtaacgatgaatgcatggaatcagtaaaaaacggcacatacgactacccaaaatacagtgaagaatcaaaactaaaccgagaaaaaatagacggagtaaaactagaatcaatgggcgtataccaaattctagctatatactcaacagtagcaagcagcttagtactattagtatcactaggagcaataagcttctggatgtgcagcaacggctcacttcaatgcagaatctgcatc

SEQ ID NO: 51263 - RNA, 1695 nt, synthetic construct
  misc_feature 1..1695: note = derived and/or modified sequence opt6 from anti-influenza_Chain
  source 1..1695: mol_type = other RNA
atgaaagtaaaactattagtactcctatgtacattcacagcaacatacgctgacaccatatgtataggatatcacgcaaacaatagcacagataccgtagacacagtcctagaaaagaatgtaacagtcacacatagtgtaaatttacttgaaaactcccacaacggaaaactatgtctattaaaaggcatcgcacccctacaattaggcaactgctcagtagccggttggatattaggcaacccagaatgcgaactattaatctctaaagaatcatggagctacatagtagaaaaacctaacccagaaaacggcacatgctacccaggccacttcgcagactacgaagaactaagggaacaattatcatcagtatcatcttttgaaagatttgaaatattcccaaaagaatcttcatggccaaaccatacagtaacaggagtatcagcaagctgctcacataatggagaaagttctttctacagaaatttactatggttaacaggcaaaaatggactataccctaatctatcaaaatcatacgctaacaataaagaaaaagaagtcctagtcttatggggagtacaccatcccccaaacataggagaccaaaaagcattataccatacagaaaatgcatatgtatcagtagtaagttcacactatagccgtaaatttacaccagaaatagcaaaacgtcctaaagtaagggatcaagaaggaagaataaattattactggacactactagaaccaggggatacaataatatttgaagcaaatggcaacctgatagccccaagatacgcatttgcactttcacgaggatttggatccggaataataaacagcaatgcaccaatggacaaatgtgacgcaaaatgccaaaccccacaaggagcaataaattcctcactaccattccaaaacgttcatccagtaacaataggagaatgcccaaaatacgtacgaagcgcaaaattaagaatggtcaccggactcagaaatattccatccatacaatcacgtggactattcggagctattgcaggattcatagaaggaggttggacaggaatggtagacggttggtacggctaccatcaccaaaatgaacaaggctcaggatacgcagcagaccaaaagagcacacaaaacgccatcaacggaataacaaacaaagtaaatagtgtaatagagaaaatgaatacgcaattcacagcagtcggaaaagaatttaacaaactagaaagaagaatggaaaacttaaacaagaaagtagacgatggcttcatagatatatggacatacaacgcagaattattagtactactagaaaatgaaagaacattagacttccatgattcaaatgttaaaaacctctacgaaaaagtaaaaagtcaacttaaaaataacgcaaaagaaataggaaacggatgcttcgaattttaccacaaatgcaacgacgaatgcatggaatcagtcaaaaatggcacatatgattatccaaaatacagtgaagaatcaaaactaaatagagagaaaatagacggagtaaaactagaaagtatgggcgtataccaaatacttgcaatctatagcacagtagcatcatcattagtactattagtaagtctaggggcaatcagcttctggatgtgcagtaacggttccttacaatgcagaatatgcata

SEQ ID NO: 51264 - RNA, 1695 nt, synthetic construct
  misc_feature 1..1695: note = derived and/or modified sequence opt6 from anti-influenza_Chain
  source 1..1695: mol_type = other RNA
atgaaagcaaaactcctagttctactatgcacctttacagcgacatacgcagacaccatatgtataggttaccatgcaaacaactcaacagatacagtagacacagtacttgaaaaaaatgtaactgtaacacactcagtaaacctactagaagacagccataatggaaaattatgtctattaaaaggaatagcaccactacaactaggaaattgttcagtagcaggttggatcctcggaaacccagaatgcgaattattaatatccaaagaatcatggtcttacatagtcgaaaccccaaatcctgaaaatggaacctgttacccaggatactttgcagactacgaagaactacgagaacaactttcatctgtttccagttttgaacgattcgaaatcttcccaaaagaatcaagctggccaaaccacacagtaacaggagtatcagcatcatgctcacacaatggtaaatcctcattctacagaaacttattatggttaactggtaagaacggattatatccaaatttatcaaaatcctacgtaaacaacaaagaaaaagaagtattagtattatggggagtccatcacccaccaaacattggaaatcaacgcgcactttaccatacagaaaacgcatatgtgtcagtagtaagcagccactactcacgaagattcactccagaaatagcaaaaagaccaaaagtaagagaccaagaaggaagaatcaactactactggaccttactagaaccaggcgacacaataatattcgaagcaaatggtaacctaatagcaccatggtatgcattcgctctatctcgaggctttggaagcggaataataacctcaaatgcacccatggacgaatgcgatgccaaatgtcaaacaccacaaggagcaataaacagctcactgccttttcaaaacgtccacccagtcacaataggagaatgccctaaatacgtcagatcagcaaaacttagaatggtaacaggactacgaaatataccatcaatacaatctcgaggacttttcggcgccatagcaggcttcatagaaggaggctggacaggaatggtagacggatggtacggataccaccatcaaaacgaacaaggatccggttatgccgcagaccaaaaaagtacacaaaacgcaataaacggaataactaataaagtaaatagcgtcatagaaaaaatgaacacacaatttacagcagttggaaaagaatttaacaaattagaaaggagaatggaaaatctaaataaaaaagtagatgacggatttttagacatatggacatataacgcagaattactagtccttctagaaaacgaacgaacgctagacttccatgacagtaacgtaaaaaacctatacgaaaaagttaaatcacaattaaaaaacaacgcaaaagaaataggcaatggatgcttcgaattttaccacaaatgtaacaacgaatgcatggaaagtgtaaaaaacggaacctacgactatccaaaatactcagaagaaagcaaactaaatagagaaaaaatagatggagttaaactagaatctatgggagtataccaaatattagcaatatacagcacggtagcaagcagtttagtacttctagtttcactaggagccataagcttctggatgtgctcaaatggatcattacaatgtagaatatgcata

SEQ ID NO: 51265 - RNA, 1695 nt, synthetic construct
  misc_feature 1..1695: note = derived and/or modified sequence opt6 from anti-influenza_Chain
  source 1..1695: mol_type = other RNA
atgaaagtaaaactattggtactattatgtactttcacagcaacatatgcagacacaatatgcattggataccacgcaaataatagtacagacaccgtcgacacagtcctagaaaaaaacgtaacagtaacacatagcgtcaacctattagaagactcacataacggaaaattatgcttattaaaaggaatagcaccattacagttaggaaattgcagcgtagccggttggatcttaggaaacccagaatgtgaactactcatcagtagagaaagttggagctacattgttgaaaaaccaaacccagagaatggaacatgttatccaggtcacttcgcagattacgaagaactaagagaacaactatcatcagtatcatcatttgaaagatttgaaatatttcccaaagaatcaagctggccaaaccatacaacaacaggcgtaagcgcatcatgctcccataacggagaatcaagtttttataaaaacttattatggctaacaggaaaaaacggactatacccaaacctatccaaatcatacgcaaataacaaagaaaaagaagtattagtattatggggagttcatcacccaccaaatataggagaccaaagagcactgtaccacaaagaaaatgcctacgtaagtgttgtctcatcacattattccaggaaattcacgccagaaatagccaaaagaccaaaagtccgagaccaagaaggcagaataaattactattggacactcttagaaccaggagataccataatattcgaagcaaacggaaacctaatagcaccaagatacgcattcgcacttagtagaggattcggcagcggaataattaactcgaatgcaccaatggatgaatgtgacgcaaaatgccaaacaccacaaggggcaataaattcaagcctaccttttcaaaatgtacaccccgtcacaataggagaatgtcctaaatatgtcaggtccgcaaaacttcgaatggttacaggattaagaaacattccaagcatccaaagtagaggtttatttggagccattgcaggatttatagaaggaggatggactggaatggtggatggatggtatggataccaccaccaaaatgaacaaggctcaggatacgcagccgaccaaaaatcaacacaaaatgcaataaacggtataacaaacaaagtaaattcagtcatagaaaaaatgaatacacaatttacagcagtaggcaaagaattcaataaattagaacgacgaatggaaaacctaaataaaaaagtagacgacggattcatagacatttggacatacaatgcagaactactagttctactagagaacgaaagaacactagatttccacgattcaaatgtaaaaaatctatatgagaaagtaaaaagtcaactaaaaaacaacgcaaaagaaataggaaacggatgcttcgaattctatcataaatgcaacgacgaatgtatggaatcagtcaaaaacggtacatatgattacccaaaatactctgaagaaagtaaactcaacagagaaaaaatagacggagtaaaactagaaagtatgggagtataccaaatattagccatatacagtacagtagcatcgtccctagtactactcgtaagcttaggtgcaataagtttttggatgtgcagtaacggaagtttacaatgtagaatatgtatc

SEQ ID NO: 51266 - RNA, 1677 nt, synthetic construct
  misc_feature 1..1677: note = derived and/or modified sequence opt6 from anti-influenza_Chain
  source 1..1677: mol_type = other RNA
gataaaatatgcataggctaccaatctacaaattcaactgaaacagtagataccctaacaaaaaccaatgtaccagtaacacaagctaaagaactattacatacagaacataacggaatgctatgcgcaacaaatctaggacacccactaatactcgatacgtgtacaattgaaggattaatatacggtaatccttcatgcgatttattattaggtggaagagaatggagttatatagtagaaagaccatcagcagtaaatggaatgtgctacccaggaaacgttgaaaacttagaagaattaagactactattttcttcagcatcaagctatcaaagggtccaaatatttccagatacaatatggaatgttacctattcaggaacatctagcgcatgcagtaactcattttatcgatcaatgagatggctaacacaaaaagataacacatacccagtacaagacgcacaatatactaacaacagagggaaatcaatactatttatgtggggtataaaccacccacccacagacactgtccaaacaaatctctatactagaacagacacaacaacctcagtaacaactgaagacataaaccgagcattcaaaccagtaataggaccaagaccattagtcaacggactacaaggaagaatagactactattggagtgtattaaaaccaggacaaaccttaagagtaagatcaaatgggaacctcatagcaccatggtacggccatatattaagcggagaaagtcatggaagaatactaaaatcagacctaaacagtggaaattgcgttgtacaatgtcaaactgaacgaggaggactaaatacaacactaccattccacaatgtcagtaaatacgcatttggaaattgtcctaaatacgtcggtgtaaaaagtctaaaattagcagttggaatgagaaatgtaccagcacgaagctcaagaggcttatttggtgcaatagcgggatttatagaaggaggatggccaggattagtcgcaggatggtatggattccaacatagcaatgaccaaggtgtaggaatggccgctgaccgagactcaacacaaaaagcaattgacaaaatcacatcaaaagtaaacaatatagtagataaaatgaacaaacaatacgaaataatagaccacgagttcagtgaaatagaaacaagattaaatatgataaacaacaaaatagacgaccaaatacaagacatatgggcttacaatgcagaattattagttcttctagaaaaccaaaagacactcgatgaacatgacgctaatgtaaataacctatataacaaagtcaaaagagccttaggatcaaacgcaatggaagatggaaaaggatgctttgaactatatcacaaatgcgacgatagatgtatggaaactatcagaaatggaacctacaatcgaggaaaatacaaagaagaaagtagattagaaagacagaaaattgaaggtgtaaaactagaatcagaaggaacatacaaatcaggaagacttgtgcctagaggatcaccaggatcaggatatataccagaagctcccagagacggacaagcatatgtaaggaaagacggagaatgggtactattaagtaccttcctaggaaaaccaataccaaacccattacttggattagatagtacaggc

SEQ ID NO: 51267 - RNA, 1677 nt, synthetic construct
  misc_feature 1..1677: note = derived and/or modified sequence opt6 from anti-influenza_Chain
  source 1..1677: mol_type = other RNA
gacaaaatatgtattgggtaccaatccactaattccacagagacagtagatacattaaccaaaacaaacgtacctgtaacacaagcaaaagaattactacacacagaacataatggaatgctttgcgcaacaaatttaggccacccactaatacttgatacatgtacaatagaaggactaatatacggaaacccaagttgtgatctattactcggaggaagagaatggtcatatatagtagaaagacccagtgcagtaaatggcatgtgctacccaggaaacgtcgaaaacctagaggaactccgactattattttcttcggcgtcaagctatcaaagagttcaaatatttcctgacacaatatggaatgtaacttattcaggcacatcatcagcatgttcaaactcattttacagatcaatgcgatggctgacacaaaaagacaatacttatccagtacaagacgcacagtataccaataacagaggaaaatctattctatttatgtggggaatcaaccacccaccaacagacaccgttcaaacaaacctatacacaaggacagacactacaacatctgtaacaacagaagacattaaccgagctttcaaaccagttataggcccaagacccttagttaacggattacaaggtagaatcgactactactggtcagtactaaaacccggacaaacattaagagtacgaagcaatggaaatctaatagcaccatggtatggacacatactatctggagaatcccacggaagaatattaaaaagcgacctcaactcaggaaactgtgttgtacaatgtcaaacagaaagaggaggactaaacacaacactaccattccataacgtatctaaatatgcctttggaaactgccctaaatatgtaggtgtaaaatcattaaaattagcagtaggaatgagaaacgttcctgccagatccagtagaggattattcggagcaatagcaggcttcattgagggaggatggccaggactagtagcaggatggtacggattccaacacagtaacgatcaaggagtaggaatggcagcagaccgcgattccacacaaaaagcaatagataaaataacatcaaaagtaaataatatagtagacaaaatgaacaaacaatacgaaattattgaccacgaattctctgaaatagaaacaagattaaatatgataaataataaaatagatgaccaaatccaagatatatgggcctacaacgcagaactattagtattattagagaaccaaaaaactttagatgaacatgatgcaaatgtaaacaacttatacaacaaagtaaaacgagccttaggatctaacgcaatggaagacggtaaaggatgcttcgaattataccacaaatgtgatgacagatgcatggaaacaattagaaatggaacatacaacaggggtaaatacaaagaagaatcaagactagaaagacaaaaaatagaaggcgtaaaactagaaagtgaaggaacatacaaaagtggaagattagttccacgaggaagcccaggtagtggttacataccagaagcaccaagagacggacaagcttacgtacgtaaagatggagaatgggtattattatcaacatttctaggaaaaccaataccaaacccattactaggattagacagtactgga

SEQ ID NO: 51268 - RNA, 1695 nt, synthetic construct
  misc_feature 1..1695: note = derived and/or modified sequence opt6 from anti-influenza_Chain
  source 1..1695: mol_type = other RNA
atgagtgacaggagacaaaacagaaaaacaccagacgaacaaagaaaagcaaacgcactaataataaatgaaaatattgaagcatatatagcaatatgtaaagaagtaggtctaaatggtgatgagatgcttatactagaaaacggcatagcgatagaaaaagctataagaatctgttgtgatggaaaataccaagaaaaacgagaaaaaaaagctcgcgaagcacaaagagcagatagcaatttcaatgcagacagcataggaataagattagtaaaaagagcaggatcaggaactaacataacttaccacgctgtcgttgaattgacaagtagatcaagaatagtccaaatacttaaatcacattggggcaacgaacttaacagagcaaaaatagcagggaaacgattaggatttagtgcactcttcgcatcgaacttagaagcaataatttaccaaagaggaagaaatgcagcgagaagaaacgggagcgcggaactgttcacattaacacaaggagcagggatcgaaacaagatataaatggataatggaaaaacatataggaataggagtactaatagcagacgcaaaaggactaataaatggaaaacgagaaggaaaaagaggagtagatgcaaacgtaaaacttagggcaggaacaactggatcaccccttgagagagcgatgcaaggaatagaaaaaaaagcattcccgggtccgctaagagcattagccagaagagtagttaaagctaattataatgacgccagagaagcattgaatgttatagcagaagctagcttgcttttaaaaccacaaattacaaataaaatgacaatgccatggtgcatgtggttagctgcaagactaacattaaaagacgaatttgcaaatttctgtgcatacgcaggaagaagagcatttgaagtattcaatatagcaatggaaaaaatcggaatatgctcattccagggaactataatgaacgacgatgaaatagaaagtattgaagacaaagcacaagttctaatgatggcatgttttggtttagcgtacgaagattttagcctagtaagtgctatggtaagtcatccattaaaactaagaaacaggatgaaaataggcaacttcagagtaggggaaaaagtaagcacagtattaagccctttactcagattcacaagatgggcagaatttgcacaaagattcgcactccaagcaaacacaagtagggaaggagcccaaataagcaattcagcggtattcgcagtagaaagaaaaataacaacagacgttcaaagagtagaagaactgctaaacaaagtacaagcccacgaggatgagccattacaaacactatataaaaaagtaagagaacaaataagtataataggacgaaacaaaagtgaaataaaagaattcttagggagttcaatgtatgatttaaacgatcaagaaaaacaaaacccgataaatttcaggtcaggggcccatccattcttctttgaatttgacccagactataaccccataagagtaaaacgaccaaaaaaacccatagccaaaagaaatagtaatataagtaggttagaagaagaaggaatggatgaaaatagcgaaataggacaagcaaaaaaaatgaagccactagaccaactaacttccacatcatcaaacattccaggaaaaaat

SEQ ID NO: 51269 - RNA, 1695 nt, synthetic construct
  misc_feature 1..1695: note = derived and/or modified sequence opt6 from anti-influenza_Chain
  source 1..1695: mol_type = other RNA
atggaaaaaatagttttattatttgcaatagtatccctggtaaaatcagaccaaatatgcattggctaccacgcaaacaatagtaccgaacaagtagataccattatggaaaaaaatgtaacagtaacacacgcacaagacatactagaaaaaaaacacaatggaaaactatgcgacttagacggagtaaaaccactcatactaagagattgttccgtagcaggatggctccttggcaacccaatgtgcgatgaattcataaacgtaccagaatggtcttacatcgtagaaaaagcaaatccagtaaacgacttatgttatcctggagacttcaatgactacgaagaattaaaacatctattaagtagaataaatcacttcgaaaaaatacaaataataccaaaaagcagctggtcttcacatgaagcttcactaggagtctcaagcgcatgcccatatcaaggaaaaagttctttctttagaaacgtagtctggttaataaaaaaaaactctacctaccctacaataaaaagatcatacaataatacaaaccaagaagatcttttagtactctggggaattcatcacccaaatgatgcggcagaacaaacaaaactatatcaaaatccaacaacatatatatcagtaggaacatcaacattaaaccaacgattagtaccaagaattgccactagaagcaaagtaaacggacaaagcggacgaatggaatttttctggacaatcttaaaaccaaacgacgccataaacttcgaatcaaacggaaacttcatagcaccagaatatgcgtataaaatagtcaaaaaaggtgactcaacaataatgaaatctgaattagaatacggaaactgtaatacaaaatgtcaaacaccgatgggagcaataaacagctcaatgccttttcataatatacatccactaacaataggagaatgtcctaaatacgtaaaaagcaacagactagtcttagctacaggattaagaaactcaccacaaagagaaagaagacgaaaaaaaagaggactatttggagcaatagccggattcatagaaggaggatggcaaggaatggtagacgggtggtatggataccatcatagtaacgaacaaggctcaggatacgcagcagacaaggaaagcacacaaaaagccatagacggagtaaccaataaagtaaactcaataatagacaaaatgaatacacaattcgaagccgtaggcagagaatttaacaacttagaaagaagaatagaaaacttaaacaagaaaatggaagatggattcttagacgtgtggacatataatgcagaattactcgtactcatggaaaacgaacgaacattagatttccacgatagcaacgtaaaaaacctatatgacaaagttagactccaactaagagataacgcaaaagaattaggaaatggatgctttgaattttaccataaatgcgacaacgaatgcatggaatctgtacgaaatggcacatacgactatccacaatacagcgaagaagcaagactaaaaagagaagaaatatcaggagtaaaattagaaagcatcggaatttaccaaatactatcaatctactcaactgtagcatcatcattagctttagcaataatggtagcaggactaagcctatggatgtgtagcaacggatcattacaatgcaga

SEQ ID NO: 51270 - RNA, 1695 nt, synthetic construct
  misc_feature 1..1695: note = derived and/or modified sequence opt6 from anti-influenza_Chain
  source 1..1695: mol_type = other RNA
atggaaaaaatagtactattattcgcaatcgtctcactagtaaaatcagaccaaatatgtatcggataccatgcaaacaactcaacagaacaagtagacacaatcatggaaaaaaatgtaacagttacacatgcccaagacatactagaaaaaacacataacggaaaactatgtgacctagatggcgttaaacctctaatattacgagactgctcagtagcaggatggctattaggtaatccaatgtgcgacgaatttataaacgtaccagaatggagctacatcgtagaaaaagcaaaccccgtgaacgacctatgctacccaggagatttcaacgactatgaagaattaaaacatctgttatcaagaataaatcattttgaaaaaatacaaataataccaaaatcatcatggtcaagccacgaagcaagcttaggcgtaagctcagcctgcccctaccaaggaaagtcatcattcttccgaaacgtagtatggctgataaaaaaaaactcaacatatccaacaatcaagcgctcatacaacaacacaaaccaagaagacctattagtattatggggaatacatcacccaaatgacgcagccgaacaaacaaaattataccaaaacccaacaacctatataagcgtaggtacaagcacattaaaccaacgactagtacccagaattgcaacaagaagcaaagtcaacggacaatcaggaagaatggaatttttctggacaatactaaagcccaatgacgcaataaacttcgaatccaacggaaattttatagccccagaatacgcatacaaaatagtaaaaaaaggagactctactataatgaaatcagaattggaatacggaaattgtaatacaaaatgccaaacaccaatgggtgcaatcaactcaagcatgccattccataacatccacccattaacaataggagaatgccccaaatacgttaagagtaacagattagtactagccactggactaaggaactcacctcaaagagaaagacgaagaaaaaaacgaggattatttggagcaatagcaggattcatagaaggaggatggcaaggaatggtagacggatggtatggataccaccacagcaacgaacaaggatcaggctacgccgcagacaaagaatcaacacaaaaagcaatagacggtgtaaccaataaagtaaattctattatagataaaatgaacacacaatttgaagccgtaggtagagaattcaacaatctcgaacgaaggatagaaaacttgaataaaaaaatggaagacggatttctagatgtttggacatataacgcagaactattagttcttatggaaaatgaaagaaccttagacttccacgattcaaacgtaaaaaacctatacgacaaagtaagactacaactacgagacaacgccaaagaactaggaaacggatgcttcgaattttatcacaaatgtgataatgaatgtatggaatcagtaagaaatggaacatacgattatccacaatatagtgaagaagcgagattaaaaagagaagaaatatcaggagtcaaactagaatcaatcggaatctaccaaatactaagtatctattcaacagtcgcatcatcactagcactagccattatggtagcaggactatcactatggatgtgctctaatggatcactgcaatgtaga

SEQ ID NO: 51271 - RNA, 1695 nt, synthetic construct
  misc_feature 1..1695: note = derived and/or modified sequence opt6 from anti-influenza_Chain
  source 1..1695: mol_type = other RNA
atggaaaaaatcgtattattattagcaatagtaagtttagtaaaaagtgaccagatatgcataggataccatgccaacaacagcactgaacaagtagacacaataatggaaaaaaacgtaactgtaacacatgcacaagatatactagaaaaaacacacaatggaaaactatgtgacctagacggagttaaaccactaatattacgagattgctcagtagcgggatggttactaggaaacccaatgtgtgatgaattcataaatgtcccagaatggagttacatagtagaaaaagcaaaccccgcaaacgatctatgctacccaggaaatttcaatgactatgaagaattaaaacatcttctatccagaattaaccatttcgaaaaaatacaaataataccaaaatcatcatggtccgatcacgaagcaagcagtggagtaagctcagcttgtccttatcaaggtaaaagttcattttttagaaatgtcgtatggttaataaaaaaaaattcatcatacccaacaataaaaagatcatataataatacaaatcaagaagacttgctagtattatggggtatacaccacccaaacgacgctgcagaacaaaccagactctaccaaaacccaacaacatacataagcgtaggtacatcaactctaaaccaacgactcgtgccaaagatagcaacaagatcaaaagtaaatggccagtcaggaagaatggaattcttctggacaatactcaaaccaaacgacgccataaactttgaatcaaacggaaacttcatagcaccagaatatgcttacaaaattgtaaaaaaaggagatagcgcaataatgaaaagcgaactagaatatggaaactgtaacacaaaatgtcaaacacccatgggagcaattaatagcagcatgccattccacaacatacatccactcacaataggagaatgtccaaaatatgtaaaatcaaacagattagtactagccacaggactcagaaactcaccacagagagaaaggagaagaaaaaaaagaggtctatttggtgcaatagcaggattcatagaaggcggatggcaaggaatggttgacggatggtatggataccatcactcaaacgaacaaggatcaggatacgctgcagacaaagaatcaacacaaaaagccatagatggagtaacaaataaagtaaactctataatagataagatgaatacacaatttgaagcagtaggacgagaatttaacaatctagagagaagaatagaaaacctaaacaaaaaaatggaagatggcttcttagatgtatggacttacaacgctgaactactagtattaatggaaaatgaaagaacattagattttcatgactcaaacgtcaaaaacttatacgacaaagtgagacttcaactaagagataacgccaaagaactaggaaatggatgtttcgaattctatcacaaatgcgacaacgaatgcatggaatcagtaagaaacggaacatatgactacccacaatattcagaagaagcaagactaaaaagagaagaaatttctggagtaaaattagaaagcataggcatctaccaaatattgtctatatattcaacagttgcatcaagcttggcattagctataatggtagcaggacttagcttatggatgtgctcgaacggtagtctacaatgtcga

SEQ ID NO: 51272 - RNA, 1695 nt, synthetic construct
  misc_feature 1..1695: note = derived and/or modified sequence opt6 from anti-influenza_Chain
  source 1..1695: mol_type = other RNA
atgaaagtaaaattactagtactcctctgtacattcaccgcaacctacgcagacaccatatgcataggctatcatgcaaacaactcaactgatacagtagacacagtactagaaaaaaacgtaaccgtaacacattcagtaaacttactagaaaacagccacaacggaaaactatgcctactaaaaggcatagcaccacttcaattaggaaactgtagcgtagccggatggattctaggaaatccggaatgcgaattgctaatcagcaaagaatcctggagttatatagtcgaaaaaccaaacccagaaaatggaacatgctatccaggacatttcgcagactatgaagaactaagagaacaactaagtagtgtatcatcattcgaaagatttgaaatattcccaaaagaatcatcttggcccaaccacacagtaacaggcgtgagcgcaagctgctcccataacggagaatcttcattttacagaaatctactatggctaacaggaaaaaatggattataccccaacttaagtaaatcatatgcaaacaataaagaaaaagaagtactcgtattatggggagtacaccatccacccaacatcggagatcaaaaagctctatatcacacggaaaatgcatacgtatcagttgtaagctcacattactcaagaaaattcaccccagaaatcgcaaaacgaccaaaagtaagagaccaagaaggaagaatcaattatcactggacattattagaacccggagacacaataatatttgaagccaacggcaacctaatagccccccgatacgcatttacactatcaagaggatttggctcaggcataataaatagcaatgcacctatggataaatgcgatgcaaaatgtcaaacaccccaaggagcaataaattcaagcctaccattccaaaacgtccaccctgtaacaattggtgaatgtcccaagtatgtacgatcagcaaaattacgaatggttacaggacttagaaacatcccaagcatacaatcgagaggactttttggagcaatagcaggcttcatagaaggaggatggacaggaatggtagacggatggtacggataccatcatcaaaacgaacaaggaagtggatatgccgcagatcaaaaaagtacgcaaaacgcaataaatggaatcacaaacaaagtaaattcagtaattgaaaaaatgaatacacaattcactgcagtaggcaaagaattcaacaaactagaacgtagaatggaaaacttaaacaaaaaagtcgacgacggattcatagacatatggacatacaatgcagaactactagtactactagaaaacgaaagaacacttgactttcacgacagcaacgtaaaaaatttatacgaaaaagtaaaatcacaactaaaaaacaatgcaaaagaaataggaaacggctgcttcgaattttaccacaaatgcaacgatgaatgtatggaatcagtaaaaaatggcacatacgattatccaaagtattccgaagaaagcaaactaaatagagagaaaattgacggagtaaaattagaaagtatgggagtataccaaatactagcaatatactccacagttgcatcatcactagtattactcgtaagcctaggggcaataagcttctggatgtgtagcaacggttcattgcaatgtagaatctgcata

SEQ ID NO: 51273 - RNA, 1695 nt, synthetic construct
  misc_feature 1..1695: note = derived and/or modified sequence opt6 from anti-influenza_Chain
  source 1..1695: mol_type = other RNA
atgaaagttaaactcctagtattattatgtactttcacagcaacatacgcagacacaatatgtataggataccatgccaacaattcaacagacacagtcgacaccgtcctagaaaaaaacgtaaccgtaacacactcagtaaacctattagaaaactcacacaacggtaaactatgtctactaaaaggaatagccccattacaattaggaaactgctccgtagcaggatggatactaggcaatccagaatgtgaactattaatatccaaagaatcatggtcatacatagtagaaaaaccaaatcccgaaaacggaacatgctatcccggacacttcgcagattacgaagaattacgagaacaattatcttccgtaagtagcttcgaaagatttgaaatattccctaaagaatcatcctggccaaaccacacagtcacaggagtaagcgcttcatgtagccacaatggagaatccagtttctaccgaaacctcctatggctaacaggaaaaaacggactatatccaaacctctcaaaatcatacgcgaacaacaaagaaaaagaagtactagtattatggggagtacaccatcccccaaacatcggagaccaaaaaacactatatcacactgaaaatgcatatgtatcagtagtctcatcccattacagtagaaaattcacacccgaaatagccaaaagaccaaaagtacgagatcaagaaggaagaataaattattactggacattactagaaccaggagacacaataatttttgaagcaaacggaaatctaatcgcaccaagatatgcttttgctttaagcagaggatttggatcaggaataataaacagcaacgcaccaatggacaaatgcgacgccaaatgtcaaacaccacaaggagcaataaatagtagcctaccatttcaaaatgtacaccccgtaacaataggcgaatgtcctaaatatgtaagatcagcaaaattacgaatggtaaccggattacgaaacataccatcaatccaaagcaggggactatttggagcaatagctggattcatagaaggcggatggacagggatggtcgacggatggtacggatatcaccatcaaaacgaacaaggatcaggatacgcagccgatcaaaaaagtacgcaaaacgcaataaatggaataacaaacaaagtcaatagcgtaatagaaaaaatgaacacacaattcacagcagtaggaaaagaattcaataaattagaaagaagaatggaaaaccttaacaaaaaagttgacgacggcttcatagacatctggacatataacgccgaactactagtcctattagaaaatgaaagaactttagactttcatgactcaaacgtgaaaaacttatatgaaaaagtaaaatcacaactaaaaaataatgcaaaagaaataggaaatggctgcttcgaattctaccataagtgcaacgacgaatgcatggaatcagtaaaaaacggaacttacgattacccaaaatactcagaagaatcaaaactcaatagagaaaaaatcgacggagtaaaactagaatcaatgggagtttatcaaatattggcaatatactctacggtagcctcatctttagtactacttgtgtcactaggagcaatctcattttggatgtgttcaaacggatcattacaatgcagaatatgcata

SEQ ID NO: 51274 - RNA, 1695 nt, synthetic construct
  misc_feature 1..1695: note = derived and/or modified sequence opt6 from anti-influenza_Chain
  source 1..1695: mol_type = other RNA
atgaaagtaaaacttttagtgctactatgcacatttacagcaacatatgcagatacaatatgcataggctatcacgccaacaattccacagacaccgtagacactgtactagaaaaaaacgtaaccgtaacacacagtgtaaacttattagaaaacagtcataacggtaaactatgcctactaaaaggaatagctccattacaattaggaaactgttcagtagctggctggatactagggaatccagaatgcgaactactaatatcaaaagaatcatggtcatatatagtcgaaaaaccaaatccagaaaacggtacatgctacccaggacattttgcagattatgaagaactaagagaacaactatcatcagtatcaagttttgaaagattcgaaatattcccgaaagaatcaagctggcccaaccacacagtaacaggcgtaagtgcatcatgctcacacaacggcgaatcatcattctaccgaaacctactatggttaacaggcaaaaacggactttacccaaacttaagtaaatcctacgccaataacaaagaaaaagaagtattagtactatggggtgtacatcaccctccagatataggagatcaaaaaacactctatcataccgaaaacgcttacgtatcagtagtttcatcacattactcacgcaaattcacccctgaaatagcaaaaagaccaaaagtaagagaccaagaaggtcgaataaactactactggactttactcgaaccaggcgatacaatcattttcgaagcaaatggaaaccttatcgcgccaagatacgccttcgccctatctagaggtttcggaagtggaataataaactcaaacgcaccaatggacaaatgtgatgctaaatgccaaacaccacaaggagcaataaattcttccttaccatttcaaaacgttcacccagtaacaataggagaatgcccaaaatacgtaagatccgcaaaacttcgaatggtaacaggcctaagaaacataccatctatacaaagtcgaggattatttggtgcaatagcaggatttatagaaggaggatggacaggaatggtagacggatggtatggttatcaccaccaaaacgaacaaggatcaggctacgcagcagaccaaaaaagcacccaaaatgccataaatggaataacaaacaaagtaaactccgtaatagaaaaaatgaatacacaattcacagccgttggaaaagaatttaacaaattagaaagaagaatggaaaacttaaataaaaaagtagacgatggattcatagacatatggacatacaacgcagaattattagtattactagaaaacgaacgaacactagacttccacgactcaaatgtaaaaaatctatatgaaaaagtcaaaagccaactaaaaaacaacgccaaagagataggaaacggatgtttcgaattctatcataaatgtaacgacgaatgtatggaaagcgtaaaaaatggaacatacgactacccaaaatactcagaagagtcaaaacttaatagagaaaaaatcgatggagtaaaactagaaagtatgggagtataccaaatactagctatctattcaactgtagcatctagtttagtattactagtaagcctgggagcaatatcattctggatgtgcagtaacggctcactccaatgccgaatatgcata

SEQ ID NO: 51275 - RNA, 1695 nt, synthetic construct
  misc_feature 1..1695: note = derived and/or modified sequence opt6 from anti-influenza_Chain
  source 1..1695: mol_type = other RNA
atgaaagtaaaactattagtacttctttgcacatttacagcaacatacgcagacacaatatgcataggctatcacgcaaacaattccacagacacagtcgacacagtattagaaaaaaacgtaactgtaacacattcagtaaatttattggaaaacagtcataacggtaaattatgcttactaaaaggaatagcaccacttcaattaggaaactgcagtgtagcgggatggattttaggaaacccagaatgtgaattactaataagtaaagaatcatggtcttatatcgttgaaaaacctaatcccgaaaatggaacatgttaccccggacacttcgcagactacgaagaattaagagaacaactaagtagtgtaagctcattcgaaagattcgaaatatttcccaaagaatccagttggccaaaccacacagtaactggagtaagcgcttcatgttcacataacggagaatcaagcttttatagaaacttactatggctaacaggaaaaaacggattgtaccccaacctctcaaaatcatacgcaaacaataaagagaaagaagttctggtactatggggagtacaccacccaccaaacattggagaccaaaaagccctataccacacagaaaatgcatatgtatcagtagtaagctcacactactcaagaaaattcacaccagaaatagcaaaaagaccaaaagtcagggatcaagaaggcagaataaactactattggaccctcttagaaccaggagacacaataatatttgaagcaaacggaaacctaatagcacccagatacgctttcgcactatcacgaggattcgggagtggaataataaattcaaacgctcctatggataaatgcgatgcaaaatgtcaaacaccccaaggagcaatcaactcatcattaccatttcaaaatgtacacccagtcaccataggcgaatgcccaaaatacgtcagatcagctaaattaagaatggtaacaggattacgaaatataccatcaatacaatcaagaggactattcggagcaatagccggattcatagaaggaggctggactggtatggtagacggatggtacggataccatcatcaaaacgaacaaggctcaggatacgcagcagaccaaaaatcaacacaaaatgcaatcaacggaataacaaacaaagtaaacagtgtaatagaaaaaatgaacacacaatttacagctgtcggaaaagaattcaacaaactagaaagaagaatggaaaacttaaacaaaaaagtagatgacggattcatagacatatggacatacaatgcagaattattagtattattagaaaatgaaagaacacttgacttccatgactcaaatgtcaaaaatttatacgaaaaagtaaaaagtcaactaaaaaataacgcaaaagaaataggaaacggatgtttcgaattctaccacaaatgcaacgacgaatgcatggaatcagtaaaaaatggaacatacgactatccaaaatactcagaagaatcaaaacttaatagggaaaaaatcgatggagtaaaattagaaagcatgggtgtataccaaatactagcaatatacagcaccgtagcatcatcactcgtacttctagtttcattaggtgctataagcttctggatgtgcagtaatggcagcttacaatgccgaatatgtata

SEQ ID NO: 51276 - RNA, 1695 nt, synthetic construct
  misc_feature 1..1695: note = derived and/or modified sequence opt6 from anti-influenza_Chain
  source 1..1695: mol_type = other RNA
atgaaggcaaaattacttgtattactatgcacatttacggcaacatatgccgacaccatttgtataggatatcatgcaaacaactcaacagatacagtagacacagtactagaaaaaaacgtaacagtaacacattcagtaaaccttctagaagattcacataacggaaaactgtgcttactaaaaggaatagcacctctccaattaggaaactgcagtgtagcaggatggatattgggaaatccagaatgcgaactattaataagcaaagaatcttggtcatatatagtagaaacaccaaatccagaaaacggcacatgctatccaggatatttcgcagactatgaagaattaagggaacaactatcatccgtcagctcattcgaaaggttcgaaatcttcccaaaagaatccagctggccaaaccacacagtcaccggagtttcagcaagttgcagccataacggaaaatcatcattctacagaaatttactttggctcacaggaaaaaatggtctatatccaaacctaagcaaatcatacgtaaacaataaagaaaaagaagtattagtcttatggggagtacaccatccaccaaatataggtaaccaacgagcattataccatacggaaaatgcatacgtaagcgtagtatcaagtcactatagcagaagatttacacccgaaatagcaaaaagaccaaaagtaagagaccaagaaggaagaataaattactactggaccctactagaaccaggagacacaataatatttgaagcaaacggaaacctaatagcaccatggtacgcattcgcattaagcagaggattcggcagtggaataataacatccaatgcaccaatggacgaatgtgacgcaaaatgccaaaccccacaaggagcaatcaattcttctctaccttttcaaaacgttcacccagtaactatcggagaatgcccaaaatacgtcagatctgctaaactaagaatggtcacaggattacgaaatatcccctcaatccaatcacgaggcctattcggagcaatagcaggtttcatagaaggaggttggacaggcatggtagatggttggtacggttaccaccaccaaaacgaacaaggatcagggtatgcagcagatcaaaaatcaactcaaaacgcaataaatggaataacaaataaagtaaattccgtaatagaaaaaatgaatacacaattcactgcagtgggtaaagaatttaataaactagaacgacgaatggaaaatctaaataaaaaagtagacgacggatttttagacatatggacatacaatgcagaattactagtactactggaaaacgagagaacactagacttccacgatagcaacgtcaaaaatctatacgaaaaagtaaaatctcaactaaaaaacaacgcaaaggaaattggaaacggatgcttcgaattctaccataaatgcaacaatgaatgcatggaatcagtaaaaaacggcacatacgattatccaaaatacagtgaagaatcaaaactaaacagggaaaaaatagatggagtgaaactcgaatcaatgggcgtatatcaaatattagcaatatacagtacagtagcctcttcattagtattactagtatctttaggcgcaataagcttttggatgtgctcaaatggttcgttacaatgcaggatatgcata

SEQ ID NO: 51277 - RNA, 1695 nt, synthetic construct
  misc_feature 1..1695: note = derived and/or modified sequence opt6 from anti-influenza_Chain
  source 1..1695: mol_type = other RNA
atgaaagtaaaactactcgtattactatgcaccttcacagcaacatacgcggacacaatatgcataggatatcacgctaataactcaacagatacagtagacacggttttagaaaaaaatgtaacagtaacacactcagtcaacctcttagaagatagccataatggaaaactatgcttactaaaaggtatcgcacctttacaactaggcaactgttccgtcgcaggttggatattaggaaacccagaatgtgaacttctcatcagcagagaatcctggtcatacatagtagaaaaaccaaatccagaaaacggaacatgctatccaggtcatttcgcagactatgaagaattaagagaacaattaagctctgtatcaagtttcgagaggtttgaaatatttccaaaagaaagtagttggccaaaccacactactacaggagtatcagcatcatgctcacacaacggggaaagttcattctacaaaaacttactatggctaacaggaaaaaatggtttatatccaaacttatcaaaatcttacgccaacaacaaagaaaaagaagtcttagtcctatggggagtacaccatccaccaaacataggagaccaaagagcactataccataaagaaaacgcctatgtaagcgtcgtttcatcacactactcaagaaaattcacaccagaaatagccaaacgacctaaagtaagagatcaagaaggacgcataaactattattggacattactagaaccaggagacacaattatttttgaggcaaacggaaatctaatagcaccacgatacgcattcgcactaagtagaggattcggaagtggaatcattaactcaaacgcacctatggacgaatgcgacgctaaatgccaaaccccacaaggagctataaactcaagcttaccattccaaaatgttcacccagtaacaataggcgaatgtccaaaatacgtaagatcagcaaaacttagaatggttacaggattaagaaacataccatcaatccaatcaagaggactatttggagcaatagcaggatttattgagggcggatggacaggaatggtagatggatggtatggttaccaccaccaaaatgaacaaggaagtggatacgcagctgatcaaaaaagtacacaaaacgcaataaacggcataacaaacaaagtcaactcagttatagaaaaaatgaatacacaatttacagcagtaggcaaagaatttaataaattagaaagacgaatggaaaacctcaacaaaaaagtagacgatggatttatagacatatggacgtacaacgcagaactcctagtattacttgaaaacgaacgaacccttgatttccacgacagtaatgtaaaaaacttatatgaaaaagtaaaatcacaattaaaaaacaacgcaaaagaaataggtaacggatgcttcgaattttaccataaatgcaacgacgaatgcatggaatcagtaaaaaatggaacctatgattacccaaaatactcagaggaatcaaaattaaacagagaaaaaatagatggagtaaaacttgaatccatgggagtatatcaaatattagccatatactcgacagtagcatcctcattagtactcctagtatcattaggagcaatatccttctggatgtgctcaaatggatccttacaatgcagaatctgtata

SEQ ID NO: 51278 - RNA, 1698 nt, synthetic construct
  misc_feature 1..1698: note = derived and/or modified sequence opt6 from anti-influenza_Chain
  source 1..1698: mol_type = other RNA
atgaaaaccataatagcactatcctacatattatgtttagtctttgcacaaaaattacccggcaatgacaacagtacagccacactatgcttagggcaccacgcagtaccaaatggaaccatagtaaaaacaataacaaacgatcaaatcgaagtaacaaatgctacagaactagtacaatcttcatccacaggaggaatttgtgactcaccacatcaaatactcgatggagaaaattgcaccttaatcgatgcgctattaggggacccacaatgcgacggattccaaaacaaaaaatgggacctttttgtagaacggtcaaaagcatatagtaactgctacccatacgacgtaccagactatgcttcattacgttcactagtagcaagcagtggcacattagaattcaataacgaaagcttcaactggacaggagtaacacaaaacggaacatcaagcgcatgcaaaagaagaagtaacaactcattcttcagtagactgaattggctcacacatctcaaattcaaatatccagcattaaatgtaaccatgccaaataacgaaaaattcgacaaactatatatctggggcgtccaccacccaggcacagacaacgaccaaataagtctatatgcacaagccagtggaagaatcacagtaagtacaaaacgatctcaacaaacagtcataccttccataggatccagaccaagaataagagacgtaccatcaagaatatccatatactggactatagtaaaaccaggcgatatattattaatcaacagcacaggcaacttaatagcaccaagaggatacttcaaaatcagatcaggtaaatcatcaataatgagaagcgacgctcctataggaaaatgcaatagcgaatgtataacccccaatggatcaataccaaatgacaaacctttccaaaatgtaaatcgaataacatatggcgcatgcccacgatacgttaaacaaaatacactcaaactagcaaccggaatgagaaatgtaccagaaaaacaaacaagaggaatatttggagccatcgcaggattcatagaaaacggatgggaaggaatggtagatggatggtacggattccgacatcaaaactcagaaggcacaggacaagcagcagatttaaaaagcacccaagccgcaataaatcaaataaatggaaaattaaaccgactcataggaaaaaccaatgaaaaatttcaccaaatagaaaaagaattctccgaagtagaaggacggattcaagacctagagaaatacgttgaagacacaaaaatagatttatggtcatacaacgcagaactattagtagcactcgaaaaccaacacacaattgatctaacagactccgaaatgaataaactattcgaaagaacaaaaaaacaactaagagaaaacgcagaagatatgggcaacggatgttttaaaatctaccataaatgcgataacgcatgtataggatcaataagaaatggaacatacgaccacgacgtttatcgagatgaagcactaaataacagattccaaatcaaaggagtagaactaaaaagcggatataaagactggatattatggatatcattcgcaataagttgtttcttactctgtgtagcactcttaggctttataatgtgggcttgccaaaaaggaaatataagatgtaacatatgtatc

SEQ ID NO: 51279 - RNA, 1698 nt, synthetic construct
  misc_feature 1..1698: note = derived and/or modified sequence opt6 from anti-influenza_Chain
  source 1..1698: mol_type = other RNA
atgaaaacaataatcgcactatcatatatattatgcctagtttcagcacaaaaatttccaggcaacgataattcaacagcaacactatgtttaggacaccacgcggtaccaaacggtacaatagtaaaaacaataaccaatgaccaaatagaagtaacaaacgccacagaattagttcaaagctcatcaactggcgaaatatgcgattccccacaccaaattctagatggagaaaattgcacactaatagatgcattattaggagatccacaatgtgacggatttcaaaataagaaatgggacttattcgtagaacgatccaaagcatacagtaactgttacccatacgacgtacccgactatgcatccttacgatcattagttgcaagctctggaacactagaatttaacaacgaatcattcaactggacaggagtaacacagaacggaacatcctcagcatgcatcagacgaagcaacaactcattcttctcaagattaaactggttaactcatctaaaattcaaatacccagccttaaatgtcacaatgccaaacaacgaagaatttgataaactgtacatctggggtgttcatcatcccggaacagacaacgatcaaatattcctatacgcacaagcctcaggaagaattaccgtaagcacaaaacgatcacaacaaaccgtaatacccaacataagaagcagacccagagtaagaaacataccctccagaatatcaatatactggacaatagttaaacctggcgatatattactaatcaattcaactggtaacttaatagcaccacgaggatatttcaaaataagatcaggcaaatcctcaatcatgagatccgacgcaccaataggaaaatgcaacagcgaatgcataacaccaaacggatctataccaaacgataaacccttccaaaacgtaaaccgaataacatatggagcctgtccaagatatgtaaaacaaaacacattaaaactagcaacaggaatgcgcaatgtcccagaaaaacaaaccaggggaatatttggagccattgcaggatttatagaaaacggatgggaaggaatggtagacggatggtacggattccgacaccaaaactcagaaggaatcggccaagcagcagatctcaaaagtacacaagcagcaatagaccagatcaacggaaaactaaatcgactaattggtaaaacaaacgaaaaattccaccaaattgaaaaagaattttcagaagttgaaggaagaatacaagacctagaaaaatatgtcgaagatacaaaaatagacttatggagctacaacgccgaactcctagtcgccctcgaaaatcaacatacgatagatctcacagattcagaaatgaataaactattcgagaaaactaagaaacaattaagggaaaacgcagaagatatgggcaacggctgctttaaaatataccacaaatgtgacaatgcatgcataggatcaataagaaatggaacatacgaccacgacgtatacagagatgaagctctaaataatagattccaaataaaaggagtagaattaaaaagtggatacaaagactggatcctgtggataagtttcgcaataagctgcttcctactatgtgtagcactactaggatttatcatgtgggcatgtcaaaaaggaaacatcagatgcaatatatgcata

SEQ ID NO: 51280 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactctcatacatactatgcttagtatttgcacaaaagctacctggtaacgacaacagtacggcaacactctgtttaggacatcacgcagtacctaacggaacaattgtcaaaaccataaccaatgaccaaatagaagtaacaaatgcgacagaattagtacaatcatcatcaacaggagaaatttgcgactcaccccatcaaatactagacggtgaaaactgcacattaatagacgcattactaggagatccacaatgcgacggattccaaaataaaaaatgggacttattcgtagaaagatcaaaagcatactcaaattgttacccatacgatgtaccagactacgcatcacttcgttcactagtagcttcatcaggaacactagaattcaaaaatgaatcattcaactggacaggagtaacccaaaacggaacaagttcagcatgtatacgaagatcaaataacagttttttcagtagactcaactggttaacacatctaaaatttaagtaccctgcactaaacgtaactatgccaaacaaagaaaaattcgacaaactatacatatggggagtacaccaccctggaacagacaacgaccaaatatttctatacgcacaagcatcaggtcggataacagttagcacaaaaagatcacaacaaacagtcatccccaacataggtagcagactccgagtaagagacataccttctagaatatccatatactggacaatagtaaaaccaggagacatactactaataaactcaaccggtaatttaatagcaccccgaggatacttcaaaataagatcaggaaaatccagcatcatgcgaagtgacgcaccaatcggaaaatgcaactcagaatgtataacacctaatggtagtataccaaacgataaaccatttcaaaatgtcaaccgtataacatacggtgcatgccctagatatgtaaaacaaaatacattaaaactagctactggtatgagaaatgttccagaaaaacaaacaagaggtatatttggagcaattgcaggatttatagaaaacggatgggaaggaatggtagatggatggtacggatttcgacaccaaaactcagaaggaacaggacaagccgcagacttaaaatctacacaagcagcaatagatcaaataaacggaaaactcaaccgactcataggaaaaacaaacgaaaaattccaccaaatagaaaaagaattcagtgaagtggaaggtagaatacaagacttagaaaaatacgtagaagataccaaaatagatctatggtcttataacgctgaattactagtagcacttgaaaatcaacatacaatagacttaacagattcagaaatgaacaaattattcgaaaaaaccaaaaaacaactaagagaaaacgctgaagatatgggaaacggatgctttaaaatataccataaatgcgacaatgcatgcataggctcaataagaaacggaacatacgaccacgacgtatatagagatgaagcattaaacaacagattccaaattaaaggagtagaactaaaaagtggatacaaagactggatactgtggatcagtttcgcaataagttgctttctattatgcgtagcgttactcggattcataatgtgggcatgccaaaaaggaaacatacgatgtaatatatgtata

SEQ ID NO: 51281 - RNA, 1698 nt, synthetic construct
  misc_feature 1..1698: note = derived and/or modified sequence opt6 from anti-influenza_Chain
  source 1..1698: mol_type = other RNA
atgaaaacaataattgcactaagctatatattatgtttagtatttgcccaaaagctacccggaaacgataacagtacagccaccctatgtctaggtcaccacgccgtcccaaacggaacaatagtaaaaacaataacaaatgatcaaatagaagttaccaacgcaacagaactagtacaatcttccagtacaggcgaaatttgcgactcaccacaccaaatattagacggagaaaattgcacactaatagacgctttactcggagatccacaatgcgacggatttcaaaacaaaaaatgggacctatttgttgaacgaagcaaagcctactcaaaatgttacccttatgacgtacctgactatgccagtttacgatccctagtagcaagctccggaacactagaattcaacaacgaatcatttaactggacaggtgtaacacaaaatggaacatcaagtgcatgtatacgaagatcaaacaactcattcttttccagattaaactggttaacacacctcaaattcaaataccccgcgctaaacgtaactatgccaaacaacgaaaaattcgacaaattatacatatggggtgtacaccatccaggaaccgataacgaccaaatattcctctacgcacaagcaagcggaaggataaccgttagtacaaaaaggtcacaacaaacggtaataccaaacataggaagcagaccaagagtccgagacataccatctagaatctctatatactggactatagtaaaaccaggagatatactactcattaatagcacaggaaacctaatagcaccaaggggatacttcaaaatacgatcaggaaaaagcagtattatgagaagtgatgcaccaataggcaaatgcaacagtgaatgcataacaccaaacggaagcataccaaacgacaaacccttccaaaatgtcaacagaataacgtatggtgcttgcccaagatatgtaaaacaaaatacactaaaactagcaaccggcatgcgaaacgtacctgaaaaacaaacaagaggaatattcggagcaatagctggcttcatagaaaatggatgggaaggaatggttgacggatggtacggattcagacatcaaaactcagaaggaataggtcaagcagccgacctaaaatcaacacaagcagccatcgatcaaataaatggaaaactaaacaggctcataggaaaaacaaacgaaaaatttcatcaaatagaaaaagaattcagtgaagtagaaggaagaatacaagacctagaaaaatacgtagaagacacaaaaatagacttatggtcatataacgcagaactattagtagcactagaaaatcaacatacaatagacttaacagactcagaaatgaataaattattcgaaaaaacaaaaaaacaactacgagaaaacgcagaagatatgggaaatggatgctttaaaatataccacaaatgcgacaatgcatgcataggatcgataagaaacggaacatacgaccacgatgtatatagagacgaagcactaaacaataggtttcaaataaaaggagtggaactgaaatcaggatataaagactggatattatggatatccttcgctatatcatgttttctactatgcgtagcactattagggttcataatgtgggcctgccaaaaaggtaatataagatgtaatatatgcata

SEQ ID NO: 51282 - RNA, 1698 nt, synthetic construct
  misc_feature 1..1698: note = derived and/or modified sequence opt6 from anti-influenza_Chain
  source 1..1698: mol_type = other RNA
atgaaaacaataatcgcattaagctatatactatgcctagtgtttgcacaaaaattaccaggaaatgacaacagtacagcaacattatgcctcggacaccacgctgtaccaaatggaacaatagtaaaaacaataacaaatgaccaaatagaagtaacaaacgcaacagaactagttcaatcatcaagcacaggagaaatatgtgacagtccacaccaaatattagacggagaaaattgtactctcattgacgcactattaggagatcctcaatgtgacggtttccaaaataaaaagtgggacctattcgtcgaaagaagtaaagcatacagtaactgttacccatatgacgtaccagactacgcatcattaagaagtctagtagcatcatccggtacactcgaatttaataatgaatcattcaattggacaggagtaacacaaaacggaacaagcagcgcatgcataagaagaagcaacaactcattcttttcaagattaaactggctaacacatctaaaattcaaatacccagccctaaatgtaacaatgccaaataacgaaaaattcgacaaattatacatctggggagtccaccatccaggtacagacaacgatcaaatcttcttatatgcacaagcatctggcagaataacagtaagtacaaaaagatcacaacaaaccgtaatacccaatataggaagtagaccaagagtaagaaacataccatcaagaattagtatatattggacaatagtaaaacctggagatatacttttaataaactcaacaggaaatttaatcgcaccacgaggatacttcaaaatacgaagcggaaaatctagcataatgagatcagacgcaccaataggaaaatgcaacagcgaatgcataacaccaaatggatcaatacctaatgacaaacccttccaaaacgtaaacagaataacctacggagcatgtccaagatacgtgaaacaaaacacattaaaacttgccacaggtatgagaaacgtaccagaaaaacaaactcgaggaatcttcggagcaatagcaggattcatagaaaatggatgggaaggaatggtagatggctggtacggattccgccaccaaaactcagaaggtataggacaggcagcagacttaaaatctacgcaagcagcaatagaccaaataaatggaaaactaaatagactaataggtaaaactaacgaaaaattccaccaaatagaaaaagaattttcagaagtagaaggaaggatacaagacctagaaaaatatgtcgaagatactaaaatagacttatggtcatataacgccgaattattagtagcattagaaaaccaacatacaatagacttaacagactcagaaatgaacaaattattcgaaaaaacaaaaaaacaattaagagaaaatgctgaggacatgggaaacggatgtttcaaaatatatcacaaatgcgacaatgcctgcataggatcaataagaaatggaacatacgaccatgacgtatacagagatgaagccctcaataatagattccaaataaaaggagtagaactaaaatcaggttataaagattggatactatggatttcgttcgcaattagttgtttcttattatgcgtagccttactaggatttattatgtgggcatgccaaaaaggaaacataagatgcaatatatgtata

SEQ ID NO: 51283 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactctcatatatattatgcctagtattctcacaaaaactacccggaaacgataacagtaccgcgacattatgcttaggacatcacgcagtaccaaacggaacgatagtaaaaacaataacaaatgaccaaatagaagtaacaaacgccacagaattagttcaatcaagttcaacaggcggaatttgcgactcaccacaccaaatactagacggagaaaactgcaccctaatagacgcactattaggtgacccccaatgtgacggatttcaaaataagaaatgggacctattcgtagaaagatccaaagcatattctaattgctacccatacgacgtaccagactacgcatccctaagatcgctagtagcatcaagtggaacactagaatttaataacgaaagtttcaattgggctggtgtaacacaaaacggaactagcagtgcgtgcaaaagaagatcaaataagagcttcttctccagacttaattggttaacccatctaaaatataaatatcctgcacttaacgtaacaatgccaaacaacgaaaaattcgataaattatacatatggggcgtacaccatccagtaactgattcagaccaaatctcactatatgcacaagcaagcggaagaataacagtctcaacaaaaagaagccaacaaacagtaataccaaatataggatatagaccaagagtaagagacattagttcaagaatttctatatactggactatagttaaaccaggagacatcttactaataaactcaacaggaaacctcatagcaccccgaggatacttcaaaatacgatcaggaaaaagctctataatgagaagtgacgcacctataggaaaatgcaatagcgaatgtataacccctaacggatcaataccaaacgataaaccatttcaaaacgttaatagaataacctatggagcctgccccagatatgtcaaacaaaatacactaaaattagcaaccggaatgagaaacgtcccagaaaaacaaacacgaggaatattcggagctattgcaggtttcatagaaaacggatgggaaggtatggtagatggttggtacgggtttagacaccaaaactctgaagggacaggccaggccgccgatctaaaatcaacacaagcagcaataaaccaaataaacggcaaattaaaccgactaataggaaaaacaaacgaaaaattccatcaaatagaaaaagaatttagtgaagtagaaggtagaatacaagacctcgaaaaatatgtagaagatacaaaaatagacttatggtcatataacgcagaattactcgtagcactagaaaaccaacacacaatagatctaacagactcagaaatgaacaaactatttgaaagaacaaagaaacaactaagagaaaacgcagaagatatgggtaacggatgctttaaaatatatcacaaatgtgacaatgcatgcatagaatcaattagaaacggaacatatgaccacgatgtatacagagacgaagcattaaataacagattccaaataaaaggagtagaattaaaatctggatacaaagattggatattatggattagcttcgccatatcatgttttctactgtgcgttgcactattaggatttataatgtgggcttgccagaaaggaaacataagatgcaatatatgtata

SEQ ID NO: 51284 - RNA, 1698 nt, synthetic construct
  misc_feature 1..1698: note = derived and/or modified sequence opt6 from anti-influenza_Chain
  source 1..1698: mol_type = other RNA
atgaaaaccataatagcactatcttacatactatgcctagtattcgcacaaaaactaccaggaaacgacaatagcactgcaacactatgtttgggtcaccacgctgtaccaaacggaaccatagtgaaaacgataactaatgaccaaatagaagtaacaaatgctacagaattagtacaatcctcaagtacaggaggcatatgcgatagcccacatcaaatactagacggcgaaaactgcaccctaatagacgcactactaggggacccacaatgcgacggattccaaaataagaaatgggatttattcgtagaaagatcaaaagcatattcaaactgctacccgtatgacgtaccagactatgcatccttacgatcattagtcgcatcatcaggaaccttagaatttaatgacgaatcattcaactggaccggagtaacacaaaacggaacaagcagtagttgcaaacgacgatccaacaactcattcttctctagactcaactggctaacacatctaaaattcaaatatccagccttaaacgtaacaatgccaaacaacgaaaaattcgacaaattatacatatggggagtacaccacccagtgacagacaatgaccaaatatttttatacgcacaagcctcaggacgaataacagtatcaaccaaaagaagccaacaaacggtaataccaaacattggaagcagaccaagaataagaaacataccctcaagaataagcatatattggaccatagtaaaaccaggagacatcctattaataaactcaacaggaaacctaatagccccaagaggatactttaaaattagatcaggcaaaagcagtataatgagatctgatgcaccaataggtaaatgtaacagcgaatgcatcacaccaaacggatctatcccaaatgataaacccttccaaaacgtaaatagaataacatacggagcatgcccaagatatgtaaaacaaaataccttaaaactagcaacaggaatgcgaaatgtacccgaaaaacaaacaagaggaatatttggagcaatagcaggattcatagaaaacggatgggaaggaatggtagatggctggtacggcttccgacaccaaaactctgaaggaataggacaagcagccgatttaaagagcactcaagcggcaattaaccaaattaatggaaaactcaaccgactaataggaaaaacaaacgaaaaattccaccaaatcgaaaaagaattttcagaagtagaaggtcgaatacaagacttagaaaaatacgtagaagatacaaaaattgacttatggtcatataatgccgaactattagtcgcactagaaaaccaacatacaatagacctcaccgattcagaaatgaacaaattattcgaacgaaccaagaaacaactcagagaaaacgcagaagacatgggcaacggctgtttcaaaatctaccacaaatgtgacaacgcatgcataggatcaataagaaatggaacctacgatcatgacgtttacagagatgaagcattaaacaacagattccaaataaaaggggtagaactaaaaagcggatataaagactggatactatggattagctttgcaataagttgctttttattatgcgttgcactactcggttttattatgtgggcttgccaaaaaggaaacatacgctgtaacatctgtata

SEQ ID NO: 51285 - RNA, 1698 nt, synthetic construct
  misc_feature 1..1698: note = derived and/or modified sequence opt6 from anti-influenza_Chain
  source 1..1698: mol_type = other RNA
atggaaaaaatcgtactcttattagctatagtatcactagtcaaatcagaccaaatatgcataggataccatgcaaataactcaactgaacaagttgatacaatcatggaaaaaaatgtaacagtaacacacgcacaagatatattagaaaaaacacataatggcaaactctgcgatctcgacggagtaaaacccttaattctaagagactgtagcgtagcaggatggctactaggaaacccaatgtgcgacgaattcatcaatgtaccagaatggagttacatagtagaaaaagcaaacccaactaatgatttatgctacccgggatcattcaatgactatgaagaactcaaacatcttctatcaagaataaaccactttgaaaaaatacaaataataccaaaatcatcatggtccgatcacgaagcaagctcaggagtctcctcagcttgcccatacctaggatccccaagtttctttagaaacgtcgtatggctaattaaaaaaaattcaacataccccacaataaaaaaatcatataacaacactaatcaagaagacttactagtattatggggaatccatcacccaaatgacgcagcagaacaaacaagactatatcaaaacccaacaacatacatatctataggaacatcaaccctaaaccaaagactagtacccaaaatagctactagaagtaaggtaaacggacaatctggaagaatggaatttttttgggcaatactaaaaccaaacgatgcaataaacttcgaaagtaacggaaacttcatagcacccgaatacgcatataaaatagtaaaaaaaggagatagtgccataatgaaaagcgaactagaatatggcaactgtaatacaaaatgccaaacaccaatgggagccataaattcatcaatgccattccacaacatacacccactaacaataggagaatgcccaaaatacgtaaaatcaaacagactagtactagcaacaggactaagaaatagcccacaaagagaaagcagaagaaaaaaaagaggattattcggagccatagcaggatttatagaaggaggatggcaaggtatggtagatggatggtatggttatcatcactcaaacgaacaaggaagcggatatgcagccgacaaagaatcaactcaaaaagcaataggagtcaccaacaaagtaaactcaataatagacaaaatgaacacacaattcgaagcagtcggaagagaattcaacaatttggaaagacgaatagaaaacttaaacaaaaagatggaagacggatttctagatgtatggacatataacgcagaattactagtcctaatggaaaacgaaagaactctagacttccacgactccaacgtcaaaaatttatacgacaaagtgagactacaactacgagacaacgcaaaagaattaggaaacggttgctttgaattctaccataaatgtgacaatgaatgtatggaaagcataagaaatggcacatacaacccacaatattccgaagaagctagattaaaaagagaagaaatatcaggcgtcaaactagaatcaataggaacatatcaaattctaagcatatacagtactgttgcgagtagtctagcattagcaataatgatcgcaggcttaagcctatggatgtgctcaaacggatcacttcaatgccgcatatgtata

SEQ ID NO: 51286 - RNA, 1698 nt, synthetic construct
  misc_feature 1..1698: note = derived and/or modified sequence opt6 from anti-influenza_Chain
  source 1..1698: mol_type = other RNA
atgaaagcaatattagtagtactactttacacattcgcaacagcaaatgcagacacactatgcattggctaccatgcaaataactcaacagacactgtagacacagtcctagaaaaaaatgtaacagtaacacactcagtcaacttgttagaagacaaacacaatggaaaattatgtaaattaagaggagtagccccactacatttaggcaaatgtaatatagcaggatggatattaggtaatccagaatgcgaaagtcttagcactgcatcaagctggagttacatcgtagaaacaagctcctcagacaacggaacatgttatccaggtgacttcatagattacgaagaactaagagaacaattatcaagcgtatccagttttgaaagattcgaaatattcccaaaaacaagttcatggcccaaccatgattctaataaaggagtaaccgcagcatgccctcacgcaggagcaaagtcattctataaaaatctcatatggctcgtaaaaaaaggaaacagctaccctaaactaagcaaatcatacataaatgacaaaggaaaagaagttctagtcctatggggaatacatcacccttcaacaagtgctgatcaacaaagcctatatcaaaacgcagatgcctatgtatttgtaggaacttcaagatatagtaaaaaatttaaaccagaaatagctataagaccaaaagtacgagaccaagaaggaagaatgaattactactggactctagtagaaccaggagacaaaataacatttgaagcaacaggcaacctagtagtcccacgatacgcattcgccatggaaagaaacgcaggaagcggtataattatcagtgacactcccgttcacgattgcaacacaacgtgtcaaactccaaaaggagcaatcaatacatcactaccattccaaaacatccacccaataacaataggaaaatgccctaaatacgtaaaatcaacaaaacttcgactagcaaccggtctaagaaatgtaccatcaatacaaagtagaggactatttggagcaatagcaggattcatagaaggaggatggacaggaatggtagacggatggtatggttaccaccatcaaaatgaacaaggatcaggatacgccgcagacctaaaaagcacacaaaacgcaatagacgaaattaccaacaaagtaaattcagtaatagaaaaaatgaacacacaatttacagcagtaggaaaagaattcaatcatctagaaaaaagaatagaaaacttaaacaaaaaagtagacgacggattcctagacatatggacgtacaatgctgaactacttgtactattagaaaatgaaagaacactcgactaccacgactcaaatgtaaaaaatttatatgaaaaagttagaagtcaattaaaaaacaatgcaaaggaaataggaaacggatgcttcgaattctaccacaaatgcgacaatacatgtatggaaagtgtaaaaaatggaacttacgactatccaaaatatagtgaagaagcaaaactaaaccgagaagaaatagacggagtaaaattagaatcgacccggatataccaaatacttgcaatttatagcacagtagcctcaagcttagtactagtagtaagcttaggagctatatcattctggatgtgctccaatggctcactacaatgtcggatttgtata

SEQ ID NO: 51287 - RNA, 1698 nt, synthetic construct
  misc_feature 1..1698: note = derived and/or modified sequence opt6 from anti-influenza_Chain
  source 1..1698: mol_type = other RNA
atgaaagcaattctagtcgtcttactatacacattcgcaacagctaacgcagacactctatgcataggataccacgcaaataactctaccgatactgtagataccgtacttgaaaaaaacgtcaccgtaacccatagtgtaaatctactagaagacaaacacaatggaaaactatgcaaattacgaggagttgccccattacacttaggaaaatgcaacatagcaggatggatactaggtaatccagaatgcgaatcactatcaacagcatcaagctggagttacatagtagaaacaagctcaagtgataatggaacatgttatccaggagatttcatcgactatgaagaactaagagaacaactgtcatcagtaagttccttcgaaagatttgaaatatttccaaaaacatccagttggcctaatcatgactcaaataaaggagtaacagcggcatgccctcatgcaggcgctaaaagtttctataaaaaccttatatggctagtaaaaaaaggaaactcatacccaaaattatccaaatcctatataaacgataaaggaaaagaagtactagtactatggggaatacaccacccaccaacatcagcagaccaacaatcactataccaaaatgcagacgcatacgtatttgtaggttcatcaagatattcaaaaaaatttaaacctgaaatcgcaataagaccaaaagtaagagaccaagaaggaagaatgaattactattggacactagtagaacccggagataaaataacttttgaagctacaggcaacttagttgtaccacgctacgccttcgctatggaaagaaacgcaggcagcggaatcataatctctgacacacctgtccatgactgtaataccacatgccaaacaccaaaaggagcaattaacacttcattacctttccaaaacatccatccaataacaataggcaaatgcccaaaatacgtaaaatccacaaaattgagacttgcaacaggtttaagaaacataccatctatacaatccagaggactcttcggtgcaatcgcaggattcatagaaggaggatggacaggaatggttgacggatggtacggatatcaccaccaaaacgaacagggatctggatacgcagccgacttaaaatcaacacaaaacgcaatagacgaaataacgaacaaagtaaactcagtaattgaaaaaatgaatacacaattcaccgcagtaggaaaagaattcaatcacctagaaaaaagaattgaaaacctgaacaaaaaagttgatgacggcttcttagatatatggacatacaatgccgaacttctagtactcttagaaaatgaacgaactctagactaccacgactcaaatgtaaaaaacctatatgaaaaagtacgaagccaactcaagaacaatgcaaaagaaataggcaacggatgctttgaattctatcataaatgcgataacacatgcatggaatctgtcaaaaacggaacatacgattacccaaagtattcagaagaagctaaacttaatagagaagaaatagacggagtaaaacttgaaagcacaagaatctatcaaatactagccatatattcaacagtagcatcatcattagtactagtagtaagtctaggagcaatatcattttggatgtgtagtaacggatccctacaatgcagaatctgcata

SEQ ID NO: 51288 - RNA, 1698 nt, synthetic construct
  misc_feature 1..1698: note = derived and/or modified sequence opt6 from anti-influenza_Chain
  source 1..1698: mol_type = other RNA
atggaaaaaatcgtactattattagcaatagtatcactagtaaaaagtgaccaaatatgtataggatatcacgcaaataattcaacagaacaagtagatacaatcatggaaaaaaacgtaacagtaacccacgcacaagacatactagaaaaaacgcacaatggcaaactatgtgatctagacggagtaaaacccctaatattaagagactgctccgttgcaggatggttactaggaaacccaatgtgcgacgaattcataaacgtgccagagtggagctacatagtagaaaaagcaaacccaaccaacgatttatgctacccaggatcttttaatgactacgaagaattaaaacacctattatcaagaatcaatcacttcgaaaaaattcaaatcataccaaaaagcagctggtctgaccacgaagctagctcaggagtgtcatctgcatgcccatatctcggatcaccaagtttcttccgtaacgtagtatggttaataaaaaaaaactcaacatatcccacaataaaaaaatcctataacaacacaaaccaagaggatctattagttctatggggaatacaccacccaaacgacgccgcagaacaaacaaggctataccaaaacccaaccacctacataagtatcggaacatcaactctaaaccagcgattagtaccaaaaatagcaactagaagcaaagtaaacggccaaagtggaaggatggaattcttctgggctatactaaaaccaaatgacgcaatcaatttcgaatcaaacggcaatttcatagccccagaatacgcttataaaatagtaaaaaaaggagactctgcaatcatgaaatccgaactagaatatggaaactgtaatacaaaatgccaaacaccaatgggagcaatcaatagctcgatgccattccacaacatccatccattaacaataggtgaatgcccaaaatacgtaaaaagtaaccgattagtattagcaacaggtctaagaaacagtccacaaagagaatcaagaagaaaaaaacgaggactattcggcgcaatagcaggatttatagaaggtggatggcaaggaatggtcgatggatggtacggctaccaccactcaaatgaacaaggttcaggatatgccgcagataaagaatcaacacaaaaagcaataggagtcacaaataaagttaatagcataatagacaaaatgaatacacaattcgaagcagtaggaagagaattcaacaatcttgaaagaagaatagaaaacctaaacaaaaaaatggaagacggattcttagacgtatggacctacaatgctgaattactagtgctaatggaaaacgaaagaacactagactttcatgactcaaatgtaaaaaacttatacgacaaagtacgactccaattacgagacaatgctaaagaactaggaaacggatgctttgaattctaccacaaatgcgacaacgaatgcatggaatcaataagaaacggaacgtacaacccacaatactcagaagaagcaagactaaaaagggaagaaataagtggagtaaaactagaatccatcggaacatatcaaatactatcaatctattccactgtagcatcttccttagcactagcaataatgatagcaggactaagcttatggatgtgttctaacggatcattacaatgcagaatatgcata

SEQ ID NO: 51289 - RNA, 1698 nt, synthetic construct
  misc_feature 1..1698: note = derived and/or modified sequence opt6 from anti-influenza_Chain
  source 1..1698: mol_type = other RNA
atgaaaacaataattgctctatcatacatactatgtttagtatttgcacaaaaactcccaggaaatgacaattcaacagccacactatgcctaggacatcacgcagtaccaaacggcactatagtaaaaaccataacaaacgaccaaatcgaagtaaccaacgcaacagaattagtacaaagctcaagcactggaggaatctgtgactcaccccatcaaatactagatggagaaaattgcaccttaatagacgcacttttaggagacccccaatgcgacggattccaaaacaaaaaatgggacctatttgttgaacgatcaaaagcttacagcaactgctatccatacgacgtaccagattacgcctccttacgctcacttgtagcatcatccggcacactagaatttaacaatgaaagcttcaactggaccggtgtaacccaaaacggaacctcctcagcctgtaaacgacgaagtaataattcattcttcagcagattaaattggctaacacatcttaaattcaaatatccagcattaaacgtaacaatgccaaacaacgaaaaattcgacaaattatacatatggggagtccatcacccaggaactgacaacgatcaaatatccttatatgcacaggcaagcggccgcataacagttagcacaaaaagaagtcaacaaaccgtaataccatcaataggctcacgaccaagaataagagatgtcccatcaagaataagcatctactggactatagtaaaaccaggagatatactactaataaattcaacaggaaaccttatcgcaccacgaggttatttcaaaataagatcaggaaaatcatcaataatgaggtcagacgctccaataggaaaatgcaattcagaatgcataacaccaaatggttccatacctaacgacaaaccattccaaaatgtaaatagaataacatacggagcatgcccaagatacgttaaacaaaatacactaaaactcgcaacaggaatgagaaatgtaccagaaaaacaaaccagaggaatctttggagcaatagcaggcttcattgaaaacggatgggaaggaatggtggacggctggtacggatttaggcatcaaaactcagaaggcacaggccaagcagcagacctaaaatcaacacaagcagctatcaaccaaataaacggaaaactcaacagactaatcggaaaaacaaacgaaaaattccaccaaatagaaaaagaattcagtgaagtagaaggacgcattcaagacttagaaaaatatgtagaagatacaaaaatagatctttggtcctacaacgcagaacttttagtagcactagaaaatcaacacacaatagacctgactgactcagaaatgaataaactctttgaaagaacaaaaaaacaattaagagaaaatgcagaagacatgggaaatggttgtttcaaaatatatcacaaatgtgacaacgcatgcataggatccatcagaaacggaacctacgaccacgacgtatacagagacgaagcattaaataacagattccaaataaaaggagttgaattaaaatctggatataaagactggatactttggatatcattcgcaatatcatgcttcctactctgtgtagcattactaggattcatcatgtgggcctgtcaaaaaggaaacatacgatgcaacatatgcatc

SEQ ID NO: 51290 - RNA, 1698 nt, synthetic construct
  misc_feature 1..1698: note = derived and/or modified sequence opt6 from anti-influenza_Chain
  source 1..1698: mol_type = other RNA
atgaaagcaatactagtagttctactatacacattcgcaacggcaaatgcagacacattatgcatcggctatcatgccaacaattcaacagatacagtagacacggttcttgaaaaaaacgtaacagttacccacagcgtaaatttactagaagataaacacaatggaaaattatgcaaactcagaggcgtagcacccttacacctaggaaaatgcaacatagcgggatggatactaggcaacccagaatgcgaaagtctaagcacagcatcatcatggtcatacatagtagaaacatcaagctccgacaatggaacctgttatcccggtgactttatagactatgaagaattaagagaacaattaagctccgtatcatcatttgaaagattcgaaatatttccaaagacatccagttggcctaatcatgactctaacaaaggtgtcactgcagcatgccctcacgcaggcgccaaatctttctataaaaatcttatctggctagtaaaaaaaggcaactcatatcccaaactaagtaaaagttacataaacgataaaggcaaagaagtcctagtattatggggaatacaccacccatcaacatcagcagaccaacaatctctataccaaaacgcagatgcctacgtattcgttggaacctcaagatatagtaaaaaattcaaacctgaaatagcaataagaccaaaagttcgcgatcaagaaggtagaatgaactactattggacacttgtagaaccaggagataaaataacattcgaagctactggaaacttagtagtaccaagatatgcattcgcaatggaaagaaacgcaggaagtggcataatcatttctgacacaccagtacacgattgcaatacaacatgccaaacacccaaaggagcaataaacacaagtttaccatttcaaaacatacaccctataacaataggcaaatgtccaaaatacgttaaaagcacaaaattaagattagcaacaggattaagaaacgtaccctcaatacaatcaagaggactattcggagccatcgccggatttatagaaggaggatggacaggaatggtagatggatggtatggatatcaccaccaaaatgaacaaggaagcggatacgcggcagacttaaaatcaacacaaaatgcaatagacgaaataacgaataaagtaaactctgtaatagaaaaaatgaacacacaatttacagcagtaggaaaagaattcaaccacttagaaaaaagaatagaaaatttaaacaaaaaagtagacgacggatttttagacatctggacatacaacgcagaactactagtactactagaaaatgaacgaacattagactaccatgattctaacgttaaaaacctatatgaaaaagtacgatcccaactaaaaaacaatgcaaaagaaataggaaatggatgcttcgaattctaccataaatgtgacaacacatgcatggaatcagtaaaaaatggaacatacgattacccaaaatacagtgaagaagcaaaactaaaccgagaagaaatagacggagtcaaactcgaatcaacaagaatataccaaatacttgcaatatactcaacagtggctagctctttagtacttgtagtatcactaggcgcaatttccttttggatgtgctcaaacggatcactacagtgcagaatatgcata

SEQ ID NO: 51291 - RNA, 1698 nt, synthetic construct
  misc_feature 1..1698: note = derived and/or modified sequence opt6 from anti-influenza_Chain
  source 1..1698: mol_type = other RNA
atgaaagccatacttgtcgtactactatacacatttgcaacagctaatgcagacacactttgcatcggataccacgccaataactcaacagacaccgtagatacagtattagaaaaaaatgtaacagtaactcacagtgtaaacctactagaagataaacataacggcaaattatgtaaactaaggggagtcgcaccattgcacctaggaaaatgcaacatagcaggatggattctaggaaatcccgaatgtgaatcattaagcacagcatcctcatggtcatatattgtagaaacatcatcttcagacaacggaacatgttacccaggagacttcatagactacgaagaactaagagaacaactatcatcggtaagctccttcgaaagatttgagatatttcccaaaacaagctcatggcctaaccatgactcaaacaaaggagtaacagctgcatgcccccacgcaggagccaaatccttctataaaaacctaatatggctagtaaaaaagggaaacagctacccaaaactatcaaaatcctacataaacgacaaaggaaaagaagtactagttttatggggaatacatcatcctccaacctcagccgatcaacaatcattataccaaaatgcagacgcctacgttttcgttggaagctccagatattcaaaaaaattcaaaccagaaatagccataagaccgaaagtgagagaccaagaaggaagaatgaattactattggacacttgtagaaccaggagacaaaataaccttcgaagcaacaggaaacttagtagtaccacgatatgcattcgccatggaaagaaacgcaggatcaggaataataatctcagacacaccagttcatgactgcaacacaacatgccaaacaccaaaaggagccataaacacaagtctaccattccaaaatatccatcctataacaataggaaaatgtccaaaatacgtaaaatcaacaaaattaagactagccacaggactaagaaatatcccttcaatacaatcacgcggcctttttggcgcaatagcaggatttatagaaggaggatggaccggaatggtagatggctggtatggataccaccaccaaaacgaacaaggaagcggatacgccgcagatcttaaaagtacacaaaatgccatagacgaaataactaataaagtaaacagcgtaatagaaaaaatgaacacacaattcacagccgtaggaaaagaattcaaccatcttgaaaaaagaatagaaaacctaaacaaaaaagtcgacgatggatttttagacatatggacatacaatgccgaactccttgtcttattagaaaatgaacgaacactcgactatcatgactcaaacgtaaaaaacctatacgaaaaagttagatctcaattaaaaaacaacgccaaagaaataggcaatggatgtttcgaattttaccataaatgtgacaatacatgcatggaatctgtaaaaaatggcacctacgactatccaaaatattcagaagaagcaaaattaaatagagaagaaatagacggcgtaaaactagaatcaacacgcatataccaaatcttagccatctatagtacagtagcatcaagtctagttttagtagtatctttaggagccatatccttttggatgtgcagcaacggatcattacaatgcagaatatgcatc

SEQ ID NO: 51292 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactcagttacatattatgtttagtatcagcacaaaaattcccaggaaacgataacagcacagcaacactatgcctaggccaccacgccgtaccaaacgggacaatagtaaaaacaataacaaatgaccaaatagaagtaacaaatgccacagaactcgtacaatcaagcagcacaggagaaatatgtgactcaccccaccaaatactagacggtgaaaattgcacactaatagacgcattactcggtgatccacaatgcgacggcttccaaaacaaaaaatgggatctattcgtagaaagatcaaaagcatactcaaattgctacccttacgacgttccagattacgcttctttaagaagtctagtagcttcctcaggaacattagaattcaacaacgaatcattcaattggactggagtaacacaaaacggaactagctcagcctgcataagaagatcaaacaactcctttttctctaggctaaactggctcacacatctaaaattcaaatacccagctttaaacgtaaccatgccaaacaatgaagaattcgacaaactatatatctggggcgtacatcatcccggaacagataatgaccaaatattcttatatgcccaagcatctggaagaattactgtatcaacaaaaagaagccaacaaacagtaataccaaacataagaagccgtccacgcgtaagaaatataccatcacgaatatctatttactggacaatcgtaaaacccggcgacatattactaataaattcaacaggaaatctaattgccccacgaggatacttcaaaataagatctggtaaaagctcaataatgcgatcagatgcacctataggaaaatgcaactccgaatgtataacaccaaacggatcaataccaaacgataaaccattccaaaacgtaaacagaataacatacggagcatgcccacgttatgtaaaacaaaatacattaaaattagccacaggaatgagaaacgtaccagaaaaacaaacacgaggaatatttggagcaatagcaggatttatagaaaacggctgggaaggaatggtagacggatggtacggatttcgccatcaaaacagcgaaggaataggccaagctgcagacttaaaatctacacaagctgcaatagatcaaataaatggaaaattaaacagactaataggaaaaaccaacgaaaagtttcaccaaatcgaaaaagaattcagcgaagtagaaggaagaattcaagacctagaaaaatatgtagaagacacaaaaatagacttatggtcatataacgccgaactacttgtcgcactagaaaatcaacacacgatagatctaaccgacagtgaaatgaataaactatttgaaaaaacaaaaaaacaactaagggaaaatgcagaagacatgggaaatggatgcttcaaaatataccacaaatgtgacaacgcatgcataggatccataagaaacggaacatatgatcacgacgtatacagagatgaagcactcaacaacagattccaaataaaaggggtagaattaaaatccggctacaaagactggatactatggatatccttcgccatcagttgcttcctattatgcgtagcactactcggattcataatgtgggcatgccaaaaaggaaacatccgatgcaacatatgtata

SEQ ID NO: 51293 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactcagctacatcttatgccttgtattcgcacaaaaacttccaggaaatgacaattcaaccgctactctctgcttaggtcatcacgcagtaccaaacggaacaatagtaaaaacaataacaaatgatcaaatagaagtaacaaatgccacagaattagtacagtcatcttcaacaggagaaatatgcgatagcccacatcaaatactagatggagaaaactgcactctaatagatgcacttctaggagatccgcaatgcgacggattccaaaataagaaatgggatctattcgtagaaagaagcaaagcctactcaaattgctatccatacgatgtacctgactatgcatctttacgtagcttagtagcctcatcaggcacattagaatttaaaaacgaatctttcaactggacaggagtaacacaaaatggcacatcaagcgcatgcatacgcagatcaaataactcatttttctcaagattaaactggctaacacacctaaaatttaaataccccgcgttaaacgtcacaatgccaaacaaagaaaaatttgacaaactatatatatggggtgtacatcacccaggaacagataacgatcaaatattcctatatgcacaagcatcaggaagaataactgtaagtacaaaaagatcacaacaaacagtaatccctaacatcgggtcaagactcagagttcgagacataccaagccgaatttcaatttactggaccatagttaaaccaggagacatactactaataaactcaacaggaaatctcatagcacctagaggttatttcaaaataagaagtggaaaaagctcaataatgagatcagatgccccaatcggaaaatgtaacagtgaatgtattaccccaaacggatcaataccaaatgacaaacccttccaaaatgtaaaccgaataacatacggagcatgtccaagatatgtcaaacaaaatacacttaaattagcaacaggtatgagaaacgtaccagaaaaacaaacacgaggaatattcggagctatagccggtttcatagaaaacggatgggaaggtatggtagatggatggtacggattccgacatcaaaactcagaaggaacaggacaagcggcggatttgaaaagtacacaagcagcaatagatcaaataaacggcaaactaaatagactaatcggtaaaacaaacgaaaaattccaccaaatagaaaaagaattttcagaagtggaaggacgaatacaagatctagaaaaatacgtagaagacacaaaaatagacctatggtcatacaacgcagaactattagtagcactagaaaaccaacacacaatagaccttacagattcagaaatgaataaattattcgagaaaaccaagaaacaattaagagaaaacgcagaagacatgggaaatggatgcttcaaaatataccataaatgtgacaacgcctgcattggatcaataagaaacggaacatatgaccatgacgtataccgagatgaagcactaaacaacagatttcaaataaaaggagtagaattaaaatcaggctataaagattggatattatggatatcattcgccatctcatgcttcctactttgcgtagcattattgggattcataatgtgggcatgccaaaaaggtaacataagatgtaacatctgtata

SEQ ID NO: 51294 - RNA, 1698 nt, synthetic construct
  misc_feature 1..1698: note = derived and/or modified sequence opt6 from anti-influenza_Chain
  source 1..1698: mol_type = other RNA
atgaaaaccataatagcattatcatatatcctatgtctcgtgttcgcacaaaaattaccgggcaatgataacagtacagcaacattatgcctaggccatcacgcagtcccaaacggaacaattgtcaagacaataactaacgaccaaatagaagtaacaaacgccacagaattagtacaatcaagctccacaggagagatatgcgactcaccacaccaaatactagacggagaaaattgtactttaattgacgcactattaggagacccacaatgcgacggatttcaaaacaaaaaatgggatttattcgtagaaagatcaaaagcctattcaaaatgttatccatacgacgtaccagactacgcaagcttaagatctctagtagcttcatcaggaacactagaattcaataatgaatccttcaattggactggagtcacacaaaatggaacatcctcagcatgcatccgtaggagtaacaactcatttttttcaagactaaattggctaactcacctaaaattcaaatacccagcattaaatgttacaatgccaaacaatgaaaaattcgacaaattatacatatggggagtacaccacccaggaacagataatgatcaaatattcctatacgcacaagccagcggaagaataacagtgtccacaaaaagatcacaacaaacagtaatcccaaacataggttcaagaccaagagtaagagatataccaagccgaatctcaatatactggacaatagtaaaacctggagacatactcttaataaattcaacaggaaacctcatagcaccaagaggatactttaaaatacgatcaggcaaatcttcaataatgagatcagacgcacccataggtaaatgcaattcagaatgtattactccaaacggatcaataccaaatgataaaccattccaaaatgtcaatcgaataacttacggagcctgtccgcgatacgtaaaacaaaatacattaaaacttgccacaggtatgagaaacgtacctgaaaaacaaaccagaggaatattcggagcaatagcaggattcatagaaaacggatgggaaggtatggtagatggatggtacggattccgacatcaaaatagtgaaggaatcggacaagccgcagacctaaaaagcacacaagcagcaatagaccaaataaacggaaaactaaatcgattaataggaaaaacaaatgaaaaatttcaccaaatagaaaaagaattctcagaagtagagggaagaatacaagacttagaaaaatacgtcgaagacacaaaaatagacctttggtcatataatgcagaattacttgtagccttagaaaatcaacacacaatagatttaactgatagcgaaatgaacaaactgtttgaaaaaactaaaaaacaactaagagaaaacgcagaagatatgggcaacggatgtttcaaaatctaccacaaatgtgacaacgcatgcataggctcaattcgaaacggaacatatgaccacgacgtatatagagacgaagcactaaacaatcgatttcaaataaaaggagtagaactaaaaagcggatacaaagactggatcctctggatatcatttgccataagctgttttctattatgcgtagcactcttaggattcataatgtgggcatgccaaaaaggaaatatacgatgcaatatatgcatc

SEQ ID NO: 51295 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactatcatatatattatgtctagtattcgcacaaaaacttcctggaaacgacaacagtacagcaacgttatgcttaggacaccatgccgtcccaaatggaacaatcgtaaaaacgataactaacgaccaaatcgaagtcacaaacgctacagaattagtccaatcatcatcaaccggagaaatttgtgactctccacatcaaatactagacggagaaaattgcactctaatagatgccctattaggagatccacaatgtgacggcttccaaaacaaaaaatgggacctatttgtagaaagaagcaaagcctactctaattgctacccatacgatgtaccagactacgcatccttaagatctctagtcgcatcatcaggaacattagaattcaacaatgaatcatttaactggacaggagtaacccaaaacggcacatcaagcgcatgcataagacgatcaaacaactcatttttctcacgattaaattggttaactcatttaaaattcaaatacccagcactcaacgtaacaatgccaaataatgaaaaattcgacaaactatatatatggggtgtacaccacccaggaactgacaatgatcaaatatttttatacgcacaagctagtggcagaataacagtaagcacaaaaaggtcacaacaaactgtaattccaaatataggatcaagaccacgagtaagaaacataccttctcgaatatcaatatactggacaatcgtaaaacctggtgacatactcctaataaactcaacaggaaacctaatcgctccaagaggttatttcaaaataagatcaggaaaatcatcaataatgagatcagacgcaccaataggaaaatgtaactctgaatgcataactcccaacggatctattcctaacgacaaaccattccaaaacgtaaatcgaataacatacggagcatgccccagatatgtcaaacaaaacacattaaaattagcaacaggaatgagaaacgtaccagaaaaacaaaccagaggaatctttggagcaatcgcaggctttattgaaaatggatgggaaggtatggtcgacggttggtacggattcagacatcaaaactcagaaggaatcggccaagcagcagaccttaaatcaacacaagcagcaatcgaccaaattaacggaaaactaaacagattaatcgggaaaacaaacgaaaaattccaccaaatagaaaaagaattctcagaagtagaaggccgaatacaagatctagaaaaatatgtcgaagatacaaaaatagacctttggtcatataatgcagaattactagtagccttagaaaaccagcacacaatagatttaacagactcagaaatgaacaaattattcgaaaaaacaaaaaaacaacttagagaaaatgcagaagacatgggaaacggttgcttcaaaatatatcataaatgtgacaacgcatgcataggatcaataagaaatggaacatacgaccacgacgtatacagagacgaagcactaaataatagattccaaataaaaggagtcgaactaaaatccggatataaagactggatattatggatatctttcgccataagctgctttctcctatgcgttgcattactaggattcataatgtgggcatgccaaaaaggtaacataagatgcaacatttgcata

SEQ ID NO: 51296 - RNA, 1698 nt, synthetic construct
  misc_feature 1..1698: note = derived and/or modified sequence opt6 from anti-influenza_Chain
  source 1..1698: mol_type = other RNA
atgaaaacaataatagcattaagttacatattatgccttgtattctcacaaaaattaccaggcaatgataactccacagcaacactatgtttaggacaccatgcagtcccaaacggtacgatagtaaaaacaataacaaacgatcaaatcgaagtaacaaacgcaaccgaattagtccaaagttcaagtacaggaggaatatgcgactcacctcaccaaatactggatggagaaaactgcacattaatcgatgcactactcggagaccctcaatgcgatggattccaaaacaagaaatgggacctatttgtagaacgatcaaaagcatattcaaattgctacccatatgacgttccagattatgctagcttacgaagcctagtagcatcatcaggaaccttagagttcaacaatgaatcattcaactgggccggtgtaacacaaaatggaacatcgtcagcatgcaaacgaagatcaaacaagagcttcttcagtagactaaattggctaacacacctaaaatacaaatacccagctctaaatgtaacaatgccaaacaatgaaaaatttgataaactatacatctggggagtacatcaccctgttacagactcggaccaaataagcctatatgcccaagcaagtggacgaataacagtaagtacaaaacgctcacaacaaacagtgatacccaatataggatacagacccagagtcagagacataagctcaagaatatcaatatactggacaatagtaaaaccaggagacatactattaataaacagtacaggaaacttaatagcacctagaggttacttcaaaattagatcaggtaaaagcagcataatgagatctgacgcgccaataggtaaatgtaacagtgaatgcataacaccaaatggatcaataccaaacgataaaccattccaaaacgtaaacagaataacttacggagcatgcccacgctatgtcaaacaaaacaccctaaaactcgcaacaggaatgagaaatgtacctgaaaaacaaacaagaggaatttttggagcaatagcaggctttatagaaaacggatgggaaggaatggtagatggatggtacggatttagacaccaaaactcagaaggaacaggacaagcagcagacctaaaatcaacacaagcagccataaatcaaataaatggaaaattaaatagactaatcggaaaaactaatgaaaaattccaccaaatagaaaaagaattttcagaagtagaaggacgaatacaagacttagaaaaatacgtagaagatacaaaaatagacctctggtcatacaacgcagaactcctagtagccctcgaaaatcaacatacaatagacctcacagacagtgaaatgaacaaactattcgaaagaactaagaaacaactaagagaaaatgccgaagacatgggaaatggatgctttaaaatataccataaatgcgacaacgcttgcatagaatcaattagaaacggcacatacgatcacgatgtatatagagacgaagcactaaataacagattccaaataaaaggagtcgaactaaaatcaggatacaaagattggatcttatggatatcattcgctatatcatgtttcctattatgcgtagctttactcggatttattatgtgggcatgccaaaaaggaaacatcaggtgcaatatatgcata

SEQ ID NO: 51297 - RNA, 1698 nt, synthetic construct
  misc_feature 1..1698: note = derived and/or modified sequence opt6 from anti-influenza_Chain
  source 1..1698: mol_type = other RNA
atgaaaacaataatagcactgtcatacatattatgcctagtcttcgcacaaaaactaccaggaaacgacaactcaacagcaacattatgcctaggacaccacgctgtaccaaacggaactatcgtaaaaacaatcacaaacgaccaaatagaagtaactaatgcaacagaattagttcaaagttcaagtacaggtggaatatgcgactcaccacaccaaatattagacggcgaaaattgcactctcatcgatgcattattaggggacccacaatgtgacggattccaaaacaaaaaatgggatttattcgtagaaagatcaaaagcatacagcaactgttacccatacgacgtgcccgattacgcttcattacgatcactagtagcatcctccggaacacttgaatttaatgatgaatcatttaattggacaggagtaacacaaaatggaacatcaagttcatgcaaaagacgatcaaacaattcattcttctcaagacttaactggctgacacatttaaaattcaaataccctgcactaaacgttacaatgcccaacaacgaaaaatttgacaaactatacatatggggagtacatcaccctgttacagacaatgatcaaatattcttatacgcacaagcctcaggccgaataaccgtatctacaaaaagatcacaacaaacggttataccaaacataggaagtagaccaagaatacgaaatataccaagtagaatatcaatatattggaccatcgtaaaacctggtgatatattactcataaacagcacaggaaatctaatcgctccaagaggttacttcaaaataagaagcggaaaatcatcaataatgcgatcagacgcaccaataggcaaatgcaacagcgaatgtataacacccaatggatcaataccaaacgacaaaccattccaaaatgttaacagaataacttacggcgcatgccccagatacgtaaaacaaaatacattaaaactagccacaggaatgagaaatgttcccgaaaaacaaacacgaggaatattcggagcaatcgcgggcttcatagaaaacggatgggaaggaatggtagacggctggtacggatttagacatcaaaattcagaaggaatagggcaagcagcagacctcaagtcaacacaagcagcaataaaccaaattaatggcaaactaaacagactaataggaaaaacaaacgaaaaattccaccaaattgaaaaagaattctccgaagtggaaggaagaatccaagacctagaaaaatacgtagaagatacaaaaatagatctttggtcatataatgctgaattactagtggctttagaaaaccaacatactattgacttaacagactcagaaatgaacaaactattcgaacgaacaaaaaaacaattaagagaaaacgcagaagacatgggaaacggatgtttcaaaatataccacaaatgcgacaatgcctgcataggctcaatacgaaacggaacttacgaccacgatgtatatagagatgaagcactaaacaacagattccagataaaaggagtagaactaaaatctggctataaagactggatattatggataagcttcgcaatctcatgctttttactatgtgttgcattactcggattcataatgtgggcatgccaaaaaggaaacataagatgtaacatatgtata

SEQ ID NO: 51298 - RNA, 1683 nt, synthetic construct
  misc_feature 1..1683: note = derived and/or modified sequence opt6 from anti-influenza_Chain
  source 1..1683: mol_type = other RNA
atggaaaaaatagtactactattcgcgatagtatcattagtaaaaagcgaccaaatatgcatagggtaccatgcaaacaactcaacagaacaagttgacacaattatggaaaaaaatgttacagtaacccatgcacaagatatattagaaaaaacacacaatggtaaactctgcgatctagatggtgtaaaaccactaatattacgagactgctcagtagcaggatggctactaggaaatccaatgtgcgatgaattcataaacgtaccagaatggtcatacatagtggaaaaagcaaatcctgtcaacgacctttgttatccaggagattttaatgattacgaagaattaaaacatctattaagccgaataaaccatttcgaaaaaatacaaataataccaaaaagtagttggtcaagtcacgaagcatcactaggcgtttcatcagcatgtccataccaaggaaaatcatcatttttccgcaacgtcgtatggctaataaaaaaaaactccacatacccaactataaaacgatcatacaataacacaaaccaagaggacctgttagtcttatggggcatacatcacccaaatgacgccgcagaacagacaaaactctaccaaaatccaacaacatacatatcagtaggaacctcaaccttaaaccaacgactagtaccaagaattgcaactaggagcaaagtaaatggccaaagtggcagaatggaattcttttggactatattaaaacctaatgatgcaataaacttcgaatcaaatggcaattttatagccccagaatacgcatataaaatcgtgaaaaaaggagactcaacaataatgaaatcagaacttgaatacggcaactgcaacacaaagtgccaaacaccaatgggtgcaataaatagctccatgcccttccacaacatacacccattaaccataggagaatgccctaaatacgtaaaaagcaacagattagtactagcaacgggactacgtaatagcccacaaagagaaagaagaagaaaaaaaagaggcctctttggagcaatagcaggctttatagaaggaggctggcaaggaatggtagatggttggtacgggtaccatcattcaaatgaacaaggatcaggatatgcagcagataaagaaagcacacaaaaagccatagacggagtaacaaacaaagtaaactcaataatagacaaaatgaacacacaattcgaagccgtaggaagagaattcaataacctagaaagacgaatagaaaacctaaataaaaaaatggaagacggtttcttggacgtctggacatataacgcagaactactagtcttaatggaaaacgagagaacattagacttccacgattcgaacgtaaaaaacctatacgacaaagtacgcttacaattaagagacaacgcaaaagaactaggaaacggatgcttcgaattctatcacaaatgtgacaacgaatgtatggaatccgtaaggaacggaacatacgactacccacaatattcagaagaagcacgacttaaaagggaagaaatctcaggagtaaaactagaatcaatcggcatataccaaatacaacacagtggaggacgaagctcattagaaggaccacgatttgaacaaaaactaatatcagaagaagatctaaacatgcacacagga

SEQ ID NO: 51299 - RNA, 1683 nt, synthetic construct
  misc_feature 1..1683: note = derived and/or modified sequence opt6 from anti-influenza_Chain
  source 1..1683: mol_type = other RNA
atggaaaaaattgtattattactagcaattgtaagtctcgtaaaatcagaccaaatatgcataggataccatgcaaacaactcaacagaacaagtagataccataatggaaaaaaatgttactgttacccatgcacaagatatactagagaaaacacataatggtaaattatgtgatctagacggtgtaaaaccattaatattaagagattgttcagttgcaggttggctactaggaaacccaatgtgtgacgaattcatcaacgtaccagaatggtcatacatagtagaaaaagctaaccctgcaaatgatctatgttatcccggcaactttaacgactacgaagaactaaaacacctactaagcaggataaaccacttcgaaaaaatacaaataatccccaaatcttcatggagtgaccacgaagcatcatcaggcgtatcatccgcctgcccgtatcaaggtaaatcatcatttttcagaaacgtcgtatggttaataaaaaaaaactcatcatacccaacaataaaaagatcctataacaacacaaatcaagaagacctattagtactatggggaatacatcacccaaacgatgcagcagaacaaactcgattatatcaaaacccaacaacttacatatctgtaggaacaagcaccctaaaccaaagattagtcccaaaaatcgcaactagaagcaaagtaaacggacaatcaggcagaatggaattcttttggacaatcctaaaaccaaacgacgcaataaacttcgaaagcaacggaaacttcatagcaccagaatacgcatacaaaattgtaaaaaaaggagactcagccataatgaaaagcgaactagaatacggaaattgtaacacaaaatgccaaacaccaatgggtgccataaattcaagcatgcccttccacaacatacatccactaactataggagaatgcccaaaatatgtcaaaagcaacagactagtactagcaacagggttaaggaattcaccacaaagagaaagaaggagaaaaaaaagaggattattcggagcaatagctggattcatagaaggaggatggcaaggaatggtagacggatggtacggatatcaccactcaaacgaacaaggaagcgggtatgcagcagacaaagaatcaacgcaaaaagcaatagacggtgtaacaaacaaagtaaatagcataatagataaaatgaatactcaatttgaagcagtaggaagagaattcaacaacttagaaagaagaatagaaaacttaaacaaaaaaatggaagacggattcttagacgtatggacatacaacgcagaactactagtattaatggaaaacgaaagaactttagacttccacgactcaaacgtaaaaaacttatatgataaagtaagactacaactaagagataacgcaaaagaattaggaaacggatgcttcgaattctatcataaatgtgataatgaatgcatggaatcagttagaaacgggacctatgattacccacaatattcagaagaagcaagattaaaacgagaagaaatatccggcgtaaaattagaaagtatagggatataccaaatacagcattcaggaggaagatcttctttagaaggaccaagattcgaacaaaaactaataagcgaagaagacctaaatatgcatacagga

SEQ ID NO: 51300 - RNA, 1701 nt, synthetic construct
  misc_feature 1..1701: note = derived and/or modified sequence opt6 from anti-influenza_Chain
  source 1..1701: mol_type = other RNA
atggaaaaaatagtattattactagcaatcgtaagtttagtcaagtctgatcaaatttgtatagggtaccatgcaaacaattcaacagaacaagtagacacaataatggaaaaaaacgtaactgtaacacacgcacaagatatattagaaaaaacccataacggtaaactatgcgacttagacggcgtaaaaccactcatactaagagattgctcagtagcgggatggttattaggcaatccaatgtgcgacgaattcataaatgtaccagaatggtcttacatagtagaaaaagcaaatccagcaaatgacttatgctatcctggaaattttaacgactacgaagaactaaaacatttattatcaagaataaaccacttcgaaaagatacaaataataagcaaatcaagttggagtgaccacgaagcctcatccggcgtaagctcagcctgcccataccaagggacaccatcattcttcagaaacgtcgtttggctcataaaaaaaaacaacacctacccaacaataaaaagaagttacaacaacacaaaccaagaagatttactaatattatggggaatacatcacagcaacaacgccgcagaacaaacaaaactctaccaaaatccaacaacatatataagtgtaggaacatccacattaaacctaagactagtaccaaaaatagcaacaaggagtaaagtaaacggacaatcaggaagaatggacttcttctggaccatactaaaaccaaatgatgctataaacttcgaatcaaacggaaatttcatagcaccagaatacgcatataaaatagtaaaaaaaggagactcagcaataatgaagagtgaagttgagtatggaaactgtaacacaaaatgccaaaccccaataggagcaataaattcatcaatgccattccacaacatacacccacttacaataggagaatgtccaaaatacgtaaaatcaaacaaattagtgcttgcaacaggattaagaaactccccactgagagaaaggcgacgaaaaaggggactatttggagcgatagcaggcttcatagaaggaggatggcaaggaatggtcgacggatggtacgggtatcaccattcaaatgaacaaggatcaggatatgccgcagacaaagaatcaactcaaaaagcaatagacggagtcacaaacaaagtaaactcaataatcgacaaaatgaacactcaatttgaagcagtaggaagagaattcaacaacctcgaacgaagaatagaaaacctaaataaaaagatggaagacggattcttagacgtatggacctacaatgcagaactactagtcctaatggaaaacgaaagaactctagatttccacgatagcaacgtaaaaaacttatacgataaagtaagattacaactcagagacaacgcaaaagaattaggaaatggatgctttgaattttaccataaatgcgacaacgaatgcatggaaagcgtacgaaatggaacatatgattaccctcaatacagtgaagaagcaagactaaaacgagaagaaatatcaggagtcaaactagaaagtataggaacatatcaaatactaagcatatatagtactgtcgctagctcactagcactagctataatggttgctggattatcactatggatgtgctcaaacggaagcttacaatgcagaatttgcata

SEQ ID NO: 51301 - RNA, 1701 nt, synthetic construct
  misc_feature 1..1701: note = derived and/or modified sequence opt6 from anti-influenza_Chain
  source 1..1701: mol_type = other RNA
atggaaaaaatcgtattacttcttgcaatagtatcattagtaaaaagtgatcaaatatgtataggataccacgcaaacaatagtacagagcaagtagacacaataatggagaaaaatgtaacagtcacccacgcacaagacatcctagaaaaaacacataacggcaaattatgtgacttagacggagtaaaacctttaatattacgggactgctcagtagctggctggttattaggaaaccctatgtgtgatgaattcatcaatgttccggaatggtcatacattgtcgaaaaagccaacccagccaacgacctatgttatccaggaaatttcaacgactacgaagaattaaaacatctattaagtcgaataaatcacttcgaaaaaatacaaatcataccaaaaagcagctggagtgaccacgaagccagtagcggagtctcaagtgcttgcccatatcaaggaaccccatcattcttcagaaacgtagtatggctcataaaaaaaaacaacacataccccacaataaaacgaagctacaataatactaaccaagaagacctactaatcctatggggaatccaccatagcaacgacgcagctgaacaaaccaaactataccaaaatccaacaacctacataagcgtaggtacatcaacactaaaccaaagattagttccaaaaatagcaacaaggtccaaagtaaatggacaatctggacgaatggacttcttctggaccatactcaaaccaaatgacgcaataaatttcgaaagtaatggaaactttatagcaccagaatacgcatacaaaatagtaaaaaaaggagacagcgcaatagtcaaatcagaagtagaatatggaaattgcaacacaaaatgtcaaacaccaatcggagcaataaactcatcaatgccatttcataacatacacccactaacaataggtgaatgcccaaaatacgtcaaatcaaacaaattagtacttgcaacaggcttaagaaattcaccactaagagaaagaagaagaaaaagaggacttttcggggcaatagcaggattcatagaaggaggctggcaaggaatggttgatggatggtatggataccaccactcaaatgaacaaggaagtggctatgcagcggacaaagaaagtacacaaaaagcaatagatggtgtaacaaataaagtcaatagcataatagataaaatgaatacacaattcgaagcagtaggaagagaatttaacaatctagaacgcagaatagaaaatttaaataaaaaaatggaagacggattcttagacgtatggacatataatgcagaactactagtactcatggaaaatgaacgaacactagattttcatgactcaaatgtcaaaaacctatatgacaaagtaagattacaattaagagacaacgcaaaagaattaggaaacggctgttttgaattttaccacaaatgcgacaacgaatgcatggaatcagtaagaaacggaacatatgactacccacaatactcagaagaagcaagactaaaaagagaagaaatttccggagtaaaactagaatctatcggcacttaccaaatcctatcaatatacagtacagtagcttctagtctagcattagcaataatggtagctggactaagtttatggatgtgctcaaacgggtctttacaatgcagaatatgtata

SEQ ID NO: 51302 - RNA, 1683 nt, synthetic construct
  misc_feature 1..1683: note = derived and/or modified sequence opt6 from anti-influenza_Chain
  source 1..1683: mol_type = other RNA
gataaaatatgtttaggtcaccatgcggtatcaaatggaacaaaagttaatacattaacagaaagaggcgtcgaagtagtcaatgctacagaaactgtagaaagaacaaatgtaccaagaatatgctcaaaaggaaaaagaacagttgatttaggacaatgtggattattaggaacaataactggtccaccacaatgtgatcaatttctagagttcagtgcagatctgattatagaaagaagagaaggatcggacgtatgttatcctggaaaatttgtaaatgaagaagcattgagacaaatactaagagaaagcggtggaattgacaaagaaacaatgggatttacatactcaggaatacgaacaaacggtacaacaagtgcatgtcggaggagtggcagttcattttatgccgaaatgaaatggttactatcaaatactgacaatgcagctttcccacagatgacaaaatcatataaaaatacacgaaaagatccggcattgataatatggggaatacaccattcaggtagtacaacagaacaaacaaaattatatggctcaggaaataaacttataacagtaggcagctcaaattatcaacagagtttcgtcccaagtccaggagcaagaccccaagtaaatggacaatcaggaagaatagatttccactggttaatattaaatccaaatgacactgtgacattttcatttaatggagcatttatcgcaccagatagagcaagtttcttaagaggaaagtcaatgggtattcaatcagaagtacaagtagatgcaaattgtgaaggagactgttatcatagtggtggaaccataatatcaaacttgccatttcaaaatataaattcaagagctgtaggaaaatgcccaaggtatgtcaaacaagaatctttattattagcaactggaatgaaaaatgtaccggaaataccgaaaagaagaagacgaggactattcggtgcaatagctggtttcattgaaaatggatgggaaggcctcatcgatggctggtacggtttcagacaccaaaatgctcaaggtgaaggtacagcagcagactataaaagtacacaatccgcgatagaccaaatcactggaaagttaaatagattaatagagaaaacaaatcagcaatttgaattaatagataatgaatttacagaagtagaaagacaaataggaaacgtaataaactggacaagagattcaatgaccgaagtatggagttataatgccgaattattagtcgcaatggaaaatcaacataccatagatctagctgacagtgaaatgaacaaactatatgaaagagttaaaagacaattaagagaaaacgcagaagaagatgggacaggatgttttgaaatattccataaatgtgatgatgactgtatggcgtccataagaaataatacatatgaccattcaaaatacagagaagaagcaatccaaaatagaatacaaatagacccagtaaaattatcatcaggatacaaagactcaggccgattagtgccaagaggaagtcctggaagtgggtacataccagaagccccacgagacggacaagcatatgttcgaaaagatggtgaatgggtactcttaagcactttccttggtaaaccaataccaaatcctcttctaggtctagacagtacaggc

SEQ ID NO: 51303 - RNA, 1701 nt, synthetic construct
  misc_feature 1..1701: note = derived and/or modified sequence opt6 from anti-influenza_Chain
  source 1..1701: mol_type = other RNA
atggagaagatagttctactactagcaatagtatcactagtaaaaagcgaccaaatctgtataggatatcacgcaaacaacagtaccgaacaagtagacacaataatggaaaaaaacgtcacagtaacacacgcacaagacatactagaaaaaacccacaacggaaaattatgtgacctagatggagtaaaacccctaatactaagagactgcagcgtagcaggatggcttctaggcaacccaatgtgcgacgaattcataaatgtaccagaatggtcatatatagttgaaaaagcaaatcccgcaaatgacctatgctacccaggaaacttcaacgattatgaagaactaaaacacttattgtcaagaattaatcactttgaaaaaatacaaataatacctaaaagttcttggtcagatcatgaagccagtagcggcgtaagcagtgcatgtccttatcaaggtacgccctctttcttcagaaacgtagtatggctaatcaaaaaaaataatacatacccaacaataaaaaggtcatacaacaacacaaaccaagaagatttactaatactatgggggatacaccacagcaatgacgcagcagaacaaacaaaattatatcaaaaccccacaacatatatttcagtaggaacatcaacattaaatcaaagattagtaccaaaaatagcaacaagatcaaaagtaaacggccaaaacggaagaatggactttttctggactatattaaaacccaacgacgcgataaacttcgaatcaaacggaaacttcatagcaccagaatacgcctacaaaatagtaaaaaaaggagacagcgcaatagtaaaaagcgaagttgaatacggaaattgcaacacaaaatgccaaacaccaattggtgcaataaacagtagcatgccctttcacaacatccacccactcacaattggagaatgcccaaaatacgtaaaatcaaataaattagtattagcaacaggattaagaaactccccactaagggaacgacgaagaaaaagaggactattcggagcaatagctgggtttatcgaaggaggttggcaaggaatggtagatggatggtatggataccatcacagtaacgaacaaggaagtggctatgccgcagacaaagaaagtactcaaaaagcaatagacggagtaacaaacaaagtaaattcaataatcgataaaatgaacacacaatttgaagcagtaggaagagaatttaataacctagaacgaagaatagaaaacctaaacaaaaaaatggaagacggattcttagacgtatggacatacaatgcagaactgctagtacttatggaaaacgaacgaaccctagactttcatgactcaaacgttaaaaacctatatgacaaagttagactacaactaagagacaacgcaaaagaattaggaaacggatgcttcgaattttaccacaaatgcgataacgaatgtatggaaagtgtacgaaacggaacatacgactatcctcaatattcagaagaagcaagactaaaaagagaagaaatatctggagtgaaattagaatcaatcggaacttaccaaatactctcaatatactcaactgtagcctcaagcctcgcactagcaataatggtagccggtctatcattatggatgtgcagcaatggaagtctacaatgcaggatatgcata

SEQ ID NO: 51304 - RNA, 1683 nt, synthetic construct
  misc_feature 1..1683: note = derived and/or modified sequence opt6 from anti-influenza_Chain
  source 1..1683: mol_type = other RNA
gataagatatgtctaggtcaccatgcagtaagtaatggaaccaaagtaaacacgctaaccgaacgaggagttgaagtagttaacgcaacagaaacggttgaaagaacaaatgtaccaagaatatgttcaaaaggaaaacgaacagtagatttaggacaatgcggactactaggtacaataacaggaccaccacaatgtgaccaatttttagaattttcagcagatctaataatcgaaagaagagaaggaagtgatgtgtgctacccaggaaagtttgttaatgaagaagcattaagacaaatattaagagaatcaggcggaatagataaagaaacaatggggtttacttattcaggaataaggactaatgggacaacatcagcatgtagacgatcaggtagttcattttacgcagaaatgaaatggctattatctaacacagacaatgcagcttttccacagatgacaaaatcctataaaaacaccaggaaagatccagctttaataatatggggaatacatcattcaggatcaacaacagaacaaaccaaattatatggaagcggaaacaaactcataacagttggatcatcaaactatcaacaatcatttgtaccatcaccaggagctagaccacaagttaatggtcaatcaggacgtatagattttcattggttaatattgaacccaaatgatacagtaacattttcatttaatggagcattcatagcacccgacagagcctcattcttaagaggaaaaagtatgggaatacaaagcgaagttcaagttgatgcgaactgcgaaggagactgttaccactccggaggaacaataatatcaaacctaccttttcaaaacattaatagcagagcagtaggaaaatgtccacgctacgttaaacaagaatcattattacttgcaacaggaatgaaaaatgtacccgaaataccgaaaagacgaagaagaggactattcggagcgatagcaggattcatagaaaatggatgggaaggattaatagacggatggtatggctttagacatcaaaacgctcaaggcgaaggaactgcagcagattataaatcaacacaatcagcaatagatcaaataacaggcaaactaaatagacttatagaaaagacaaatcaacaattcgaactaattgataatgaatttacagaagtagaaagacagattggtaacgtcataaactggacacgagatagcatgactgaagtttggtcatataacgcagaactattagtagctatggaaaaccagcatacaatagacctagcagatagcgaaatgaataaactatatgaaagagtaaaaagacaactgagagaaaacgcagaagaagacggaacaggatgcttcgaaatatttcataaatgcgacgacgactgtatggcatcaataagaaataacacatatgatcactcaaaatatagagaagaagcaatacaaaacagaatacaaatagatcccgtaaaattgtcctcaggatataaagattcaggaagattagttcccagaggatcacctggcagtggatatattcctgaagcaccacgagatggacaagcctacgttagaaaagatggagaatgggtcttattatcgacattcctaggaaaaccaataccaaacccacttctaggcctagactcaaccgga

SEQ ID NO: 51305 - RNA, 1683 nt, synthetic construct
  misc_feature 1..1683: note = derived and/or modified sequence opt6 from anti-influenza_Chain
  source 1..1683: mol_type = other RNA
atggaaaaaatagtactattatttgcaatagtatcactagtaaaatcagaccaaatatgcataggataccacgctaataattctacagaacaagtagacaccataatggaaaaaaacgtaacagtaacacacgcacaagacattctggaaaaaacacacaacggaaaattatgtgatttagacggcgtaaaaccactaatattacgagactgcagcgtagctggctggctattaggaaacccaatgtgcgatgaatttataaatgtacccgaatggtcgtacatagttgaaaaagcaaacccagtcaatgacctatgctacccaggagattttaatgactacgaagaacttaaacatttattaagcagaataaatcactttgaaaaaatacaaataatcccaaaaagctcatggtcatcacatgaagctagcttaggagtatcatcagcctgtccctatcaaggaaaatcatcatttttcagaaatgtagtctggcttataaaaaaaaactcaacatacccaacaataaaacgaagttataataatacaaatcaagaagacctacttgtactatggggaatccaccatcccaacgacgcagctgaacaaactaaattatatcaaaacccaaccacatatatatctgtaggtacaagtacactaaaccaaagattggtcccaagaattgccacaagatcaaaagtaaatggccaatcaggaagaatggaatttttttggaccatactaaaacccaacgatgcaataaactttgaatctaatggcaatttcatagccccagaatatgcatacaaaattgtcaaaaaaggtgattcaacaataatgaaatcagaactagaatacggaaattgcaatacaaaatgccaaacaccaatgggtgctattaactcatcaatgcctttccacaacatacacccactaacaattggagagtgcccaaaatacgttaaaagtaatagactggttctcgccacaggattacgaaacagtccacaaagagaaagaagaagaaaaaaaagaggactcttcggagcaatagcaggatttatagaaggaggatggcaaggcatggtagacggatggtatggatatcaccactcaaacgaacaaggatccggttacgcagcagacaaagaatctacacaaaaagcaatagacggagtaacaaataaagtcaacagtataattgacaaaatgaacacacaatttgaagctgtaggcagagaattcaataacttagaaagaagaatagaaaacctaaacaaaaaaatggaagacggatttttagatgtctggacatataacgcagaactactagttcttatggaaaacgaacgaacattagactttcacgactcaaacgtaaaaaatctatacgacaaagtcagactacaattaagggataacgccaaagaactaggcaacggatgttttgaattctaccataaatgcgataacgaatgcatggaatcagtaagaaacggcacatatgactacccacaatactcagaagaagcaagactaaaaagagaagaaatatccggagtaaaactagaatcaataggcatataccaaatacaacacagcggcggacgatcatctttagaaggaccaaggttcgaacaaaaactcatttcagaagaagacctcaacatgcacacagga

SEQ ID NO: 51306 - RNA, 1683 nt, synthetic construct
  misc_feature 1..1683: note = derived and/or modified sequence opt6 from anti-influenza_Chain
  source 1..1683: mol_type = other RNA
atggaaaaaatcgtactattactagcaattgtcagtttagtaaaaagcgaccaaatttgtataggctaccatgctaataattcaacagaacaagtagacacgataatggaaaaaaacgtaacggtaacccacgcacaagatatactagaaaaaacccacaacggaaaactatgtgatctagatggagtaaagccactaatcttaagagactgctcagtcgcaggctggctattgggaaaccccatgtgcgatgaattcattaacgtcccagaatggtcatacatagtagaaaaagcaaatccagcaaatgacctatgttacccaggaaacttcaacgattacgaagaattaaaacacctattatcaagaatcaatcactttgaaaaaatacaaataatacctaaatcgagctggtctgatcatgaagcaagctcaggagtaagcagcgcctgcccataccaaggaaaaagtagtttcttccgaaacgtagtatggttaataaaaaaaaatagcagctacccaacaataaaaagatcctacaacaacacaaaccaagaagatctgttagtattatggggaatacaccaccccaacgacgcggccgaacaaaccagattataccaaaacccaacaacatatatatcagtaggaacctcaaccttaaaccaacgattagtaccaaaaatagcaacaagaagcaaagtaaacggtcaatccggtagaatggaattcttctggactatactaaaaccaaatgacgctattaatttcgaaagcaacggcaatttcatagcaccagaatacgcctacaaaatagtaaaaaaaggcgatagtgcaataatgaaatcagaattagaatacggaaattgcaatacaaaatgccagacaccaatgggagcaataaacagttcaatgccttttcacaacatacatcccttaactatcggagaatgcccaaaatacgtaaaaagcaatcgactagtactagcaactgggctacgaaacagtccacaaagagaaagaagacgaaaaaaacgaggcctgtttggagcaatagcaggattcatcgaaggcggctggcaaggaatggtagacggctggtatgggtatcaccactcaaatgaacaaggctcaggatacgcggcagacaaagaaagcacacaaaaagcaatagatggagtaactaataaagtaaactctataatagacaaaatgaacacacaatttgaagcagtaggaagagaattcaacaacttagaacgaagaatagaaaacttaaacaaaaaaatggaagatggattcctagatgtctggacctataacgcagaactattagtactaatggaaaacgaaagaacattagactttcatgactcaaatgtaaaaaacctctacgataaagtaagactacaattaagagataacgccaaagaattaggaaatggatgttttgaattctatcacaaatgcgataacgaatgcatggaaagtgtaaggaatggcacatacgattacccccaatatagcgaagaagcaagactaaaacgagaagaaatctcaggagtaaaactagaatcaataggaatatatcaaatacaacactcaggaggacgaagctcactcgaagggcctagattcgaacaaaaactaataagcgaagaagacttaaacatgcacacagga

SEQ ID NO: 51307 - RNA, 1701 nt, synthetic construct
  misc_feature 1..1701: note = derived and/or modified sequence opt6 from anti-influenza_Chain
  source 1..1701: mol_type = other RNA
atggaaaaaatagtcttactactagcaatagtatcactagtaaaatcagaccaaatttgcataggttaccacgcaaataactcaacagaacaagtagatacaataatggaaaaaaatgtaacagtaacccatgcacaagacatactagaaaaaacacacaacggaaaattatgtgacctcgatggagtaaaaccattaatattacgagactgcagtgtagcaggatggctactaggtaatccaatgtgcgacgaattcataaatgtaccagaatggtcgtatatagtagaaaaagcaaacccagctaatgacctctgctacccaggtaatttcaacgactacgaagaactaaaacacctcttgtcacgaataaatcacttcgaaaaaatacaaataataccaaagagctcatggagtgaccacgaagcatcatccggagtaagttctgcatgcccataccaaggaaccccatcattctttagaaacgtagtgtggttaataaaaaaaaacaacacctatccaacaataaaaagatcatataataacacaaaccaagaagatctccttatattatggggcatacaccactcaaatgacgctgcagaacaaacaaaactctaccaaaacccaaccacttacatatcagtaggaacctcaacattaaaccaaagattagtaccaaaaatagcaacaagaagtaaagtaaacggccaaaatggcagaatggactttttctggaccatactaaaaccaaatgacgcaataaatttcgaatcaaatggaaacttcatagcaccagaatacgcatacaaaatagtaaaaaaaggagacagtgccatagtaaaatcagaagtagaatatggaaactgtaacacaaaatgccagactcccataggagcaataaatagcagcatgccatttcacaatatacaccccctaacaataggagaatgcccaaaatacgtaaaatccaacaaattagtactagctacgggactaagaaattcaccactacgagaaagaagaagaaaaagaggattatttggagccattgcaggatttatagaaggaggatggcaaggaatggtagatggatggtacggataccaccattcaaacgaacaaggaagcggatatgcagcagacaaagagagtacacaaaaagcaatcgatggcgtaacaaacaaagtaaactctataatagacaaaatgaatacccaattcgaagcagtcggaagagaatttaataacctagaaagaagaatcgaaaacctcaacaaaaaaatggaagatggattcctagacgtttggacatataacgcagaattgttagtactaatggaaaacgaaagaacacttgactttcatgactccaatgttaaaaacctttacgataaagtaagactacaactaagagataacgcaaaagaattaggaaatggttgtttcgaattctaccataaatgtgataatgaatgtatggaaagcgtccggaacggaacatatgactacccgcaatatagcgaagaagctagactaaaaagagaagaaatctcaggagtaaaactcgaaagcatcggtacataccaaatattaagtatttacagtaccgtagcctcatcattagcattagcaataatggtggcaggattaagcttatggatgtgctcaaatggaagtctacaatgtagaatatgcata

SEQ ID NO: 51308 - RNA, 1701 nt, synthetic construct
  misc_feature 1..1701: note = derived and/or modified sequence opt6 from anti-influenza_Chain
  source 1..1701: mol_type = other RNA
atggaaaaaatagtcttactactagcaatagtatcactcgtaaaatcagaccaaatatgcataggatatcacgcaaacaattcaacagaacaagtagacacaatcatggaaaaaaacgtaacggtaacacatgcacaagacatacttgaaaaaacacacaacggaaaattatgcgatttagacggagtaaaacctctaatattacgagattgttcagttgcaggatggctattaggaaacccaatgtgtgacgaattcataaacgtaccagaatggtcttatatcgtagaaaaagcaaacccagcaaacgacttatgctacccaggaaatttcaatgattatgaggagttaaaacacctactatcaagaattaatcacttcgaaaaaatacaaataatatcaaaatcctcatggagcgatcacgaagcttcatccggagttagctcagcatgtccctatcaaggcacaccatcgttctttagaaacgtagtatggcttataaaaaaaaacaatacatacccaacaataaaaaggtcatataacaatacaaaccaagaagatctattaatactctggggaatacaccactcaaataacgcagcagaacaaacaaaactataccaaaacccaacaacgtatatcagtgtaggaacatctaccttaaacttaagactagtcccaaaaatagcaactagaagtaaagtaaatggacaatcaggaagaatggactttttctggacaatactcaaaccaaacgacgccataaactttgaatcaaacggaaacttcatagctcctgaatatgcgtataaaatagtaaaaaaaggagacagcgcaataatgaaatctgaagtagaatacggtaactgtaatactaaatgccaaacaccaataggtgcaatcaacagttcaatgccatttcacaacatacacccactaacaatcggagaatgtccaaaatacgtcaagtcaaataaactagtattagcaacaggattaagaaacagcccattaagagaaagaagaagaaaaagaggacttttcggagcaatagcaggattcattgaaggaggatggcaaggaatggtagacggatggtatggataccaccactccaatgaacaaggcagtggatacgcagcagataaagaaagcacacaaaaagcaatagacggagtaacaaacaaagtcaattcaatcatagacaaaatgaatacacaattcgaagcagtaggtagagaatttaataatttagaacgaagaatagaaaacctcaataaaaaaatggaagacggcttcttagatgtatggacttataatgccgaattattagtattaatggaaaacgaaagaacccttgactttcacgatagcaatgtaaaaaacctatacgacaaagttagattacaattaagagacaacgctaaagaactgggaaacggatgcttcgaattctatcacaaatgtgataatgaatgcatggaatcagtaagaaacggaacttacgactaccctcaatactcagaagaagcaagactaaaacgcgaagaaatatcaggagtgaaattagaaagtataggcacatatcagatattaagcatatattctactgttgcaagtagcctagcattagcaataatggtagccggcctaagcttatggatgtgctcaaatggctctctacaatgtagaatatgcata

SEQ ID NO: 51309 - RNA, 1701 nt, synthetic construct
  misc_feature 1..1701: note = derived and/or modified sequence opt6 from anti-influenza_Chain
  source 1..1701: mol_type = other RNA
atggaaaaaatagtactactattagctatcgtatccctagtcaaatcagaccaaatatgcataggatatcatgcaaacaactccacagaacaagtcgacacaataatggaaaaaaacgtaacagtaactcacgctcaagacatattagaaaaaacacataacggcaaactatgcgatctagacggagtaaaacctctaatactaagagactgctcagtagcaggatggctactaggaaacccaatgtgcgacgaattcataaatgtccctgaatggagttatatagtagagaaagccaatccagcaaacgacctatgctacccaggaaactttaacgactacgaagaacttaaacatctactatcaagaataaaccatttcgaaaaaatacaaatcataccaaaatcaagctggtcagatcacgaagccagctcaggagtaagtagtgcatgcccatatcaaggaacaccaagcttcttcagaaatgtagtttggctaatcaaaaaaaataatacgtatccaacaatcaaaagatcttacaataataccaaccaagaagatttattaatcttatggggaatacaccactcaaacgatgcagcagaacaaaccaaactatatcaaaacccaacaacatacatatctgtaggaacatcaacattaaaccaacgattagtaccaaaaatagccacaagaagtaaagtaaacggacaaagcggaagaatggatttcttctggacaatattaaaaccaaacgacgcaataaacttcgagtcaaacggaaactttatagccccagaatacgcatacaaaatagtaaaaaagggagactcagcaatagtaaaatcagaagtcgaatatggtaactgcaataccaaatgccaaacaccaataggcgcaataaactcttcaatgccctttcacaatatacacccattaacaataggcgaatgcccaaaatacgtgaaatcaaacaaattagtactggcaaccggattaagaaactcaccactaagagaaagacgaagaaaaagaggactcttcggagcaattgcaggattcatagaaggcggttggcaaggtatggtagacggatggtacggataccatcactcaaacgaacaaggcagcggatacgccgcagacaaagaaagtacacaaaaagcaatagacggagtaactaataaagtaaacagcattatcgacaaaatgaacacacaattcgaagccgtaggaagagaatttaacaatttagaacgacgaatagaaaacctaaacaaaaaaatggaagacggtttcttagatgtatggacatacaacgcagagctactagtactaatggaaaacgaaagaactctagacttccatgactcaaacgtaaaaaacttatacgataaagtaagactacaactacgagacaatgcaaaggaattaggaaatggctgtttcgaattttaccacaaatgtgacaatgaatgcatggaatccgtacgaaatggtacgtatgactacccccaatacagtgaagaagcacgactaaaaagagaagagataagcggagtaaaactagaatcaataggaacctatcaaatcctaagtatctattcaacagtagcatcatcactagcactagcgataatggtagccgggctatcattatggatgtgctcaaacggaagtttacaatgtagaatctgtatc

SEQ ID NO: 51310 - RNA, 1704 nt, synthetic construct
  misc_feature 1..1704: note = derived and/or modified sequence opt6 from anti-influenza_Chain
  source 1..1704: mol_type = other RNA
atggaaaaaatagtattactcctagcaatagtatcattagtaaaatcagatcaaatatgcataggctatcacgcaaataactcaactgaacaagtagataccataatggaaaaaaacgtaacggtaacacatgctcaagacatcctagaaaaaacacataacggaaaactatgcgacttagacggagtaaaaccattaatattgagagactgctcagtagcaggttggttattaggaaacccaatgtgtgacgaatttttaaacgtaccggaatggagctacattgttgaaaaaataaacccagccaacgatttatgttatccaggagatttcaatgactacgaagaactcaaacacttactttccagaataaatcattttgaaaaaatacagataataccaaaatcaagttggagtgattacgaagcatcatcaggagtaagctccgcatgtccataccaaggtagaagctctttctttagaaacgtagtatggctaataaaaaaaaacaacgcatatccaacaataaaaagatcatacaacaacacaaatcaagaagatctattagtactatggggtatacaccatccaaatgatgcagctgaacaaataagactatatcaaaaccctacaacatacatttcaataggaactagcacattaaatcagcgattagtaccaaaaatagccacaagaagtaaagtaaacggacaaagtggaagaatggaatttttctggacaatcctaaaatcaaacgatgcaataaactttgaatcgaatggaaactttatcgcacccgaatacgcatacaaaatagtaaaaaaaggagactcaaccattatgaaatctgaactcgaatatggaaattgcaacacaaaatgtcaaacacccataggtgcaataaactcaagcatgccatttcataacatacatccactaacaataggtgaatgccccaaatacgtaaaatcaaacagactagtcttagcaactggactaagaaacagccctcaaggagaaagacgacgcagaaaaagaggcctattcggagcaatagcaggattcatagaaggaggatggcaaggaatggtagacggttggtacggataccatcatagcaatgaacaaggaagcggatatgcagcagataaagaatcaacacaaaaagccatagacggagtaaccaacaaagtaaactcaattataaacaaaatgaacacccaattcgaagcagttggccgagaattcaataacctagaaagaaggattgaaaatctcaacaaaaaaatggaagatggttttttagacgtatggacttacaacgcagaactactagttctcatggaaaacgaaagaaccttagacttccatgacagtaacgtaaaaaacctatatgacaaagtaagactacaacttagagataacgcaaaagaattgggaaatggatgttttgaattttaccatcgatgcgacaacgaatgtatggaatccgtcagaaacggaacatacgactatccacaatacagcgaagaagctagactaaaaagagaagaaataagcggagtaaagttagaaagtatgggaatatatcaaatactaagcatatactcaacagtagcaagtagcttagccctcgcaatcatggtagctggattattcctctggatgtgtagcaacggatcactacaatgtagaatatgcata

SEQ ID NO: 51311 - RNA, 1704 nt, synthetic construct
  misc_feature 1..1704: note = derived and/or modified sequence opt6 from anti-influenza_Chain
  source 1..1704: mol_type = other RNA
atggaaaaaattgtactactattagctatagtaagcctggtaaaatcagatcaaatatgcataggttatcacgcaaacaactcaaccgaacaagtcgataccataatggaaaaaaacgtcacagtcacacatgcacaagacattttagaaaaaacacacaacggtaaactatgcgatctagatggcgtaaaaccactaatacttagagactgcagtgtagctggttggttattaggaaaccctatgtgcgacgaattcatcaacgtacccgaatggtcatacatagtagaaaaagcaaacccaacaaacgacctatgctacccaggatcattcaacgattacgaagaattaaaacacctattatcaaggataaaccatttcgaaaaaatacaaataatcccaaaaagctcatggtcagatcacgaagcaagcagcggcgtcagctcagcatgtccatacttaggatcaccaagcttctttagaaatgtagtctggctcataaaaaaaaactcaacatatccaacaataaaaaaatcatacaacaacacaaaccaagaagacctattagtcttatggggaatacaccatccaaacgacgcagcagaacagacaagattataccaaaacccaactacatatatatcaataggtacaagtacattaaaccaaagactagtcccaaaaatcgcaacgcgatcaaaagtaaatggacaatctggaagaatggaattcttctggacaattttaaaacccaacgatgccataaactttgaatcaaatggcaactttatagcaccagaatatgcatacaaaatagtaaaaaaaggagacagtgcaatcatgaaatcagaattagaatatggaaactgtaacacaaaatgccaaacaccaatgggtgctataaactcaagcatgccattccacaacatacatcccttaacaataggcgaatgtccaaagtacgtaaaatcaaacagattagtactagcaaccggactaagaaacagcccacaaagagaaagccgtaggaaaaaacgaggtctatttggagcaatagccggatttatagaaggaggatggcaaggcatggtggacggctggtacggatatcaccactcaaatgaacaaggatcaggatacgccgcggataaagaaagtacacaaaaagccatagatggagtaacaaataaagtcaactctataatagataaaatgaacacacaatttgaagcagtaggccgagaattcaataatctagaacgaagaatagaaaacctaaacaaaaaaatggaagacggatttctagacgtatggacatacaacgcggaactattagtactaatggaaaatgaacgaacattagatttccatgactcaaacgtcaaaaacctatatgacaaggtcagattacaactaagagacaacgcaaaagaattaggtaacggctgcttcgaattctatcacaaatgcgacaatgaatgcatggaatcaattagaaatggaacatataactatccacaatacagcgaagaagccagactaaaacgagaagaaataagcggagtaaaactagagtcaataggcacataccaaattttatcaatctattcaacagttgcctcaagtctagcattagcaataatgatggcaggtttatcactatggatgtgttcaaacggatcactacaatgccgaatatgcata

SEQ ID NO: 51312 - RNA, 1704 nt, synthetic construct
  misc_feature 1..1704: note = derived and/or modified sequence opt6 from anti-influenza_Chain
  source 1..1704: mol_type = other RNA
atggaaaaaatcgtactactgttcgcaatagtaagcttagtcaaatcagaccaaatatgtataggataccacgcaaacaactcaacagaacaagtagacactataatggaaaaaaatgtaacagtcacacacgcacaagatatattagaaaaaacacacaatggaaaactttgcgacctagatggagtaaaacccctaatactcagagactgctcagtcgccggctggctattaggcaatcccatgtgcgatgaatttattaatgtaccagaatggagctacatagtagaaaaagcaaacccagtcaacgacctatgctaccccggagactttaacgactacgaagaacttaaacacctattatcaagaatcaatcacttcgaaaaaatacaaataatacctaaatcatcatggtcatcacatgaagcatcattaggagtatcaagtgcatgtccataccaaggaaaatcgtcatttttcaggaacgtcgtttggctaataaaaaaaaactccacatatccaacaataaagcgatcatacaataacacaaaccaagaagacttactagtactatggggtatccaccatccaaatgacgccgccgaacaaaccaaattatatcaaaacccaacaacatacatatcagtaggcacatccacactgaaccaaagattagtcccaagaatagcaacaagaagtaaagtaaatggccaatcaggaagaatggaattcttctggactatactaaaacctaatgatgcaatcaactttgaatcaaatggcaactttatagcacctgaatacgcatataaaattgtaaaaaaaggagacagtacaataatgaaatctgaactagaatatggaaattgcaacacaaaatgccaaacaccaatgggtgccataaacagttcaatgcccttccataacatacatcccctaacaattggtgaatgcccaaagtacgtaaaatctaatagactagtactcgcaacaggactccgaaacagtccacaacgagaaaggagaagaaaaaaacgaggacttttcggagctatcgcaggattcatcgaaggaggttggcaaggcatggtagacggatggtacggttatcaccactcaaacgaacaaggatcaggatacgcagcagacaaagaaagtacacaaaaagcaatagacggagtaacaaacaaagtaaattcaataatagacaaaatgaacacccaatttgaagcagtaggacgagaattcaacaacttagaaaggagaatagaaaatctaaacaaaaaaatggaagacggattcctagacgtgtggacatacaatgccgagttattagtactaatggaaaacgaaagaacactagatttccacgactcaaacgtaaaaaacctatatgacaaagtaagattacaactacgagacaatgcaaaagaactaggcaacggatgcttcgaattctaccacaaatgcgacaacgaatgcatggaaagcgtaagaaatggaacatatgactacccacaatacagtgaagaagcaagacttaaaagagaagaaataagtggagtcaaattagaatccataggtatataccaaatactatcaatttacagtacagtagcatccagcttagcactagctatcatggtagcaggactttcactatggatgtgctcaaatggatcactacaatgcagaatttgcata

SEQ ID NO: 51313 - RNA, 1704 nt, synthetic construct
  misc_feature 1..1704: note = derived and/or modified sequence opt6 from anti-influenza_Chain
  source 1..1704: mol_type = other RNA
atggaaaaaatagtactactattagcaatagtatcactagtaaaaagcgaccaaatatgcataggatatcatgcaaacaattcaacagaacaagtagacaccataatggaaaaaaatgtgaccgtaacacacgcacaagacatattagaaaaaacacataacggtaaactatgtgacctagacggggtaaaaccactaatattaagagattgtagtgtagcgggttggctacttggaaatccaatgtgcgacgaattcctcaacgtaccagaatggtcatatattgtcgaaaaaatcaaccccgcaaacgatctttgctacccaggcgacttcaatgattatgaggaactaaaacacttactatcgagaataaaccacttcgaaaaaatacaaataatacccaaatcatcttggtcagactatgaagcatccagcggcgtcagttcagcatgcccataccaaggaagatcaagcttctttagaaacgtcgtctggctaataaaaaaaaacaacgcatacccaacaataaaaagatcatacaacaacacaaatcaagaagacctactagtactatggggaatacaccacccaaatgacgcagcagaacaaataagattataccaaaacccaacaacttacatttcaataggcacgtccacattaaaccaaagattagtacccaaaatagcaacaaggtcgaaagtcaatggacaatcaggacgaatggaatttttctggacaatactaaaatcaaatgacgctataaacttcgaaagcaacgggaacttcattgcaccagaatacgcatacaaaatagtaaaaaaaggcgatagtacaataatgaaaagtgaactagaatacggaaactgtaatacaaaatgccaaacaccaataggcgcaataaattcatcaatgccatttcataatatacatccactaacaataggagaatgccctaaatacgtaaaatcaaatagactagtgttagcaactggattaagaaactcaccccagggagaaagaagaagacgaaaaagaggtctatttggagcaatagcaggattcatagaaggaggatggcaaggaatggtagacggatggtacggctaccaccattcaaatgaacaaggatcaggatacgcagctgacaaagaaagtacccaaaaagcaatagacggcgtaacaaacaaagtaaacagtataataaacaaaatgaatacacaatttgaagcagtcggaagagaatttaataacctagaacgaagaatagaaaatctaaacaagaaaatggaagacggttttctagacgtatggacatacaacgcagaactacttgttttaatggaaaacgaaagaacattagacttccacgactcaaatgtaaaaaatctatatgataaagttaggttacaacttcgagacaacgccaaagaattaggaaacggatgtttcgaattctatcacagatgcgataacgaatgcatggaatcagtaagaaatggaacttacgactatccacaatactcagaagaagcacgcctaaaacgagaagaaatatcaggagtaaaactagaatcaatgggaatttatcaaatactctcaatatacagcacagtagcttcatcactagctttagctataatggtagcaggactattcttatggatgtgcagcaatggatcactacaatgcagaatatgtata

SEQ ID NO: 51314 - RNA, 1704 nt, synthetic construct
  misc_feature 1..1704: note = derived and/or modified sequence opt6 from anti-influenza_Chain
  source 1..1704: mol_type = other RNA
atggaaaaaatagtcctactactagccatagtttctctcgtaaaatccgatcaaatatgcataggataccacgcaaacaactcaacagaacaagtagacacaataatggaaaaaaacgtaacagtaactcacgcccaagacatattagaaaaaacacacaacggaaaactatgcgacttagacggagtaaaaccactaatactaagagactgtagtgttgctggatggctactaggcaaccccatgtgcgacgaattcataaacgtccccgagtggtcctacatagtcgaaaaagcaaaccccaccaatgacctctgctacccaggatccttcaacgactacgaagaactaaaacacttactatcaagaataaatcactttgaaaaaatacaaataataccaaagtcatcatggagcgatcacgaagcttcatcaggagtaagctcagcttgtccatacctaggatcgccatcattctttagaaatgtagtttggttaataaaaaaaaatagcacatatccaacaataaaaaaatcatacaataacacaaatcaagaagacttactagtattatggggaatacaccacccaaacgacgcagcagaacaaacaagattataccaaaacccaacaacctacataagtataggaacaagcacactaaatcaaagattagtaccaaaaatagcaacacgatcaaaagtaaatggacaatcaggacgaatggaattcttctggacaatactaaaaccaaacgatgcaatcaattttgaatcaaatggcaatttcatcgcaccagaatacgcttacaaaatagtaaaaaaaggagatagcgccataatgaaaagcgaattagaatacggaaattgcaacaccaaatgccaaactccaatgggagcaataaacagcagcatgccattccacaacatacatcccctcacaataggcgaatgcccaaaatacgtaaaatcaaatagactagtactagcaacaggtctaagaaactcaccccaacgagaaagcagacgaaaaaaaagaggactcttcggagcaatcgcaggattcatagaaggaggatggcaaggaatggtagacggatggtatggatatcaccacagcaacgaacaaggcagcggatacgcagcagataaagaatcaacccaaaaagcaatagacggcgtaacaaataaagtaaacagtataattgataaaatgaatacacaattcgaagcagtaggaagggaatttaataatttagaaagaagaatagaaaacttaaacaaaaaaatggaagatggattcttagacgtatggacatacaacgcagaactattagttctcatggaaaatgaaagaacactagacttccacgacagtaatgtaaaaaacttatacgacaaagtaagactccaactaagagataacgccaaagaactaggaaatggatgcttcgaattctaccataaatgtgacaacgaatgcatggaaagcatcagaaatggaacctataactacccacaatactcagaagaagccaggcttaaacgagaagagatatcaggagtaaaactagaaagtataggaacatatcaaattctatcaatctacagcacagtagcctcaagtctagcattagctataatgatggcgggactaagcctatggatgtgctccaatggatcactacaatgccgaatatgcata

SEQ ID NO: 51315 - RNA, 1704 nt, synthetic construct
  misc_feature 1..1704: note = derived and/or modified sequence opt6 from anti-influenza_Chain
  source 1..1704: mol_type = other RNA
atggaaaagatagtattattattcgcaatagtatcattagtaaaatctgaccaaatatgcataggatatcacgcaaacaacagcacagaacaagtagacacaatcatggaaaaaaatgtaacagtaacacatgcacaagacatactcgaaaaaacccacaacggaaaactatgtgatcttgatggagttaaaccacttatactaagagactgctcagtagcaggatggttattaggaaacccaatgtgcgatgaattcataaacgtaccagaatggagctacatagtagaaaaggcaaaccccgtgaatgacttatgttacccaggagatttcaacgattacgaagaattgaaacacctactcagtagaataaaccactttgaaaaaatacaaataataccaaaatcaagctggtcatcacacgaagcatcactgggagtaagtagtgcatgcccctaccaaggaaaaagtagtttcttcagaaatgtagtatggctaatcaaaaaaaatagcacttatccaaccataaaacgatcatacaataacacaaatcaagaagacttattagtactatggggaatccaccacccaaacgacgcagcagaacaaacgaaattataccaaaatccaacaacatatataagtgtaggaacatcaacactaaatcaaagacttgtacccagaatagcaacaagatcaaaagtaaatggacaatcaggaagaatggaatttttctggacaatattgaaaccaaatgacgctataaattttgaatcaaacggaaattttatagcacctgagtacgcatataaaatcgttaaaaagggcgactccacaataatgaaatcagaattagaatacggaaactgcaacacaaaatgccaaacaccaatgggagcaataaactcatcaatgccatttcacaacattcacccacttacaatcggcgaatgcccaaaatacgttaaatctaacagactagtgttagctaccggtctaagaaacagcccccaaagagaaagaagaagaaaaaaaagaggactattcggcgcaatagccggctttatagaaggaggatggcaaggtatggtagacggatggtatggttatcaccatagtaatgaacaaggatcaggatacgcagcagacaaagaatcaacacaaaaagctatagatggagtcacaaacaaagtaaatagtataattgacaagatgaatacacaatttgaagcggtaggaagagaattcaacaacctagaaagaagaatagaaaatctaaacaaaaaaatggaagacggatttttagacgtatggacatacaacgcagaacttctcgtattaatggaaaacgaaagaacacttgactttcacgactcaaacgtaaaaaacttgtacgacaaagttagattgcaactcagagacaatgcaaaagaactaggcaacggctgtttcgaattctatcataaatgcgacaatgaatgtatggaatctgtacgtaacggcacatatgactacccacaatatagcgaagaggctagactaaaaagagaagaaatctcaggagtgaaactcgaatcaattggaatatatcaaatattaagtatatactcaacagtagcttcatcattagcactagcaataatggtagccggactatcattatggatgtgcagcaacggaagcctacaatgcagaatatgcata

SEQ ID NO: 51316 - RNA, 1707 nt, synthetic construct
  misc_feature 1..1707: note = derived and/or modified sequence opt6 from anti-influenza_Chain
  source 1..1707: mol_type = other RNA
agtaaaagtagaggatataaaatgaacacccaaattctagtatttgcattagtagcaagcataccaacaaatgcagacaaaatatgtttaggacatcacgcagtaagcaatggaacaaaagtaaacactttaacagaaagaggagtagaagtagtaaacgcaacagaaaccgtagaaagaacaaatgtcccaagaatttgcagcaaaggaaaacgaactgtggacctaggccaatgcggactactcggcacaataacaggaccaccacaatgcgatcaatttttagaatttagtgcagatttaataatagaaaggcgggaaggatcagatgtatgttatccaggaaaatttgtaaatgaagaagcactaagacaaatactaagagaatcaggaggaatagataaagaaaccatgggattcacatatagtgggataagaacaaatggaactacctccgcatgtagaagatcgggaagcagcttttatgcagaaatgaaatggttattatcaaacacagataacgcagcatttccacaaatgactaaaagttataaaaatacaagaaaagaccctgctctaataatctggggcatacaccattcaggaagcactacagaacagacaaaattatatggatcaggaaataaactaataacagttggatccagtaattatcaacaatcattcgtaccatctccaggagcaagaccacaagttaacggacaatcaggaaggattgattttcactggctaatacttaatccaaatgatacagtaacttttagttttaatggcgcatttattgctccagatagagcaagtttcttaagaggaaaatcaatgggtattcaaagcgaagtacaagtcgacgcaaattgtgaaggagactgttatcacagcggaggaacaataataagtaatctcccctttcaaaatatcaattcaagagcagtaggcaaatgcccaagatacgtaaaacaagaatcactcctattagcaacaggaatgaagaatgtaccagaaataccaaaaaggagaagaagaggattatttggtgcaatagcaggatttattgagaatggatgggaaggtctaattgatggatggtatggtttcaggcatcaaaatgcacaaggcgaaggaacagcagctgattataaatcaacacaaagcgcaatagatcaaataacaggaaaattaaacaggctaatagagaaaacaaatcaacaatttgaattaatagacaatgagttcacagaagtagaaagacaaataggaaatgtaataaactggacaagagactctatgacagaagtatggtcatacaacgctgaattattagtagcaatggaaaatcaacatacaatagatcttgcggatagcgaaatgaataaactatatgaacgagtaaaacgacaattacgagaaaacgcagaagaagatggaaccggatgctttgaaatatttcataaatgcgacgatgactgtatggcatcaatcagaaataacacatacgatcactcaaaatatagagaagaagcaatacaaaatagaatacaaatagatccagtaaaattaagctctgggtataaagatgtgattctatggttctccttcggagcatcctgcttcatactattagcaatagcaatggggctagtattcatatgcgtcaaaaatggaaatatgagatgtaccatatgtata

SEQ ID NO: 51317 - RNA, 1707 nt, synthetic construct
  misc_feature 1..1707: note = derived and/or modified sequence opt6 from anti-influenza_Chain
  source 1..1707: mol_type = other RNA
tcaaaaagcagaggatataaaatgaacactcaaattcttgtatttgcattagtagcatcaataccaactaacgctgataaaatatgtcttggacatcacgcagtatccaacggaaccaaagtaaacacattaaccgaacgaggagtagaagtagtaaatgccaccgaaacagtagaacgaactaatgtacccagaatatgttcgaaaggaaaaagaacagtagacttaggtcaatgcggattattaggcactataacaggaccaccccaatgcgaccaattcttagagttctcagcagacctaataatagaaagaagagaaggaagtgatgtatgttatccaggaaaatttgtaaatgaagaagcattacgacaaatattaagagaatcaggaggaatagataaagaaacaatgggctttacttattcaggaataagaacaaatggaaccacctcagcatgtagaagaagcggatcctctttttatgcagaaatgaaatggctactttcaaacactgataatgcagcctttccacaaatgacaaaatcctacaaaaacacaagaaaagacccagcactaataatctggggtattcaccacagtggatcaacaacagaacaaacaaaactatacggaagcggaaacaaattaataacagtaggatcatcaaattatcaacaatcattcgtcccatcaccaggagcaaggccacaagtaaacggacaaagcggaagaattgactttcactggttaatattaaatccaaatgacacagtcacttttagtttcaacggagctttcatagcaccagaccgagcatcatttcttagaggaaaatcaatgggtatccaaagcgaagttcaagtagatgcaaattgcgaaggagattgttatcactcaggaggtacaataatctcaaacttaccctttcaaaacataaattcaagagcagtaggcaaatgccctagatatgtgaaacaagaatcattattacttgcaacaggaatgaaaaatgtgccagaaattccaaaacgaagacgtagaggactatttggagccatcgcaggattcatagaaaatggttgggaagggttaatagatggatggtacggttttagacaccaaaacgcccaaggcgaaggaacagcagcagactataaatcaacacaatcagcaatagatcaaataacaggaaaattaaatagattaattgaaaagacaaatcaacaattcgaactaatagacaatgaatttacagaagtagaaagacaaataggaaacgtaataaattggacaagagactcaatgactgaagtatggtcatacaatgctgaattactcgtagcaatggaaaaccaacataccattgacctagcagactcagaaatgaataaactatatgaaagagtaaaacgacaactacgagaaaacgcggaagaagacggaacaggatgctttgaaatattccacaaatgtgatgatgattgtatggcctcaataagaaataacacctacgatcattcaaaatacagagaagaagcaatacaaaatcgtatacaaatcgatcctgttaaactatcatctggatataaagatgtaatactatggttttcattcggtgcatcttgtttcatactattagcaatagcaatgggattagtcttcatatgtgtcaaaaatggaaatatgagatgtacaatatgtatc

SEQ ID NO: 51318 - RNA, 1692 nt, synthetic construct
  misc_feature 1..1692: note = derived and/or modified sequence opt6 from anti-influenza_Chain
  source 1..1692: mol_type = other RNA
gatcaaatatgtataggatatcacgcaaataatagtacagaaaaagtagatacaaatctagaaagaaacgtaacggtcacacacgcaaaagatattctagaaaagacacacaacggaaaactatgcaaactaaatggaatacctccactagaactaggagattgttcaatagcaggttggctactaggaaatccagaatgtgacaggttactaagcgttccagaatggagttatataatggaaaaagaaaacccaagagacggattatgctatccaggatcattcaatgattacgaagaactaaaacatttattaagttcagtaaaacattttgaaaaagttaaaatactcccgaaagacagatggacacaacatacaactacaggtggaagtagagcatgcgcagtaagtggcaacccaagtttctttagaaacatggtgtggctaactaaagaagggtcagactatcccgtagcaaaaggatcttacaacaatacaagtggagaacaaatgctgataatctggggagtacatcaccccatagacgaaacagaacaaagaacattataccaaaacgtaggcacatacgtaagcgtcgggacatcaactctaaataaacgatctacaccagaaattgcaactagaccaaaagtaaacggacagggtggacgaatggaattttcatggaccttactagacatgtgggacaccataaatttcgaatctacaggcaatttaatagccccagaatatggattcaaaataagcaaaagaggatctagtggaataatgaaaacagaaggcacattagaaaattgtgaaacaaaatgtcaaacacctttaggcgcaataaatacaactctacccttccataatgtacatccattgactataggagaatgcccaaaatacgtaaaaagtgaaaaattagtactagcaacaggactaagaaacgtaccccaaattgaaagtagaggactatttggagcaatagcaggattcattgaaggaggatggcaaggaatggtagacggttggtatggatatcatcactcaaatgaccaaggttcaggctatgcagcagataaagaatcaacgcaaaaagcatttgacggcattactaacaaagtaaattcagtcatagagaaaatgaatacacaattcgaagcagtaggaaaagaatttggtaatctagaacgaagactcgaaaatctaaacaaaagaatggaagatggattcctagatgtatggacatataacgccgaattattagtattaatggaaaacgaacgaacactagactttcatgattcaaatgttaaaaatttatacgataaagtaagaatgcaattaagagataatgtaaaagaactaggaaacggatgctttgaattttaccataaatgtgacgatgaatgtatgaacagtgtgaaaaacggaacatatgattacccaaaatatgaagaagaatcaaaattaaatagaaacgaaattaaaggagtaaaattatcaagtatgggagtatatcaaagtggaagattagtaccaagaggatctcctggtagtggatacatacctgaagcacctagggatggccaagcatacgtaagaaaagatggagaatgggttctcctgagcacgttccttggaaaaccaatacccaatccattactaggactagatagtacagga

SEQ ID NO: 51319 - RNA, 1692 nt, synthetic construct
  misc_feature 1..1692: note = derived and/or modified sequence opt6 from anti-influenza_Chain
  source 1..1692: mol_type = other RNA
caaaaactgccaggcaatgataatagtacagcaaccttatgcctaggtcatcatgctgtaccaaatggaacaatagtaaaaaccataaccaacgaccagatagaagttacaaacgcaacagaactagtacaaagcagtagcactggtggcatatgtgattcaccacatcaaatattagacggtgaaaattgcacactaatagatgctctattaggagacccacaatgtgacggattccaaaataaaaaatgggacctattcgtagaaagatcaaaagcttattcaaactgttatccatacgatgtaccagattacgcatcattaaggtcactagtcgcatcatccggtacattagaatttaatgacgaaagcttcaattggaccggcgtaacacaaaacggaacaagttcatcctgtaaaagacgaagcaacaactcatttttctcaagactaaattggctaacccaattaaaattcaaatacccagcacttaatgtaacaatgccaaataacgaaaaattcgataaattatacatatggggcgtacatcatccagtaaccgacaatgatcaaatatttctctacgcacaagcatccggcagaataacagtatcaacgaaacgctcacaacaaacagtaatacctaacataggcagcagaccaagaataagaaacataccctcaagaataagcatatactggacaatagtaaaaccaggtgatatactactaatcaacagtacaggaaacttaatagcaccaagaggatactttaaaataagaagcggaaaaagctcaataatgcgtagtgatgcacccattggcaaatgtaattcagaatgcataacacccaacggatcaataccaaatgacaaaccattccaaaacgtgaatcgcataacatacggagcatgcccaagatacgtaaaacaaaatacactaaaattagcaacaggaatgagaaacgtacccgaaaaacaaacaagaggaatattcggagcaatagccggattcatagaaaacggatgggaaggcatggtagacggctggtacggattcagacaccaaaacagcgaaggaataggacaagcagcagatttaaaatcaacacaagcagcaataaatcaaatcaatggaaaattaaacaggctaataggaaaaactaatgaaaaatttcaccaaatcgaaaaagaattcagcgaagttgaaggaaggatacaagacttagaaaaatacgtagaagacacaaaaatagacttatggtcatacaatgcagaactactagtagcattagaaaatcaacacactatagatctaacagacagcgaaatgaacaaactatttgaaagaacaaaaaaacaattaagagaaaacgcagaagacatgggcaatggctgtttcaagatatatcataaatgtgacaacgcatgcataggatccataagaaatggcacatatgatcatgacgtatacagagatgaagcattaaataacagatttcaaattaaaggagtagaactaaaatccggatcaggaagactagtacctagaggatcaccaggatctggctatataccagaagcaccaagagatggacaagcctacgtacgaaaagacggtgaatgggtattattatcaacattcttaggaaaacccataccaaatcccttgcttggtcttgatagcacagga

SEQ ID NO: 51320 - RNA, 1692 nt, synthetic construct
  misc_feature 1..1692: note = derived and/or modified sequence opt6 from anti-influenza_Chain
  source 1..1692: mol_type = other RNA
gatcaaatatgtatcggataccacgcaaataactcaacagaaaaagttgatacaaatcttgaaagaaatgtaacagtaactcacgcaaaagatatactagaaaaaactcacaatggaaaattatgtaaactaaatggaataccaccattagaactaggtgactgttcaatagcgggatggcttttaggaaacccagaatgcgacagactattaagcgtacctgaatggagttacattatggaaaaagaaaacccaagagacggtttatgctatccaggatcattcaatgattacgaagaattaaaacacttattaagttcagtaaaacactttgaaaaagtaaaaatattacccaaagacagatggacacaacatacaacaacaggcggatcaagagcatgcgcagtatcaggaaatcccagtttcttcagaaatatggtttggttaacaaaagaaggatcagattacccagtcgcgaaaggtagctataataatacaagcggcgaacaaatgttaataatatggggagtacaccacccaatagacgaaacagaacaaaggaccttataccaaaacgtaggcacatatgtgtcagtaggaacatcaacattaaataaaagatccacaccagaaatcgcaacaaggccaaaagtaaatggccaaggaggaaggatggaattcagttggacactcttagatatgtgggatacaataaattttgaaagcacaggaaatctaatagctccagaatatggatttaaaattagcaaaagaggaagttcaggaataatgaaaacagaaggtacattagagaactgtgaaacaaaatgtcaaacaccattaggcgcaataaatactacattaccatttcataatgtacacccactaacaattggagaatgcccaaaatacgtaaaatccgaaaaattagtactagcaacaggactcagaaatgtaccacaaattgaaagtagagggctatttggagcaattgctggattcatagaaggcggttggcaaggtatggtagacggatggtatggatatcaccactcaaatgatcaaggatcaggatatgcagccgacaaagaatccactcagaaagcattcgatggaataacaaataaagttaatagtgtaatagaaaaaatgaatacacaatttgaagcagtaggcaaagaatttggaaacctagaaagaagactagaaaacttaaacaaaagaatggaagatggattcttagacgtatggacttataacgcagaacttttagtactgatggaaaatgaaagaactctagattttcacgatagcaatgtaaaaaacttatatgataaagtaagaatgcaattacgagacaacgtaaaagaattaggaaatggatgttttgaattttatcataaatgtgatgatgaatgcatgaatagtgtaaaaaatggaacgtatgattatccaaaatatgaagaagaaagcaaattaaacagaaacgaaataaaaggtgtaaaattaagtagtatgggagtataccaatctggcagattagtaccacgaggatcaccagggtcagggtacataccagaagcgccaagagatggccaggcttatgtaagaaaagatggagaatgggtcctattaagtacatttttaggaaaacctataccaaatccactactaggactagatagcacggga

SEQ ID NO: 51321 - RNA, 1692 nt, synthetic construct
  misc_feature 1..1692: note = derived and/or modified sequence opt6 from anti-influenza_Chain
  source 1..1692: mol_type = other RNA
caaaaactaccaggaaatgataacagtacagcaacattatgtctcggacaccatgcagtaccaaatggaacaatcgttaaaaccataactaacgatcaaatagaagtaacaaacgccactgaattagtccagtcatcaagtaccggaggcatctgcgatagtccacaccaaattctagatggagaaaactgcacattaattgacgcattattaggagaccctcaatgcgacggtttccagaacaaaaaatgggacttattcgtagaaaggtcaaaagcttattctaactgctatccatacgatgtaccagactatgcgagtctccgatcactagtagcatcatcaggaacactagaatttaatgacgaatcattcaattggacgggagtcacacaaaacggaacatcaagttcatgcaaacgaaggtccaataactcattctttagtagattaaactggttaacccaactaaaatttaaatacccagcactaaacgtcaccatgccaaacaacgaaaaattcgacaaactatatatctggggagtacaccatccagtaactgataacgaccaaatattcctctacgcacaagctagtggacgaataacagtatcaacaaaacgatcacaacaaacagtaataccaaacataggaagcagacctagaataagaaacatacccagtcgaataagtatatactggacaatcgttaaacctggagacatattactcatcaatagcacaggaaatctaatagcaccaagaggatattttaaaatacgatcaggtaagagctcaataatgcggagcgacgcaccaataggaaaatgcaatagcgaatgcataacgccaaatggatcaataccaaacgataaaccatttcaaaatgtaaatagaataacatacggagcatgtccaagatacgtcaaacaaaatacactaaaactagccacaggaatgagaaatgtaccagaaaaacaaacacgaggcatattcggagcaatagcaggatttatagaaaatggctgggaaggcatggtagatggttggtatggattcagacaccaaaactcagaaggaataggacaagcagcagacctaaaaagcacacaagcagctataaaccaaataaacggtaaactaaatcgattaatcggaaaaactaacgaaaaattccatcaaatagaaaaagaattttcagaagtagaaggccgcatacaagacctagaaaaatacgtagaagacactaaaatagacctatggagctacaacgcagaacttctagtagcacttgaaaaccaacacacaatagacttgacagatagtgaaatgaacaaactattcgaacgaacaaaaaaacaattaagagaaaatgcagaagacatgggaaatggatgctttaaaatataccataaatgcgacaatgcatgcattggatccataagaaacggaacatatgaccacgatgtatatagagacgaagcattaaacaatagatttcaaataaaaggagtagaattaaaatcgggaagcggacgattagtccctcgaggatctccaggatccggatatatacctgaagcaccaagagacggccaagcctacgttagaaaagacggagaatgggtattactaagcacattcttaggaaaacccatcccaaacccgttattaggcttggacagcacagga

SEQ ID NO: 51322 - RNA, 1695 nt, synthetic construct
  misc_feature 1..1695: note = derived and/or modified sequence opt6 from anti-influenza_Chain
  source 1..1695: mol_type = other RNA
gatacaatatgcataggataccacgcaaacaactcaaccgacacagtagataccgtactagaaaaaaacgtaacagtaacacactcagtcaacttactagaagatagccacaacggaaaattatgcttattaaaaggaattgcccctctacaattaggaaactgttcagtagcaggatggatcttaggaaacccagaatgtgaattattaatatcaagggaatcatggtcatacatagttgaaaaaccaaacccagagaatggcacttgttacccaggacacttcgcagattatgaagaactcagagaacaactaagtagtgtatcatcgtttgaaagattcgaaatcttccccaaagaatccagttggccaaaccataccacaacaggggtatccgcaagttgtagccacaatggagaaagttcattttacaaaaatctcctatggctaacaggcaaaaacggtctatacccaaatttatcaaaaagttacgccaataacaaagaaaaagaagtattagtgctatggggagtacatcatccaccaaatataggagatcaacgcgcattatatcacaaagaaaatgcatatgtaagcgttgtatcctctcactacagtcgaaaattcacaccagaaatagcaaaaagacccaaagtcagagaccaagaaggaagaataaattattattggaccttactagaaccaggcgacactataattttcgaagccaatggaaacttaatagcaccacgatacgcatttgccttatcacgaggattcggatccggaataataaactcaaacgcaccaatggacgaatgcgacgcaaaatgccaaacaccacaaggagcaataaacagctcactaccatttcaaaacgtacatccagtaacaataggtgaatgcccaaaatacgtcagatccgcaaaactacgaatggttacaggactgcgaaacatcccatcaatacaatcaagaggactatttggtgccatagcgggttttatagaaggaggttggacaggaatggtcgatggatggtatggctatcatcaccaaaacgaacaaggaagcggatatgcagccgatcaaaaaagtacacaaaacgctataaatggaataacaaacaaagtcaacagtgttatagaaaaaatgaacacacaatttaccgcagttgggaaagaattcaataaattggaaagaagaatggaaaatctaaataaaaaagtcgatgatggattcatagacatatggacgtacaatgcagaactactagtcttactagaaaatgaaagaacattagactttcatgattcaaacgtaaaaaatttatatgaaaaagtaaaaagtcaactaaaaaataatgcaaaagaaataggaaatggatgcttcgaattctaccataagtgcaacgacgaatgcatggaatcagttaaaaacggaacatatgactacccgaaatattcggaagaatctaaactaaatagagaaaaaatagatggagtaaaattagaatcaatgggagtataccagagcggaaggctagtaccaagaggaagtcctggtagcggatatatcccagaagcaccacgagacggtcaagcatatgttagaaaagatggagaatgggtacttctatcaactttcctaggtaaacctataccaaatcctctattaggattagactccacagga

SEQ ID NO: 51323 - RNA, 1695 nt, synthetic construct
  misc_feature 1..1695: note = derived and/or modified sequence opt6 from anti-influenza_Chain
  source 1..1695: mol_type = other RNA
caaaattatacaggaaatcctgtaatatgcttaggacatcatgcagtatcaaacggaacaatggtaaaaacattaacggacgatcaaattgaagtagtaacagcacaagaattagtagaaagtcaacatctaccagaactatgcccatcaccattaagattagtagacggacaaacatgcgacatagtaaacggtgcattaggatcaccaggctgtgaccatctaaatggagcagaatgggacgtatttatagaacgacccacagccgtagatacatgctacccattcgacgtacccgactaccaaagtctacgaagtatactagcaaataacggcaaatttgaatttatagcagaagaatttcaatggaacaccgtgaaacaaaacggaaaatcaggagcatgtaaaagagcaaacgtcaacgacttcttcaatagattaaactggcttacaaaaagtgacggaaacgcctatcccctacaaaatcttaccaaagtaaacaatggcgattacgcaagactatacatatggggcgtacatcaccctagtacagacacagaacaaacaaacctatacaaaaacaaccccggaagagtaacagtctcaacacaaactagccaaacgtcagtcgtaccaaacataggatcacgaccatgggtgagaggactaagttcaagaatctcattctactggacaatagtagaaccaggagacctaatagtattcaacaccataggcaacctaatagcaccaagaggacactacaaactaaatagtcaaaagaaatcaacaatactaaacacagctgtaccaatcggaagttgtgtaagcaaatgtcacacagacaaaggatccattagtactacaaaaccattccaaaacatatcacgaatatctataggagattgtccaaaatacgtaaaacaaggaagtttaaaattagcaacaggaatgagatcaatattagaaaaagctacaagaggcctatttggcgcaatagcaggtttcatagaaaacggatggcaaggtctaatagatggatggtatggattccgacaccaaaatgcggaaggaaccgggacagcagctgacctaaaatcaacacaagcagcaattgatcaaataaatggaaaactaaacagacttatcggaaaaccaaatgaaaaatatcaccaaatcgaaaaagaatttgaacaagtagaaggaagaatacaagacttagaaaaatatgtagaagacaccaaaatagacctatggtcctataacgcagaacttctagttgcattagaaaaccaacacacaatagacgtaacagactcagaaatgaataaattgttcgaaagagtaagacatcaactaagagaaaatgccgaagacaaaggcaacggatgtttcgaaatattccaccaatgcgataattcctgtattgaatcaataagaaacggaacatatgatcacgacatatacagggatgaagctataaacaacagattccaaatacaaggagtcaaattaatacaaggatacaaagactcaggaagattagtaccaagaggctcaccaggtagcggatatataccagaagcaccaagagacggacaagcatacgtcagaaaagatggagaatgggtactactatcaacattcctaggaaaaccaatccccaaccctctactaggactagactcaactggt

SEQ ID NO: 51324 - RNA, 1695 nt, synthetic construct
  misc_feature 1..1695: note = derived and/or modified sequence opt6 from anti-influenza_Chain
  source 1..1695: mol_type = other RNA
gatcaaatatgtataggatatcacgctaacaattccacagaacaggttgatacaataatggagaaaaacgtaacagtaacacacgcacaagatatattagaaaaaacacacaatggaaaattatgcaaccttgacggagttaaacctcttatactaaaagattgcagcgttgcaggctggctactaggaaatccaatgtgcgacgaattcctaaatgtctcggaatggagctacatagtagaaaaagcaagtccagcaaacggcctatgctacccaggagattttaacgattatgaagagctaaaacatttactatcaagaataaaccatttaaaaaaaataaaaataataccaaaaagttattggtctaaccacgaagcatcatcaggagtctcagcagcatgttcatacctaggagaaccatcattttttagaaatgtagtatggttaatcaaaaaaaacaatacatacccccccataaaagtaaactatactaacacaaaccaagaagacctattagttttatggggaatacaccaccccaatgacgaaaaagaacaaataagaatctaccaaaacccaaacacaagcataagtgtaggaacatcgacattaaaccaaagactagtacctaaaatagcaaccaggccaaaagtaaacggacaatctggaagaatggaatttttttggacaatattaaaaccaaatgattccataaactttgactccaatggaaacttcatcgccccagaatatgcatataaaatcgcaaaaaaaggagattcagtaataatgaaaagcgaactagaatatggtaactgcaacaccaaatgtcaaacaccaatgggagcaataaactcttcaatgccttttcacaacatacatccattaacaataggagaatgcccgaaatatgtaaaatccaatagattagtactcgcaacaggcttaagaaatgcaccacaaactgaaacaagaggattattcggagcaatagcaggatttatcgaaggaggatggcaaggaatggtcgatggatggtacggataccatcattcaaatgaacaaggatcaggatatgcagcagacaaagaaagtacacaaaaagcaatagatggaataacaaataaagtaaattcaataatagataaaatgaacacccaatttgaaatagtaggcagagaatttaacaatctagaaagaagaatagaaaacctgaacaaaaaaatggaagacggattcctcgacgtgtggacatataacgccgaactacttgtcctaatggaaaatgaaagaaccctcgacttccacgattcaaatgtaaaaaacctatacgaaaaagtacgattacaactacgagacaacgcaaaagagctaggaaacggatgctttgaattctatcacaaatgtgataatgaatgcatggaaagcgtacgaaatggaacatacgattacccacaatactctgaagaagcaaggttaagtagagaagaaatatcaggagtaaaaatggaaagcatggtaacataccaaagcggccgattagttccccgaggatcacctggaagcggatacatacctgaagcacctcgagacggtcaagcatacgtaagaaaagacggagaatgggtactactatcaacattccttggaaaacctataccgaatcccctactaggactcgacagcacagga

SEQ ID NO: 51325 - RNA, 1695 nt, synthetic construct
  misc_feature 1..1695: note = derived and/or modified sequence opt6 from anti-influenza_Chain
  source 1..1695: mol_type = other RNA
gataccatatgcataggttatcacgcaaataatagcacagacacagtagacacagtactagagaaaaatgtaacagtaacccactcagtaaatttattagaagactcacacaacggaaaattatgtctactaaaaggaatagcaccactacaactcggaaactgttcagtagctggatggatattaggtaaccccgaatgcgaactactaatctcaagagaatcatggtcatatatagtagaaaaaccaaacccagaaaacggaacatgttaccctggacactttgccgattacgaagaactaagagaacaactttccagtgtatcatcattcgaaagattcgaaatatttcctaaagaatcatcatggcctaatcacacaacaacaggagtatcagcatcatgttcacataatggcgaaagctcattttacaaaaacttactatggctaacaggcaaaaatggattatatcccaacttatcaaaatcatacgctaataataaagaaaaagaagtattagtactatggggagtacaccacccgcctaatataggagaccaaagagcgctataccataaagaaaacgcatacgtatcagtagtatcaagccattattcaagaaaattcacaccagaaatagcaaaacgaccaaaagttagagaccaagaaggacgtataaactattattggacattattagaaccaggagatacaataatatttgaagcaaatggaaatctcatagcaccaaggtatgcatttgcgttatcacgaggattcggcagcggaataataaactcaaacgcaccaatggacgaatgtgatgccaaatgtcaaacaccccaaggagcaattaacagctcattgccattccaaaatgttcatcccgtaacaataggagaatgcccaaaatatgtaagatccgcaaaattaagaatggtcacaggattaaggaatataccatccatacaaagtagaggactatttggcgcaatagcaggatttatagaaggaggatggaccggcatggtagacggatggtatggataccatcaccaaaacgaacaaggatcaggctatgctgctgatcaaaaatcaacacaaaatgcaataaatggaataaccaacaaagtaaactcagtaatagagaaaatgaacacacaatttacagcagtcggcaaagagttcaataaactagaaagaaggatggaaaacctaaacaagaaagtagacgacggttttatagatatatggacatataatgcagaattattagtattacttgaaaatgaaaggactttagatttccacgattcaaacgttaaaaacttatatgaaaaagtaaaatcacaactaaagaataatgcaaaagaaatcggaaatggttgttttgaattttaccacaaatgtaatgacgaatgcatggaatcagtcaaaaacgggacttacgactacccaaaatacagtgaagaatcaaaactaaatagagagaaaatagacggagtaaaattagaatcaatgggagtataccaaagtggtagattagtaccaagaggaagcccaggctcagggtatattccagaagcaccacgagacggacaagcgtatgtaagaaaagatggcgaatgggtattactaagcaccttcctcggaaaaccaatcccaaacccgctattaggattagatagtaccgga

SEQ ID NO: 51326 - RNA, 1695 nt, synthetic construct
  misc_feature 1..1695: note = derived and/or modified sequence opt6 from anti-influenza_Chain
  source 1..1695: mol_type = other RNA
caaaattacacaggaaaccccgtaatatgtctaggacatcacgctgtaagcaatgggaccatggtaaaaacactcacagacgaccaaatcgaagtcgtcaccgcacaagaattagtagaaagccaacacttaccagaactatgcccgagtccgttaagattagtagatggacaaacatgcgatatcgtaaatggagcattaggatcaccaggctgtgaccacctaaacggagcggagtgggacgtatttatagaaagaccaactgcagtagatacatgttacccattcgatgtaccagattaccaatcgttaagatcaatactagcaaataatggaaaatttgagttcatagcagaagaatttcaatggaatacagtcaaacaaaacggaaaatcaggagcttgtaaaagagcaaacgtaaatgacttctttaatagacttaattggctaacaaaatccgacggaaatgcttacccactacaaaatttaactaaagtaaataacggagactatgcaagattatatatatggggagtacatcacccatcaacagacacagaacaaactaacttatataaaaataacccaggtagagtcacagtctcaacacaaacaagtcaaacatcagttgtacctaacataggaagcagaccctgggtgagaggtcttagcagcagaatttcattttattggactatagtagaaccaggagacctaatagtatttaacacaataggaaacctaatagcaccaagaggacactacaaacttaacagccaaaagaaaagcacaatactaaacacagccgtaccaataggttcatgcgttagtaaatgtcatacagacaaaggatcaatcagtacaacaaaaccatttcaaaatatctcaagaataagtataggagattgcccaaaatacgtaaaacaaggaagtctaaaattagcaacaggcatgcgatcaatactagaaaaagcaaccagaggcttattcggagcaatagcaggcttcatagaaaacggatggcaaggcttaatagacggatggtacggattcagacaccaaaacgctgaaggcaccggaacagccgcagacttaaaaagtactcaagcagcgatcgatcaaataaacggtaaattaaacaggttaataggaaaaccaaacgaaaaatatcaccaaatagaaaaagaatttgaacaagtcgaaggcagaatccaagacttagaaaaatatgttgaagacaccaaaatagacctatggtcatacaacgcagaactattagtagcactagaaaatcaacatacaatagatgtaactgattctgaaatgaataaactatttgaaagagtaagacaccaactaagagaaaatgccgaagacaaaggaaatggctgttttgaaatatttcaccaatgtgacaacagctgtatagaatcaataaggaatggcacctatgaccacgacatatatagagacgaagcaataaacaacagattccaaatacaaggagtaaaactaatacaaggatacaaagattcagggaggctagtcccaagaggatcacccggatcaggttacataccagaagcacccagagatgggcaggcttacgtacgaaaagatggagaatgggtcctactatcaacattcttaggaaaaccaataccaaatccactactaggactagacagtaccgga

SEQ ID NO: 51327 - RNA, 1695 nt, synthetic construct
  misc_feature 1..1695: note = derived and/or modified sequence opt6 from anti-influenza_Chain
  source 1..1695: mol_type = other RNA
gaccagatatgtataggctaccatgcaaataattcaaccgaacaagtagatacaatcatggaaaaaaatgtgaccgtaacccatgctcaagacattttagaaaaaacccacaatgggaaattatgcaatctagatggagtaaaaccactaatccttaaagattgcagcgtagcaggatggctattagggaacccaatgtgcgacgaattcctaaatgtatctgaatggagttacatagtagaaaaagcaagcccagcaaacgggctatgttacccaggagacttcaacgactatgaagaactaaaacacctactaagtagaattaatcacctaaaaaaaatcaaaataattccgaaaagctattggtccaaccacgaagcatcatcaggagtatctgcagcatgctcatatctaggagaaccatcattcttccgaaacgtagtatggctcataaaaaaaaacaacacatacccaccaataaaagtaaactacacaaacaccaaccaagaagacctactagtattatggggaattcatcacccaaatgacgaaaaagaacaaataagaatatatcaaaatcccaatacatcaatatccgttggtacatccaccctaaatcaacgactcgttccaaaaatagccacaagaccaaaagtaaacggacaaagcggaagaatggaattcttttggaccattctaaaacctaatgattcaatcaacttcgatagtaatggaaatttcatagcaccagaatatgcatacaaaatcgcaaaaaaaggagactcagtaatcatgaaaagtgaactcgaatacggaaattgtaacacaaaatgccaaacaccaatgggcgcaataaactcaagcatgcccttccacaacattcaccccctaacaataggagaatgcccaaaatatgtaaaatcaaatagactcgtactagccacaggactcagaaacgcaccacaaacagaaaccagaggactcttcggagccatcgctggttttatagaaggaggatggcaaggaatggtagacggctggtatggataccaccattcaaacgaacaaggttcaggatacgcagcagataaagaatcaacacaaaaagcaatagacggaataactaataaagtaaactcaataatagataaaatgaacacgcaattcgagatagtaggaagagaattcaataacctagagagaagaatagaaaacttaaataaaaaaatggaagacggattcctagacgtatggacatacaacgcagaactcctagtattaatggaaaacgaaagaacattagacttccacgatagtaatgttaaaaacctatacgaaaaagtaagactacaattacgagataatgcaaaagaacttggaaacggatgctttgaattttatcacaaatgcgacaacgaatgcatggaatcagtaagaaacggaacctacgattatccacaatactcagaagaagctagattaagtagagaagaaatatcaggagtaaaaatggaatcaatggtaacataccagtccggaagattagtaccacgaggaagtccaggatcaggatacataccagaagcacccagagacggacaagcatatgtaagaaaagacggagaatgggtactactcagcacattcctaggaaaaccaataccaaaccctttattaggcttagatagtacaggc

SEQ ID NO: 51328 - RNA, 1698 nt, synthetic construct
  misc_feature 1..1698: note = derived and/or modified sequence opt6 from anti-influenza_Chain
  source 1..1698: mol_type = other RNA
gacacactatgcatcggataccatgcaaacaactcaacagacacagtagatacagtattagaaaagaacgtaacagtaactcactcagtcaacttactagaagacaaacataatggaaaactatgtaaacttcgtggagtagcaccactacacttaggcaaatgcaatattgctggatggatattaggaaaccccgaatgcgaaagcctatcaaccgcttcaagctggagttacatagtagaaacaccaagttcagacaatggaacctgttacccaggtgacttcatagattatgaagaactacgtgaacaattatcgagcgtatccagtttcgaacgattcgaaatcttcccaaaaacaagttcatggccaaaccacgactccaataaaggagtaacagcagcgtgcccacacgcaggagcaaagagcttttacaaaaatctaatatggttagtaaagaaaggcaattcatatccaaaattaagcaaatcatacataaacgataaaggtaaagaagttctagtactctggggaatacaccacccatcaacatcagcagatcaacaatccctttaccaaaatgcagacacctacgtatttgtgggctcatcaagatactcaaagaaatttaaaccagaaatagcaatacgaccaaaagtaagagatcaggaaggaagaatgaactactattggacacttgtagaaccaggagacaaaataaccttcgaagcaactggaaatttagtagtaccaagatatgcatttgcaatggaaagaaacgcaggatcaggaataataataagcgacacacccgtacacgattgcaacacaacatgccaaacaccaaaaggagcaataaatacatcactcccatttcaaaatatacacccaataacaataggaaaatgcccaaaatacgttaaaagcaccaaattaagattggccacaggattaagaaacataccatcaatccaatcccgaggactcttcggagcaatagcaggctttatagaaggaggctggaccggcatggtagacggatggtatggatatcaccatcaaaacgaacaaggctccggctacgcagcagacttaaaaagtacacaaaacgcaatagatgaaataacaaacaaagtaaactcagtaatagaaaagatgaatacacaattcacagcagtaggaaaagaatttaaccacttagaaaaacgaatagaaaaccttaataagaaagtagatgatggattcctagatatatggacatataacgcagaattacttgtactattagaaaacgaaagaacactagactaccatgactccaacgttaaaaacctatacgaaaaagtaagatcacaacttaaaaataatgcaaaagaaataggaaatggatgctttgaattttaccataaatgcgacaacacatgtatggaatcagtcaaaaatggaacatatgactatcccaaatactccgaagaagcaaaactaaacagagaagaaatagacggagtaaaactagaatcaacacgaatatatcaatcaggaagattagtaccaagaggctccccaggaagtggatacattccagaagcaccacgagacggccaagcatacgtaagaaaagatggagaatgggtactactttcaactttcctaggaaaaccaatcccaaatccactactcggactcgactccacaggc

SEQ ID NO: 51329 - RNA, 1698 nt, synthetic construct
  misc_feature 1..1698: note = derived and/or modified sequence opt6 from anti-influenza_Chain
  source 1..1698: mol_type = other RNA
gacagaatatgcataggataccaatctaataactcaaccgacacagtaaacaccctaatagaacaaaaagtcccagtaacacaaacaatggaattagtggaaacagaaaaacatccagcatattgcaacacagatctaggcgcaccattagaactaagagactgtaaaatcgaagcagtaatatatggaaacccaaaatgcgatatacacctcaaagatcaaggatggtcatacatagtagaaaggccatcagctccagaaggcatgtgctacccaggctcagtagaaaatttagaagaactcagattcgtattttcatccgcagcgagctacaaaagaataagactattcgactactcaagatggaacgtcacatcaagcggtactagcaaagcatgtaatgcaagcacaggaggacaatccttctatcgatcaatcaactggttaaccaaaaagaaaccagatacttatgatttcaatgaaggaacatacgtaaacaatgaagacggagatataatatttctatggggaatacatcatccaccagatacaaaagaacaaacaacattatataaaaacgcaaatacattatcaagcgttacaaccaacacaatcaaccgatcattccaaccaaacataggtccaagaccattagtccgtgggcaacaaggtagaatggactactattggggcatattaaaaagaggagaaacactaaaaataagaacaaatggaaacctgatcgcaccagaatttggttatctattaaaaggtgaatcacacggaagaactatacaaaacgaagacataccaattggcaactgctacaccaaatgccaaacatacgcaggggcaataaatagttcaaaaccattccaaaacgcatcacgacattacatgggagaatgtcctaaatatgtaaagaaagcctctctaaggctagcagtaggattgcgaaacacgccatccgtcgaaccgagaggattattcggagccatcgcaggatttatagaaggaggatggagtggaatgatagatggatggtacggattccaccatagcaattcagaaggtacgggtatggcagcagaccaaaaatcaacacaagaagccatagacaaaataacaaataaagtcaataacatagtagacaaaatgaacagagaatttgaagtagttaaccatgagttctcagaagtagagaaaagaataaatatgataaacgataaaatagacgatcaaatagaagatctctgggcatacaacgcagaactattagtattactagaaaaccagaaaacacttgatgaacatgacagcaatgtcaaaaatttattcgatgaagtaaaaaggcgactatcagcaaatgcaattgatgctggaaacggttgcttcgacatcttacataaatgtgacaacgaatgcatggaaaccattaaaaacggaacatatgatcataaagaatatgaagaagaagcaaaactagaaagatcaaaaataaacggagtaaaactcgaagaaaacaccacatacaaatcaggtagattagtaccaagaggatccccaggatcaggatatatacctgaagctccaagagacgggcaggcttatgtacgaaaagacggagaatgggttctactatcaacattcctaggcaaaccaataccaaatccactattaggattagatagcacagga

SEQ ID NO: 51330 - RNA, 1698 nt, synthetic construct
  misc_feature 1..1698: note = derived and/or modified sequence opt6 from anti-influenza_Chain
  source 1..1698: mol_type = other RNA
gacaccttatgtataggataccatgcaaataacagtacagatacagtagatacggtactagaaaaaaacgtaacagtaacacacagcgtaaacctcttagaagacaaacataatggcaaactctgcaaacttcgaggcgtagcaccattacacttgggaaaatgcaatatagcaggatggatattaggtaacccagaatgcgaatcactttcaacagcatcaagttggtcatacatcgttgaaactccatcatcagacaacggaacatgttaccctggtgattttatagactatgaagaactaagagaacaattaagtagcgtgtcatcatttgaaagatttgaaatatttcccaaaacatcatcttggccaaaccacgactcaaacaaaggcgtgacagcagcatgtccacatgccggagcaaaatcattctacaaaaacttgatttggttagtcaaaaaaggaaatagctaccccaaactatccaaatcatatataaacgacaaaggcaaagaagtattagtattatggggaatacaccatcccagcacaagcgctgaccaacaaagtttatatcaaaatgcagacacatatgtattcgtaggatccagcagatattcaaaaaaatttaaacccgaaatagcaatacgccctaaagtaagagaccaagaaggacgaatgaattactactggacactagtagagccaggagacaaaattaccttcgaagcaacaggcaacttagtagtccccagatatgccttcgctatggagagaaatgcaggaagcggaataataataagcgacacacctgtacatgactgcaatacaacatgccaaacaccaaaaggagcaattaacacaagcttaccattccaaaacatacatccaataacaattggaaaatgcccaaaatacgtcaaatcaacaaaactaagattagcaacaggactaagaaacataccatcgatacaatcaagaggactattcggagcaatcgcaggttttatagaaggaggctggacaggaatggtagatggctggtacggctatcaccaccaaaacgaacaaggaagcggttacgccgcagacttaaaatccacacaaaatgcaatagacgaaatcacaaataaagtaaattcagttattgaaaagatgaatacacagtttacagcagtaggaaaagaatttaaccacttagaaaaacgtattgaaaatctcaataaaaaagtagacgacggttttctcgatatatggacatacaatgcagaattactagttttattagaaaacgaaagaacattagactaccatgattcgaacgtaaaaaatctatatgaaaaagtaagatcacaattaaaaaacaacgctaaggaaataggaaacggctgtttcgaattctatcacaaatgcgacaatacttgcatggaaagcgtaaaaaacggtacctatgactatccaaaatactcagaagaagcaaaattaaatagagaagaaatagacggagtaaaactagaatctaccagaatatatcaatcaggaagattagtacctagaggcagcccaggaagtggatacatcccagaagcaccaagagatggacaagcttacgtaagaaaagacggggaatgggtcctactatcaacctttctaggaaaaccaataccaaacccactattaggattagattccactggc

SEQ ID NO: 51331 - RNA, 1698 nt, synthetic construct
  misc_feature 1..1698: note = derived and/or modified sequence opt6 from anti-influenza_Chain
  source 1..1698: mol_type = other RNA
gatagaatatgtataggataccaatcaaataattccaccgatacagtcaacacattaatagaacaaaaagtaccagtcacacaaacaatggaattagtcgaaaccgaaaaacatccagcatattgcaatacagatttaggagctccactagaactcagagattgcaaaatagaagcagtaatctatggaaatccaaaatgcgacatacatttaaaagatcaaggatggagttatatagttgaaaggccctcagcacctgaaggaatgtgttacccaggaagtgtcgaaaacttagaagaactaagatttgtattctcaagtgcggcatcatacaaaagaataagactattcgattacagcagatggaatgtgacatcaagcggaacatctaaagcatgcaatgcctcaaccggtggccaaagtttctatagatcaatcaactggctaactaaaaagaaaccagatacatatgattttaatgaaggaacatacgtaaacaacgaagacggagatataatttttctttggggaatacatcatccaccagacacaaaagaacaaactacactatacaaaaacgcaaacacattatcaagtgtaacaaccaacactataaatagatcattccaaccaaatataggacctagacctctagtcagaggacaacaaggaagaatggactactattggggaatcctaaaaagaggagagacattaaaaattagaaccaacggaaatttaatagcaccagaatttggttacttgttaaaaggagaaagtcacggaagaacaatacaaaatgaagacatacctataggaaattgctatacaaaatgtcaaacatacgcaggagcaataaactcaagtaaaccgtttcaaaatgcatcaagacattatatgggagaatgcccaaaatatgtaaagaaagcaagccttagacttgcagtaggattaagaaatacaccgtcagtcgaaccaagaggattatttggagcaatagccggctttatagaaggaggatggtcaggaatgatagatggatggtacggattccaccacagcaattcagaaggcaccggcatggccgcagaccaaaaatcaacacaagaagctatagataaaataacaaacaaagtaaacaacatagtagacaaaatgaaccgagagttcgaagtagtaaatcacgagttcagcgaagtagagaaaagaataaacatgataaatgacaaaatagacgaccaaatagaagatttatgggcatataatgcagaactattagtactactagaaaatcaaaagacattagatgaacatgacagtaatgttaaaaatctcttcgatgaagtaaaaagaaggctatcagcaaatgcaatagatgcaggaaatgggtgtttcgatatactacataaatgtgacaacgaatgcatggaaacaatcaaaaatggaacctacgatcataaagaatatgaagaagaagctaaactagaaagaagcaaaataaacggtgtcaaactagaagaaaacacaacatacaaatcaggacgattagttccaagaggttcaccaggttcaggatatataccagaagcaccaagggacggacaagcgtatgtacgaaaagacggagaatgggtacttctcagtacatttttaggaaaacccataccaaacccattattgggtctagactcaacagga

SEQ ID NO: 51332 - RNA, 1701 nt, synthetic construct
  misc_feature 1..1701: note = derived and/or modified sequence opt6 from anti-influenza_Chain
  source 1..1701: mol_type = other RNA
gataaaatatgcattggataccatgcaaacaattcaaccacacaggtcgacacaatattagagaaaaatgtcacagttacacactccgtagaactattagaaaatcaaaaagaagaaagattttgcaaaatactaaataaagccccattagacttaagaggctgtacaatagaaggatggatactaggaaacccccaatgtgacttactactgggagatcaatcatggtcatacattgtagaacgaccaacagcgcaaaacggaatatgttatccaggtgcattaaacgaagtcgaagaacttaaagcattaatcggatccggagaaagagtagaaagatttgaaatgtttccaaaaagtacatggacaggagttgataccagtagtggagtaacaaaagcatgcccatataatagtggatcaagtttctacagaaatttattatggataataaaaaccaaatcagctgcatacccagtaataaagggaacatacaataacacaggaagtcaacctatactatacttctggggagtccatcatccaccagacacaaatgaacaaaacacactatacggaagcggagaccgatacgtaagaatgggtactgaaagcatgaattttgcaaaaagtcccgaaattgctgctagacctgcagtaaatggacaaagaggacgaatagattactactggagtgtattaaaaccaggagaaacactcaatgtagaaagtaacggaaacttaatcgcaccatggtatgcctacaaattcgtaagcacaaacaataaaggagcaatattcaaatcgaatttaccaatagaaaattgcgatgcaacatgccaaactatagcaggagtactaagaactaataaaacatttcaaaatgtatcaccattatggataggcgaatgccccaaatatgtaaaatcggaaagtctaagattagcaacaggtctaagaaatgtaccacaaatagaaacaagaggactattcggagcaatagcaggattcatagaaggtggatggacagggatgatagacggatggtacggataccaccatgaaaacagtcaagggtcaggttacgcagcagacaaagaaagtacacaaaaagcgattgatggaataacaaataaagtaaatagtataatcgataaaatgaatacacaattcgaagcagtagatcatgaatttagcaatttagaaagacgaatagacaacctaaataaaaggatggaagacggctttctagatgtatggacatataatgcagaactattagtactattagaaaacgaacgaacactcgacttacacgacgcaaatgtcaaaaatttatacgaaaaagtaaaatcacaattacgtgataatgcaaatgatttaggaaacggatgctttgagttctggcacaagtgcgataatgaatgcatagaatcagtgaaaaatggaacttacgactatccaaaatatcaagatgaaagtaaattaaacagacaagaaatagaatcagtaaaactagacaatctaggagtttatcaatcgggcaggctagtacccagaggatcaccaggttcaggctacataccagaagctccaagagatggacaagcatatgttagaaaagatggagaatgggtattactcagcacatttctaggaaaacctataccaaacccacttctaggactagactcaacagga

SEQ ID NO: 51333 - RNA, 1701 nt, synthetic construct
  misc_feature 1..1701: note = derived and/or modified sequence opt6 from anti-influenza_Chain
  source 1..1701: mol_type = other RNA
gacaaaatatgcataggttaccacgcaaataacagcacaactcaagtcgatacaatattagagaaaaacgtaacagtaacacattcagtagaattattagaaaatcaaaaagaagaaaggttctgtaagatactaaataaagctcccttagatctaagaggatgtacaatagaaggatggatactcggaaacccacaatgtgaccttttactaggagatcagtcatggtcatacatagtagaaagaccaaccgcacaaaatggaatctgttacccaggagctctaaatgaggtcgaagaattaaaagcattaataggaagcggggaaagggtagaacgctttgaaatgtttccaaaaagtacatggacaggagtcgacacatccagtggagtaacaaaagcatgcccatataactctggtagtagtttctatagaaatctattatggataataaaaacaaaatcagcagcataccccgtaataaaagggacatacaacaacacaggatctcaacctatactctatttctggggagtacatcatccacccgacacaaacgaacaaaacacattatatggtagtggagatagatatgtcagaatgggaacagaatcaatgaactttgcaaaatcacccgaaatagcagcaagaccagcagtaaatggacaaagaggaagaattgattattattggtcagtactaaaaccaggagaaacgttaaatgttgaatcaaacggaaatctaatagcaccctggtacgcatacaaatttgtatcgactaataataaaggagccatatttaaatctaacttaccaatcgaaaattgcgatgcaacatgtcaaactatagcaggagttctacgaacaaataaaacgtttcaaaacgtatcaccactctggataggcgaatgtccaaaatatgtaaaaagtgaaagtctaagacttgccacaggattaagaaacgtaccacaaatagaaacacgaggattattcggtgcaattgcaggatttatagaagggggttggacaggaatgattgacggatggtacgggtatcatcatgaaaactcacaaggaagtggttatgcagcagataaagaaagtacacaaaaagcaatcgatggcataacaaataaagttaattcgataatagacaaaatgaatacacaatttgaagccgtagaccatgaattttcaaacttagaaagaagaatagataatctaaataaaagaatggaagatggattcctagatgtatggacatacaatgcagaactattagtactacttgaaaacgaaagaacattagaccttcatgatgcaaacgttaaaaacctatatgaaaaagtaaagtcacaattaagagataatgcaaatgatctaggaaatggttgttttgaattttggcacaaatgcgataatgaatgcatagaaagcgttaaaaacggaacctatgattaccctaaatatcaggacgaaagtaaattaaataggcaagaaatcgaatcagttaaacttgataacttaggagtataccaatctgggagattggtacccaggggatcaccaggatcaggatacataccagaagcaccacgagacggtcaagcatatgtaagaaaagatggagaatgggtactattaagcacatttttaggtaaaccaataccaaacccgctattaggactagatagcacaggt

SEQ ID NO: 51334 - RNA, 1704 nt, synthetic construct
  misc_feature 1..1704: note = derived and/or modified sequence opt6 from anti-influenza_Chain
  source 1..1704: mol_type = other RNA
gaccacatatgcataggataccacgcaaacaactcaaccgaacaagtagataccataatggaaaaaaacgtaacagtaacacatgcacaagatatactagaaaaaacccacaacggaaaactatgtgacctcaatggagtaaaaccactaatactaaaagactgcagtgtagccggatggttactaggaaacccaatgtgcgacgaatttataaatgtaccagaatggagttacatagtagaaaaagcaaacccagcaaatgacttatgctacccgggaaatttcaatgactatgaagaactaaaacacctattatcaaggataaatcattttgaaaaaatacaaataataccaaaagacagttggtcagaccacgaagcatcactaggtgtatcatcagcgtgcccataccaaggaaattcaagtttcttccgcaacgtagtatggcttataaaaaaaggcaatgcataccctacaatcaaaaaatcatacaacaacacaaaccaagaagatctactggtattatggggaatacaccacccaaacgatgaagcagaacaaacaagactatatcaaaaccccactacatatatatcaataggaacatcaacactaaaccaaagattagtaccaaaaatagctacccgaagtaaagtaaacggacaaagtggaagaatagattttttttggaccatattaaaaccaaatgacgcaataaatttcgaatcaaacggaaatttcatagcccctgaatacgcatacaaaatagttaaaaaaggagattcgacaataatgaaaagtgaagtagaatatggaaactgtaacacaagatgccaaacacccatgggagcaataaacagttcaatgccattccacaacatacacccactaacaataggagaatgtccaaaatacgtaaaatcaaacaaattagttttagctacaggactaagaaattccccacaacgggaacgaaggagaaaaagaggattattcggtgcaatagccgggttcatagaaggaggatggcaaggaatggtagatggatggtatggataccatcacagtaacgaacaaggaagtggatacgcagcagacaaagagtcaacgcaaaaagcaatcgatggagtaacaaacaaagtcaactcaataatagacaaaatgaacacacaattcgaagcagtgggaagagaattcaacaatctcgaaagaagaatagaaaatttaaacaaaaaaatggaagacggattcctagacgtatggacatataacgcagaactattagtactaatggaaaatgaaaggactctagacttccacgactcaaacgtaaaaaacttatacgacaaagttagattacaacttagagataacgcaaaagaacttggcaatggatgtttcgaattctatcataagtgtgacaacgaatgtatggaaagtgtaagaaacggaacatacgactatccacaatacagcgaagaagcaagactcaaaagagaagaaataagtggagtcaaactagaatcaataggaacatatcaatcaggacgcttagtaccaagaggaagtccaggctcaggatatatcccagaagcaccaagagatggacaagcatacgtacgaaaagacggagaatgggtattactaagcaccttcttagggaaaccaataccaaatccgttactaggactagattctacaggt

SEQ ID NO: 51335 - RNA, 1704 nt, synthetic construct
  misc_feature 1..1704: note = derived and/or modified sequence opt6 from anti-influenza_Chain
  source 1..1704: mol_type = other RNA
gaccagatctgtataggatatcatgctaacaatagtacagaacaagtagataccattatggaaaagaatgtaactgtcacccacgcacaagatatactagaaaaaacacacaacggtaaattatgcgacttagacggagtaaaaccgcttattctacgagactgttcagttgcaggatggttattaggaaacccaatgtgcgatgaattcataaatgtaccagaatggagttatatagtagaaaaagccaatccagcaaacgacttatgctacccaggtaatttcaatgactacgaggaacttaaacacttactaagcagaataaatcactttgaaaaaatacaaataataccaaaatcatcatggtctgaccatgaagcatcatcaggagtatcatcagcttgtccatatcaaggtacaccaagtttcttcagaaatgtggtctggttaataaaaaaaaataacacatacccaacaataaaaagatcatataacaatacaaaccaagaagacctactaatcctctggggtatacaccactcaaacgacgccgcagaacaaacaaaattatatcaaaaccctacaacatacatatctgttggaacaagtacactcaaccaaagattagtaccaaaaattgcaaccagatcaaaagtaaacggacaatcaggaagaatggattttttttggacaatattaaaacccaacgacgcaatcaacttcgaatccaacggtaattttatagcaccagaatatgcttacaaaattgtcaaaaaaggcgactcagcaatagttaaaagcgaagtagaatacggaaactgcaacacaaaatgccaaacaccaataggagcaataaactcaagcatgccattccataatatacacccgctaacaataggcgaatgccccaaatacgtaaaatcaaataaattagttttagcaacaggattaagaaattctccactcagagaaagacgtcgaaaaagaggactctttggagcaattgccggattcatagaaggaggatggcaaggaatggtagatggatggtacggatatcaccattcaaacgaacaaggatcaggatacgcagccgataaagaatcaacacaaaaagcaatagatggagtaacaaacaaagtgaacagtataatagataaaatgaacacccaattcgaagcagtaggaagagaattcaacaacttagaaagaagaatagaaaacctaaacaaaaaaatggaagacggatttctggatgtatggacgtacaacgcagaactcctagttctaatggaaaatgaaagaacactagattttcatgactccaatgtaaaaaatctatatgataaagttagattgcagcttagagataacgcaaaagaattaggaaacggatgctttgaattctaccacaaatgtgacaatgaatgcatggaatcagttcgaaatggaacatacgattacccacaatatagcgaagaagcacgcctaaaaagagaagaaataagcggagtaaaattagaatcaataggaacatatcaaagtgggcgactagtaccacgaggcagcccaggctccggatacataccagaagcaccaagagatggacaagcatatgtaagaaaagacggagaatgggtgctattatcaacatttctaggtaaaccaattcctaatccattactaggattagactcaactgga

SEQ ID NO: 51336 - RNA, 1704 nt, synthetic construct
  misc_feature 1..1704: note = derived and/or modified sequence opt6 from anti-influenza_Chain
  source 1..1704: mol_type = other RNA
gatcatatatgtatcggataccacgccaacaactcaacagaacaagtagacacaatcatggaaaaaaacgtaacagttacacatgcccaagacatactagaaaaaacacacaacggaaaattatgtgatttaaacggagtcaaaccactcatactaaaagactgttcagtcgcaggatggttattaggtaatccaatgtgcgatgaattcataaacgtaccagaatggagttacatagtagaaaaagctaacccggcaaatgatctatgctatccaggaaacttcaatgactacgaagaattaaaacacctgttaagtagaataaaccacttcgaaaaaatacaaataataccaaaagattcatggtcagatcacgaagcctcgctcggtgtttcaagcgcatgcccatatcaaggaaatagctcattcttcaggaacgtggtttggctgatcaaaaaaggtaacgcatacccaacaatcaaaaagtcatacaacaatacaaaccaagaggacctactagtactgtggggaatacaccacccaaacgacgaggcagaacaaacacgactatatcaaaatccaacaacatacatttcaataggaacaagtacattaaatcaaagattagtcccaaaaatagcaacaagaagcaaagtaaatggccaatctggaagaatagactttttctggacaatactaaaaccaaacgacgcaataaatttcgaaagtaatggaaactttatagcaccagaatatgcatacaaaatagtaaaaaaaggcgatagcaccataatgaaaagtgaagtagaatacggaaattgcaacacaagatgccaaaccccaatgggagcaataaatagctcaatgccatttcataacatacacccactaacaataggagaatgcccaaaatatgtaaaaagcaacaaacttgtactcgcaacaggactacgaaactcaccacaacgagaaagacgaagaaaaagaggactattcggagcaatagcaggatttatagaaggcggatggcaaggaatggtagatggctggtacggatatcaccatagcaatgaacaaggatcaggctacgcagctgacaaagaatccactcaaaaagcaatagacggagtaacaaacaaagtaaactcaataatagacaaaatgaatacccaatttgaagcagtaggtagagagttcaataatctggaaagaagaatcgaaaacctaaataaaaaaatggaagatgggttcctcgacgtatggacatacaacgcagaattattagtactaatggaaaatgaaagaactttagactttcacgacagcaatgtaaaaaacttatatgataaagttagattacaactcagagacaacgcaaaagaattaggcaatggatgtttcgaattttaccacaaatgcgataacgaatgtatggaatcagtaagaaacggaacatatgactacccacaatattcagaagaagccagactaaaaagagaagaaataagcggagtaaaattagaaagcatcggaacatatcaaagcggaagactagtaccacgcggatcaccaggttctggatacattcctgaagcaccaagagatggacaagcttacgtaagaaaagatggagaatgggtcctactatccacattcctaggaaaaccaataccaaatccactactaggtctagacagtacagga

SEQ ID NO: 51337 - RNA, 1704 nt, synthetic construct
  misc_feature 1..1704: note = derived and/or modified sequence opt6 from anti-influenza_Chain
  source 1..1704: mol_type = other RNA
gatcaaatatgtataggataccacgccaacaactcaacagaacaagtagacaccatcatggaaaaaaacgtaacagtaacacatgcacaagatatacttgaaaaaacacacaatggaaaattatgtgatctagacggagtcaaaccattaatactaagagactgttcagtagcaggctggctattaggaaatccaatgtgcgacgaattcataaacgtacccgaatggtcatatatagtagaaaaagcaaaccccgcaaatgacctatgttacccaggaaatttcaatgattatgaagaattaaaacatctactatcaagaataaaccacttcgaaaaaatacaaataataccgaaaagctcatggtctgaccatgaagcatcatcaggtgtatcgtcagcatgtccataccaaggaacaccatcattcttcagaaacgtagtatggttaataaaaaaaaataacacatacccaacaatcaaaagaagctataataacactaaccaagaagacctattaattttatggggaatacaccattctaatgacgccgctgaacagaccaaactatatcaaaacccaacaacatacatatcagtcggaacttcaacattaaatcaacgactagttccaaaaatagccacaagaagcaaagtaaacgggcaaagtggaagaatggattttttctggacaatattaaaaccaaacgacgcaattaatttcgaaagtaacggaaactttatagccccagaatatgcctataaaatagttaagaaaggagacagcgctatagtaaaaagcgaagtagaatacggaaactgtaacacaaaatgtcaaacacctataggagcaataaactcatcaatgccttttcataatatacatccgctaacaataggagaatgccccaaatacgttaaatcaaacaaattagtattagcaacaggcctaagaaacagtccattaagagaaagaagacgtaaacgaggattattcggagcaatagcaggattcattgaaggtggatggcaaggaatggtagacggatggtacggttatcatcatagtaatgaacaaggtagtggatacgcagcagacaaagagtcaacacaaaaagcaatagacggagtaacaaataaagtcaattcaataatagacaaaatgaacacacaatttgaagccgtaggacgagaattcaataatctagaaaggagaatcgaaaacctaaacaaaaaaatggaagacgggttcttagacgtatggacatataacgcagaattattagtcctcatggaaaatgaaagaactctagactttcacgattcaaacgttaagaacttatatgacaaagtaagattacaattacgcgataatgcaaaagaattgggaaacggctgtttcgaattttaccacaaatgcgacaatgaatgtatggaatcggtaagaaatggaacatacgactatccacaatattctgaagaagcccgactaaaaagagaagaaatctccggcgtaaaattagaatcaataggaacatatcaaagcggaagattagtaccaagaggatcaccaggaagtggatacataccagaagcacctagagatggacaagcatacgtaagaaaagacggcgaatgggtattgctatccaccttcctaggtaaaccaataccaaacccattattaggcctagactcaacagga

SEQ ID NO: 51338 - RNA, 1707 nt, synthetic construct
  misc_feature 1..1707: note = derived and/or modified sequence opt6 from anti-influenza_Chain
  source 1..1707: mol_type = other RNA
gatcaaatctgtataggatatcatgctaataatagtacagaacaagtagacacaataatggaaaaaaatgtaacagtaacccacgcacaagacatactagaaaaaaaacacaatggaaaactctgcgacttagatggagtaaaaccattaatattgagggattgttcagtagcaggatggctcctaggaaatccaatgtgcgacgaatttataaacgtaccagaatggagctacattgtagaaaaagcaaacccagtaaacgatctatgctaccccggagatttcaacgactacgaagaactaaaacacctactatcaagaataaaccatttcgaaaaaatccagataataccaaaatccagctggagtagtcacgaagcaagcctgggagtatcctccgcgtgcccatatcaaggcaaaagcagtttcttccgaaacgtcgtatggctaataaaaaaaaactcaacatatccaacaatcaaacgatcctataacaacaccaaccaagaagacttattagtattatggggaatacaccatccaaacgatgcagcagaacaaacaaaactatatcaaaatccaaccacatacatatcggtcggaacatccacccttaaccaaagactagtaccaagaatagcaacaagaagtaaggttaacggacaaagtggaagaatggaattcttctggacaatactaaaaccaaacgatgcaatcaactttgaatcaaacggtaactttatagcaccggaatacgcctataagatcgtaaaaaaaggagattctacaataatgaaatcagaactggaatacggaaattgtaacacaaagtgccaaacaccaatgggcgcaatcaacagcagcatgccattccataatatacacccactaacaatcggggaatgcccaaaatatgtaaaatcaaacagactagtattagccacgggcttacgtaactcaccacaaagagaaagaagaagaaaaaaaagaggactatttggtgcaatagcaggttttatagaaggaggatggcaaggaatggtcgacggatggtatggataccaccattcaaacgaacaagggagtggctatgctgcagacaaagaaagtactcaaaaagcaatagacggagtaacaaacaaagtaaacagtataatagacaaaatgaacacacaatttgaagcagttggcagagaattcaacaatttagaacgaaggatagaaaatctaaacaaaaaaatggaagacggatttttagatgtatggacatacaatgcagagcttttagtactaatggaaaatgaaagaaccctagactttcacgatagcaacgtaaaaaatctatacgataaagtaagattacaactaagagataacgcaaaagaactaggaaacggatgtttcgaattctatcataaatgcgacaacgaatgcatggaatccgtaagaaacggaacatatgactacccacagtactcagaagaagcccgactaaaaagagaagaaatatcaggcgttaaactagaatcaatcggaatataccaaagcggaagactagtaccaagaggatcaccaggatcaggatacataccagaagccccaagagacggacaagcatacgtacgaaaagacggagaatgggtcctactatcaacatttttaggaaaaccaataccaaatcctctactaggtctagactcaacagga

SEQ ID NO: 51339 - RNA, 1707 nt, synthetic construct
  misc_feature 1..1707: note = derived and/or modified sequence opt6 from anti-influenza_Chain
  source 1..1707: mol_type = other RNA
gaccaaatatgtattggataccacgcaaacaatagtacagaacaagtagacacaataatggagaaaaatgtaacagtaacacacgcccaagacatcctcgaaaaaacacataacggaaaactctgcgacttagatggagtaaaacctttaatactaagagactgcagcgtcgcaggatggttattaggcaatcccatgtgtgatgaattcataaacgttccagaatggtcatatatagtagaaaaagccaatccaacaaacgacttatgctaccctggatcttttaacgactatgaagaactaaaacatttactaagtagaataaatcattttgaaaaaatacaaataatacccaaatcatcatggagtgatcacgaagccagctcaggcgtatcttcagcatgcccatatttgggatcaccaagcttctttagaaatgttgtatggctaattaaaaaaaatagtacataccccactataaaaaaatcatataacaatacaaaccaagaagatctactagtattatggggaatacaccacccaaacgacgcagcagaacaaacaagattataccaaaaccctacaacatacatatcaataggtacaagcaccttaaaccaacgactagtaccaaagatagccacaagaagcaaagtaaacggacaatcaggaaggatggaatttttttggacaatactaaaacctaatgacgcaataaacttcgaatcgaacggaaactttatcgcaccagaatacgcatacaaaatagtaaaaaaaggagatagcgccataatgaaatccgaactagagtatggaaactgcaacactaaatgccaaacaccaatgggagcaataaactcaagcatgccattccacaacatacacccactaacaattggagaatgtccaaaatatgtaaaatcaaacagattagtactagcaacaggactaagaaacagtccacaaagagaaagcagacgtaaaaaaagaggactattcggagccatcgcaggatttatagaaggaggatggcaaggaatggtagatggatggtacggataccatcattcaaacgagcaaggatcgggatacgcggcagacaaagaatccacacaaaaagcaatagacggcgtaacaaacaaagtaaacagtataattgataaaatgaatacacaattcgaagcagtaggaagagaatttaacaatctagaaagaagaatagaaaatctaaataaaaagatggaagacggtttcctagacgtctggacatataacgccgaactactagtattaatggaaaatgaaagaacactagactttcatgactcaaatgtaaaaaacctttacgataaagtcagattacaattaagagataacgccaaagaactaggaaatggctgttttgaattttaccacaaatgtgataatgaatgtatggaatctataagaaacggcacctataattatcctcaatactcagaagaagcaagactaaaaagagaagaaatatcaggcgtaaaattagaaagtatcggaacataccaatccggtcgactcgtacctagaggctcaccaggctcaggttatatcccagaagcacctagagacggacaagcatatgtaagaaaagatggagaatgggtattgctatccacattcctaggaaaaccaataccaaatccacttttaggtctcgacagcaccgga

SEQ ID NO: 51340 - RNA, 1707 nt, synthetic construct
  misc_feature 1..1707: note = derived and/or modified sequence opt6 from anti-influenza_Chain
  source 1..1707: mol_type = other RNA
gaccagatatgcataggatatcatgcaaacaatagcacagaacaagtagacacaataatggaaaaaaacgttacagtcacacatgcccaagacatattagaaaaaacacataacggaaaactatgtgacttagatggcgtaaaaccactaatattaagagactgctctgtagctggatggctccttggaaatccaatgtgcgatgaatttttaaatgttagcgaatggtcctatatagtagaaaaaataaatccagctaacgacctttgttaccctggaaatttcaacaattacgaagaactaaaacatttattatcaagaatcaacagatttgaaaaaatccaaataataccaaaatcctcctggccagatcatgaagcatcattaggcgtatcatctgcatgtccataccaaggaggtccatcattctacagaaacgtagtatggttaatcaaaaaaaacaatacttaccccacaataaaaaaatcatatcacaacactaaccaagaagacctattagtactctggggaatccatcatccaaacgatgaagcagaacaaactcgaatatacaaaaatccaacaacctacatttcagtaggaacatcaacactcaaccaaagactagtaccaaaaatagcaaccagatcaaaagtaaacggacaaagcggaagagtagaatttttctggacaatattaaaatcaaacgatacaataaacttcgaaagtaacggaaattttattgcaccagaaaatgcatacaaaattgtaaaaaaaggagacagtacaataatgaaatccgaattagaatatggcaactgtaacacaaaatgccaaacaccaataggcgcaataaactcatcaatgccatttcataacattcacccactaacaattggagaatgtcccaaatatgtaaaaagtaacagattagtgctagccacagggctaagaaacagccctcaaggcgaacgaagacgaaaaaaacgaggcctattcggagcaatagcaggatttatagaaggagggtggcaaggtatggtcgatggttggtacggatatcaccattctaacgaacaaggtagtggatatgcagcagacaaagaaagcacccaaaaggcaatcgatggcgtaacaaacaaagtaaactcaatcatagacaaaatgaacacacaattcgaagccgtaggaagagaattcaacaacttagaaagaagaatagaaaacttaaataaaaaaatggaagacggattcttagatgtatggacatacaacgctgaacttctagtactaatggaaaacgaaaggaccctagacttccatgactcaaatgttaaaaacctatacgacaaagtaagattacaactaagagacaacgcaaaagaactaggtaatggatgtttcgaattttaccacagatgtgacaacgaatgtatggaatccgtaagaaacggtacctatgattacccacaatactcagaagaagcaagattaaaacgagaagaaatatcaggagtaaaattagaatcaatcggcacgtatcaatcgggaagactagtaccaagaggaagtccaggaagcggatacataccggaagctccaagagatggacaagcatatgtccgaaaagatggagaatgggtactattaagcactttcctaggaaaacccattcccaacccgctactaggactagactcaactggg

SEQ ID NO: 51341 - RNA, 1707 nt, synthetic construct
  misc_feature 1..1707: note = derived and/or modified sequence opt6 from anti-influenza_Chain
  source 1..1707: mol_type = other RNA
gaccaaatatgcataggataccacgcaaacaatagcacagaacaagttgacacaataatggaaaaaaacgttacagtaacacacgcccaagacatactcgaaaaaaaacacaatggaaaactatgtgacttagatggcgtaaaacccttaatactacgagactgttcagtagcaggatggctattaggaaacccaatgtgcgacgaattcataaatgtaccagaatggagttacatagtagaaaaagcaaacccggtaaacgacctctgttaccctggagacttcaacgactatgaagaactaaaacacctactctcaagaataaatcattttgaaaaaatacaaattataccgaaaagttcatggtcatcacatgaagcatctctaggagtatcaagtgcatgcccataccaaggaaaatcatcattcttcagaaacgtagtatggttaataaaaaaaaacagtacatacccaacaatcaaaagatcatacaataacactaaccaagaagacctcctagttttatggggaatacatcaccccaatgatgcagcggaacaaacaaagctataccaaaacccaacaacatacataagcgtcggcacatcaactctcaatcaaagactagtaccaagaatagcaacaagaagcaaagtaaacgggcaatcaggtagaatggaatttttctggactatccttaaaccaaacgatgcaataaacttcgaaagcaacggcaactttatagcaccagaatatgcatataaaatagtaaaaaaaggagacagtacaataatgaaaagtgaactcgaatacggaaactgcaacacaaagtgccaaacaccaatgggcgcgataaatagtagtatgccatttcacaatatacatccactaacaattggcgaatgtccaaaatacgtaaaaagtaatagactagtattagccacaggattaagaaattcaccacaacgagaacgaagacgaaaaaagagaggactcttcggagctatagcaggtttcatagaaggcggatggcaaggaatggtagatggatggtacggttatcaccacagtaacgaacaaggctcaggatacgcagccgacaaagaatcaacacaaaaagcaatagatggggtcactaacaaagtaaattcaataatagacaaaatgaatacacaatttgaggcagtaggaagagaattcaataacctagaaagacgtatagaaaatttaaataaaaaaatggaagacggatttttagatgtatggacatacaacgcagagttactagtactaatggaaaatgaaagaacactagatttccatgactcaaacgtaaaaaatttatatgacaaagtaagacttcaattaagagataacgcaaaagaattaggcaatggatgtttcgaattttaccacaaatgcgacaacgaatgtatggaaagcgtaagaaacggcacctacgactatccacaatattcagaagaagcacgactaaaaagggaagaaatatcaggagtcaaattagaaagtataggaatataccaaagtggcagacttgtaccccgaggttcaccaggatcaggatatataccagaagcaccaagagacggacaagcatatgtaagaaaagacggagaatgggtacttctatcaacatttctaggcaaacccataccaaacccactactaggattagattcaacagga

SEQ ID NO: 51342 - RNA, 1707 nt, synthetic construct
  misc_feature 1..1707: note = derived and/or modified sequence opt6 from anti-influenza_Chain
  source 1..1707: mol_type = other RNA
gatcaaatatgcatcggataccacgccaacaacagtacagaacaagtagacacaataatggaaaaaaacgtcacagtaacacacgcacaagacatattagaaaaaactcacaatggaaaattatgcgatctagacggtgtaaaaccgctaatattacgagactgcagtgtagctggatggctactaggaaacccaatgtgtgacgaattcataaacgtaccagaatggtcatacatcgtagaaaaagccaatccaacaaatgatctctgctatccaggatcattcaacgactatgaagaactaaaacatttattaagcagaataaatcattttgaaaaaatacaaataattcccaaaagttcctggagtgaccatgaagcatctagcggcgtatcctctgcatgcccatacctaggatcgccaagcttcttcagaaacgttgtctggctcataaaaaaaaattccacctacccaactataaaaaaaagctacaataacacaaaccaagaagaccttttagtattatggggaatacaccacccgaacgacgcagcagaacaaacaaggctttatcaaaatccaaccacatacataagcataggaacatcaacactaaatcaaagattagtacccaaaattgctacaagaagtaaagtaaacggacaatcaggaagaatggaatttttctggacaatcctaaaaccaaatgatgcaataaacttcgaaagcaacggaaactttatagcacccgaatatgcttacaagatagtaaaaaaaggagacagtgcaataatgaaatcagaattagaatacggaaattgcaacacaaaatgccaaacaccaatgggagccataaactcatccatgccattccataatatccacccactaacaataggagaatgcccaaaatacgtaaaatcaaatcgactagtcctagccacaggcctaagaaattctccacaaagagaaagtcgaagaaaaaaacgaggactatttggagcaatagcggggttcatagaaggaggatggcaaggaatggtagacggatggtacggctaccaccacagtaatgaacaaggatccggatatgccgcagacaaagaatcaacgcaaaaagccatagacggagtaacaaacaaagtaaattcaataatagacaaaatgaacacacaattcgaagcagtaggaagagaattcaataacttagaaagaagaattgaaaatttaaacaaaaaaatggaagatggtttcctagacgtatggacatataacgcagaactactagtactaatggaaaatgaaagaaccttagatttccatgacagtaacgttaaaaacttatacgataaggtaagactacaactaagagataacgcaaaagaacttggtaacggctgtttcgaattttatcataaatgtgataatgaatgcatggaaagtataaggaacggcacctataactaccctcagtattcagaagaagccagattaaaaagagaagaaatatcaggagtaaaactagaaagtataggaacataccaaagcggaagattagtaccacgaggctcacccggatcaggctacataccagaagcaccaagagacggacaagcatatgtcagaaaagatggagaatgggtcctactatctaccttcctaggaaaaccaataccaaacccactactaggcttagattcaacaggc

SEQ ID NO: 51343 - RNA, 1707 nt, synthetic construct
  misc_feature 1..1707: note = derived and/or modified sequence opt6 from anti-influenza_Chain
  source 1..1707: mol_type = other RNA
gatcaaatatgcatagggtaccacgcaaataattcaacagaacaagtagacacaataatggaaaagaatgtaacggtcactcacgcacaagacatattagaaaaaacacacaatggaaaactctgcgacttagacggagtaaaacctttaatactaagagattgtagcgtagcaggttggctcttaggaaaccctatgtgtgatgaattcctaaacgtctcagaatggagctacatcgtagaaaaaatcaacccagcaaacgacctatgctacccaggaaacttcaataactacgaagaactaaaacacctactctcacgaatcaacagattcgaaaaaatacaaataataccgaaatcatcatggccagaccatgaagcaagcctaggtgtctcaagcgcatgcccatatcaaggcggaccatcattctacagaaacgtagtatggctaataaaaaaaaacaatacgtacccaacaataaaaaaaagttatcataatacaaaccaagaagacttattagtactctggggaatacatcacccaaacgacgaagcagaacaaacaagaatatacaaaaatccaacaacatacataagtgtcggaacctcaacactaaaccaaagattagtaccaaaaatagcgactagatccaaagtaaacggacaatcaggacgcgtagaattcttttggacaatattaaaaagcaacgatacaataaattttgaatcaaacggcaactttatagcaccagaaaatgcatacaaaatagtaaagaaaggagattcaacaatcatgaaatcagaattagaatatggaaactgtaatacaaaatgtcaaactccaataggcgcaattaactcaagcatgccatttcataacatacatccactaacgataggagaatgtccaaaatacgtaaaatcaaacagattagtactagcgacaggattaagaaattctccgcaaggagaaagaagaaggaaaaaacgaggattatttggagcaatagccggattcatagaaggaggatggcaaggaatggtcgatgggtggtatggatatcaccatagcaacgaacaaggcagcggatatgcagctgataaagaatcaacacaaaaagcaatcgatggagtgacaaataaagtaaatagcataatagacaaaatgaacacacaattcgaagcagtgggccgagaattcaataatctagaaagaagaatagaaaatctaaacaaaaaaatggaagacggatttttagatgtttggacatataatgcagaattactcgtactaatggaaaatgaaagaaccttagacttccacgacagcaatgtaaaaaacttatacgataaagtccgacttcaactaagagataacgcaaaagaattaggaaacggttgctttgaattttaccacagatgtgataatgaatgcatggaatccgtaagaaacggaacgtacgactatcctcaatattcagaagaagcaagattaaaaagagaagaaatatcaggagtaaaactagaatccataggaacttatcaaagtggacggctagtaccaagaggcagccccggcagtggatacattccagaagcaccgagagatggacaggcatacgtaagaaaagatggagaatgggtactgttaagtacctttttaggaaaacctatcccaaacccactattaggacttgactcaacagga

SEQ ID NO: 51344 - RNA, 1728 nt, synthetic construct
  misc_feature 1..1728: note = derived and/or modified sequence opt6 from anti-influenza_Chain
  source 1..1728: mol_type = other RNA
atctgcataggataccacgcaaataactcaacagaacaagtagatactataatggaaaaaaatgtaaccgtaacacatgcacaagacatcctagaaaaaacacacaacggcaaactctgcgatctagatggagtaaaaccattaatactaagagactgctcagtagctggatggctactcggaaatcccatgtgtgacgaattcataaacgtaccagaatggtcatacattgttgaaaaagcaaatccagcaaatgacctatgctacccaggaaacttcaacgactacgaagagttaaaacacttattatccagaatcaatcactttgaaaaaatacaaataataccaaaatcaagttggtcagaccacgaagcatccagcggagtctcttcagcatgcccataccaaggaacaccctcgttctttcgaaacgttgtatggctaataaaaaaaaacaatacctatccaacaataaaacgatcatacaataacacaaatcaagaagatttactcatattatggggcatacaccactccaacgatgctgcagaacaaacaaaattataccaaaacccaacaacctatataagtgttggaacctcaaccttaaaccaaagactagtacctaaaatagcaaccagatccaaagttaatggacaaaacggcagaatggacttcttttggacaatactaaaaccaaacgacgctataaactttgaatcaaacggcaactttatagcaccagaatatgcatacaaaatagtaaaaaaaggtgacagcgccatagtaaaatcagaagtcgaatatggtaactgtaataccaaatgtcaaactccaatcggagcaataaactcatcaatgccatttcataatatccacccactcaccataggtgaatgtccaaaatatgtaaaatctaacaaattagtactagcaacaggtctacgtaattcacccttaggatacataccagaagccccaagagacggacaagcatacgtaagaaaagacggagaatgggtattattatcaacatttttacgatcagacaaaacacacacttgtccaccatgtccagctccagaactacttggaggcccatccgtattcctattcccaccaaaacctaaagatacattgatgatatctcgaacccctgaagtaacctgtgttgtagtggacgtatcccatgaagaccctgaagtcaaattcaactggtacgtagacggtgttgaagtacacaatgcaaaaacaaaacctagagaagaacaatacaactctacatacagagtcgtatccgtactaaccgtcctacatcaagactggctaaatggaaaagaatacaaatgcaaagtatcaaacaaagcactaccagcaccaatagaaaaaacaatatcaaaggctaaaggccaaccgagagaaccacaagtttacaccctaccacctagtagagaagagatgaccaaaaaccaagtatctttaacatgtctagtaaaaggattctatccttcagatatcgctgtagaatgggagtctaatggacaacccgaaaacaactacaaaacaacaccaccagtcctagactcagatggatcatttttcttatattcgaaactcaccgtagataaatcaagatggcaacaaggcaacgtcttttcatgctctgtaatgcatgaagcactccataaccattatacacaaaaatcattatcattatcacccggaaaa

SEQ ID NO: 51345 - RNA, 1728 nt, synthetic construct
  misc_feature 1..1728: note = derived and/or modified sequence opt6 from anti-influenza_Chain
  source 1..1728: mol_type = other RNA
atggtagtaacatccaacgcagacaggatatgtacaggcatcacatcatcaaattccccacacgtagtgaaaacagcaacacaaggagaagtaaatgtaacaggagtcataccactaacaacaaccccaacaaaaagtcatttcgcaaacttaaaagggaccgaaacacgaggcaaattatgccctaaatgcttaaactgtactgacttagatgtcgcattaggaagacctaagtgcacaggaaatataccctcagcaagagtatctatcctccacgaagtcagaccagtaacttcgggatgctttcctattatgcacgatagaacaaaaattcgacaactacctaatttgctaagaggatatgaacatataagactatcaacacataatgtaataaatgccgaaaacgcaccaggaggaccttataaaataggaacctcaggatcatgcccaaacgtaacaaatggaaacggtttttttgcaacaatggcatgggcagttccaaaaaacgacaataataaaacagcaactaacagcctaacaatcgaagtaccatacatatgcacagaaggagaagaccaaataacagtatggggctttcacagcgataacgaaacacaaatggcaaaattatatggcgactccaaaccacaaaaatttacaagttcagcaaacggcgtcacaacacactatgtatcccaaataggcggattcccaaaccaaaccgaagatgggggactaccacaaagtggtagaatagtcgtagactatatggtacaaaaaagtggaaaaacaggaacaataacataccaacgaggcatactactcccacaaaaagtttggtgcgcaagtggcaaaagcaaagtaataaaaggatccctaccactcataggcgaagcagattgtttacatgaaaaatatggcggactaaacaaaagcaaaccttactacacaggagaacacgcaaaagcaataggaaattgccctatatgggtaaaaaccccactaaaattagcaaacggtacaaaatacagaccaccagctaaacttctaaaagaaaggggcttttttggcgcaatcgcaggattcctagaaggagggtgggaaggtatgatagcgggatggcatggatacacaagtcatggagcacatggtgttgcagtagcagctgatctaaaatctactcaagaagccataaataaaataacaaaaaatctaaactcactaagcgaactagaagtaaaaaatttacaaagactatcaggagcaatggacgaacttcacaatgaaatactagaattagatgaaaaagtagatgacctacgagcagacactatctcatcacaaatagaactagcagtcttattatcaaacgaaggaataataaacagcgaagacgaacacctactggcattagaaagaaaattaaaaaaaatgttaggaccatccgcagttgaaataggaaatggatgtttcgaaacaaaacacaaatgcaatcaaacatgcttagaccgaatagcagcgggaaccttcgacgcaggcgaattttccctaccaacatttgactctctcaatataacagcagcgtcattaaacgacgatggtttagacaatcataccatactattatattattcaaccgcagcatcaagcctagcagtaacactaatgatagcaatattcgtagtatatatggtaagcagagacaacgtcagctgtttccatagc

SEQ ID NO: 51346 - RNA, 1728 nt, synthetic construct
  misc_feature 1..1728: note = derived and/or modified sequence opt6 from anti-influenza_Chain
  source 1..1728: mol_type = other RNA
atggtcgtcacatcaaatgcagaccgaatatgcacaggtataacaagttccaactcaccacacgttgtaaaaactgcaacacaaggagaagtcaatgtaacaggagtcataccactaacaactacacctacaaaaagccatttcgctaacttaaaagggaccgaaaccagaggcaaattatgtccaaaatgtctaaattgtacagacttagatgtagcactaggaagaccaaaatgtacaggaaacatcccttcagcccgagtatctatactacacgaagtcaggccagtaacatcaggatgtttcccaataatgcacgatagaacaaaaataagacaactcccaaatttattaagaggatatgaacatattagattatctacccataacgttatcaacgctgaaaacgctccaggaggaccatataaaatcggaacatctggaagctgcccaaacgtgactaatggcaatggatttttcgcaacaatggcatgggctgtacctaaaaacgataataataaaaccgcaacaaatagcctaaccatagaagtaccgtatatatgtacagaaggagaagaccaaataacagtttggggattccatagtgacaacgaaacacaaatggctaaactatatggagattccaaaccacaaaaatttacaagctcagccaatggagtaacaacacactatgtatctcaaataggcggatttccaaaccaaacagaagacggaggacttccccaaagcggccgaattgtagtagactacatggtccaaaaatcaggaaaaacaggaacaataacataccaaagaggaatcttactaccacaaaaagtatggtgcgcaagtgggaaaagtaaagttataaaaggctcgctaccactaattggagaagccgattgcctccacgagaaatatggcgggctaaacaaatccaaaccatactatacaggtgaacatgcaaaagccattggaaactgcccaatatgggtaaaaacaccattaaaattagcaaatggtacaaaatacagaccaccagccaaattattaaaagaaagaggattcttcggagcaatagctggttttctcgaaggaggttgggaaggcatgatcgctggctggcacggatatacaagtcatggagcacacggagtagcagtagcagcagacctcaaaagcacacaagaagcaataaacaaaataacaaaaaatctcaattcactatcagaactagaagtaaaaaatctacaaagactatcaggagcaatggacgaactacataatgaaatattagaactcgacgaaaaagtagatgacctacgagctgacacaatatcttcacaaatagaattagcagtattactatcaaacgaaggaattataaatagtgaagacgaacatttactagcactcgagagaaaattaaaaaaaatgttaggaccttctgcagtagaaatcggcaatggatgcttcgaaacaaaacataaatgcaatcaaacatgcttggatagaatcgcagcagggacctttgacgcaggcgaattttcactacccacgtttgactcactcaacataacagcagcaagtctcaacgatgatggactagataatcataccatattactatactactctacagctgcttcctcccttgcagtaactttaatgatagctatttttgtagtatacatggtaagtagagacaatgtatcatgttttcacagt

SEQ ID NO: 51347 - RNA, 1728 nt, synthetic construct
  misc_feature 1..1728: note = derived and/or modified sequence opt6 from anti-influenza_Chain
  source 1..1728: mol_type = other RNA
atatgtataggctatcatgcaaacaattcaacagaacaagtagacacaataatggaaaaaaacgtcacagtaacccacgcacaagacatcttagaaaaaacccacaatggaaaactatgtgatctagatggagtaaaaccactcatactccgagactgtagtgtagcaggatggttattaggaaacccaatgtgcgatgaattcataaacgtaccagaatggtcctacatagtagaaaaagccaacccagcgaacgatttatgctaccccggaaatttcaatgactacgaagaactcaaacacttactatcacgcataaaccatttcgaaaaaatacaaatcatacccaaatcatcatggtctgatcatgaagcatcttcaggagtaagctcagcatgtccataccaaggtacaccatcctttttcagaaacgtagtatggttaataaaaaaaaataacacatacccaacaataaaacgatcatataataacacaaatcaagaagatctactcatattatggggtatacatcactccaacgacgccgcagaacaaacaaaattataccaaaatcccacaacatatatatcagtaggtacatcaacccttaatcaacgactagtaccaaaaatagctacaagatccaaagtgaacggccaaaacggtagaatggactttttctggaccatactaaaaccaaacgatgccataaatttcgaaagtaacggaaactttattgcaccagaatacgcatataaaatcgtaaaaaaaggtgattcagcaatagtaaaatctgaagttgaatacggaaattgcaataccaaatgccaaacaccaatcggagcaatcaactcaagcatgcctttccacaacatacacccactcacaataggagaatgccccaaatatgtcaaaagcaacaaactagtactcgctacaggacttcgaaactccccactaggctacataccagaagcaccaagagatggacaagcatatgttcgaaaagacggagaatgggtactattatcaacattcctacgatctgataaaacacacacatgcccaccatgccccgctccagaactccttggaggcccatcagtattcctattcccacccaaaccaaaagacactctaatgatatccagaacacccgaagtcacatgcgtagtagtagatgtatcacacgaagaccctgaagtaaaattcaattggtatgtcgacggcgttgaagtacacaacgcaaaaacaaaaccaagagaagaacaatataactccacataccgggtagtatcagtactcacagttttacaccaagactggttaaatggaaaagaatacaagtgcaaagtaagcaacaaagctttaccagcaccaatcgaaaaaacaatatctaaagccaaaggacaaccaagagaaccacaagtctataccttaccaccatcaagagaagaaatgacaaaaaaccaagtttcgctcacttgtttagtaaaaggattctacccctcagacatagctgtcgaatgggaatcaaatggacaaccagaaaataactacaaaacaacacctccagttttagactcagacggatcattctttctatattctaaactaacagttgacaaatcacgatggcaacaaggaaacgtattttcttgcagcgtaatgcacgaagcacttcacaaccattacacacaaaagtcactatccctatcaccaggcaaa

SEQ ID NO: 51348 - RNA, 1731 nt, synthetic construct
  misc_feature 1..1731: note = derived and/or modified sequence opt6 from anti-influenza_Chain
  source 1..1731: mol_type = other RNA
gcaaaagctggagtacaaagtgtaaaaatggaaaaaatagtattattatttgctattgtttcactagtgaaatcagatcaaatatgtataggctaccacgcaaacaactcaacagaacaagttgacacaataatggaaaaaaacgtaacagttacacacgcacaagacatattagaaaaaacccataacggtaagctctgcgatttagatggagtaaaaccattaatactaagagattgcagcgtagcaggctggctactaggaaacccaatgtgcgacgaattcataaatgtaccagaatggagctatatagtagaaaaagcaaaccccgtaaatgatttatgctaccctggagactttaacgactatgaagaactaaaacacttactatcaagaattaatcactttgaaaaaatacaaatcataccaaaaagtagctggagctcacatgaagcatcactaggagtatcaagtgcatgtccatatcaaggaaaaagctccttctttagaaacgtagtatggttaataaaaaaaaatagtacataccctacaattaaacgaagttacaacaacacaaatcaagaagatctactagtactatggggcatacaccacccaaacgatgcagctgaacaaacaaaattataccaaaatcctacaacgtacatatccgtaggcacttcaacactaaaccaaagactagttccaagaattgcaacaagaagtaaagttaacggacaatcaggcaggatggaatttttctggacaatattaaaaccaaatgacgcaataaatttcgaaagtaacggtaatttcatagctcccgaatacgcatacaaaatagtaaaaaaaggagattctacaataatgaaatcagaactagaatacggaaactgtaatacaaaatgtcaaacacctatgggcgcaatcaatagctcaatgccattccacaacatacatccactcacaataggggaatgcccaaaatacgtaaaatcaaatagactagtacttgcaacaggattaagaaattcaccacaaagagaaagacgccgaaaaaaaagaggtctatttggagctattgcaggattcatagaaggcggatggcaaggaatggtagacggttggtacggatatcaccacagcaacgaacaaggatcaggatatgcagctgacaaagaatctacacaaaaagcaatagatggagtaactaacaaagtaaacagcataatagacaaaatgaacacacaattcgaagccgtaggaagagaatttaacaacttagaaagacgaatagaaaatctaaacaaaaaaatggaagacggcttcctagatgtatggacatacaacgcagagcttcttgtcctaatggaaaacgaaagaacactagacttccacgacagtaatgtaaaaaacttatacgacaaagtaagattacaactgcgcgacaacgcaaaagaattaggaaacggatgcttcgaattctaccataaatgtgataacgaatgcatggaatcagtaagaaacggcacttacgactatccacaatattctgaagaagcaaggctcaaaagggaagaaatatcaggagtcaaactagaatccataggaatatatcaaatactaagtatatattcaacagtagcgtccagcctagcactcgcactcatggtcgctggattatcactatggatgtgctcaaatggatcattacaatgccgtatatgtatt

SEQ ID NO: 51349 - RNA, 1731 nt, synthetic construct
  misc_feature 1..1731: note = derived and/or modified sequence opt6 from anti-influenza_Chain
  source 1..1731: mol_type = other RNA
gctaaagccggagtacaaagtgtaaaaatggaaaaaatagtattattattcgcaatagtatccctagtaaaatcagaccaaatatgcataggctaccatgcaaacaacagtacagaacaagtagatacaataatggaaaaaaacgtaacagtgacacacgcccaagacatattagaaaaaacccacaacggaaagttgtgcgacttagacggagtaaaaccattaatactaagagattgtagtgtagcaggctggttactaggaaatccaatgtgtgatgaattcataaatgtaccagaatggagctacatagtagaaaaagcaaacccagtcaacgacttatgttaccctggcgactttaacgattacgaagaattaaaacacctattaagccgaataaaccattttgaaaaaattcaaattataccaaaaagttcatggtcatcacacgaagcatcactaggagtaagcagtgcctgcccatatcaaggaaaatcatcatttttcagaaacgtagtatggttaataaaaaaaaactcaacttacccaacaataaaaagatcctacaacaacactaatcaagaagacttactagttctatggggtatccaccacccaaatgatgcagcagaacaaacgaaattatatcaaaacccaaccacatacataagcgtaggaacatcaacactcaaccaaagattagttccccgcatagctacaagaagtaaagtaaacggacaatcaggaagaatggaattcttctggactatactaaaaccaaacgacgcaataaactttgaatcaaacggcaacttcatagcaccggaatacgcatataaaatagtcaaaaaaggagacagtacaataatgaaatcagaactagaatatggaaactgtaacacgaaatgtcaaaccccaatgggagctataaatagttcaatgccgttccacaatatacatccactaacaataggagaatgcccgaaatatgtcaaatcaaacaggcttgtactagcaacaggactacgaaactccccacaacgagaacgaagacgaaaaaaaagaggcttattcggagcaattgcagggttcatagaaggaggatggcaaggtatggtagacggatggtatggttaccaccattcaaatgaacaagggagcggctacgcagctgataaagaatcaacacaaaaagctatagacggagttaccaacaaagtaaacagtataatagacaaaatgaacactcagtttgaagcagtaggaagagaatttaacaacctagaaagaagaatagaaaacttaaacaaaaaaatggaagacggattcttagatgtatggacatataatgcagaattactcgtactaatggaaaacgaaagaactctagattttcatgattcaaacgtaaaaaacttatacgataaagtacgtttacaactaagagataacgcaaaagaactcggaaatggatgcttcgaattctatcacaaatgtgacaacgaatgtatggaaagcgttagaaatggaacatacgattacccacaatattcagaagaagcaagattaaaaagagaagaaatatcaggggtaaaactagaaagtataggtatataccaaatactatcaatatattcaacagtagccagctccctagcattagcactaatggtagcaggcctttcactatggatgtgttcaaacggatcattacaatgtcgcatatgtatt

SEQ ID NO: 51350 - RNA, 1737 nt, synthetic construct
  misc_feature 1..1737: note = derived and/or modified sequence opt6 from anti-influenza_Chain
  source 1..1737: mol_type = other RNA
atggttgtaacaagtaatgcagatagaatatgcacaggaataacatcatccaatagcccacacgtagttaagacagcgacccaaggtgaagtaaacgttacaggtgtgataccactcacaactactccaacaaaatctcatttcgctaatctaaaaggtacccaaacaagaggcaaactatgcccaaactgtcttaattgcacagatttggatgtagctctaggaagacctaaatgtatgggaacaataccatccgcgaaagcaagtatacttcatgaagttaaaccagtaacaagcggatgttttccaataatgcacgatagaacaaaaataagacagctacccaatcttcttagaggatatgaaaacatacgattatcagcaagaaacgtaataaacgcagaaacggcaccaggcggaccatacatcgtaggcacttcaggaagctgtccaaacgtcacaaacgggaaaggattctttgcaaccatggcttgggcagtacctaaaaacaaaaataaaacagcaacaaatccattaacagtcgaagttccatacatatgcactaaaggagaagaccaaataaccgtatggggatttcacagcgacaacgaagcacaaatggtaacattatatggagatagcaaaccacaaaaattcacttcatcagcaaacggtgtgacaacacattatgtatcgcaaattggaggtttcccaaaccagactgaagacgaaggacttcaacaatcaggaagaatagtcgtagactatatggtacaaaaacctggaaaaacgggtacaattgtataccaaagaggagttttacttccacaaaaagtatggtgtgcaagcgggagatcaaaagtaatcaaaggatcattaccactaataggagaagccgactgcttacatgaaaaatatggaggactcaataaatctaaaccatactataccggagaacatgcaaaagcaattggtaattgcccaatatgggtaaaaacccctctaaaacttgcaaacggaacaaaatatagaccaccagccaaattattaaaagaaagaggatttttcggagcaattgcaggatttctagaaggcgggtgggaaggcatgatagcaggatggcatggatatacatcccatggcgcacacggagtagcagttgcagcagatcttaaaagcacacaagaagccataaacaaaataactaaaaatctaaactcattgagtgaattagaagttaaaaatctacaaaggctatcaggagcaatggacgaattacataatgaaatattagaattagatgaaaaagtagatgacttaagagccgacacaatctcaagtcaaatagaactagcagtactactttcaaacgaaggaataataaatagtgaagacgaacacctactagcactcgaacgtaaacttaagaaaatgctaggaccatcagcagtagacataggaaatggctgtttcgaaacaaaacataagtgcaaccaaacatgcttagacagaattgcagcaggaacattcaacgcaggagaattttcattaccaaccttcgactcactaaatataacggcagccagtctaaatgacgacggtctagataaccatacaatactattatactatagtactgcagcaagctcacttgcagtaactctaatgatagctatcttcatagtatacatggtatctcgagataacgtatttctactacatctttctataagaaaa

SEQ ID NO: 51351 - RNA, 1737 nt, synthetic construct
  misc_feature 1..1737: note = derived and/or modified sequence opt6 from anti-influenza_Chain
  source 1..1737: mol_type = other RNA
atggtagtcactagcaatgccgacagaatatgcacaggcataactagctcaaatagtccccacgtagtaaaaaccgcgacacaaggagaagtaaatgtaactggagttataccgctaacaacaacgccaacaaaatctcactttgcaaatttaaaaggaactcaaaccagagggaaactttgtcctaattgtttaaattgtacagacctagacgtagcattgggaagacccaaatgcatgggaacaataccgagcgcaaaagcatccatactacacgaagtaaaaccggtcacatctggatgctttccaataatgcatgatagaacaaaaatcagacaactacctaacctcttacgaggatatgaaaatataagactatctgcccgaaatgtaatcaatgcagaaaccgccccaggaggaccatatatagtgggcacgtcaggatcatgcccaaatgttaccaacggaaaaggattctttgcaacaatggcatgggctgtacccaaaaataaaaataaaacagcaacaaacccactaactgtagaagtcccatacatatgcacaaaaggagaagatcaaataacagtatggggctttcatagtgataatgaagcccaaatggtaacactatacggagacagcaaaccacaaaaattcacctcctcagcaaatggagtaactacacactacgtatcacaaatcggaggattccccaaccaaacagaagatgaaggattacaacaaagtggtcgaatcgtagtagattacatggtacaaaaaccaggaaaaactggaactatagtataccaaagaggagtcctactcccgcaaaaagtatggtgtgctagtggacgtagtaaagtaatcaaaggatcacttccacttataggcgaagcagactgtttacacgagaaatatggaggacttaataaatcgaaaccatattatacaggagaacatgcaaaagcaataggcaactgtccaatttgggttaaaaccccactaaaactagcaaatggtactaaatataggcctccagccaaattactcaaagaacgaggtttctttggtgcaatagcgggatttttagaaggaggatgggaaggaatgatagctggctggcatgggtacacatcccacggagctcatggagtagcagtagcagctgatttaaaaagcacacaagaagccataaataaaatcacgaaaaatctaaatagtctttccgaactcgaagtcaaaaacttacaacgactatcaggagcaatggatgaactccacaacgaaatactagaattagatgaaaaagtagatgatttacgagcagacacaatttcttcccaaatagaattagcggtcttactatcaaacgaaggaataataaatagcgaagacgaacacttactagcactagaaagaaaactaaagaaaatgttaggtccaagtgcagtagatatcggaaacggatgttttgagacgaaacataaatgcaaccaaacttgtttggacagaatagcagccggaacatttaacgcaggcgaattttcattaccaaccttcgattcactcaacataacagccgccagcttaaatgatgatggactagataatcatactatattactatattattcaactgcagcgagctcccttgcagtaacattaatgatcgcaatatttattgtatatatggtatcaagagataacgtattcttattacacttaagtataagaaaa

SEQ ID NO: 51352 - RNA, 1731 nt, synthetic construct
  misc_feature 1..1731: note = derived and/or modified sequence opt6 from anti-influenza_Chain
  source 1..1731: mol_type = other RNA
atggaaaccatatcactaataacaatacttctagtagtaacagcaagcaatgccgataaaatctgcataggtcatcaatcaacaaactcaactgaaacggtagacacattaacagaaacaaacgttccagtaacacatgctaaagagctattacacacagaacataatggcatgctctgcgcaacatcgctaggacatccattaatacttgacacatgtacaatagaaggattagtatacggcaacccaagttgtgatttactattagggggcagagaatggagttatatagtagaaagatcatcagcagtaaatggaacttgttatccaggaaacgttgaaaatttagaagaattaagaactctcttctcatccgcatcatcatatcaacgaatacaaatatttccagatacaacttggaacgtaacatatacaggaacaagtagggcatgcagtggatcattctatagatcaatgagatggctaacccaaaaatcaggcttctatccagtacaagatgcccaatatacaaacaatagaggaaaaagtatattattcgtatggggaatacaccacccaccaacatacacagaacaaacaaatctatatataagaaatgatacaacaacatcagttactaccgaagacttaaacagaacatttaaaccagtaataggaccaagacctctcgtaaatggtctacaaggcagaatagattattattggtcagtcttaaaaccaggacaaacattaagagtaagaagtaacggaaacttaatcgctccctggtacggccacgtattatcaggaggatctcatggtagaatattaaaaacagacctgaaaggaggaaactgcgtagtgcaatgtcaaaccgaaaaaggaggattaaacagtacccttccctttcacaatatatccaaatatgcatttggaacttgtcctaaatacgtaagagtaaatagcctaaaactagccgtaggactgagaaatgtcccagctagatcctctagaggactatttggcgcaatcgcaggatttattgaaggaggatggccaggacttgtagcaggttggtacggatttcaacattcaaatgatcaaggagtaggaatggcagcagacagagatagcacacaaaaagccatagacaaaataacatcaaaagtaaacaacattgtagataaaatgaacaaacaatatgaaataatagatcatgagttcagcgaagtagaaacacgactaaacatgataaataacaaaatagatgaccaaattcaagatgtctgggcttacaatgctgaacttctagtactactagaaaaccagaaaacactggatgaacatgacgccaacgttaataatttatataataaagtaaaacgagcactaggaagtaacgccatggaagacggaaagggatgctttgaattatatcataaatgcgatgatcaatgcatggaaacaattcgaaatggaacctataacagaagaaaatacagagaagaaagcagactagaacgccagaaaatagaaggagtcaaactagaaagcgaaggcacatacaaaagcggaagactggtaccacgagggagtccaggaagtggatacatcccagaagctccaagagatggacaagcctacgtccgaaaggacggagaatgggtattattatccacctttctaggcaaaccaatacctaacccattattaggattagactcaacagga

SEQ ID NO: 51353 - RNA, 1731 nt, synthetic construct
  misc_feature 1..1731: note = derived and/or modified sequence opt6 from anti-influenza_Chain
  source 1..1731: mol_type = other RNA
atggaaacaataagtttaataacaatcttattagttgtaacagcaagtaatgcagataaaatctgtattggacatcaatcaacaaatagtacagaaaccgtagatacccttacagaaacaaatgtaccagtaacacacgcaaaagaactacttcatacagaacataacggcatgctatgcgcaaccagtctagggcatccattaatactagacacatgtacaattgaaggattagtatacggcaacccatcatgcgacttattactaggaggccgtgaatggtcatacatagttgaaagaagtagcgctgtaaatggaacctgttatccaggtaatgtagaaaacctagaagaattacgaacattattttcatcagcatcgagttatcaaagaatacaaatatttcccgataccacctggaatgtaacatacacaggaacatccagagcatgttcaggaagtttctatagatcaatgaggtggttaactcaaaaatcagggttctatccagttcaagacgcacaatatacaaataatcgaggaaaatcaatattattcgtatggggaatacatcacccaccaacctataccgaacaaaccaacttatatatacgcaacgatacaactacaagcgttaccacagaggacctaaatagaacatttaaacccgtaataggacccagaccactcgtaaacggtctacaaggaagaatagattactattggtctgtattaaaaccaggacaaacattaagagtaaggtcaaacggcaacctaatagcaccttggtacggtcacgtactaagtggaggaagtcatggacgaatattaaaaacagacttaaaaggaggaaattgcgtcgtacaatgccaaacagaaaaaggaggactaaattctactcttccttttcacaatatatcaaaatacgcatttggaacatgtcctaaatatgtcagagtaaactcactaaaactagctgtaggtctaaggaatgtaccagcaagatcctcaagaggactcttcggtgcaattgcaggatttatagaaggaggatggccaggtctagtagcaggatggtatggttttcaacatagtaatgaccaaggagtaggtatggctgcagatagagacagcacccaaaaagccatagataaaataacaagcaaagtcaataacatagtagacaaaatgaacaaacaatatgaaataatagatcatgagttcagtgaagttgaaacaagactaaatatgataaataacaaaatagacgatcaaatacaagacgtctgggcatataatgcagaattattagtactactagaaaatcaaaagacattagacgaacatgatgcaaacgtaaacaacctatataacaaagtaaaaagagccctaggaagtaatgctatggaagacggaaaaggttgttttgaactataccacaaatgcgacgaccaatgcatggaaaccataagaaatggtacatataacagaagaaaataccgagaagaatcaagattagaaagacaaaagatagaaggcgtaaaactagaaagtgagggaacctacaaatctggaagattagtaccaagaggatctcctggaagtggctatataccagaagcaccaagagacggtcaggcttacgtacgaaaagacggagaatgggtactattaagtacatttttaggaaaaccaataccaaacccattactaggattagactcaaccgga

SEQ ID NO: 51354 - RNA, 1752 nt, synthetic construct
  misc_feature 1..1752: note = derived and/or modified sequence opt6 from anti-influenza_Chain
  source 1..1752: mol_type = other RNA
atgaaagcaatcatagtactactaatggtagttacaagtaatgctgatagaatatgcacaggcataacatcctcaaattcaccacacgtagtcaaaacagcaacacaaggagaagtaaatgtaactggagtcataccattgacaaccactccaacaaaatctcactttgctaatttaaaaggaactcaaacaagaggaaaattatgcccaaactgttttaattgcacagacttagatgtagccttaggtagacctaaatgcatgggaaatacccctagcgcaaaagtaagcatattacatgaagtgaaaccggcgaccagtggatgttttccaatcatgcatgatagaacaaaaataagacaattaccaaaccttttacgaggttacgaaaatataagactgtcaacaagcaatgtaataaacacagaaacagctcctggtggaccatacaaagtaggaacatcaggaagctgcccaaatgtagcaaatggcaacggattcttcaacacaatggcgtgggtaataccaaaagacaacaataaaacagcaataaatccagtcacagtagaagtaccctacatatgctcagaaggagaagatcaaataacagtatggggattccatagtgacgataaaactcaaatggaacgactgtacggagattctaacccccaaaaattcacatcttccgccaatggagtaacaacacattacgtatcgcaaataggaggatttccaaatcaaacagaagatgaaggtcttaaacaaagcggaagaatagtagttgactatatggtacaaaaacccggaaaaacaggaaccatcgtctaccaacgaggtatattactcccacaaaaagtatggtgcgcatctggaagatctaaagtgataaaaggttctctacctctaattggagaagccgattgtttacacgaaaaatatggtggtttaaacaaatctaaaccatactacacaggagaacatgcaaaggcaataggaaactgcccaatatgggtaaaaacaccactaaaattagcaaacggaaccaaatacagaccaccagcaaaactattaaaagaacgaggattctttggagctattgctggatttctagaaggaggatgggaaggaatgatagcaggatggcatggctacacaagtcatggtgcacacggagtagcagtcgcagctgatttaaaatcaacacaagaggctataaataaaatcacgaaaaatctaaattatttatctgaactcgaagtcaaaaacttacaaagactatcaggtgcaatgaacgaattacacgatgaaatattagaactcgacgaaaaagttgatgacttgagagcagacacaatatcatctcaaatagaattagcagttttactcagtaatgaaggaataattaatagcgaagacgaacacctactagcattagaaagaaaattaaagaaaatgctaggtccatcagctgtagaaataggaaatggatgtttcgaaacaaaacataaatgcaatcaaacatgcttagatcgaatagcagcaggaacatttaatgccggtgatttttcattaccaacattcgactcactaaacatcacagcagcaagtctaaacgacgacggactagataatcatacaatattattatactatagcacagcagcaagttcattagcagttacgttaatgatagcaatatttattgtatatatggtatcaagagataatgtcagttgttcaatatgcttg

SEQ ID NO: 51355 - RNA, 1752 nt, synthetic construct
  misc_feature 1..1752: note = derived and/or modified sequence opt6 from anti-influenza_Chain
  source 1..1752: mol_type = other RNA
atgaaagctatcatagtattattaatggtagtaacctcaaatgccgaccgaatttgtacaggcattacatcaagtaattcaccccacgtggtaaaaacagcaacacaaggagaagtcaacgtaacaggagttataccattaacaacaaccccaacaaaatcatactttgcaaacttaaaaggaacaaaaacaagaggaaaactatgtcctgattgcctaaactgcactgatcttgacgtagcactaggaagaccaatgtgtgtaggaaccacacccagcgcaaaagcatccatattacatgaagtacgacctgttacatcaggctgctttccaataatgcatgacagaactaaaataagacaactagccaacctattaagaggctatgaaaacataagactaagcacccaaaatgtaatagatgcagaaaaagcaccaggtggaccatacaggttaggaactagcggaagttgtccaaatgcaacatcaaaatcaggtttcttcgcaacaatggcttgggctgtcccaaaagacaacaacaaaaatgcaacaaaccctctcacggtagaagtaccttatatatgcacagaaggagaagatcaaataacagtatggggattccacagtgatgacaaaacacaaatgaaaaacctatatggagactcaaacccacaaaaattcactagttccgcaaacggagtaacaacacactacgtttcacaaataggaggatttccagatcaaacagaagatggaggattacctcaaagcggacggatagtagtagactatatgatgcaaaaacctggcaaaactggaactatagtataccaaagaggagtattattaccacagaaagtatggtgcgcgagtgggagaagcaaagttataaaaggatcactaccactcataggagaagctgactgtttacatgaaaaatacggaggactcaacaaaagtaaaccatattacactggcgaacatgccaaagcaataggcaactgcccaatatgggtaaaaacaccactaaaactagcaaatggaaccaaatacagaccccctgccaaactattaaaagaacgaggattcttcggagcaatagccggatttttagagggaggatgggaaggaatgattgcaggatggcacggatatacatcccatggagcccacggggtagcagtcgcagcagacttaaaaagtacacaagaagcaattaacaaaataacaaaaaatcttaattccttgagtgaattagaagtaaaaaatctacaacgactaagtggagcaatggatgaactacataacgaaatactagaattagatgaaaaagtagacgatttaagagcagatacaataagttcacaaatagaattagcagtactattatcaaacgaaggaataattaatagcgaagatgaacaccttctagccttagaaagaaaattaaaaaaaatgctaggaccctcagcagtagacataggaaatggatgcttcgaaacaaaacacaaatgcaatcaaacatgcttagatagaatagcagcaggaacatttaacgcaggagaattcagcctaccaacctttgactcactaaacataacagcagcaagtctaaatgacgacggtcttgataaccacactatactactatattattcaacagctgctagctcactagcagtcacactcatgttagcaatattcatagtatatatggtatcaagagacaacgtatcatgctcaatatgtcta

SEQ ID NO: 51356 - RNA, 1752 nt, synthetic construct
  misc_feature 1..1752: note = derived and/or modified sequence opt6 from anti-influenza_Chain
  source 1..1752: mol_type = other RNA
atgaaagcaataatagtactgttaatggtagtaactagcaacgctgatcgaatctgcacaggaataacatcaagtaatagcccacatgtagtaaaaacagccacacaaggagaagtaaatgttacaggagtaataccactcacaacaacacctacaaaatcatacttcgcaaatttaaaaggcacaagaacaagaggaaaactttgcccggattgcctcaactgcacagatttagacgtagcactagggagaccaatgtgcgtaggaacgaccccaagtgcaaaagcaagtatcctacatgaagtaaaaccagtaacaagtggttgcttccccataatgcacgacagaacaaaaatacggcaattaccaaacctattaagaggatatgaaaacatacgactaagtacacaaaacgtaatagatgcagaaaaagcgccaggaggaccatatagattgggaacaagtggaagctgtcccaatgccacaagtaaaagcggtttctttgcaacaatggcatgggcggtacctaaagataacaacaaaaatgcaaccaacccattaacagtagaagtaccatatatctgcactgaaggagaagatcaaatcaccgtatggggttttcactccgatgataaaacccaaatgaaaaacctatatggagactcaaacccacaaaaattcacaagcagtgctaatggagtaactacccattatgtatcacaaataggatcatttccagaccaaacagaagatggaggattgcctcaaagtggcagaatagtagtagactacatgatgcaaaaacctggaaaaactggcacaatagtatatcaaagaggagtattactaccacaaaaagtatggtgtgcatcaggacgatcaaaagtaataaagggatcgctaccactaataggagaagctgattgtttacatgaaaaatacggcggtttaaacaaatcaaaaccttattatacaggagaacatgcaaaagccataggaaattgccctatatgggtaaaaacacctttaaaactagctaacggaacaaaatacagacccccagcaaaactattaaaagaaagaggattctttggagcaatcgcaggcttcttagaaggcggatgggaaggaatgatagcaggatggcatggatacacatcacacggagcacacggagtagcagtagcagcagatctcaaaagcacacaggaagcaataaataagatcactaaaaatctaaatagcttaagcgaattagaagttaaaaacttacaaagactatcaggagcaatggatgaattacacaatgaaatattagaacttgatgaaaaagtagatgaccttagagctgacacaataagttcacaaatagaactagcagttttactatctaatgaaggaattataaattctgaagacgaacacttacttgctttagaaagaaaattaaagaaaatgctaggaccttcagcagtagaaataggaaatggctgtttcgaaacaaaacataaatgcaatcaaacctgcctggacagaatcgcagcaggaacatttaacgccggtgaatttagcttacctacatttgatagcctaaacattacagcagcaagtctaaacgatgacggattagataatcacacaatattattatactatagtacggcagcgtcatcattagcggtcacactaatgctagcaatctttatcgtatacatggtatctcgcgataacgttagttgctccatatgttta

SEQ ID NO: 51357 - RNA, 1752 nt, synthetic construct
  misc_feature 1..1752: note = derived and/or modified sequence opt6 from anti-influenza_Chain
  source 1..1752: mol_type = other RNA
atgaaagcaataatcgtactcttaatggttgttacaagtaacgcagatagaatatgcacaggaataacctcatccaattctccacatgtagtaaaaacagcaacgcaaggcgaagtaaacgttactggagtaattccgctaacaacaacaccaacgaaatcacattttgcaaatttaaaaggcacacaaacaagaggaaaattatgcccaaactgttttaattgcacggacctagacgtcgcactaggacgaccaaaatgcatgggaaacacaccaagcgcgaaagtaagtatactacatgaagtaaaaccggccacatctggatgcttcccaataatgcacgatcgaacaaaaattagacaattaccaaacttactaagaggatacgaaaatataagactaagcacctcaaatgtaatcaacacagaaacagcaccaggaggaccatacaaagtaggaacaagcggtagttgcccaaatgtcgcaaacggtaacggtttctttaatacaatggcatgggtaataccaaaagacaacaataaaacagccataaatccagtaacagttgaagtaccatacatatgctctgaaggtgaagatcaaataactgtttggggatttcatagtgatgataaaacacaaatggaaagactatacggggacagtaacccacaaaaattcacaagctcagctaacggcgtaacaacacactacgtctctcaaataggtggatttccaaaccaaacagaagacgaaggcctaaaacaatcaggtagaatagtagtagattacatggtacaaaaaccaggaaaaactggcacaattgtatatcaaagaggtatattattaccgcaaaaagtatggtgcgcatcaggaagatcaaaagtaataaaaggatcattaccacttatcggtgaagcagattgcctacacgaaaaatatggaggtcttaataaatcaaaaccctattataccggcgaacatgcaaaagccataggaaattgtccaatctgggtaaaaacaccactcaaattagcaaatggaacaaaatacaggcccccagcaaaactattaaaagaaagaggtttctttggcgcaatcgcaggattcctagaaggaggatgggaaggtatgatagcaggctggcacggatatacgtcacatggagcacacggagtagcagtagcagcagatctaaaatcaacacaagaagcaattaacaaaataactaaaaatctaaattacttaagtgaactagaagttaaaaacttacaaagattaagcggagcaatgaatgaacttcatgatgaaatattagaattagatgaaaaagtagatgatttaagagcggacacaatatcaagtcaaatagagctagcagtattattatcaaacgaaggaataataaatagtgaggacgaacatctactcgcactagaacgaaaactaaagaaaatgctcggtccatcagcagtagaaataggaaatggatgctttgaaacaaaacataaatgcaatcaaacatgcctagacagaatagcagccggaacatttaacgcgggtgatttcagtttacccacattcgactcactaaacataacggcagcaagcctaaatgatgacggacttgataaccataccatactattatattacagtacagcagcaagctcattagcagttacactaatgatagcaatattcatcgtatacatggtatcgagagataatgtatcatgtagcatatgtttg

SEQ ID NO: 51358 - RNA, 1752 nt, synthetic construct
  misc_feature 1..1752: note = derived and/or modified sequence opt6 from anti-influenza_Chain
  source 1..1752: mol_type = other RNA
atgaaagccataattgttctattaatggtagtaacaagtaatgcagacagaatttgtacaggaataacatcaagcaatagtcctcacgttgtaaaaaccgcaacccaaggcgaagtaaacgtaacaggcgtaataccgctcactacaacgcctacaaaatcatacttcgcaaatctaaaaggaacaaaaactagaggtaaactatgcccagactgtcttaattgcacagacctagacgtagccttaggcaggcctatgtgcgtaggaacaacaccaagtgcgaaagcatcaatattacatgaagtaaggccggtaacttccggctgctttccaattatgcacgatagaacaaaaataagacaactagcaaatttactacgaggttacgaaaacataagactaagtacacaaaatgttattgatgctgaaaaagcacctggaggaccatatagattaggaacatctggcagttgtcccaatgcaacaagcaaatctggattcttcgcaacaatggcatgggcagtccccaaagataacaataaaaatgcaacgaatcctttgacagtagaagtaccatacatatgtacagaaggtgaagatcaaataacagtgtggggatttcatagtgacgataaaacccaaatgaaaaatctatacggagactcgaacccacagaaattcacatcctcagcaaatggagtaacaacccactatgtaagtcaaataggaggatttccagatcaaacagaagacggaggattaccacaatcaggacgtatcgtagtagattacatgatgcaaaaaccaggaaaaacaggcacaatcgtataccaaagaggagtcctactaccacaaaaagtatggtgtgcaagtggacgatcaaaagtaatcaaaggatctctaccacttattggagaagcagattgtctacatgaaaaatatggaggactaaacaaatcaaaaccatactatactggagaacacgctaaagctataggcaattgtccaatctgggtaaaaacaccacttaaactagcgaacggaacaaaatacaggcccccagcaaaattactaaaagaacgaggattcttcggagcaatagcaggatttcttgaaggaggatgggaaggaatgatagcaggctggcatggatatacaagtcatggagcacacggagttgccgtcgcagcagatctaaaaagcacccaggaagcaataaacaaaatcacaaaaaatctcaacagtctaagtgaactcgaagttaaaaatctacaaagattatcaggagcaatggatgaattacacaatgaaatattagagttagatgaaaaagtagatgacttaagagcagacactattagctcccaaattgaactcgcagtattactatctaacgaaggaataataaactcagaagacgaacatttactagcacttgaaagaaaactaaaaaaaatgctcggtccatcagccgtagacataggaaatggatgtttcgaaacaaaacacaaatgtaatcaaacatgcttagatagaatcgcagccggaacctttaacgcaggagaattttcgttaccaacctttgactcactcaacataaccgcagcaagtctaaatgatgacggactagataatcatacaattcttctatactatagtacggcagctagttcgctagcagtaacattaatgctagccatatttatagtatatatggtctcaagagataatgtatcctgtagcatatgctta

SEQ ID NO: 51359 - RNA, 1752 nt, synthetic construct
  misc_feature 1..1752: note = derived and/or modified sequence opt6 from anti-influenza_Chain
  source 1..1752: mol_type = other RNA
atgaaagctataatcgtattattaatggtagtcactagcaatgccgacagaatatgcacaggaataacatctagcaattcaccacacgtagtaaaaacagctacacaaggagaagtaaatgtcacaggagtaatcccactcacaacaacacccactaaatcatacttcgcaaatctaaaaggaacaagaacacgtggaaaattatgccctgattgcttaaattgcactgatcttgatgtcgcactaggtagacctatgtgcgtaggtaccacaccttcagcaaaagcatcaatattacatgaagtaaaaccagtcacaagcggatgtttcccaataatgcacgacagaaccaaaattagacaactgccaaatttattaagaggatatgaaaatattcgattaagcacacaaaacgttatagacgctgaaaaagcaccaggaggcccatatagactaggcacaagtggaagctgtccaaatgcaacatcaaaaagtggcttttttgcaacaatggcatgggccgtacccaaagacaataataaaaatgctacaaacccgttaacagttgaagtaccatacatatgcactgaaggtgaagatcaaattacagtatggggatttcacagcgatgataaaactcaaatgaaaaacctatacggtgattcaaacccgcaaaaattcacgagttcagctaatggagtaaccacacactacgtatcacaaataggatcattcccggatcaaacagaagacggaggattaccacagagcggcagaatagtagtagattacatgatgcaaaaaccaggtaaaacaggaacaatcgtgtaccaaagaggagtactactaccacaaaaagtatggtgcgcaagtggaagatcaaaagtgataaaaggatcactaccattaataggagaagcagattgcctacatgaaaaatatggcggactaaataaaagtaaaccttactatacaggagaacatgcaaaagcaataggaaattgcccaatctgggtcaaaacacccctaaaactagcaaacggaaccaaatatagacccccagcaaaattgctgaaagaaagaggattttttggagcgatagcgggcttcctagaaggaggatgggaaggaatgatagctggttggcacggctacacatcacatggagcacatggagtagccgttgcagcagatctaaaaagtacacaagaagcaataaacaaaataacaaaaaatttaaattcattaagtgaactagaagtaaaaaacttacaaagactatcaggagctatggacgaactacataatgaaatactagaactagacgaaaaagtagacgacctaagagcagatacaataagcagccaaatcgaactagcagtactattatccaatgaaggaattattaatagcgaagacgaacatctcttagcactagagcgaaaactaaaaaaaatgctaggaccatctgcggtagaaataggtaatggatgctttgaaacaaaacataaatgcaatcaaacatgcctagaccgaatcgcagcaggtacatttaacgcgggagaattctcattaccgacttttgactcattaaatataactgcagcaagcctaaatgacgacggattagataaccatacaatactactatactactccacagctgcaagttcactagcggtaacactaatgttagcgatattcatagtatacatggtatctagagacaatgtctcctgcagcatttgttta

SEQ ID NO: 51360 - RNA, 1758 nt, synthetic construct
  misc_feature 1..1758: note = derived and/or modified sequence opt6 from anti-influenza_Chain
  source 1..1758: mol_type = other RNA
atgaaagctataatagtactactaatggtagtcacttctaacgcagatagaataatatgtacagggataacaagcagtaacagtccacacgtagtaaaaacagccactcaaggtgaagtaaacgttaccggggtaataccattgacaacaaccccaactaaaagccatttcgcaaacttaaaaggtacagaaacacgaggcaaactatgcccaaaatgtttaaactgtacagacttagacgtcgctttaggaagaccaaaatgcactggcaacattccatcagcaagagtgtctatattacacgaagtaagaccagtaacatcaggctgtttcccaatcatgcacgatcgcacaaaaatacgacaactaccaaatctccttagaggatatgaacacataaggctgagcactcataacgtaattaacgcagaaaatgcacccggaggaccttataaaataggaacatcaggaagctgcccaaatgtgacgaatggcaatggattcttcgctaccatggcatgggcagtacctaaaaacgataacaataaaacagctacaaactcccttacaatcgaagtaccatatatatgcacagaaggagaagatcaaataacagtctggggatttcacagcgataatgaaacacaaatggcaaaattatacggtgactcaaaaccacaaaaatttacaagttccgcaaatggagttacaactcattacgtatcacaaataggaggattccctaatcaaacagaagacggaggattaccacagtccggacgaattgtagtagactatatggtacaaaaatcaggcaaaacaggaacaataacttaccaaagaggaatattattacctcaaaaagtatggtgcgcttcaggcagatcaaaagtaataaaaggatcactcccactaataggagaagcagattgcttacacgaaaaatatggcggattaaacaaatcaaaaccatattatactggagaacatgccaaagctataggcaattgccctatatgggtaaaaacacctttaaaattggcaaacggaactaagtacagaccaccagccaaattattaaaagaacgcggatttttcggcgcaatagcaggctttctagaaggaggttgggaaggaatgatagcaggatggcacggatatacaagtcacggagcccacggagtagcagtagctgcagatttaaaaagtacacaagaagcaattaataaaataactaaaaatctaaatagtctatcagaactagaagtcaaaaatctacaaagattatcaggagcaatggatgaactacataatgaaatattagaactagacgaaaaagtcgatgaccttagagctgatactatatcaagccaaatagaattagcagttttactatcaaacgaaggaataataaatagcgaagacgaacacttactagcactcgaaagaaaactaaagaaaatgttaggccctagcgcagtcgaaataggaaatggttgcttcgaaacaaaacataaatgtaatcaaacttgcctagatagaatagctgccggaacatttgacgcaggagagttcagtttaccaacatttgactctctaaatataacagcggcatcattaaacgatgacggattagataaccatacaatcttactatattattcaacagcagcaagttcattagctgtcacacttatgatagcaatatttgtcgtttacatggtaagtagagataacgtatcctgttccatatgctta

SEQ ID NO: 51361 - RNA, 1758 nt, synthetic construct
  misc_feature 1..1758: note = derived and/or modified sequence opt6 from anti-influenza_Chain
  source 1..1758: mol_type = other RNA
atgaaagccataatagtactactaatggtggtaacaagtaatgccgacagaattatttgtacaggaataaccagttcaaactcaccacacgtagtgaaaacagctacacaaggagaagtaaatgtaacaggagtaataccactaacaacaacaccaacaaaaagtcacttcgcaaatctcaaaggaacagaaacacgaggaaaactatgtcctaaatgtttaaactgcaccgaccttgatgtagcgctaggaagacccaaatgcaccggaaacataccttccgcacgagtatccatattacacgaagttagaccagttacatcgggttgttttcccattatgcacgacagaacaaaaataagacaactaccaaatctactcagaggctacgaacacatacgtctatcgacacataatgtcataaacgcagaaaacgcaccagggggaccatacaaaatcggaacatctggatcatgcccaaatgtaacaaatggaaatggattctttgcaaccatggcatgggcagtacctaaaaacgacaacaataaaactgctacaaattcactcacaatcgaagttccatatatatgtacagaaggtgaagatcaaataactgtctggggatttcacagtgataacgaaactcaaatggcaaaattatatggtgattctaaaccacaaaaatttactagctctgcaaatggagtaacaacccactatgtaagtcaaattggcggatttccaaatcaaacagaagacggtggtttaccacaatcaggacgaatagtagtagattacatggtacaaaaatcaggaaaaaccggcacaatcacataccaaagagggatactattaccccaaaaagtctggtgtgcaagtggaagaagcaaagtaataaaaggatctttaccactaataggagaagcagactgcttgcacgagaaatacggaggactaaataaatctaaaccatactacaccggagaacatgccaaagccataggaaactgcccaatctgggtaaaaacaccactcaaactagcaaacggaaccaaatacagacctccagcaaaactcctaaaagaaagaggattctttggagcaatcgcaggtttcctagaaggaggatgggaaggaatgatagcaggatggcatggatacacatctcatggagcacacggagtagcagtagcagcagatctaaaatcaactcaagaagcaataaacaaaataactaaaaatctaaacagtttaagcgaacttgaagtcaaaaatttacaaagattatcaggagcaatggacgaactgcataacgaaatattagaattagatgaaaaagtagatgaccttagagcagacacaatatcaagccaaatagaactagcagtattattatcaaacgaaggcataattaatagtgaagacgaacacttattagcactagaaagaaaactcaagaaaatgctaggcccttcagctgtcgaaataggaaacggatgttttgaaaccaaacacaaatgcaatcaaacatgcttagacaggatagccgcaggaacctttgacgctggagagttttctcttccaacatttgatagtctaaatataacagcagcaagccttaacgatgacggactagataaccataccatattactatattacagcacagcggcaagtagtcttgcagtaaccctaatgatagctatttttgtagtatatatggtaagcagagacaacgtaagctgtagcatatgctta

SEQ ID NO: 51362 - RNA, 1749 nt, synthetic construct
  misc_feature 1..1749: note = derived and/or modified sequence opt6 from anti-influenza_Chain
  source 1..1749: mol_type = other RNA
atggaagcaagattactagtattattatgtgcatttgcagccacaaatgcagacactatatgcataggatatcatgcaaataactccacagatacagtagataccgtattagaaaaaaatgtaacagtaacacattccgtaaatttgctagaagactcacataacggaaaactctgtaaattaaaaggaatagcaccattacaattgggaaaatgcaatatagcgggatggctattaggaaatccagaatgcgatctattactcacagcttcaagctggagctatatagtggaaacatccaacagcgaaaacggaacatgttatccaggcgactttatagattatgaagaacttagagaacaactctctagcgtaagctcattcgaaaaatttgaaatatttccaaaaacgtcatcatggccaaatcacgaaacaacaaaaggtgtaactgcagcatgctcatatgcaggagcatcatccttttacagaaacctattatggttaacaaaaaaagggtcatcatatccaaaattatctaaatcatacgtaaataataaaggaaaagaagtattagtactctggggagtacatcatccacccacgggcacagaccaacaatcactataccaaaatgctgatgcttatgtaagtgtaggctcatctaaatataaccgaagattcacaccagaaattgctgcacgtccgaaagtacgagatcaagcaggacgaatgaattattactggacactcctggaaccgggagacaccatcacatttgaagctacgggaaacttaattgcaccatggtacgcatttgcattaaaccgaggaagcggaagcggaataataacctccgacgcaccagtacacgattgcaataccaaatgccaaacaccacacggagcaatcaattcaagcttgccttttcagaatatccacccagtaacaataggagaatgtccaaaatacgtcaggagtacaaaattaagaatggccactggcttaagaaatataccaagcatacaaagtcgcggattattcggagcaatagctggatttatagaaggaggatggacaggaatgattgatggctggtacggatatcatcaccaaaacgagcaagggagtggatacgcagcagatcaaaaaagtacacaaaacgcaattgacggaatcacaaacaaagtgaattcagtaatagaaaaaatgaatactcaattcacagcagtcggaaaagaattcaataacctagaaagaagaatagaaaatttaaacaaaaaagttgatgacggattcctagacatttggacttataatgccgagcttttagtgttactagaaaacgaacgtacgctcgatttccatgattcgaatgtacgaaacctttacgaaaaagtaaaatcacaactaaaaaacaacgcaaaagaaataggaaatggatgtttcgaattctatcataaatgtgatgacgcatgtatggaatccgtaagaaatggaacatatgattatcctaaatattcagaagaatcaaaattaaatagagaagaaatcgatggagtaaaattagaaagtatgggtgtataccaatcaggaagactagtaccaagaggatcaccaggatcaggatatatacctgaagctcctagagacggacaagcttacgtgagaaaagacggagaatgggtattactatcaacatttcttggaaaacccataccgaatcctctccttggattagattcaactgga

SEQ ID NO: 51363 - RNA, 1749 nt, synthetic construct
  misc_feature 1..1749: note = derived and/or modified sequence opt6 from anti-influenza_Chain
  source 1..1749: mol_type = other RNA
atggaagcacgattactagtactactctgtgcattcgcagcaacaaatgcagacacaatatgtatcggataccacgcaaataattctacagataccgtagataccgtattagaaaaaaacgtaacagtaacacatagcgtaaaccttctagaagatagtcacaacggaaaactatgtaaactgaaaggaatagcaccattacaattaggaaaatgcaacatagcaggatggttattaggaaaccctgaatgcgatttactactaacagctagttcatggagctatatcgtagaaacatcaaattcggaaaatggtacatgttatccaggcgacttcatagattatgaagaactaagagaacaattatcaagcgtatcatcatttgaaaaatttgaaattttcccaaaaacatcatcatggccaaaccatgaaactacaaaaggtgtaacagccgcctgttcatacgcaggcgcatcatcattttacagaaacctcttatggttaactaaaaaaggaagcagctacccaaaattatcaaaaagttacgtaaataacaaaggaaaagaagtactagtattatggggcgtccatcatccaccaacaggaaccgatcaacaatcactataccaaaatgcagatgcctatgtttcagtaggatcttcaaaatataacagacgatttactcctgagatagccgcacgtccaaaagtaagggatcaagcaggtagaatgaactactattggacattacttgaacctggagacaccataacatttgaagctaccggaaacttaatagcaccatggtatgctttcgcattaaacagaggcagcggaagtggaattataacatcagatgcaccagtgcacgattgcaatacaaaatgtcaaacacctcacggagccataaactcatctcttccattccaaaacatacatcccgtaacaataggtgaatgtccaaaatatgtcaggtccacaaaattaagaatggcaacaggcttaagaaatattccatcgattcaatcaaggggactattcggagcaatagcaggatttatagaaggtgggtggaccggtatgatagatggatggtacggctaccaccatcaaaacgaacaaggaagcggatatgcagccgatcaaaaatcaacacaaaatgctatagatggaataaccaacaaagtaaattcagtaatagaaaaaatgaatacacaatttaccgctgtaggaaaagaattcaataatttagaaagaagaatagaaaaccttaacaaaaaagtagatgatggatttctagacatatggacatacaacgcagaactactagtattactagaaaatgaaagaacattagattttcatgactcaaacgttcgaaacctatatgaaaaagtaaaaagtcaactaaaaaataatgcaaaagaaattggaaatggttgctttgaattttatcacaaatgcgatgatgcatgtatggaaagtgtaagaaatggaacatatgactaccccaaatattcagaagaaagtaaactaaatagagaagaaatagatggagtgaaattagaaagtatgggagtatatcaaagtggtagactcgtaccaagaggcagtcctggatcagggtatatacctgaagcaccaagggacggacaagcatatgtcagaaaagacggtgaatgggtactcctatcaacattcttaggaaaaccaataccaaacccactactaggacttgacagtaccgga

SEQ ID NO: 51364 - RNA, 1755 nt, synthetic construct
  misc_feature 1..1755: note = derived and/or modified sequence opt6 from anti-influenza_Chain
  source 1..1755: mol_type = other RNA
atggaaagaacagtactactactagcaaccgtaagtcttgtaaaatcagatcaaatttgtataggataccatgcaaataactcaacagaacaagtagacacaataatggaaaaaaacgtaaccgttacacatgcccaagatatactcgagagaacacacaatggtaaactatgtgacctaaacggagttaaaccactaatattaagagactgttcagtcgcaggatggctattaggaaatccaatgtgcgatgaattcataaatgtaccagaatggagctacatagtggaaaaagcatcaccagcaaatgatctatgttacccaggcaacttcaacgactacgaagaattaaaacacctactatcaagaataaatcatttcgaaaaaatacaaataatccctaaatcatcatggagcaatcatgatgccagtagtggagtatcttcagcctgcccatacttaggaagatcatcattcttcaggaatgtcgtatggttaataaaaaaaaactcggcctacccaaccataaaaaggagttacaataacacaaatcaagaagatttattagttttatggggagtccatcacccaaatgatgcagcagaacaaaccaaactataccaaaacccaactacctacataagtgtaggaacaagtacattaaatcaaagactagtacccgaaatcgcaacacgcccaaaggtaaatggacaatcaggtcgaatggaatttttctggacaatattaaaaccaaatgatgctattaatttcgaaagcaatggaaacttcatagcaccagaatacgcatataaaatagttaaaaaaggagacagtacaataatgaaatcagaattagaatatggaaactgtaacacaaaatgtcaaacacctatgggcgcaataaactcatcaatgccattccataacatacacccacttacaatcggagaatgtccaaaatatgtaaaatcaaacagattagtactcgctacaggactcagaaatacaccacaaagagaaaggagaaggaaaaaaagaggattattcggagccatcgcaggattcatagaaggaggctggcaaggcatggttgacggatggtatggatatcatcacagcaatgaacaaggaagttgttactctgcagacaaagaaagtacacaaaaagcaatagatggagttaccaataaagtaaatagtatcataaataaaatgaatacacagtttgaagcagtaggaagggagttcaataacttagaaagaagaatagaaaacctaaataaaaaaatggaagacggattcctcgacgtatggacttataatgcagaactactagtactaatggaaaacgaaagaacactagactttcacgacagcaacgtaaaaaacctatacgataaagtaagactccaactcagagacaacgcaaaggaattaggaaacggttgcttcgaattctaccacaaatgtgataatgaatgcatggaatcagtgaaaaatggaacatacgactacccgcaatactctgaagaagcaagactaaacagagaagaaatatcaggagttaaattagaaagtatgggaacataccaatcaggacgactagttccaagaggatcaccaggaagtggatatattccagaagcgcctagagatggacaagcatatgtaagaaaagatggtgaatgggtcttacttagtacattcttaggaaaaccaataccaaacccactcctaggactagactcaacagga

SEQ ID NO: 51365 - RNA, 1755 nt, synthetic construct
  misc_feature 1..1755: note = derived and/or modified sequence opt6 from anti-influenza_Chain
  source 1..1755: mol_type = other RNA
atggaaagaacagtactactacttgcaacagtatcactagtaaaaagcgatcaaatatgcataggataccacgcaaataatagtacagagcaagtagacacaataatggaaaaaaacgtaacagttacacatgcccaagatatattagaaagaacacataacggaaaattatgcgatttaaacggagtaaaaccactcatactaagagactgctcagtagcaggatggctattaggaaatccaatgtgcgacgaatttataaacgtaccagaatggtcatacatagtagaaaaagcaagccccgcaaatgatctatgctacccaggaaactttaacgactacgaagaacttaaacacctattatcccgaataaaccacttcgaaaaaatacaaataataccaaaatcaagctggtcaaaccacgatgccagctcaggtgtatcctcagcctgcccatatttaggaagatcaagctttttcagaaacgtagtatggttaatcaaaaaaaactccgcatatccaacaataaaaagaagctacaacaatacaaatcaagaagatctactcgtactatggggagtacaccacccaaatgacgctgcagaacaaaccaaactataccaaaatcccactacatacatttcagtaggaaccagcacactaaaccaaagactagtacctgaaatagcaactagaccaaaagtcaacggccaatcagggagaatggaatttttttggacaatactaaaaccaaatgatgcaataaactttgaaagcaacggaaactttatagccccagaatacgcatacaaaatcgtaaaaaaaggagacagtactataatgaagagtgaattagaatacggaaactgcaacacaaaatgtcaaacaccaatgggtgcaataaattccagtatgccattccacaatatacatcccttaacaataggtgaatgtccaaaatatgtaaaatcaaatagattagtgttagcaacaggattacgaaacacaccacaaagagaaagaagaagaaaaaaaagaggactatttggagcaattgcaggattcatagaaggcggatggcaaggaatggtagacggatggtatggataccaccattccaacgaacaaggatcatgctattccgcagacaaagaaagtacccaaaaagcaatagatggcgttacaaacaaagtaaattcaataattaacaaaatgaacacacaattcgaagcagtgggcagagaatttaacaatttagaacgacgcattgaaaacctaaacaaaaaaatggaagacggattcttagacgtctggacatataacgcagaactactagtactaatggaaaacgaaaggactctagattttcacgactcaaatgtgaaaaacctatatgacaaagtaagactacaactaagggataatgcaaaagaattaggaaatggctgtttcgaattttaccataaatgcgataacgaatgcatggaaagcgtaaaaaatggcacctacgactatcctcaatacagcgaagaagcaagactgaacagagaagaaatatcaggcgtaaaactggaaagcatgggaacatatcaatcaggaagactcgtaccaaggggttcaccaggttcaggatacataccagaagcgccaagagatggccaagcatacgtcagaaaagacggagaatgggtcctactaagtacattcttaggcaaaccaataccaaatccgctactaggtttagacagtactgga

SEQ ID NO: 51366 - RNA, 1947 nt, synthetic construct
  misc_feature 1..1947: note = derived and/or modified sequence opt6 from anti-influenza_Chain
  source 1..1947: mol_type = other RNA
atgggggacaaaataaattttattttcggtattcataaccatcaaccattaggaaattttggatgggtatttgaagaagcatatgaaaaatgttactggccatttttagaaacattagaagaatatccgaatatgaaagtagcaatccatacaagtggacctctaatagaatggttgcaagacaatagaccagaatatatagacttattaagatcattagtaaaaagaggacaagtagaaatagtagtagcaggattttatgaaccagtattagcaagtatacctaaagaagatagaattgaacaaataagacttatgaaagaatgggccaaaagtattggattcgatgcacgaggagtatggttaacagaaagagtctggcaaccagaattggtaaaaacattaaaagaaagtggaatagattatgtgatagttgatgattaccattttatgtcagcaggacttagcaaagaagaactttattggccatactacacagaagacggaggagaggtaatagcagtatttccaatagacgagaaattaagatacttaataccatttagaccagtagacaaagtattggaatatctacacagtttaatagatggagatgaatcaaaagtagcagttttccacgatgatggagaaaaatttggaatatggccaggaacctatgaatgggtgtacgaaaaaggatggctaagggaatttttcgataggatcagctcagatgaaaagataaatctcatgctttacacagaatacctagaaaaatataaaccaagaggacttgtttacttacctatagcatcatacttcgaaatgtcggaatggtccttacctgcgaaacaagcgcggctttttgtagaatttgtaaatgaattaaaagtaaaaggaatattcgaaaaatatcgcgtattcgtaagaggaggaatttggaaaaatttcttttataaatatccagagtccaattacatgcacaaaagaatgttaatggtatctaaattagtaagaaacaatcccgaagcaagaaaatatttattaagagcacaatgtaatgatgcttattggcacggattatttggaggagtatacctaccacatttaagacgagcaatatggaataacctaataaaagcaaattcctatgtaagcctaggaaaagtaataagagatatagactatgatgggtttgaagaagtactaatagaaaacgataacttttatgctgtttttaaaccaagctacggagggagtctagtcgagtttagctctaaaaatagattagtaaattacgttgatgttctagccagaagatgggaacattatcacggttatgtagaaagccaattcgacggtgtagccagcatacatgaactagaaaagaaaattccagatgaaataagaaaagaagttgcatatgataaatatagaagatttatgttacaagaccatgtagtaccactaggaactacattagaagactttatgtttagtagacaacaagaaataggtgaatttcctcgagtaccatattcctatgaattactagatggaggaatccgactaaaaagagaacatctaggaatagaagtagagaaaaccgtgaaattagttaatgatggatttgaagtagaatacatagtaaataataaaaccggaaatccagtgctatttgcagtcgaattaaatgtagcagtccaaagcataatggaatcaccaggagtactaagaggaaaagaaatagtagtagacgataaatacgcagtaggcaaatttgcactcaaatttgaagatgaaatggaagtatggaaatacccagtcaaaaccctttcacaatcagaaagtggatgggatttaatacaacaaggagtatcatacatagttccaataagactagaagataaaataagatttaaattgaaatttgaagaagcaagtgga

SEQ ID NO: 51367 - RNA, 1947 nt, synthetic construct
  misc_feature 1..1947: note = derived and/or modified sequence opt6 from anti-influenza_Chain
  source 1..1947: mol_type = other RNA
atgtccagaatgacactaaaaagcagtatgaaaaaaagagtactgagtttactaatcgcagtagtattcttaagtctaacaggagtattcccttcaggactgatcgaaacaaaagtcagcgcagccaaaataacagaaaattaccaattcgatagtagaatcagattaaactcaattggttttataccaaaccatagtaaaaaagccacaatagcagcaaattgctcaacattctacgttgtaaaagaagatggaacaatagtatatacaggaaccgcaacaagtatgtttgacaacgacactaaagaaaccgtgtatatagcagatttctcatcagtaaacgaagaaggaacatattacttagcagtacctggagtaggaaaaagcgtcaatttcaaaattgctatgaatgtgtacgaagatgcatttaaaaccgcaatgctaggaatgtatttactacgttgtggaacatcagtatcagcaacctataatggtatccactacagtcacggaccatgtcatacaaatgatgcatatctagactatataaatggacaacatacaaaaaaagactcaacaaaaggctggcatgacgctggcgattataacaaatatgtagtaaacgcaggaataaccgtaggatctatgttcttagcctgggaacactttaaagatcaattagaacctgttgccttagaaataccagaaaaaaataatagcataccagactttttagatgagttaaaatatgaaatagactggatattaacaatgcaatacccagacggttcaggaagagtagctcataaagtatcaacaagaaatttcgggggatttataatgcctgaaaatgaacatgatgaacgattctttgtaccatggtcaagcgcagcaacagcagatttcgtagccatgacagctatggcagcaagaatatttagaccttatgacccacaatatgcagaaaaatgtattaacgcagcaaaagtatcatacgaattcctaaaaaacaaccctgcaaatgtctttgcaaatcagtcaggcttcagcacaggagaatatgctactgtatcagatgctgatgacagattatgggctgcagcagaaatgtgggaaactctaggggatgaagaatatttacgcgacttcgaaaatagagctgcccagttctcaaaaaaaatcgaagctgattttgactgggataacgttgccaatctaggtatgttcacatatctactaagtgaaagaccaggaaaaaaccctgctctagtacaaagcataaaagattcactattatccacagccgactcaatagtaagaactagtcaaaaccatggatatggaagaacactaggaacgacatactattggggatgtaatggtacagtagtacgacaaacaatgatactacaagtagcaaataaaatatcaccaaataatgattacgtaaatgctgcattagatgcaataagtcacgtttttggaagaaattactataatagatcatatgtaacaggactcggaataaatccaccaatgaacccacacgatagaagaagcggtgcagatggaatatgggaaccatggccaggatatctggtaggcggtggatggcctggaccaaaagactgggtagacatacaagatagttaccaaacaaatgaaattgcaataaattggaatgctgcactaatttatgcattagcaggctttgtcaattacaatagcccacaaaatgaagtattatacggagatgtaaatgacgatggcaaagtaaacagcactgatctaaccctactaaaaagatacgtattaaaagccgtctcaacgttaccatcaagtaaagcagaaaaaaatgctgatgttaaccgagatggaagagtcaattcaagtgatgtaacaatactatcaagatatttaattagagttattgaaaaactacccata

SEQ ID NO: 51368 - RNA, 1947 nt, synthetic construct
  misc_feature 1..1947: note = derived and/or modified sequence opt6 from anti-influenza_Chain
  source 1..1947: mol_type = other RNA
atgggagataaaataaattttatattcggaatacataaccaccagccattaggaaactttggatgggtatttgaagaagcctacgaaaagtgttactggccttttcttgaaacactagaagaatatcctaatatgaaagtagcaattcacacaagcggaccactcatagaatggttacaagacaatcgaccagaatatatagatttattaagatcattagttaaaagaggacaggtggagattgtagtagcaggattttatgaaccagtgttagcatcaatacctaaagaagacagaatagaacagataagattaatgaaagaatgggctaaaagtataggatttgatgcaagaggagtatggcttacagaaagggtatggcaaccagagctagtaaaaacattaaaagaaagtggaatcgattacgtaatagtagacgactaccactttatgtcagccggactaagcaaagaagaactttattggccatactacacagaagacggaggagaagtaatagcagtatttccaatagatgaaaaattaagatatctaataccatttcgaccagtagataaggtactagaatacttacattcattaatagatggtgatgaatcaaaagttgctgtgtttcacgacgatggagaaaaattcggtatatggccaggaacatatgaatgggtatatgaaaaaggatggcttagagagttcttcgacaggatatcaagtgatgagaaaataaatttaatgttatatacagaatatctagaaaaatataaacccagaggattagtatacttaccaatagcgagctactttgaaatgagtgaatggagtctaccagctaaacaagcaagactgtttgtagagttcgtaaacgaattgaaagtaaaaggcatattcgaaaaatatagggtgttcgtccgagggggaatatggaaaaactttttctacaaataccctgaaagtaattacatgcataaaaggatgttaatggtaagcaaactcgtaaggaataatccagaagcgagaaaatacctactaagagcacaatgcaatgacgcatattggcatggattatttggaggagtatatttacctcatctaaggagagcaatatggaataatttaataaaagcaaatagttatgtcagtctaggtaaggtaataagagatatagattacgatggatttgaagaagtgttaatagaaaatgacaatttttacgcagtattcaaaccatcatatggaggatctttagtggagttcagtagtaaaaacagattagttaactacgttgatgtcttagcaagaagatgggaacactaccatgggtatgtagaaagtcaattcgatggagtagcaagcatacacgaattagaaaagaaaatacccgatgaaataagaaaagaagtagcatatgataaatacagaaggtttatgttacaagatcatgtagtaccactaggaactacactagaagattttatgttcagcagacaacaagaaataggagagttcccaagggtaccctattcatatgaattactcgatggaggaataaggttaaaaagagaacacctaggaatagaagtagagaaaacagtaaagctagttaacgatggctttgaagtggaatacatagttaataataaaacaggaaatccagtattatttgcagtagaattaaacgtggcagtacaaagcatcatggaaagtccaggagtattgagaggaaaagaaatagtggtagatgataaatacgcagtaggcaaatttgctttaaaattcgaagacgaaatggaagtctggaaataccctgtaaaaacactgtctcaatcagaaagcggatgggatttaatacaacaaggagtaagctatatagtaccgataagactagaagataaaattaggttcaaactaaaattcgaagaggcaagtgga

SEQ ID NO: 51369 - RNA, 1947 nt, synthetic construct
  misc_feature 1..1947: note = derived and/or modified sequence opt6 from anti-influenza_Chain
  source 1..1947: mol_type = other RNA
atgagtcgaatgacactaaaatcatctatgaaaaaaagagtattaagtctactaatagccgtagtattcctatcactaacaggcgtatttccatcaggcttaatagaaaccaaggtctcagcagcaaaaataacagaaaactaccaatttgattcaagaataaggttgaatagtataggatttatcccaaaccacagcaaaaaagcaacaatagccgctaactgctcaactttctatgtagtcaaagaagatggtaccatagtatatactggtactgcaacatctatgttcgataatgacacaaaagaaaccgtatacatagccgacttcagctcagtaaatgaagaaggaacatactatctagcagtaccaggagttggcaaatcagtaaactttaaaatagccatgaatgtatatgaagacgcatttaaaacagcaatgctcggaatgtacttattaagatgtggaacttcagtttcagcaacatacaacgggatccattactcacacggaccatgtcatacaaacgatgcatatcttgactacataaacggccaacacacaaaaaaagatagcactaaaggatggcacgacgctggagattataacaaatatgtcgtaaacgctggaataacagtaggcagtatgtttctagcctgggaacactttaaagaccaattagaacctgttgctttagaaatacccgaaaaaaacaactcaataccagatttcttggacgaactaaaatatgaaatagattggatattaacaatgcaataccctgacggaagcggaagggttgcacacaaagtctctacaagaaactttggaggattcattatgccagaaaatgaacatgacgaaagattctttgtaccatggagttcagcagccacagcagatttcgtagcaatgacagcaatggcagcaagaatctttagaccatatgatccacaatatgcagaaaaatgcataaacgctgcaaaagtaagctacgaatttctaaaaaataatccagcaaacgtattcgcaaatcaatcaggtttttcaacaggtgaatacgcaacagtatcagatgcagatgatagactatgggcagcagctgaaatgtgggaaacccttggtgacgaagaatatttgagagacttcgagaacagagctgcccaattttccaaaaaaatagaagcagattttgattgggataatgttgcaaacttaggaatgtttacatacctactaagtgaaaggccaggtaaaaacccagcactcgtccaatctataaaagactcactactttcaactgctgactcaattgtacgaacaagccaaaatcatggctatggtagaacattaggtacaacatattactggggatgtaacggtactgtcgtacgccaaacaatgatactccaagtagctaataaaatatcaccaaacaatgactacgtaaatgcagcactagatgcaatcagccacgtattcggaagaaactactataatagatcatatgtaacaggtttaggaattaatccaccaatgaatccacacgaccgacgtagcggagcagatggtatttgggaaccatggccaggatatttagtaggaggaggatggcctggaccgaaagactgggtagatatacaagattcataccaaacgaatgaaatagcaataaactggaacgcagcgctaatatatgcactagcaggctttgtaaactacaattcaccacaaaatgaagtactatacggagatgtaaatgacgacggaaaagtcaactctacagatctcacgttattaaaaagatatgtattgaaagcagtttcaacactaccaagctcaaaagcagaaaaaaatgcggacgttaacagagatggcagagtgaatagcagtgatgtaacaatattatcaagatatctaataagagtaatagaaaaattaccgata

SEQ ID NO: 51370 - RNA, 2046 nt, synthetic construct
  misc_feature 1..2046: note = derived and/or modified sequence opt6 from anti-influenza_Chain
  source 1..2046: mol_type = other RNA
atgaaaccatcacactttacagagaaaagattcatgaagaaagtattaggcttatttctagtcgtagttatgctagccagtgtaggagtactaccaacatcaaaagttcaagccgcaggaacaaccgttacaagtatggaatattttagtccagcagatggaccagtaatatcaaaatcgggcgtaggaaaagcatcatatgggtttgtaatgcctaaatttaacggaggaagcgctacatggaatgatgtctattcagatgtaggagtaaatgtaaaagtaggaaataattgggtagatattgatcaagcaggaggatatatttacaatcaaaattggggacattggtcagacggtggttttaatggatattggtttacattaagcgcaacaacagaaatacaattatacagtaaagcaaatggagttaaattagaatatcaacttgtattccaaaacattaataaaacaacaatcacagcaatgaacccaacgcaaggaccacaaataactgcatcatttacaggaggagctggatttacctatccaacattcaacaacgatagtgcagtaacatacgaagctgtcgctgacgatttaaaagtatacgtaaaaccagtaaactcaagcagctggatagatatagacaacaatgcagcaagtggatggatctatgaccacaactttggccaatttaccgacggaggaggaggatattggttcaatgttacagaatctattaatgtaaaactcgagtccaaaacttcatcagcaaatttagtatacactataacatttaacgaacccacaagaaattcatacgtaataacaccatatgaaggaacaacatttacagcagacgcaaacggatcaataggaataccattgccaaaaatagatggtggagctccaatagcaaaagaattaggtaatttcgtatatcaaataaatataaacggacaatgggttgatttatcaaattcatcacaatcaaaatttgcttatagcgctaatggttataataacatgtcagatgcaaatcaatggggatattgggccgactacatatatggtctctggttccaaccaatacaagaaaatatgcaaatcagaataggatacccactaaatggacaggcaggaggaaacataggaaataattttgttaactatacttttataggaaatccaaatgcaccaagaccagatgttagcgatcaagaagatattagtattggaacaccaacagatccagcaatagccggaatgaatctaatatggcaagatgaatttaatggcacgacactagacacatcaaaatggaattacgaaactggatattatctaaacaatgacccagcaacgtggggatggggaaatgcagaactacaacattacacaaattcaactcaaaacgtatatgtacaagacggtaaactaaatataaaagcaatgaatgattccaaatcatttcctcaagacccaaacagatacgcacaatattcttctggtaaaataaacactaaagataaattatcgttaaaatatggaagagttgatttccgagcaaaattaccaacaggtgatggagtctggccagcattatggatgttaccaaaagattcagtatacggaacatgggcagcttcaggcgaaatagacgtaatggaagcaaggggtcgactaccaggaagtgttagtggaactatacattttggaggacaatggccggtgaatcaaagttcaggaggagattaccatttcccagaaggacaaacatttgcaaatgattatcatgtatattctgtagtatgggaagaagacaatattaaatggtatgtagatggaaaatttttctataaagtaactaatcaacaatggtattcaacagcagcacccaataatccgaacgcaccatttgacgaaccattttatttaataatgaacttagctgtgggaggcaacttcgatggaggaagaacacctaatgcatccgatataccagcaactatgcaagtagattacgtaagagtatataaagaacaa

SEQ ID NO: 51371 - RNA, 2046 nt, synthetic construct
  misc_feature 1..2046: note = derived and/or modified sequence opt6 from anti-influenza_Chain
  source 1..2046: mol_type = other RNA
atgaagccatcacacttcaccgaaaaacgatttatgaagaaagttctaggattattcctagtagtagttatgctagccagtgtaggagtcctaccaacatcaaaagtgcaagcagcaggaacaacagtaacatccatggaatatttctcaccagcagatggccccgtaataagtaaaagcggagtaggtaaagcatcatacggatttgtaatgccaaaatttaatggcggtagtgcaacatggaacgacgtatacagtgacgttggtgtaaacgtaaaagtaggcaataactgggtagatatagaccaagcaggaggatatatatataaccaaaactggggacactggtcagacggaggattcaatggatattggtttacattatcggcaaccacagaaatacaattatattctaaagctaatggagtaaaactagaatatcagctagtatttcaaaatatcaacaaaactacaataacggcaatgaatccaacacaaggaccacaaataactgccagctttactggaggagcaggatttacttatccaacgtttaataatgattcagcagtaacctacgaagcagtagcagacgacctcaaagtttatgtaaaaccagtaaattcaagtagttggatagatatagataacaacgcagcaagtggatggatatacgatcataactttggccaatttacagatggtggaggaggatattggtttaacgtaaccgaaagcataaatgtaaaactagaaagcaaaacctcgtccgcaaacctagtatacacaattacttttaatgaaccaacacgaaatagttacgttataactccatacgaaggtacaacatttacagcagatgcaaatggatcgattggaataccactcccaaaaatagatggaggagcacccattgcaaaagaactaggaaattttgtatatcaaataaatataaacggacaatgggtagatttatctaattcttcacaaagtaaatttgcttactctgcaaatggatataacaacatgtcagatgcaaaccaatggggatactgggcagactatatatatggcctgtggtttcaaccaatacaagaaaatatgcaaataagaataggatatccattaaacggacaagctggtggaaatataggaaataattttgtaaattatacattcataggtaacccaaacgctccaagacctgatgtaagcgatcaagaagatatatcaataggaacacccacagatccagcaatagcaggaatgaatcttatctggcaagatgaatttaatggaacaacattagatacaagcaaatggaactatgaaacaggatattatttaaataatgatccagcgacatggggatggggtaatgcagaactccaacattatacaaattcaacacaaaatgtttacgtacaagacggaaaactaaacataaaagccatgaacgacagtaaaagtttcccacaagaccctaatagatatgcccaatattcatctggtaaaataaatacaaaagataaactatctttaaaatatggaagagttgattttagagcaaaattacctaccggagacggagtatggccagcactatggatgctaccaaaagacagtgtatatggaacatgggccgcatcaggtgaaatagatgtcatggaagcaagaggtagactaccaggaagcgtctcaggtactatacatttcggcggccaatggcccgtaaatcaatcatcaggaggagattatcacttcccagaaggacaaacttttgcaaatgattatcatgtatacagtgtagtttgggaagaagataatataaaatggtacgtggacggaaaattcttttataaagtcacaaatcaacaatggtactcaacagcagctccaaataaccccaatgcaccattcgatgaaccattctatcttataatgaatctagcggtaggaggaaactttgatggaggccggacacctaacgcgagcgatataccagccacaatgcaagtagattacgtacgtgtatacaaagaacaa

SEQ ID NO: 51372 - RNA, 2058 nt, synthetic construct
  misc_feature 1..2058: note = derived and/or modified sequence opt6 from anti-influenza_Chain
  source 1..2058: mol_type = other RNA
atgacaaaatcaatttatttcagcctaggaatacacaatcatcaaccagtaggaaattttgactttgtgatagaaagagcatacgagatgtcttataaaccactcataaactttttcttcaaacaccctgatttccctataaacgtacatttttctggtttccttttactatggctcgagaaaaatcacccagaatacttcgaaaaattaaaaataatggcagaaagaggccaaatagaattcgtatccggaggtttttacgaacctatactacccataataccagataaggacaaagtccaacaaatcaaaaaactgaataaatacatatatgacaaattcggacaaacacctaaaggaatgtggctagcagagagagtatgggaaccgcatttagttaaatacatagcagaagcgggaatagaatacgtcgtcgtagatgatgcacactttttctcagtaggactaaaagaagaagatttgttcggctactacttaatggaagaacaaggttacaaactagcagtattcccaatatcaatgaaactaagatacttaataccatttgcagacccagaggaaacaataacatatttagacaaatttgcatctgaagacaaatcaaaaatagcacttctattcgacgacggggaaaaatttggcctatggccagacacctatagaacagtctacgaagaaggatggttagaaacattcgtaagtaaaattaaagaaaactttttactagtcacaccagtaaatctatacacctacatgcaacgagtaaaacctaaaggacgcatatatttaccaacagcctcctacagagaaatgatggaatgggtcctattcccagaagcacaaaaagaactagaagaactagtagaaaaattaaaaacagaaaacctttgggacaaattctcaccatacgtaaaaggaggattttggcgaaacttcctagccaaatatgacgaatcaaaccacatgcaaaaaaaaatgttatacgtctggaaaaaagtccaagactcaccaaacgaagaagtaaaagaaaaagccatggaagaagtattccaagggcaagcaaatgacgcatactggcacggaatattcggaggattatacctaccacacttacgaacagcaatatacgaacatctcattaaagcagaaaactatctagaaaattctgaaataaggtttaacatattcgatttcgactgtgacggaaatgacgaaataatagtagaatctcccttttttaatctttacctatcacccaaccacggaggaagcgtattagaatgggactttaaaacgaaagcatttaatctaacaaatgtactaacacgaagaaaagaagcttaccattcaaaattgtcttacgtaacatccgaagctcaaggaaaaagcattcacgaaagatggactgctaaagaagaaggacttgaaaacatattattttacgataatcacagaagggttagcttcacagaaaaaatattcgaatcagaacctgttctagaagatctttggaaagactcatcgagactagaagtagattcattttacgaaaactacgattacgaaataaacaaagacgaaaataaaatccgagtactattctctggagtatttagaggcttcgaactttgtaaaagctacatactttacaaagacaaatctttcgtagatgtagtctatgaaataaaaaacgttagtgaaacaccaatctctttaaatttcggatgggagataaatctcaacttcctggcaccaaaccatcctgattactacttcctaataggtgatcaaaaatacccactcagctcttttgggattgaaaaagtcaacaactggaaaatattctcaggtatcggaatagaactagaatgtgtattagatgtagaagcatctctatacagatacccaatagaaacagtctcactttccgaagaaggctttgaaagagtataccaaggatccgctttaatacacttttataaagtagacttaccagtcggctcaacctggcgaaccactatcagattctgggtaaaa

SEQ ID NO: 51373 - RNA, 2058 nt, synthetic construct
  misc_feature 1..2058: note = derived and/or modified sequence opt6 from anti-influenza_Chain
  source 1..2058: mol_type = other RNA
atgacaaaaagcatatacttctctttagggatacacaatcaccaacctgtaggtaactttgacttcgtaattgaaagagcttatgaaatgagttacaaaccactaataaatttcttcttcaaacatccagacttcccaataaacgtccacttcagtggatttctgctattatggctagaaaaaaatcatcctgaatatttcgaaaaacttaaaataatggcagaaagaggacaaatagaattcgtttcaggtggattctacgaacccatactaccaataataccagacaaagacaaagtacagcagataaaaaaattaaataaatatatatatgataaattcggccaaacaccaaaaggaatgtggctagcagaaagagtatgggaaccgcatctagtaaaatacatagcagaagccggtatcgaatacgttgttgtagacgatgcacactttttttcagtagggttaaaagaagaagacttattcggttattacttaatggaagaacaaggatataaacttgcagtatttcctatcagtatgaaattaagatacctaataccatttgcggacccagaagaaacaataacgtacttagataaattcgcgtcagaagacaaaagcaaaatagcactactattcgatgacggagaaaaatttggattatggccggacacatacagaacagtatatgaagaaggttggcttgaaactttcgttagtaaaataaaagaaaacttcctactagtaacaccagtaaacttatatacatatatgcaacgagtaaaaccaaaaggaagaatctacctaccgacagcaagctacagagaaatgatggaatgggtactattcccggaagcacaaaaagaattagaagaactagtagagaaactaaaaacagaaaacctatgggataaattctcaccatacgtaaaaggaggattttggcgaaattttttagccaaatacgacgaaagtaatcacatgcaaaaaaaaatgttatacgtttggaaaaaagtccaagattcaccaaatgaagaagttaaagaaaaagctatggaagaagtattccaaggccaagcaaacgacgcatattggcacggtattttcgggggactatatctaccacatttaagaacagcaatctacgaacacctcataaaagcagaaaactatttagaaaattcagaaataagattcaacatatttgattttgattgcgatggaaacgatgaaatcatagtagaaagtcccttttttaatctatacctgagtcccaaccatggcggatccgtattagaatgggattttaaaacaaaagccttcaacctaacaaacgtattaacgagaagaaaagaagcataccattcaaaattaagctacgtcactagtgaggcacaaggaaaatctatacacgaaagatggactgcaaaagaagaaggactagaaaacatactattctatgataatcacagaagagtatcattcacagaaaaaatcttcgaaagtgaacctgtcctagaagacctatggaaggacagtagcagactcgaagtagatagtttttacgaaaattatgactacgaaataaacaaagatgaaaacaaaataagagtactgttttcaggagtatttcgaggctttgaattatgcaaatcttatatattatacaaggacaaaagctttgtagatgtagtatacgaaataaaaaacgtatcagaaacccctataagcctaaattttggatgggaaatcaatcttaatttcttagcaccaaaccatccagactactacttcttaataggagatcaaaaataccccctatcgagcttcggcatagaaaaagtaaataactggaaaatcttctcaggtattgggatagaattagaatgcgtcctagacgtagaagcatcactttacagatatccaatagaaacagtatcactatcagaagaaggtttcgaacgtgtctaccaaggaagcgctttaatccatttttacaaagtagacctacctgtaggatccacatggagaacaactataagattctgggtaaaa

SEQ ID NO: 51374 - RNA, 2115 nt, synthetic construct
  misc_feature 1..2115: note = derived and/or modified sequence opt6 from anti-influenza_Chain
  source 1..2115: mol_type = other RNA
atgcccacaaatttatttttcaacgcacaccattcaccagtaggcgcgtttgcatcatttacattaggatttccaggaaaatccggaggattagatttagaactcgcacgtccaccaagacaaaatgtactcataggagtcgaatcattacatgaatcaggtctatatcatgtactaccatttctagaaacagctgaagaagatgaaagtaaacgatatgatatagaaaatccagacccaaatcctcaaaaaccaaatatattaataccatttgcaaaagaggaaatacaaagagaatttcatgtagcaactgacacatggaaagctggtgatttaacgtttacaatatattcccccgttaaagctgtaccaaatccagaaacagctgatgaagaagaattaaaattagctttagtgccagcagtaatagtagaaatgacaatagataatacaaacggtacaagagccagaagagcgtttttcggtttcgaaggcacagatccatatacatctatgagaagaattgacgatacgtgtccacaattaagaggagtaggacaaggaagaatcctctcaatagtcagcaaagatgaaggagtacgtagtgctttacattttagtatggaagacatattaactgctcaattggaagaaaattggacatttggactaggaaaagtaggagccttaatagtagatgttccagctggagaaaaaaaaacatatcaatttgccgtatgtttttatagaggaggatacgtaacagccggtatggacgcttcatatttttatactcgattcttccaaaatatagaagaggtaggtctatacgcattagaacaagcagaagtcttgaaagaacaaagttttagatcaaataaattgattgaaaaagaatggttatcagatgaccaaacattcatgatggcccatgcaatacgatcctattatggtaatacacaattattagaacatgaaggcaaaccaatttgggtagtcaacgaaggagaataccgaatgatgaacacattcgatttaacagtagatcaacttttttttgaattaaaattgaatccatggacagtaaaaaacgtactagatttatacgtagaaagatacagttatgaagacagagtaagatttcccggagaagaaacagaatacccaagtggaatatcattcacacatgatatgggagttgcaaatacattttctagacctcattatagtagttatgaactctatggaatctcaggatgcttttcccatatgactcatgaacaactagtcaattgggtactatgcgccgcagtatatatagaacaaacaaaagattgggcatggagagataaaagactagcaattctggaacaatgcttagaatctatggtaagacgagaccatcccgatccagaacaaagaaatggcgtaatgggactagacagtacacgtacaatgggaggggcggaaataacaacctatgacagtttagatgtatcactcggccaagccagaaataatctatatctagcaggaaaatgttgggcagcatatgtagcattagaaaaactatttcgagatgttggaaaagaagagttagcagcattagcaggcgagcaggcagaaaaatgtgcagcaacaattgtttcacatgtaacagacgatggatatatacctgcaataatgggagaaggaaatgacagcaaaataatacctgcaatagaaggattggtatttccatattttacaaactgtcacgaagcattagacgaaaatggaagatttggagcatacatacaagcattaagaaatcacttacaatacgtgttaagagaaggaatatgtttatttccagacggaggttggaaaattagtagcacaagtaacaactcatggttatcaaaaatatacctatgccaattcatcgcacgacatatattaggatgggaatgggatgaacaaggaaaaagagcagacgcagcacatgtagcgtggttaacccatccaacattatcaatttggagttggtctgatcaaataattgcgggtgaaattacaggaagcaaatattacccaaggggtgttacaagtatactttggcttgaagaaggagaa

SEQ ID NO: 51375 - RNA, 2115 nt, synthetic construct
  misc_feature 1..2115: note = derived and/or modified sequence opt6 from anti-influenza_Chain
  source 1..2115: mol_type = other RNA
atgccaactaatttattctttaatgcacatcatagtcctgttggcgcttttgcatcattcactttagggtttcctggaaaatcaggaggattagatttggaactagcaagacctccaaggcagaatgtcttaattggagtagaaagtctacatgaaagcggattataccatgtactaccatttcttgaaacagctgaagaagatgaaagcaaaagatatgatatagaaaacccagatcccaatccccaaaaacctaatatactaataccttttgcaaaagaagaaatacaaagagagtttcatgtagcaacggatacctggaaagccggagatttaacatttacaatatatagccctgtaaaagcagtaccaaatccagaaacagcagatgaagaagaattaaagttggccttagtacctgcagtaatagtagagatgacaatagacaataccaacggaacaagagcaagacgagcatttttcggatttgagggtacagacccatatacttctatgagaagaatagacgatacatgtcctcaattaagaggagttgggcaaggaagaatattatcaattgtatctaaagatgaaggagtcagaagtgctttacatttctcaatggaagatatactaacagcccaattagaagagaattggacattcggactaggtaaggtaggggcactaatcgtagatgtaccagctggtgaaaagaaaacataccaatttgcagtatgcttttacagaggagggtacgtaaccgctggcatggacgcatcatatttttatacaagattctttcagaatatagaggaagtaggactatacgcattagaacaagcagaagtattaaaagaacagagctttcgatcaaacaaattaatagaaaaagaatggttaagtgatgaccaaacattcatgatggcacatgcgatcaggtcatactatggaaatacccaactcttagaacatgaaggtaaacccatttgggtagtaaatgagggcgaatatagaatgatgaacacattcgatttaacagtagaccaactattcttcgaacttaaactaaatccatggacagtcaaaaacgtattggatttatacgtagaaagatactcatatgaagacagagtaagatttccaggagaggaaacagaatatccatcaggaatatcattcacccacgacatgggagtagctaacactttttcacgacctcattactcatcatacgagctatatggtatcagcggatgcttctcacatatgactcacgaacaattagtaaattgggttttatgtgctgcagtatacatagagcaaacaaaagactgggcttggagagacaaaagattagcaatattagaacaatgtctagaatcaatggtaagaagagatcatcccgatccagaacaaagaaatggagtaatgggtttagattcaacaaggactatgggaggcgccgagataacaacatatgatagcctagatgtaagtttaggtcaagcacgcaacaatctatatttagccggaaaatgctgggcagcatatgtagcactagaaaaactatttagagatgttggaaaagaagaattagcagccctagcaggagaacaagcagaaaaatgtgcagcaactatcgttagtcacgttacagatgatggttacatacccgctataatgggagaaggaaatgactcaaaaataataccagctatagaaggcctagtatttccatacttcacaaactgtcatgaagcattagatgaaaacggaagatttggtgcttatattcaagccttaagaaatcatttacaatatgtattaagagaaggaatatgcttattccccgatgggggatggaaaatcagctccaccagtaataattcatggttatcaaaaatatatctatgccaattcatagcaagacatatattaggatgggaatgggacgaacaaggaaagagggctgacgctgcacacgtggcatggttaacccatcctacattatcaatatggtcttggtccgatcaaataatagcaggagaaataacaggatctaaatattacccacgaggagtaacttcaatattatggctagaagaaggtgaa

SEQ ID NO: 51376 - RNA, 2148 nt, synthetic construct
  misc_feature 1..2148: note = derived and/or modified sequence opt6 from anti-influenza_Chain
  source 1..2148: mol_type = other RNA
atggaagacttcgtcagacaatgctttaacccaatgatagtagaactagcggaaaaagcaatgaaagaatacggagaagacctaaaaatagaaaccaataaattcgcagccatttgtacacatctagaagtatgcttcatgtacagtgatttccattttataaatgaacaaggagaaagcataattgtagaaccagaagaccctaacgccttactaaaacacaggtttgaaattatcgaaggaagagatcgcacaatggcctggactgtagtgaactcaatctgcaacacaacaggagctgaaaaaccaaaatttttacctgacctatacgattacaaagaaaaccgttttatcgaaattggagtcacaagacgagaagtacacatttactatcttgaaaaagccaataaaataaagagcgagaaaacacatatacacatattctctttcacaggagaagaaatggcaacaaaagcagattatacattagacgaagaatctcgagcaagaataaaaacgagattattcaccataagacaagaaatggcatcaagaggattatgggattcattccgccaaagcgaaagaggcgaagaaactatagaagaaagattcgaaataactggaacaatgcgacgactagcagatcaatcattaccaccaaatttttcatgtctagaaaactttagagcatacgtggacggatttgaaccaaatggatacatagaaggaaaacttagtcaaatgagtaaagaagtaaacgcaagaattgaaccattcctcagaacaaccccacgaccaataagacttcctgacggaccaccatgtttccaacgatcaaaattccttttaatggacagtcttaaactatcaatagaagacccatcccatgaaggagaagggataccgctctatgacgcaataaaatgtatgagaacattctttggatggaaagaaccctcagttgttaaaccacacggaaaaggaataaatccaaattacttactatcatggaaacaagtactagcagaacttcaagatatagaaagtgaagaaaagatcccacgaaccaaaaatatgaaaaagacaagccaactaaaatgggcactgggggaaaacatggcaccagaaaaagtagatttcgatgactgcaaagacatatccgatttaaagcagtatgactcagacgaaccagaactacgatcactatcaagctggattcaaaacgaatttaataaagcatgcgaattaacagattccatctggatcgaattagatgaaatcggagaagatgtcgcccccatcgaacacatagcttcaatgagaagaaattatttcacagcagaagtatcccactgccgagcaacagagtacataatgaaaggtgtgtacataaacacagccttattaaacgcatcatgcgcagcaatggatgatttccaactaatacctatgatctcaaaatgtagaacaaaagaaggaagaagaaaaaccaatctatatggatttataattaaaggaagatcccatttaagaaatgatactgatgttgtcaactttgtctcaatggaatttagtctaaccgatccaagattagaacctcataaatgggaaaagtattgtgtcctagaaataggggatatgttattaagatcagcaatcggacaagttagtagaccaatgttcctatatgtcagaacaaatggtacatcaaaaattaaaatgaaatggggaatggaaatgcgtagatgcttattacagagtttgcaacaaatagaaagtatgatcgaagccgaatcatcagtcaaagaaaaagacatgaccaaagaatttttcgaaaacagatcagaaacatggcctatcggagaaagccctaaaggtgtcgaagaaggttcaattggcaaagtatgtcgaacactcctcgctaaatcagtttttaatagtttatacgctagtccacaattagaaggatttagtgcagaatcacgaaaactgttactaattgtacaagctctcagagacaatctagaacctggaaccttcgacctcggaggtttatatgaagcaatagaagaatgtctaatcaacgacccatgggttctacttaatgcttcatggtttaacagtttcctaacccacgcactacga

SEQ ID NO: 51377 - RNA, 2148 nt, synthetic construct
  misc_feature 1..2148: note = derived and/or modified sequence opt6 from anti-influenza_Chain
  source 1..2148: mol_type = other RNA
atggaagacttcgtacgacaatgctttaacccaatgatagtagaactagcagaaaaagcaatgaaagaatatggtgaagatttaaaaatagaaaccaataaatttgccgcaatatgtacacatctagaagtatgtttcatgtactcagactttcattttatcaatgaacaaggagaatcaatcatcgtagaacctgaagatcctaatgctttattaaaacacagattcgagattatagaaggaagagatcgtacaatggcatggacagtagtaaactcgatatgtaatacgactggagcggaaaaaccaaaatttttaccagacctatatgactataaggaaaatagatttatagaaataggcgtaacaagaagagaagtacacatatactacttagaaaaagcgaacaaaatcaaatccgagaaaactcacatacatatattttcattcaccggagaagaaatggcaacgaaagcggattatacattagacgaagaaagtagagcaagaatcaaaacaagattatttactatcagacaagaaatggcatcaagaggattatgggatagcttcagacaatcagaacgcggagaagaaacaatagaagaaagatttgaaataacagggacaatgagaaggctagcagaccaatctttacctcccaatttcagctgtctagaaaactttagagcatacgtagatggttttgaaccaaacggctacatcgaaggaaaattaagccaaatgagcaaagaagtaaacgctcgaatagaaccatttctaagaacaactccgagaccaatcagactacctgacggaccaccttgcttccaaagatcaaagttcttactaatggattcattgaaactatcaattgaagacccaagtcatgaaggagaaggaataccactctatgatgctattaaatgcatgcgtacgttctttggctggaaagaaccctccgtagtaaagccacatggaaaaggaataaaccccaattacctattatcatggaaacaagtactagccgaactccaagatatagaaagcgaagagaaaattccacgcacgaaaaatatgaagaaaacaagtcaattaaaatgggctttaggtgaaaatatggcaccagaaaaagttgactttgacgactgcaaagatatctcagacttaaaacaatatgatagcgatgaaccagaactcagatcattatcatcatggattcaaaatgaatttaacaaagcctgtgaattaaccgatagtatatggatagaattagatgagattggagaagacgttgcacctatagaacacatagcaagtatgcgaagaaactactttacagcagaagtttcgcattgtcgagcgacagaatacattatgaaaggagtttacataaacactgcattattaaatgcaagctgcgcagctatggacgatttccaactcataccaatgatatcaaaatgcagaacaaaagaaggaaggcgaaaaacaaatttatacggattcataatcaaaggaagaagccatttacgaaacgacacagacgtagtaaactttgtgtccatggaatttagcctaacagatcccagactcgagcctcataaatgggaaaaatattgtgtattagagataggtgatatgctactcagatcagctataggtcaagtatctagaccaatgttcttatacgtaagaacaaatgggacatcaaaaataaaaatgaaatggggtatggaaatgagacgatgcttgcttcagagcttacaacaaatagaaagtatgatcgaagcagaaagctctgtaaaagaaaaagatatgacaaaagaatttttcgaaaacagaagtgaaacatggccaataggtgaatcacctaaaggcgtagaagaaggaagcataggcaaggtttgcagaacactcctcgccaaatcggtattcaatagcttatatgcaagtccacaactagaagggtttagcgcagaatcccgaaaattactattgatcgttcaagcattaagagataacctagagcccggaacatttgacctaggaggattatacgaagcaatagaagaatgcctaataaacgacccatgggtactactcaacgcatcgtggttcaattcattcctaacccatgcactaaga

SEQ ID NO: 51378 - RNA, 2256 nt, synthetic construct
  misc_feature 1..2256: note = derived and/or modified sequence opt6 from anti-influenza_Chain
  source 1..2256: mol_type = other RNA
atgaatataaatccatacttcttgtttatagacgtcccaatacaagcagcaataagcacaacattcccctatacaggtgtcccaccatactcacacgggaccggaacaggttataccatagatacagtaattcgtactcatgagtactcaaataagggaaaacaatatatcagtgacgtaacaggatgcgtaatggtagatccaacaaacggaccactaccagaagataacgaaccatcagcatacgcacaactagattgcgtgttagaagctttagacaggatggatgaagaacatccaggactatttcaagcaggaagccaaaatgcaatggaagcactaatggtaactaccgtagacaaactaacacaaggaagacaaacattcgattggactgtttgccgaaatcaaccagcagcaactgctcttaatactacaataacgtcatttaggttaaacgatctaaatggagctgataaaggaggcctagtcccattttgtcaagacataattgattctctagataaaccagaaatgatattctttactgtaaaaaacataaaaaaaaaactaccagctaaaaaccgaaaaggatttctcattaaaagaataccaatgaaagttaaagaccgaataactagagtcgaatatataaaaagagcattgtctttaaacacaatgacgaaagatgcagaaagaggaaaactaaaacgtcgtgcaatagcaactgcaggaatccaaataagaggattcgtactagtagtagaaaacctagccaaaaacatctgcgaaaatctcgaacaaagcggattaccagtaggtggaaacgaaaaaaaagcaaaattatccaatgcagttgccaaaatgctatcaaattgcccacctggtggaatatcaatgacagttactggagacaatacaaaatggaatgaatgtttgaatcctagaatatttctagcaatgactgaaaggattacacgagactcaccaatatggttcagagacttctgttcgatagcaccagtactattctcaaataaaatagcaagattaggaaaaggatttatgataacaagcaaaacaaaaagattgaaagcacaaataccatgtcccgacctcttcaacataccattagaaagatataatgaagaaactagagcaaaactaaaaaaattaaaaccatttttcaacgaggagggaacagcaagcctaagtcccggaatgatgatgggaatgtttaatatgcttagtacggtactaggagtagccgccctaggtataaaaaacattggaaataaagagtatctatgggacggcctccaaagttccgatgattttgcattattcgtaaacgcaaaagatgaagaaacttgcatggaaggcataaacgatttttatcgaacatgtaaactactaggcattaatatgagcaaaaaaaaatcatattgcaatgaaactggtatgtttgaattcacatcaatgttctatagggacggatttgtaagtaattttgcaatggaattaccgtctttcggagtagcgggagtaaatgaatcagcagatatggcaataggaatgacaataataaaaaacaatatgataaacaacggaatgggccctgcaacagcacaaacagcaattcaattatttatagctgactatcgctatacatacaaatgccatagaggcgactccaaagttgaaggaaaaaggatgaaaatcataaaagaattatgggaaaatacaaaaggaagagatggattactagtagctgacggtggacccaacttatataatctccgaaacctccacataccagaaataatattaaaatataatattatggatccagaatacaaaggcagactattacacccccaaaacccctttgtaggccacttatcaatagaaggaataaaagaagcagacattaccccagcccacggaccaataaaaaaaatggactatgatgctgtaagtggcactcattcatggcgtacaaaacgcaatagatcgatcctaaatactgatcaaagaaatatgatactagaagaacaatgctatgctaaatgctgtaacttattcgaagcttgttttaatagtgcatcatacagaaagccagtaggccaacattctatgttagaagcaatggcacacagactaaggatggacgcaaggctagattacgaatccggaagaatgtcaaaagaggatttcgaaaaagcaatggcgcaccttggagaaataggatacatg

SEQ ID NO: 51379 - RNA, 2256 nt, synthetic construct
  misc_feature 1..2256: note = derived and/or modified sequence opt6 from anti-influenza_Chain
  source 1..2256: mol_type = other RNA
atgaatatcaatccctattttttattcatcgatgttccaatacaagctgccatatccacaacatttccctataccggcgtaccaccatacagccatggaacaggaactggatatacaatagacacagtaataagaacacatgaatactcaaacaagggcaaacaatatatatcagacgtcaccggatgcgtaatggtagatccaacaaacggaccactacctgaagataatgaaccttctgcctatgcacaactagactgtgtactagaagcattagacagaatggatgaagaacaccccggtttatttcaagcaggatcgcaaaatgctatggaagcattaatggtaacaaccgttgataaattaacacagggaagacaaacattcgattggacagtatgtagaaaccaaccagcagcgacagcattaaatacaacaataacaagcttcaggctaaacgaccttaatggagcagacaaaggaggattagtaccattctgccaagacataatagattcgttagataaaccagagatgatattcttcacagtaaaaaatatcaaaaaaaaactaccagcaaaaaacagaaaaggtttcctcataaaaagaataccaatgaaagttaaagatcggataacacgagtagaatatataaaaagagctctttcacttaatactatgacaaaagatgctgaacgaggaaaactgaaaagaagagctattgcaacagcaggcatacaaataagaggattcgtactcgtagtagaaaacctagccaaaaatatatgtgaaaatttagaacaatcaggtttacccgtaggtggaaatgaaaaaaaggctaaattatcaaacgcagtagcaaagatgttaagcaattgcccgccaggtgggatatcaatgacagtaacaggagataatacaaaatggaatgaatgcttaaatccacgaatattccttgcaatgaccgaaagaatcacaagagattcaccaatctggtttcgagacttttgctccatagctccagtactattcagcaataaaatagcaagactaggaaaaggttttatgataacaagcaagaccaaacgactaaaagcacaaataccatgtccagatctattcaacattccattagaacgatataatgaagaaacaagagctaaactgaaaaaattaaaaccattttttaacgaggaaggaacagcatccctatcaccaggaatgatgatgggcatgttcaacatgttatcaaccgtattaggtgtagcagccctaggaataaaaaatataggcaataaagaatacctatgggatgggctacaatcatcagacgactttgcgttattcgtaaacgccaaagacgaagaaacatgcatggaaggcataaacgatttctatagaacatgcaaactattaggcataaatatgtcaaaaaaaaaaagctactgtaatgaaacagggatgttcgaattcacaagcatgttttatagagatggattcgtatcaaatttcgcaatggaactgccttcgtttggagtagctggcgttaacgaaagtgctgatatggccataggaatgaccataataaaaaacaatatgataaataatggcatgggaccagccacagctcaaaccgctattcagctatttattgcagactatcggtatacatacaaatgtcacagaggtgactcaaaagtagaaggaaaaagaatgaaaataataaaagaattatgggaaaacaccaaaggaagagatgggttactcgtagcagatggaggaccaaacttatataacctaagaaatttacacataccagaaattatactaaaatataacataatggaccccgaatacaaaggaagacttctacatccacagaatccgtttgtaggacatctatcaatagaaggtataaaagaagctgatatcacaccagcccatggtcctataaaaaaaatggactacgatgcagtatcaggtacacattcctggaggacaaaacgaaatcgaagcatactaaatacagaccaaagaaatatgatcctagaagaacaatgttatgcaaaatgctgcaatttatttgaggcatgttttaattcagcttcatatagaaaaccagtaggacaacactcaatgctggaagcaatggcacaccgcttaaggatggatgctagacttgattatgaatctggtagaatgagcaaagaagatttcgagaaagctatggcgcacttgggagaaataggatatatg

SEQ ID NO: 51380 - RNA, 2265 nt, synthetic construct
  misc_feature 1..2265: note = derived and/or modified sequence opt6 from anti-influenza_Chain
  source 1..2265: mol_type = other RNA
atggcagttgatataaaaaaaataattaagcagatgacattagaagaaaaagcagggttatgtagcggattagacttctggcatacgaaaccggtagaaagacttggaataccatcaatcatgatgacggatggacctcatgggctacgtaaacaaagggaagacgcagaaatagcagatataaacaatagcgtaccagcaacatgcttcccaagcgcagcaggcctagcatgctcatgggacagagaacttgtggaaagggtaggggcagcgttaggggaagaatgtcaagcagaaaacgtaagtatattactggggccgggagcaaatatcaagaggtctcctctatgtggaaggaattttgaatacttttcggaagatccgtacctaagtagcgaacttgcagcatcacacataaaaggagtacaaagtcaaggcgtaggagcgtgtttaaagcactttgcggcaaataatcaggaacaccgaagaatgactgtagacactatagtggatgaaagaaccttgagagaaatatatttcgcgagctttgaaaatgcagtaaaaaaagcacggccctgggtagtaatgtgtgcgtataataaactaaatggagaatattgctcagaaaacagatatttactcacagaagtactaaaaaatgaatggatgcatgatggattcgttgtatcagattggggagcagttaacgatagagtaagtggactagacgccgggttagatttagaaatgccgacaagtcatggcataacagataaaaaaatagtagaagcagtaaaatcaggaaaactatcggaaaatatactaaatcgtgccgttgaaagaatactcaaagtgatatttatggcgttagaaaataagaaagaaaatgcacaatacgataaagatgcacatcatagattagcaagacaagcagcagctgagtcgatggtactattaaagaatgaagacgatgtactcccactgaaaaaatcaggaacaatagcattgattggagctttcgtaaaaaagcctaggtatcaaggaagtggttcaagccatataaccccaacgagattagatgacatctatgaagaaattaaaaaagcaggcggagacaaagttaatctcgtatacagtgaagggtatagattagagaatgatggaattgacgaagaacttataaacgaagctaaaaaagcagcaagttcttcagatgtagcagttgtttttgcaggcctccccgatgaatatgaaagcgaaggatttgatagaacacatatgagtatacctgaaaatcaaaacagattaatagaagcagtagcggaagtacaaagtaatatcgttgtggtactactaaacggaagcccagtggaaatgccatggatagataaagtaaagtcagtcctcgaagcatacttgggaggacaagcattagggggcgcattagcagacgtactattcggcgaagtaaacccaagcggaaaattagcagaaacatttccagtaaaattaagtcacaacccatcatacttaaactttccaggagaagatgatagagtagaatacaaagaaggactcttcgtaggatatagatattatgatacaaaaggaatagaacctttattcccatttggacacgggttatcatacacaaagtttgagtatagtgatatatcagtcgataaaaaagatgttagcgataacagcattataaacgtgagcgtaaaagtaaaaaatgtaggaaaaatggcaggtaaagagatagtacaattatacgtaaaagatgttaaaagtagtgttaggagaccagagaaagagttaaaaggtttcgaaaaagtatttctaaatcctggagaagaaaaaactgtaacattcactctagataaaagagcatttgcatactataacacacaaataaaagattggcatgtcgaatctggggaattcttaatattaataggaagaagttcacgagatatagtgttaaaagagtcagtacgggtaaatagtacagtaaaaataagaaaaagatttaccgtcaacagtgcagttgaagatgtaatgtcggactcaagtgcagcagcagttttaggaccagtattaaaagaaattacagatgcacttcaaatagacatggacaacgcgcacgacatgatggcagctaatataaaaaatatgccactaaggagcctagtcggatacagtcaaggaagattaagtgaggaaatgctagaagaactagtagataaaataaataacgttgaa

SEQ ID NO: 51381 - RNA, 2265 nt, synthetic construct
  misc_feature 1..2265: note = derived and/or modified sequence opt6 from anti-influenza_Chain
  source 1..2265: mol_type = other RNA
atggcagtagacattaaaaaaataattaaacagatgacattagaggaaaaagcaggactatgttcaggattagacttttggcacacaaaacccgtagaaagactgggcataccaagtattatgatgacagatgggcctcatggtttgagaaaacaaagagaagacgcagaaatagcagatataaacaacagtgttcctgcaacatgtttcccgtcggcagccggcttagcatgtagttgggacagagagcttgtagaaagagtcggagcagcattaggagaagagtgtcaggcagaaaatgtcagtatattgttaggccccggagcaaacataaaaagatctccactatgtggaagaaattttgagtattttagtgaagacccatatttaagtagtgaactagcggcttcacacattaaaggagttcaaagtcagggagtaggagcatgtttgaaacatttcgcggcaaataaccaagaacatagaagaatgacagtagatacaatagtagatgaaagaacactaagagaaatatactttgcatcatttgaaaacgcagtgaaaaaagcgagaccatgggtagtaatgtgtgcatacaacaaattaaatggagaatactgtagtgaaaacaggtatttacttacagaagtattaaaaaatgaatggatgcatgacggtttcgtagtcagtgattggggagcagtaaatgatagagtatcaggattggatgcaggattagatttagaaatgccaacatcccatggtataacagataaaaaaattgtagaggcagtgaaatcgggaaaactaagtgaaaatatattaaatagagctgtagaaaggattctaaaagtaatatttatggcgcttgaaaataaaaaagaaaatgcacaatacgacaaagacgctcaccatagattagcaagacaggcagcagcagaaagtatggtattactaaaaaatgaagatgacgttttaccgttaaaaaaaagtggaacaatcgctctaataggagcatttgtaaaaaaaccaaggtatcaaggaagtggaagtagtcatataacaccaacacgactagacgatatatatgaagaaattaaaaaagcaggcggagataaagtaaacttagtttattcagaaggttacagattagagaacgatggaatagatgaagagctaattaacgaagcaaaaaaagcagcaagcagcagcgatgtagcggtggtattcgcaggattaccagatgaatacgagagcgaagggttcgacagaacgcacatgtcaataccagaaaaccaaaacaggttgatagaagctgttgccgaagtacaaagtaacattgtcgtagtgttactaaacggtagtccagtagaaatgccatggatagataaagtaaaatcagtattagaagcatatttaggaggacaagcattgggaggggcattagcagatgtactattcggagaggtaaatccttcaggaaaattagcagaaacattccctgtgaagttaagtcacaacccaagttatttaaattttccaggagaagatgaccgagtcgaatacaaagaaggactttttgtgggctataggtattatgataccaaaggaattgaaccattatttccatttggacatggattaagttatacaaagttcgaatactcagatatatcggtagacaaaaaggatgtaagtgacaattcaataattaacgtaagtgtaaaagtaaaaaatgtaggaaaaatggcaggaaaagaaatagtacaactatatgtgaaagatgttaaatcatcagtaaggaggccggaaaaagaactaaaaggttttgaaaaggtatttttaaatcccggagaagaaaaaacagtgacattcacattagacaaaagagcctttgcctattataatacgcaaatcaaagattggcatgtagaatcaggtgaattcttaattttaataggaagaagtagccgagatatagttttaaaagaaagtgtaagagtaaattcaacagtaaaaatacgtaaaagattcacagtaaatagtgcagtggaagatgtaatgagtgactcatcagcggctgcagtgctcggccctgtattaaaggaaataacagatgctttacaaatagacatggataacgcacatgatatgatggcagcaaacataaaaaatatgcctttaagaagtttagtaggatatagtcaaggtagattaagtgaagagatgctagaagaactagtagataaaataaataatgtagaa

SEQ ID NO: 51382 - RNA, 2277 nt, synthetic construct
  misc_feature 1..2277: note = derived and/or modified sequence opt6 from anti-influenza_Chain
  source 1..2277: mol_type = other RNA
atggaaagaataaaagaactacgaaatttaatgtcgcagtcaagaacacgagaaatactgacaaaaacaacagtagatcatatggcaattattaagaaatatacatctggaagacaagagaaaaaccctgccttgcggatgaaatggatgatggcaatgaaatatccaattactgcagataaaagaataactgaaatgatacctgaaagaaacgaacaaggccaaacgctatggagcaaaatgaacgatgctgggtcagacagagtgatggtgtcaccactagcagttacttggtggaatagaaacggacccatgacaaatacagttcactatccgaaaatatataaaacctatttcgaaagagttgaaaggctaaaacacggaacgtttggacctgttcatttccgaaatcaagtcaaaataagaagaagagtagacattaacccaggacatgcagatttaagtgcaaaagaagcacaagatgtgataatggaagtagtatttccaaacgaagtaggagcaagaattttaacatcagaatcacaattaactataactaaagaaaagaaagaagaactgcaagactgtaaaattagcccattaatggtagcatatatgctagaaagagagctagtaagaaaaacacgatttttgccagttgccggaggaactagcagcgtatatatagaagtactacacttaacgcaaggcacttgttgggaacaaatgtatacaccaggaggagaagtcaaaaatgatgacgtagatcagagcttaataatagctgcgagaaatatagtcagacgagctgccgtatcagcagatccattagcctccttattagaaatgtgtcacagcactcaaataggtggtataagaatggtagatattctaaaacaaaatcccacagaagaacaagcagtaggcatatgtaaagcagcaatgggattaagaatttcaagctcattttctttcggaggattcacctttaaaagaacttcaggatcatcagttaaacgcgaagaagaagtacttacaggaaatttacaaacactaaaaattagggtacatgaaggatatgaagagttcacaatggttggcagacgagcaacagcaatactacgaaaagctacaagacgattaatacaactaatagtaagcggtagagatgaacaatcaatagctgaagctatcatagtagcaatggtatttagccaagaagattgcatgataaaagcagttaggggagatttaaatttcgtaaaccgagcaaatcaaagactaaatcccatgcaccaactattacgacacttccaaaaagacgctaaagtattatttcaaaattggggagtagaaccaatagacaatgtaatgggaatgatcggaatactaccagatatgacaccaagcatagaaatgagcatgagaggagttagaatatccaaaatgggcgtggatgaatacagttccaccgaacgagtagtcgtatcaatagacagatttctaagagttcgggaccaaagaggcaacgtattactttcaccagaagaagtaagtgaaacgcaaggaacagaaaaactaaccataacctatagctcaagcatgatgtgggaaataaatggaccagaaagcgtcctagtaaacacttatcaatggataatcagaaattgggaaactgtaaaaattcaatggtcacaaaacccaactatgctgtataataaaatggaatttgaaccatttcaatcattagtacccaaagcaataagaggtcaatattcaggctttgtaagaactctatttcaacaaatgagagacgtactaggtacatttgatacagcccaaataataaaactattacctttcgcagcagcaccaccaaaacaaagcaggatgcaatttagctcatttacagtaaatgttagaggatccggaatgagaatattagtccgcggaaactccccagtatttaattataataaagccacaaaaagactaacagtgttaggcaaagacgctggcacattaacagaagaccccgatgagggaacagccggtgtagagagtgcagtactaagaggattcctcatattaggtaaagaagatagaagatacggaccagcattaagtatcaatgaattatctaatttagccaaaggagaaaaagcaaacgtattaataggacagggagatgtagttctcgtaatgaaaagaaaacgagatagttccatactaacagatagccaaacagccaccaaaagaatacgtatggcgattaac

SEQ ID NO: 51383 - RNA, 2277 nt, synthetic construct
  misc_feature 1..2277: note = derived and/or modified sequence opt6 from anti-influenza_Chain
  source 1..2277: mol_type = other RNA
atggaacgaataaaagaattgagaaatctcatgtcgcaatcaagaacaagagaaatacttacaaaaacaacagtagaccatatggcaataataaagaaatatacaagtggtaggcaagagaaaaacccggcactcagaatgaaatggatgatggcaatgaaatacccaatcacagccgataaaagaataaccgaaatgatacccgaaagaaatgaacaaggacaaacactctggtctaaaatgaatgacgcaggaagtgacagagttatggtttccccactagctgtgacatggtggaatcggaatggacctatgacaaacacagtgcattatcctaaaatatacaaaacatattttgagagagtagaaagattaaaacacggtacctttggaccagtacactttaggaatcaagtaaaaataagaagacgagtggatataaatccaggtcatgcagatctatcagcaaaagaagcacaagatgtcataatggaagtagtatttccaaatgaagttggcgctagaatactaacaagcgaatcacaacttactattacaaaagaaaagaaagaagaattacaagactgtaaaattagccctctaatggtcgcttatatgctagaacgagaattagtacgaaaaacaagattcctacccgtagctggtggaacaagctcagtttacatagaagtgcttcatcttacacaaggaacgtgttgggaacaaatgtacacacctggtggcgaagttaaaaatgatgacgttgaccaatcactgataatagcagcaagaaatatagtgaggagagctgcagtcagtgctgacccattagcatctttgttagaaatgtgtcattctacacaaataggtggcataagaatggtagacatattaaaacaaaacccaactgaagaacaggcagtaggtatatgtaaagctgcaatgggtttaagaatatcaagtagtttttcatttggaggatttacatttaaacgaacatcaggttcaagcgtaaagcgagaagaagaagtactgactgggaacctacaaacattaaaaatcagagttcacgaaggatatgaagagttcacaatggtaggacgacgagcaaccgcaattttaagaaaagcaactagaagactaattcaattaatagtaagtgggagagatgaacaatcaatcgctgaagccataatagtagcaatggttttcagtcaagaagattgtatgattaaagcagtaagaggagatttaaattttgtaaatagagcaaaccaaagactaaatccaatgcatcagttactaagacacttccagaaagacgcgaaagtcttattccaaaattggggagtagaacccattgataacgtaatgggaatgatcggaatattacccgacatgactccatcaattgaaatgagtatgagaggagttagaattagtaaaatgggtgtagacgaatattcgagtacagaacgagtagttgtaagtattgacagatttttaagagtaagagatcagagaggaaatgtacttctatcaccagaagaagtttcagaaactcaaggaacagaaaaactaacaattacatacagtagctcaatgatgtgggaaataaacggaccagaatctgtcctagttaatacatatcaatggattatacgaaattgggaaaccgtgaaaatacaatggagccaaaacccaaccatgctatataataaaatggaatttgaaccatttcagagcttagttcccaaagcaataagagggcaatacagcgggtttgtcagaacactatttcaacaaatgagagatgttttaggaacattcgatactgctcaaataataaaactactaccctttgctgcagcgccacccaaacaatcaaggatgcaattcagctcattcacagtaaatgtacgcggatctggaatgaggattctcgttagaggaaatagcccagtattcaactataataaagctacgaaaagattaacagtactgggtaaagatgcaggcactttaacagaagacccagatgagggtacagcaggagtagaatcagcagtattgagaggctttctaattcttggaaaagaagatagaagatatggacctgcattgtcaataaacgaattatcaaacttagcaaaaggagaaaaagcaaacgtactcataggacaaggagacgtcgtcctagtaatgaaacgaaaacgagattcaagcatactcacagattcgcaaacagccacaaaaagaattagaatggcaataaac

SEQ ID NO: 51384 - RNA, 2472 nt, synthetic construct
  misc_feature 1..2472: note = derived and/or modified sequence opt6 from anti-influenza_Chain
  source 1..2472: mol_type = other RNA
atgatgcttagaaaaaaaacaaaacaactaatttctagcatattaatactagtattactactcagtttattcccagctgcattggcagcagaaggcaatacaagagaagacaattttaagcatctactaggaaacgataatgtaaaacgcccctcagaagcaggagccctacaactacaagaagtggatggccaaatgacattggtagaccaacacggcgaaaaaattcaattacgtgggatgtcgacacatggtctccaatggtttccagaaatacttaatgacaatgcatataaagcattatctaatgactgggactcaaatatgattaggctagcaatgtatgtaggtgaaaatggatacgcgacaaatccagaactaataaaacaaagagtaatcgatggaatagaattagcaatagaaaacgacatgtatgtaattgtagattggcatgtacacgcacccggagatccaagagatcccgtatatgcaggtgcaaaagatttcttccgagaaatagctgccttatacccaaacaatcctcatataatatacgaattagcaaatgaaccatcttcaaataacaacggaggcgctgggattccaaacaatgaagaaggatggaaagcagtaaaagaatacgccgatcctatcgtagaaatgcttagaaaatcaggaaatgctgacgacaacataataatagtaggatcaccaaattggagccaaagacccgacctagcagcagacaatccaatagatgatcaccatacaatgtacactgtccatttttacactggatcacatgcagcaagcacagaatcatatccatctgaaacaccaaattctgaacgaggaaacgttatgtccaacacaagatatgcactggaaaatggcgtagcagtttttgcaacagaatggggaacatcacaagcatcaggtgatggcggaccatatttcgatgaagctgatgtatggatagaattcctaaatgaaaataatatatcatgggccaattggtcacttacaaacaaaaatgaagtctcaggagctttcacgccattcgaactaggcaaatcaaatgcaacaaatttggaccccggaccagaccatgtatgggcaccagaagaactttcccttagtggagaatatgtccgcgcaagaataaaaggagtcaattatgaaccaattgacagaacgaaatatacaaaggttctatgggattttaacgatggaaccaaacaaggattcggtgtaaatagtgattcaccaaataaagaactgattgcagttgataacgaaaataacacactaaaagtatccggattagacgtctctaacgacgtttcagatggtaatttttgggctaatgcacgactaagcgcaaatggatggggaaaaagcgtagacattctaggagccgaaaaattaacaatggacgtaatcgttgatgaaccgactactgtagctatagctgcaataccacaaagttcaaaatcaggatgggcaaatccagaaagggcagtaagagtaaatgcagaagattttgtacaacaaactgacggaaaatataaagcaggattaacaattacaggagaagacgcgccaaatttaaaaaatatagcatttcatgaagaagataataatatgaataatataatattattcgtaggaactgatgctgcagatgtaatatacttagacaatataaaagttataggtacggaagtcgaaataccagtagtacatgacccgaaaggggaagcagtattgccatctgtatttgaagacggaacaagacaaggttgggattgggcaggtgaatcaggagtaaaaactgcactaacaatagaagaggccaatggatcaaatgctctgtcatgggagtttggatatccagaggtgaaaccatctgacaactgggccacagcgcccagattagatttttggaaatccgatctcgttagaggagaaaatgattacgtcgccttcgatttctacttagatcctgtaagagcaacagaaggagcaatgaatataaatctagttttccagccaccaacaaacggatattgggtacaagcaccaaaaacatatacaattaattttgacgagttggaagaagcaaaccaagtcaacggcctataccattatgaagtaaaaatcaacgtacgagacataaccaacatacaagatgacacacttttacgtaatatgatgataatcttcgctgacgttgagtcagattttgcaggccgagtatttgtagataacgtaagatttgaaggtgcagctacaactgaaccagtagaacccgaaccagtggatccaggtgaagaaactcctccagttgatgagaaagaagcaaaaaaggagcaaaaagaagcagaaaaagaggaaaaagaagcagtcaaagaagaaaaaaaagaagctaaagaagaaaaaaaagcagtaaaaaatgaagcaaagaaaaaa

SEQ ID NO: 51385 - RNA, 2472 nt, synthetic construct
  misc_feature 1..2472: note = derived and/or modified sequence opt6 from anti-influenza_Chain
  source 1..2472: mol_type = other RNA
atgatgctccgaaaaaaaacaaaacaattaatctcaagtatattaatattagtattactattatcgttatttccagctgcactagcagctgaaggaaatacaagagaagataatttcaaacatcttttgggtaatgacaatgtaaaaaggccatcagaagctggagcacttcaattacaagaggtagatgggcaaatgactttagtagatcaacatggagaaaaaatacaactaagaggtatgagcacccatggcctacaatggttccctgaaatattaaatgacaacgcatataaggcactatcaaacgattgggactccaacatgattagactagcaatgtatgtaggagaaaatggatacgcaacgaacccagaattaataaaacaaagagtaatagatggtatcgaattagctatagaaaatgatatgtatgtaatagttgattggcatgtgcacgcacctggagatcctagagatcctgtatatgcaggagcgaaagatttcttcagggaaatagcagccttatatccaaataatccccatatcatatatgagctcgccaacgaaccatccagcaataacaacggaggagcaggaataccaaataatgaagaaggttggaaagcggtaaaagaatatgcagaccctatagtagaaatgctcagaaaatcaggcaatgcagacgacaacataataatagtcggatctccaaattggtcacagaggccagacctagcagctgataatccaatagacgaccatcacactatgtatacagtgcacttttatacaggtagccacgcagcatcaactgaaagctacccatcagaaaccccaaacagtgaaagaggcaacgtaatgtcaaacacaagatacgcactagaaaacggagtggcagtattcgctacagaatggggaacaagtcaagcatcaggagatggaggaccatatttcgacgaagcagatgtctggatagaatttcttaacgaaaacaatataagctgggcaaattggtcattaacaaataaaaacgaggtaagcggagcattcacaccatttgagttaggaaaatccaacgcgacaaacttagatccaggaccagaccacgtatgggcaccagaagagctaagtctctcaggagaatatgttcgcgctcgaataaaaggagtaaattacgaaccaatagatcgaacaaaatacacgaaagtactatgggactttaacgacggaactaaacaaggattcggagtaaattctgatagcccaaataaagaattaatagcagtagacaacgaaaataatactcttaaagtaagtggattagatgtgagtaacgatgttagcgacggcaacttctgggcaaatgcaaggttatcagcaaatgggtggggaaaaagtgttgatatattaggagcagaaaaactaacaatggacgtaattgtcgatgaaccaactacagtagcaatagcagcaatccctcaatcatcaaaaagcgggtgggcaaacccagaaagggccgtaagagtaaatgcagaagacttcgttcaacaaaccgatgggaaatataaagccggacttactataaccggagaagacgcacctaacctaaaaaatatagcttttcacgaagaagataataatatgaacaatataatcctgtttgtagggacagatgcagcagatgttatatatttagataatatcaaagtcatagggacagaagtagaaataccagttgtacacgacccaaaaggagaagcagtcttaccctcagtatttgaggacgggacgcgacaaggatgggactgggctggtgaaagtggcgtaaagacagctcttacaatagaagaagcaaatggctcaaatgctttatcatgggaattcggatacccagaagtaaaaccaagcgacaactgggcaacagcgccaagactagatttttggaaaagcgacctagtaagaggagagaatgattacgtagcatttgatttctatttagatccagtaagagcaacagaaggtgcaatgaacataaacctagtatttcaacccccaaccaacggatactgggtacaagcacctaaaacatacacaataaatttcgacgaattagaagaggcgaaccaagttaatggtttatatcattatgaagtaaaaataaatgtacgcgatataacaaatattcaagacgacacattattaagaaatatgatgataatatttgccgacgtagagtccgactttgcaggtagagttttcgttgacaatgtaaggtttgaaggtgcagcaactacagaacctgtagagccagaaccagtcgatcctggcgaggaaacaccaccagttgatgaaaaagaagcaaaaaaagaacaaaaagaggcagagaaagaagaaaaagaagcagttaaagaagaaaaaaaagaagctaaagaagaaaagaaagcagtaaaaaatgaagcaaaaaaaaaa

SEQ ID NO: 51386 - RNA, 3063 nt, synthetic construct
  misc_feature 1..3063: note = derived and/or modified sequence opt6 from anti-influenza_Chain
  source 1..3063: mol_type = other RNA
atggcaggtccgcacagatcaagagccgcaggaccacctcccttcgcagtggacgagcatgtagctctagagatggtcgcattcagaggagaagtttttgctggacatggacttctagcagatcagcgcttaatagcacataccggaagaccagcacttaacgcacaacgaataacacaacaaaaacaacgagaccagtgtagaggccaaagacaccgacatcaccaagggggtagaaacttgagaaaagcacatagaacgtttcacgaacatcaatcaactcaagatcaagcacatgatgccccacatggtcaacaagctaaaacaggacatgaaggactaggacacgaacatgctcaagctcaacaccaacaaggacaaagcaacgtagtagataggcaggatggagagcctgtagaagctcaacaccaaaaagatggagcacaaagagctggcaatgcaccagcaggtagagttgaactagagcaacaaccagttgaagcgcaacatcaacagcaagagggtgatgtaagaataggaaaaagaagacaaaacgcatttgctcctcctgctctagatcatgtccatggtggacctggaagactgcaacgtcacggattagcggtagaacgacacgtcccagcagtacaacaacaccagcaaagggtccagagaggcagacaacaaattgatcacgtgttaggacatggtttgcctggaaggcaaagattagcctttagagatggcccacgtagacctgtaggagtagcctcacctgttttaggacaaagaccatgtcctggtcatcggattgttcaaaacctttttagacacggaatcgacccatgtagagtgggtcgctgtcgaagatctccttcagagctacatggcatgggttgcgctgatgtacgagcacgagggcacggaagacatatgagaggacaaagagatgaacacccaggaagaggaagaccgtgtgctagaaggagacatgttgatgacgatcgagataggactccacaagagaagttatatgatgtagctagaggattagacgaaccagcgcgaagagtgcacttcgacgatgaagccgatagatcagtctttagaggactcgctcaacctgcaccagatgagccagaaggtagacgtagagatcgattagttttacaaagacaaagtgtaaatcatagaagaggaagattaagcagacaccgacaacaacatcaaccacaacaacaacgccctcacggtaatcaggcctttttgggaaaatatgagaaaagaagacgtaaaccaactgcttgcctgaaaagtctcagaagatttccagacaaggatgcaccggtattatattttgtaaatcaactagagaaaacaaagaggagaatgacactactattagtatggttaatatttactggagtagcaggggaaataagattagaagctgaagatggcgaactacttggtgtagctgttgatagtacactaacaggttactcgggtagaggatacgtaaccggctttgatgcaccagaagattctgtaaggtttagttttgaagctccacgtggtgtatatagagtagtattcggggttagtttttcatcaagatttgcatcttacgccttaagagttgatgattggcatcaaaccggctccctgattaaaagaggaggaggattctttgaagcatctataggagaaatctggcttgacgagggagcacacacaatggcatttcaactgatgaatggagcattggattatgtacgactagaacctgtttcatatggacctccagcaaggccaccagctcaactatcagatagtcaagcaaccgcctctgcacaagcactttttgcattcttattaagcgaatacggacgacatatacttgcaggacaacagcaaaacccatatagaagagattttgatgctataaattacgttagaaacgtaactggcaaagaacccgcgttggtatcgtttgatttaatcgattatagcccaaccagagaagctcatggcgtagtacactatcagacaccagaagattggatagcttgggcaggtagagatggaatagtctcacttatgtggcattggaatgctccaacagacttaatcgaggatccaagtcaagactgctactggtggtatggtttctatacacggtgcacaacctttgacgttgcagcagcattagcagacacatcatcagaaagatatcgattattattgagagatatagatgttatagcagcacagctccaaaaatttcaacaagctgatattccagtcttatggcgaccactacacgaagcagcaggaggttggttttggtggggagcaaaaggtcctgaaccattcaaacaattatggagattactatatgagaggcttgttcatcatcatgggttacataatttaatctgggtatacacacatgaacctggagctgcggaatggtatccaggggatgcgtacgtggatatcgtagggagggatgtatatgcagacgatcctgatgccctaatgcgatcagattggaatgaattacaaacattatttggaggaagaaaacttgtggcgctaacagaaactggaacactaccagacgtggaagtaataacagattacggaatatggtggagttggttttcaatttggacagaccccttcttgagagatgttgacccagatcgactgactcgtgtttatcattccgaaagagtattaacacgcgatgagcttccagattggcgttcctacgtattacatgcaacaacagtacagcctgcaggagacttagcactagctgtatacccgaatcctggagctggtcgattacatgtagaagtcggcttaccagtagcggcaccagtagtagtcgaggtatttaatctacttggacaaagggtgtttcaatatcaagccggtatgcagccagccggtttatggagaagggcattcgaattagcattagcaccaggagtataccttgtacaagtaagagcaggtaatcttgtagctagaaggagatgggtatccgtaaga

SEQ ID NO: 51387 - RNA, 3063 nt, synthetic construct
  misc_feature 1..3063: note = derived and/or modified sequence opt6 from anti-influenza_Chain
  source 1..3063: mol_type = other RNA
atggcaggaccacacaggtcacgagcagctggaccacctcccttcgcagtcgacgaacatgtggcattggaaatggtggcctttcggggagaagtatttgcaggacatggtttattagcagatcaaagattaatcgctcacacaggaagacctgccttaaacgcacaaagaattactcaacaaaaacaaagggaccaatgcaggggacaaagacatagacaccatcaaggcggaaggaatcttagaaaggcccatagaacttttcacgaacatcaaagtacacaagatcaagcacatgatgctccgcatggccaacaagcgaaaacaggacacgaaggccttggacacgaacatgcccaggcccaacatcaacaaggtcaaagtaacgtagtagatcgccaggatggagagccggttgaggcccagcatcagaaagatggtgctcaaagagctggtaatgcgcctgcaggacgggtagaactagaacaacaaccagtcgaagctcaacaccaacaacaagagggtgacgtacggatcggtaaaagaaggcaaaatgccttcgccccgccagcactcgatcatgttcatgggggaccaggacgcttacaaagacacggcttagctgtagaaagacatgtacccgctgtacagcaacatcaacaacgagtacaaagaggacgacaacagatagatcatgtattgggacatggattaccaggaaggcaaagattagcatttagagatggtcctaggagaccagtaggggtagcgtctcccgtcttagggcaaagaccctgtccagggcacagaatagtacaaaatttgtttcgtcacggtatagatccttgtagagtaggacgatgtcgaagatcaccaagtgagttacatggaatgggatgcgctgacgtaagggcaagaggtcacggtagacatatgagaggccaaagagatgaacatcctggcaggggaagaccgtgcgcaaggcgacgacacgttgatgacgatagagacagaacacctcaagaaaaattatatgatgttgctagaggtttagatgaaccagctcgaagagttcattttgatgacgaagcagatagaagtgtatttcgaggactcgcacagcctgctccagatgaacctgaaggaagacgaagagatcgcctagtattacaaagacaatcagtaaatcataggagaggcagactaagcagacatagacaacaacatcaaccacagcaacaacgaccacatggaaatcaagcattcttaggaaaatatgagaaaaggcgcagaaaaccaacagcttgtttgaaaagtttaagacgattcccagataaagatgctcccgttttatattttgtgaaccaactggagaaaaccaaaagacgaatgacactgctcctagtttggctaatatttacaggagttgctggggaaataagattggaagcagaagacggagaattgctaggtgtagccgtagattcaacattaacgggttactcaggaagaggatacgtaactggattcgatgcacctgaagactcagtaagattttcttttgaagcaccacgaggagtttatagagtagtttttggggtaagtttcagttctagatttgccagttatgctctccgagtagatgattggcatcagactggttctctaataaaaagaggaggtggattctttgaagcatccatcggggaaatttggcttgacgaaggagcccacacaatggcctttcagctaatgaatggggctttagattatgttaggctagaaccagtatcttatggacccccagcccgaccgccagctcaactatcagattctcaagcaacagcatcagctcaggctttatttgcatttttactcagcgaatatggaagacatatactagctggacaacaacaaaatccatatagacgagacttcgatgctataaactatgtacgtaatgtaactggaaaagaaccagcccttgtgtccttcgatctaatagactattcacctaccagagaagcacatggagttgtacattatcaaactccggaagattggatagcatgggcaggaagggatggaattgtatctctcatgtggcattggaacgcaccaacggatttgattgaagatccaagtcaagattgctattggtggtacggcttctatacaagatgtacaacattcgatgtcgcagcagcattagctgacacatcatctgagagataccggcttttactcagagatatagatgtaatcgctgcacaattacaaaaatttcaacaagctgacatacctgtactttggcggcctctacatgaggcagctggtggctggttctggtggggtgcaaaaggaccagaacctttcaaacaactatggagactactttatgaaaggttagtacaccaccacggtcttcacaatctaatctgggtatacacacatgaaccaggagctgcagaatggtatcctggagatgcatacgtcgatattgtgggccgagatgtgtacgcagatgatccagacgccttgatgagatcagactggaatgagctgcaaacgctatttggaggaagaaaattggtagccttaacagagacgggaacattaccagacgtagaagtaataacggattacggaatctggtggtcatggtttagtatatggactgacccctttcttagagatgtagatccagacagactcactagagtttatcacagtgaacgtgtattaaccagagatgaattaccagactggagatcatatgtactacatgcaacaaccgttcaacctgcgggtgatctagcattagctgtatacccaaatccaggcgcaggaagattacatgttgaagtcggattacctgtagcggctccggtcgtagtagaagtttttaaccttttaggccagagagtattccaataccaggctggtatgcagccagcaggattatggagacgcgcgtttgagttagctttggcaccaggtgtatatttggtacaagttagagcagggaatttagtagcaagacgacgatgggttagtgtaaga

SEQ ID NO: 51388 - RNA, 3165 nt, synthetic construct
  misc_feature 1..3165: note = derived and/or modified sequence opt6 from anti-influenza_Chain
  source 1..3165: mol_type = other RNA
atgaggaagaaacgacggggttttctaaatgcttctaccgctgttttagtgggtatccttgcaggattcctcggggtagtactagcagcaacaggagcgctaggattcgctgtacgtgaatcattattgttaaaacaattcttatttttgagctttgaaggaaacacagacggagccagtccattcggtaaagacgtggtcgtaacagcaagccaagacgttgctgcagatggtgaatactccttaaaagtagagaacagaacctcggtatgggacggagtggaaatagacttaaccggaaaagtaaacactggaacagattatctattatcttttcacgtatatcaaacaagcgacagcccacaactatttagtgtacttgccagaacagaggatgaaaaaggagaacgatataaaatacttgctgataaagtggtggtaccaaactactggaaagaaatattggtaccatttagtccaacgtttgaaggaacaccggcaaaatttagtttgataattacaagtccaaagaaaacagattttgtcttctacgtagataatgttcaagttttaacaccgaaagaagccgggcctaaagtcgtatacgaaacatcattcgagaaaggaataggtgattggcaaccaagaggaagtgacgtaaaaataagtataagccccaaagtagcacactctggaaagaaatctttatttgtaagtaatagacaaaaaggatggcacggagcacaaataagtctaaaaggtattttaaaaacaggcaaaacatacgcattcgaagcgtgggtctaccaagaatcagggcaagaccaaacaataataatgactatgcagagaaaatactcaagtgactcatcaactaaatacgaatggataaaagcagctaccgtcccttcaggacaatgggtacaactatcaggaacttacacaattccagcaggagtaaccgtagaagatctcacactatactttgaaagccaaaacccaacattagagttctacgtagatgatgttaaagtcgtggacacaacatcagcagaaataaaactagaaatgaatcctgaagaagaaataccagccctaaaggacgttttaaaagactattttagagtaggggttgcattaccatcaaaagttttcataaatcaaaaagatatagcattaatatcaaaacactccaattcatcaacagcagaaaacgaaatgaagcctgatagtttattagcaggaatagaaaacggaaaattaaaattcagattcgaaacagcagataaatatatcgaatttgctcaacaaaatgggatggtagttcgaggtcacaccctagtctggcataatcaaacaccagaatggtttttcaaggatgaaaatggaaacctacttagcaaagaagagatgacagaaagacttcgtgaatatattcatactgttgtaggacattttaaaggaaaagtttatgcgtgggatgtagtaaacgaagcagtagacccaaaccaacctgatggcttaagacgaagcacatggtatcaaattatgggtccagattatatagaactcgcattcaaatttgcgagagaagctgatccaaatgccaaattattctacaacgattacaatacattcgaaccaaagaaaagagacataatatataacttagttaaaagtttaaaagaaaaaggtctaatagacggcataggaatgcagtgtcacataagcctggctacggacatacgccaaattgaagaagcaataaagaaatttagtacaattccaggaatcgaaatacatataacagaattagatataagtgtatatagagactctacgtcaaactacagcgaagcacctcgaacagcattaattgaacaggctcataaaatggcacagctatttaaaatattcaagaaatactctaatgtaataacaaatgtaacgttctggggtttaaaagacgactactcatggcgtgcaacgcgaagaaacgactggccactaatatttgacaaagactaccaagcaaaacttgcatattgggcaattgtagcccctgaagtattacctccattaccaaaagaaagcaaaataagtgaaggagaggcagtagtagtaggaatgatggacgatagttatatgatgtcgaaacctattgaaatttacgacgaagaaggaaacgtaaaagcaacaataagagcaatctggaaagatagcacaatatatgtatacggagaagtccaagatgcgacgaagaaacccgcagaggatggagtagcaattttcataaatcctaataatgaaagaaccccatatcttcagccagacgatacatatgttgtactttggacaaactggaaatcagaagtgaatagagaagatgtagaagttaaaaagttcgttggaccaggattcaggagatatagctttgaaatgtcaataacaatccctggggtcgaatttaagaaagacagttatattggattcgacgtagcagtaatagacgatggaaaatggtactcatggtcagacactaccaattcacagaaaactaatacaatgaactatggtaccttaaaactcgaaggagtcatggtcgcaactgcaaaatacgggacaccagtcatagatggggaaatagacgatatatggaacacaacagaagaaattgaaacaaaatctgttgctatgggatcactcgagaaaaatgcaacagcaaaagtcagagtgttatgggatgaggaaaacttatatgttttagcaatcgtgaaagacccggtccttaacaaagataattccaatccatgggaacaagattctgtagaaatctttatagatgagaataatcataaaacaggatattacgaagacgatgatgcccaatttagagtaaactacatgaacgaacaatcttttggaacaggagcttctgcagctagattcaaaacagccgtaaaattaatagaaggtggatacattgtagaggcagccattaaatggaaaacaataaaaccaagtccaaataccgtcataggatttaatgtccaagtaaatgacgccaatgaaaaaggacaacgcgtaggaataataagctggtccgatccaacaaataattcttggagggacccctcaaaatttggcaatcttaggttaatcaaa

SEQ ID NO: 51389 - RNA, 3165 nt, synthetic construct
  misc_feature 1..3165: note = derived and/or modified sequence opt6 from anti-influenza_Chain
  source 1..3165: mol_type = other RNA
atgagaaaaaaacgaaggggttttttaaatgcatcaacagctgtactagtaggaatcctcgccggatttctaggagtagttctagccgctacaggagctctcggattcgcagtacgagaaagtcttctacttaaacaattcttattcctatcatttgaaggaaacacagacggagcttcaccttttggaaaagatgtagtagtaacagcaagccaagacgttgccgccgatggagaatattcattaaaagtcgaaaatcgaacatctgtctgggatggagttgagatagacttaacaggaaaagtaaacacaggaacggattacctattatcatttcacgtataccaaacttcagactctccacagttatttagtgtactcgccaggacagaagatgaaaaaggagaaagatataagatattagcagacaaagtagtagtaccaaattattggaaagaaatactagtaccttttagtcctacctttgaaggaacgccagccaaattcagtttaataataacatccccaaaaaaaactgacttcgtattttacgtcgacaatgtacaggttttaacaccaaaggaagcagggccaaaagtcgtatacgaaacatcattcgaaaaaggaataggcgattggcagcctaggggcagcgacgtaaaaatttcaataagccctaaagtagcacactcaggaaaaaaatctctctttgtttctaacagacaaaaaggttggcatggtgcccaaatatcattaaagggaatacttaaaacaggtaaaacgtacgcttttgaagcttgggtatatcaagagtctggacaagaccaaacaataattatgacaatgcaaagaaaatacagcagcgatagtagtactaaatatgaatggataaaagcagccacagtcccgagcggtcaatgggtccaattgtcaggtacatacacaataccagccggagtaacagtagaagatctaacattatacttcgaatcacaaaatccaactttagaattctatgtagatgacgtgaaagttgtagatacaacaagtgcagaaataaaactagaaatgaatccagaagaagagattcctgctttaaaagatgtattaaaagattacttcagggtcggagtagcgcttccttctaaagtttttataaatcaaaaagatattgcattaattagtaaacacagtaactcaagcactgccgaaaatgaaatgaaacctgactcattattagcaggaatagaaaacggaaaactaaaatttaggtttgaaacagcagacaaatatatagaattcgcacagcaaaacggaatggtagttagagggcataccttagtatggcacaatcaaactccggaatggttcttcaaagacgaaaatggtaatcttttatcaaaagaggaaatgaccgaaaggctccgagaatacatacataccgtagtcggacattttaaaggaaaagtttatgcatgggacgtcgtaaacgaagccgtagatccaaatcaaccggacggactacgtagatcaacatggtatcaaataatgggtccggactatatcgaactagcatttaaatttgcaagagaagctgatccaaatgcaaaattgttttataacgattataatacattcgaaccaaaaaaaagggatattatatataacttagttaagtcattgaaagaaaaaggcttgatagatggtataggaatgcaatgccatatcagtttagctacagatataagacaaatcgaagaagccataaaaaaatttagcactatcccaggaatagaaatacacataacagaactagacataagtgtatacagagactctacatctaattattcagaagctccacgaactgccttaatagaacaagctcataaaatggcacaactttttaaaatcttcaaaaagtattcaaacgtcatcacaaatgttacgttttggggactaaaagatgactattcctggagagctacaagacgaaatgattggcctttaatatttgacaaagattaccaagctaaacttgcctattgggccatagtggcacctgaagtactcccacctttaccaaaggaaagtaaaatatctgaaggtgaagcagtagtagtaggaatgatggatgactcatacatgatgtcaaaaccaatagaaatctatgatgaagagggtaatgttaaagcaactatcagagccatatggaaagactccacgatatatgtatacggcgaagtacaagatgcaacaaaaaaacctgccgaagatggcgtcgcaatatttataaatccgaacaatgaaagaacaccttatctccaaccagacgatacatatgtagttctgtggacaaattggaaaagtgaagtaaatagagaagacgttgaagtaaaaaaattcgttggaccgggtttcagacgttattcatttgaaatgtccataactataccaggagtagaattcaaaaaagatagttacataggatttgatgttgcggtgattgacgatggcaaatggtatagttggtccgacacaacaaacagccaaaaaacaaatacaatgaactatggaacattaaaactcgagggtgtaatggttgcaacagcaaaatatggaacacccgtgatagacggcgaaatagacgacatttggaatactaccgaggagatcgaaacaaaatctgttgcaatgggatctctagagaaaaacgctacagcaaaagttagggttctatgggacgaagaaaatttatacgttttagcaatcgtcaaagatccagttctaaataaagacaacagtaacccatgggaacaggattcggtagaaatatttatagatgaaaataatcataagacaggatattacgaagatgacgacgcgcaatttagagtaaattatatgaacgagcaatcatttggcacaggagcatcagcagcaagattcaaaacagcagtcaaactaatagagggagggtacatagtagaagcagcaattaaatggaaaaccattaaaccatcaccaaatacagtaataggtttcaacgtacaagtaaatgatgcaaatgaaaaaggtcaacgcgtaggaataatcagctggagtgacccaacaaataactcatggagagatcccagtaaatttggtaatttacgattaattaaa

SEQ ID NO: 51390 - RNA, 3177 nt, synthetic construct
  misc_feature 1..3177: note = derived and/or modified sequence opt6 from anti-influenza_Chain
  source 1..3177: mol_type = other RNA
atgcaagtacgaaaaagaagaggtcttttagacgtatcaaccgccgtattagttggaatactagccggcttccttggagttgtactagcagcatccggagtattaagtttcggaaaagaagcatcatcgaaaggagactcatccttagaaacagtattagcactaagtttcgaaggaacaacagaaggagtcgttccattcggaaaagatgtagtcttgacagcatcacaagacgtagcggcggatggagaatacagtttgaaagtagaaaatagaacatcaccttgggatggcgtagaaatagatttaacaggaaaggtcaaatcaggagcggactatcttctaagtttccaagtatatcaatcctcagacgcaccacaactattcaatgtcgtcgctagaacagaagacgaaaaaggagaaagatacgacgtaatactggacaaagtagtagtaagtgatcattggaaagaaattctagttcccttctctccaacatttgaaggaactcccgcaaaatattcactaattatcgttgcatctaaaaatacgaacttcaatttctacttagacaaagtacaagtactagcaccaaaagaatcaggacctaaagtaatatatgaaacttcatttgaaaatggagtaggagactggcaaccgcggggtgatgtaaacatagaggcttcatctgaagtagcacattctggaaaaagttcactattcataagtaacagacaaaaaggatggcaaggagcgcaaataaatctaaaaggtattttaaaaacaggtaagacatacgcctttgaggcctgggtataccagaatagtggacaagaccaaaccataataatgaccatgcagagaaaatatagctcagatgccagcacacaatacgaatggatcaaaagtgcaacagttccatctggccaatgggtacaactttccggtacttacacaattcccgccggtgtaactgttgaagaccttactttgtactttgaaagtcaaaacccaacattagaattttatgtcgatgatgtaaaaatagtagatacaacatcagcagaaataaaaattgaaatggaaccagaaaaagaaattcctgcacttaaggaagttctaaaagattatttcaaagtaggggttgcattaccttcaaaagtgttcttgaatcctaaagatatcgaactaataacaaaacattttaactcaatcacggctgaaaatgaaatgaaaccagaatcattattagcaggaatagagaacggaaaactaaaatttcgattcgaaacagcagataaatacattcaatttgttgaagaaaacggtatggtaattagaggacacacattagtctggcacaaccaaactccagactggtttttcaaggacgaaaatggaaacttactatcaaaagaagcgatgacagaacgtttgaaagaatatatacatacagtggttggacactttaaaggtaaagtatacgcgtgggatgtcgtaaacgaagcagtagatccaaaccaacccgatggcttaaggagaagtacatggtatcagatcatgggaccagactatattgaactagcgtttaaatttgcaagagaagctgatcccgacgcaaaactcttttataacgattataatacatttgaaccgcgaaaaagagatataatatacaatctagtgaaagatttaaaagagaaaggattaatagacggaattggaatgcaatgtcatatctctttggcaaccgatatcaaacaaatcgaagaagcgatcaagaaattctcaacaataccaggaattgaaattcacattactgaattagacatgagcgtatatcgagattcatcaagtaattacccagaagctccaagaactgctttgattgaacaagcgcacaaaatgatgcaattatttgaaatatttaagaaatattcaaatgtgataacaaacgtaacattttggggattaaaagatgactactcatggcgagcgacaagaagaaatgattggcccttaatatttgataaagatcatcaagctaaactagcatattgggcaatagtggcaccggaagtgctaccacctctaccaaaagaatcacgcatatctgaaggagaagcagtagttgtaggaatgatggacgactcatatttaatgagcaaacctatagaaatattagacgaagaaggaaatgtaaaagcaactattagagctgtatggaaagattcaactatatacatctatggagaggtgcaagacaaaacaaagaaaccagccgaagatggagtagctatctttataaatccaaataatgagagaactccatatttacaaccagatgatacttacgctgtactatggacaaactggaaaaccgaagtaaatagagaagacgtacaagtaaagaaatttgtgggaccaggcttcagaagatatagttttgagatgtctataactataccaggagttgaatttaagaaagatagttatattggttttgatgcagctgtaatagatgacggaaaatggtatagctggtccgacaccacaaacagccagaaaacaaacacaatgaattatgggactttaaaattagaaggaataatggtggcaactgcaaaatatggaacaccagtcatagatggtgaaatagatgaaatatggaatacaaccgaagagattgaaactaaagctgtagcgatgggtagcctagataaaaatgcaaccgcaaaagtacgagtactatgggatgaaaactatctatatgtacttgcaatcgtaaaagacccagttctcaataaagacaatagcaatccatgggaacaagatagcgtcgaaatttttatagatgaaaataaccacaaaacaggatactacgaagatgacgatgcacaatttagagtaaattatatgaatgaacaaacatttggcacaggtggaagcccagcaaggtttaaaacagcagtaaaactaattgaagggggttatattgtcgaagcagcaataaaatggaaaacaattaaaccaacccctaatacagtaatcggatttaatatacaagtaaatgatgcaaacgaaaaaggacaaagagtaggcattataagttggagtgatcccactaacaactcatggcgtgatccatcaaaatttggaaatcttcgtctaatcaaa

SEQ ID NO: 51391 - RNA, 3177 nt, synthetic construct
  misc_feature 1..3177: note = derived and/or modified sequence opt6 from anti-influenza_Chain
  source 1..3177: mol_type = other RNA
atgcaagtcagaaaacggagaggactactagatgtaagtacagcagttttagtgggaatactagctggcttccttggagtagttttagcagcatcaggagtcctttccttcggaaaagaagcatcaagtaaaggtgactccagtctcgaaacagttctagcattgtcatttgaaggaacaactgaaggagtggtccctttcggaaaagatgtagtcctaacagcaagtcaagatgtcgcagctgatggagaatatagcttaaaagtagagaacagaacaagtccatgggacggcgtagaaatcgatttaacaggaaaagtaaaaagcggagcagactacttattgtcattccaagtatatcaaagcagtgatgcaccacaactattcaatgtagttgcaagaactgaagatgagaagggagaaagatacgatgtcatattagacaaagtcgttgtgagcgaccattggaaagagatactcgtaccattttccccaacatttgaaggaacacccgctaaatattctctaatcatagtcgcatctaaaaatacaaattttaacttttatctagataaagttcaagtacttgccccaaaagaatcaggtccaaaagtcatttatgaaacatcatttgaaaatggcgtcggagattggcaaccacgaggtgacgtaaatatagaagctagttcagaagtagcacactccggaaaatcatccttatttatcagtaatcggcaaaaaggatggcaaggagcacaaatcaaccttaagggaatactcaaaaccggaaaaacctatgcgtttgaggcttgggtgtatcaaaactctgggcaagaccaaacaataatcatgaccatgcaaagaaaatatagttcagatgcatcaacgcaatatgaatggataaaaagtgctacagtcccaagtggacaatgggtacagctaagtggtacatataccataccagcaggcgttactgtcgaagatttaacattatatttcgaatcacaaaatccaacattagaattttatgtagatgacgtaaaaatagtagacacaacttctgctgaaataaaaatagaaatggaaccagaaaaagaaatccctgcactcaaagaagtcttgaaagattacttcaaagtaggagtagcactaccttcaaaagtatttctaaacccaaaggatattgaattaataacaaaacatttcaactcaataactgcagaaaatgaaatgaaaccagaatctttgctagcaggcatagaaaacggaaaacttaaattcagatttgaaaccgccgacaaatacatacagtttgtcgaagaaaatggtatggtaataagaggacacactctagtatggcataatcaaacaccagattggtttttcaaagatgaaaatggaaacttactatcaaaagaagcaatgacagaaagactaaaagaatatatacacacagttgttggccacttcaaaggcaaggtatatgcatgggatgtagtcaatgaagctgtagacccaaaccagcccgacggattacgaagaagcacatggtatcaaatcatgggaccagattacatagagttagcatttaaattcgcacgagaagctgaccctgatgccaaactcttttataatgattataataccttcgaacctagaaaaagagatataatatacaacttagtgaaagatctaaaggaaaaaggattaatcgacggaataggaatgcaatgtcatataagtttagcaacagacataaaacaaatagaagaagcaattaagaaattcagtacaataccgggaatcgaaattcacattacagaattggatatgtcagtttatagagatagcagcagtaattacccagaagctccgcgaaccgcattaatagagcaagcacataaaatgatgcaacttttcgagatatttaagaaatattctaatgtcatcacaaatgtgactttttggggattaaaagacgactatagctggagagcaaccaggaggaatgattggccactaatattcgataaagatcatcaagcaaaattagcgtattgggcaatagtcgcacctgaagttttaccaccactaccaaaagaaagtagaataagtgaaggagaagctgtagtagttggaatgatggacgattcataccttatgtctaaaccaatagaaattttggatgaggaaggaaacgtaaaagccacaatacgagctgtttggaaagactcaactatatatatttacggagaagtacaagacaaaactaagaaaccagcagaagatggtgtagccatattcataaacccgaataatgagagaacaccttatttgcaaccggatgacacatacgcagttttatggacaaattggaaaacagaggtcaatagagaggatgtacaggtaaagaaatttgtaggtccaggttttagacgttatagcttcgaaatgagcataacaatacctggagttgaatttaagaaagattcatatataggatttgatgcagcggtaatagatgatggtaaatggtatagttggtctgatacaactaactcccagaaaacaaatacaatgaactatggtactttaaaactagaaggaataatggtagcaacagctaaatacggtacccctgtaatagacggagaaatagatgaaatttggaatacaacagaagagatagaaactaaagcggtagcaatgggctcattagataaaaacgcaacagctaaagttagagtattatgggatgaaaattacctctatgtattagcaattgtaaaagatccagtacttaataaagacaattcaaacccatgggaacaagacagtgtagaaatttttatagatgaaaacaatcataaaacaggatattatgaagatgacgacgcacaatttagagtgaattatatgaacgagcaaacatttggaacaggaggaagtccagcacgattcaaaactgcagtaaaactaatagaaggaggttacattgtagaagcagctatcaaatggaaaacaataaaacctacaccaaatacagtcataggctttaatattcaagtcaacgatgcaaacgaaaaaggtcaaagagtcggaataatcagttggtcagatccaactaacaatagttggagggatccctcaaaatttggaaatctaagactaataaaa

SEQ ID NO: 51392 - RNA, 318 nt, synthetic construct
  misc_feature 1..318: note = derived and/or modified sequence opt6 from anti-OX40_LightChain
  source 1..318: mol_type = other RNA
gaaatagtagtaacacaatcaccagcaacactatcactatcaccaggagaaagagcaacactatcatgcagagcatcacaatcagtatcatcatacctagcatggtaccaacaaaaaccaggacaagcaccaagactactaatatacgacgcatcaaacagagcaacaggaataccagcaagattctcaggatcaggatcaggaacagacttcacactaacaatatcatcactagaaccagaagacttcgcagtatactactgccaacaaagatcaaactggccaacattcggacaaggaacaaaagtagaaataaaa

SEQ ID NO: 51393 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaaggaatatcatcatggctagcatggtaccaacaaaaaccagaaaaagcaccaaaatcactaatatacgcagcatcctcactacaatcaggagtaccatcaagattctcaggatcaggatcaggaacagacttcacactaacaatatcatcactacaaccagaagacttcgcaacatactactgccaacaatacaactcatacccaccaacattcggaggaggaacaaaagtagaaataaaa

SEQ ID NO: 51394 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaacaaggacacacactaccaccaacattcggacaaggaacaaaagtagaaataaaa

SEQ ID NO: 51395 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaaacagtaaaactactaatatactacacatcaagactaagatcaggagtaccatcaagattctcaggatcaggatcaggaacagacttcacactaacaatatcatcactacaaccagaagacttcgcaacatactactgccaacaaggacacacactaccaccaacattcggacaaggaacaaaagtagaaataaaa

SEQ ID NO: 51396 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaaacagtaaaattactaatatactacacatcaagactaagatcaggagtaccatcaagattctcaggatcaggatcaggaaaagactacacactaacaatatcatcattacaaccagaagacttcgcaacatacttctgccaacaaggacacacattaccaccaacattcggacaaggaacaaaagtagaaataaaa

SEQ ID NO: 51397 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccctcaagattctcaggatcaggatcaggaacagacttcacactaacaatatcatcactacaaccagaagacttcgcaacatactactgccaacaaggacacacactaccagcaacattcggacaaggaacaaaagtagaaataaaa

SEQ ID NO: 51398 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaacaaggacacacagcaccaccaacattcggacaaggaacaaaagtagaaataaaa

SEQ ID NO: 51399 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacttaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaacaaggagcaacactaccaccaacattcggacaaggaacaaaagtagaaataaaa

SEQ ID NO: 51400 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactattaatatactacacatcaagactaagatcaggagtaccatccagattctcaggatcaggatcaggaacagacttcacactaacaatatcatcactacaaccagaagacttcgcaacatactactgccaacaaggacacgcactaccaccaacattcggacaaggaacaaaagtagaaataaaa

SEQ ID NO: 51401 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaacaagcacacacattaccaccaacattcggacaaggaacaaaagtagaaataaaa

SEQ ID NO: 51402 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcattatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaacaaggacacacactagcaccaacattcggacaaggaacaaaagtagaaataaaa

SEQ ID NO: 51403 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaactactaatatactacacatcaagactaagatcaggagtaccatcaagattctcaggatcaggatcaggaacagacttcacactaacaatatcatcactacaaccagaagacttcgcaacatactactgccaagcaggacacacactaccaccaacatttggacaaggaacaaaagtagaaataaaa

SEQ ID NO: 51404 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcaccaaaattactaatatactacacatcaaaactacactcaggagtaccatcaagattctcaggatcaggatcaggaacagactacacactaacaatatcatcactacaaccagaagacttcgcaacatactactgccaacaaggatcagcactaccatggacattcggacaaggaacaaaagtagaaataaaa

SEQ ID NO: 51405 - RNA, 321 nt, synthetic construct
  misc_feature 1..321: note = derived and/or modified sequence opt6 from anti-OX40_LightChain
  source 1..321: mol_type = other RNA
gacatacaaatgacacaatcaccatcatcactatcagcatcagtaggagacagagtaacaataacatgcagagcatcacaagacatatcaaactacctaaactggtaccaacaaaaaccaggaaaagcagtaaaactactaatatactacacatcaaaactacactcaggagtaccatcaagattctcaggatcaggatcaagaacagactacacactaacaatatcatcactacaaccagaagacttcgcaacatactactgccaacaaggatcagcactaccatggacattcggacaaggaacaaaagtagaaataaaa

SEQ ID NO: 51406 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggagactcaagttataaccaaaaatttagagaaagagtaacaataacaagagacacaagcacaagcacagcatatctagaactatcaagcttaagatcagaagatacagcagtatattactgtgtattagcaccaagatggtactttagcgtatggggacaaggaacattagtaacagtatcaagt

SEQ ID NO: 51407 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggagactcaagttataatcaaaaatttagagaaagagtaacaataacagtagacacaagtacaagcacagcatatctagaactatcaagcttaagatcagaagatacagcagtatattactgtgtattagcaccaagatggtactttagtgtatggggacaaggaacattagtaacagtatcaagc

SEQ ID NO: 51408 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggagactcaagctataaccaaaaatttagagaaagagtaacattaacagtagacacaagcacaagcacagcatatctagaactatcaagcttaagatcagaagatacagcagtatattactgtgtattagcaccaagatggtactttagcgtatggggacaaggaacattagtaacagtatcaagc

SEQ ID NO: 51409 - RNA, 351 nt, synthetic construct
  misc_feature 1..351: note = derived and/or modified sequence opt6 from anti-OX40_HeavyChain
  source 1..351: mol_type = other RNA
gaagtacaactagtacaaagcggagcagaagtaaaaaaaccaggagcaagcgtaaaagtaagctgtaaagcaagcggatacacattcacagacgcatacatgagctgggtaagacaagcaccaggacaaggactagaatggataggagatatgtatccagataacggagactcaagctataaccaaaaatttagagaaagagtaacaataacaagagacacaagtacaagtacagcatatctagaactatcaagcttaagatcagaagatacagcagtatattactgtgtattagcaccaagatggtactttagcgtatggggacaaggaacattagtaacagtatcaagc

SEQ ID NO: 51410 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagaatcatacatgagctgggtaagacaagcaccaggacaaggactagaatggataggagatatgtatccagataacggagactcaagctataaccaaaaatttagagaaagagtaacaataacaagagacacaagcacaagcacagcatatctagaactatcaagcttaagatcagaagatacagcagtatattactgtgtattagcaccaagatggtactttagcgtatggggacaaggaacattagtaacagtatcaagt

SEQ ID NO: 51411 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagtggagcagaagtaaaaaaaccaggagcaagcgtaaaagtaagctgtaaagcaagcggatacacattcacagactcgtacatgagttgggtaagacaagcaccaggacaaggactagaatggataggagatatgtatccagataacgcagactcgagttataaccaaaaatttagagaaagagtaacaataacaagagacacaagcacaagtacagcatatctagaactatcaagcttaagatcagaagatacagcagtatattactgtgtattagcaccaagatggtactttagcgtatggggacaaggaacattagtaacagtatcaagc

SEQ ID NO: 51412 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacgcagacgcaagttataaccaaaaatttagagaaagagtaacaataacaagagacacaagcacaagcacagcatatctagaactatcaagcctaagatcagaagatacagcagtatattactgtgtattagcaccaagatggtactttagtgtatggggacaaggaacattagtaacagtatcaagc

SEQ ID NO: 51413 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagttgggtaagacaagcaccaggacaaggattagaatggataggagatatgtatccagataacggagacgcaagctataaccaaaaatttagagaaagagtaacaataacaagagacacaagcacaagcacagcatatctagaactatcaagcttaagatcagaagatacagcagtatattactgtgtattagcaccaagatggtactttagcgtatggggacaaggaacattagtaacagtatcaagc

SEQ ID NO: 51414 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggattagaatggataggagatatgtatccagatagcggagactcaagctataaccaaaaatttagagaaagagtaacaataacaagagacacaagcacaagcacagcatatctagaactatcaagcttgagatcagaagatacagcagtatattactgtgtattagcaccaagatggtactttagcgtatggggacaaggaacattagtaacagtatcaagc

SEQ ID NO: 51415 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggaagctcaagctataaccaaaaatttagagaaagagtaacaataacaagggacacaagcacaagcacagcatatttagaactatcaagcttaagatcagaagatacagcagtatattactgtgtattagcaccaagatggtactttagcgtatggggacaaggaacattagtaacagtatcaagc

SEQ ID NO: 51416 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagacgcatacatgagctgggtaagacaagcaccaggacaaggactagaatggataggagatatgtatccagataacgcagacgcaagctataaccaaaaatttagagaaagagtaacaataacaagagacacaagcacaagcacagcatatctagaactatcaagcttaagatcagaagatacagcagtatattactgtgtattagcaccaagatggtactttagcgtatggggacaaggaacattagtaacagtatcaagc

SEQ ID NO: 51417 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggagactcaagctataaccaaaaatttagagaaagagtaacaataacaagagacacaagtacaagcacagcatatctagaactatcaagcttaagatcagaagatacagcagtatattactgtgtattagcaccaagatggtactttagcgcatggggacaaggaacattagtaacagtatcaagt

SEQ ID NO: 51418 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacatttacagactcatacatgagctgggtaagacaagcaccaggacaaggactagaatggataggagatatgtatccagataacggagactcaagctataatcaaaaatttagagaaagagtaacaataacaagagacacaagcacaagcacagcatatctagaactaagtagtttaagatcagaagatacagcagtatattactgtgtattagcaccaagatggtattttgcagtatggggacaaggaacattagtaacagtatcaagt

SEQ ID NO: 51419 - RNA, 351 nt, synthetic construct
  misc_feature 1..351: note = derived and/or modified sequence opt6 from anti-OX40_HeavyChain
  source 1..351: mol_type = other RNA
gaagtacaactagtacaatcaggagcagaagtaaaaaaaccaggagcatcagtaaaagtatcatgcaaagcatcaggatacacattcacagactcatacatgtcatgggtaagacaagcaccaggacaaggactagaatggataggagacatgtacccagacaacggagactcatcatacaaccaaaaattcagagaaagagtaacaataacaagagacacatcaacatcaacagcatacttagaactatcatcactaagatcagaagacacagcagtatactactgcgcactagcaccaagatggtacttctcagtatggggacaaggaacactagtaacagtatcatca

SEQ ID NO: 51420 - RNA, 351 nt, synthetic construct
  misc_feature 1..351: note = derived and/or modified sequence opt6 from anti-OX40_HeavyChain
  source 1..351: mol_type = other RNA
gaagtacaattagtacaaagcggagcagaagtaaaaaaaccaggagcaagcgtaaaagtaagctgtaaagcaagcggatacacattcacagactcatacatgagctgggtaagacaagcaccaggacaaggactagaatggataggagatatgtatccagataacggagattcaagctataaccaaaaatttagagaaagagtaacaataacaagagacacaagcacaagcacagcatatttagaactatcaagcttaagatcagaagatacagcagtatattactgtgtagcagcaccaagatggtactttagcgtatggggacaaggaacattagtaacagtatcaagt

SEQ ID NO: 51421 - RNA, 354 nt, synthetic construct
  misc_feature 1..354: note = derived and/or modified sequence opt6 from anti-OX40_HeavyChain
  source 1..354: mol_type = other RNA
gaagtacaattagtagaaagtggaggaggattagtacaaccaggagggagtttaagattaagttgtgcagcaagtggatttacattttcaagttatagtatgaattgggtaagacaagcaccaggaaaaggattagaatgggtaagttatataagtagtagtagttcaacaatagattatgcagatagtgtaaaaggaagatttacaataagcagagataatgcaaaaaatagtttatatttacaaatgaatagtttaagagatgaagatacagcagtatattattgtgcaagagaaagtggatggtatttatttgattattggggacaaggaacattagtaacagtaagtagt

SEQ ID NO: 51422 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattctcatcaggatactggaactggataagacaacacccaggaaaaggactagaatggataggatacatatcatacaacggaataacataccacaacccatcactaaaatcaagaataacaataaacccagacacatcaaaaaaccaattctcactacaactaaactcagtaacaccagaagacacagcagtatactactgcgcaagatacagatacgactacgacggaggacacgcaatggactactggggacaaggaacactagtaacagtatcatca

SEQ ID NO: 51423 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccaagtcaaacactatcactaacatgcgcagtatacggaggatcattctcatcaggatactggaactggataagaaaacacccaggaaaaggactagaatggataggatacatatcatacaacggaataacataccacaacccatcactaaaatcaagaataacaataaacagagacacatcaaaaaaccaattctcactacaactaaactcagtaacaccagaagacacagcagtatactactgcgcaagatacagatacgactacgacggaggacacgcaatggactactggggacaaggaacactagtaacagtatcatca

SEQ ID NO: 51424 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggagactcattctcatcaggatactggaactggataagaaaacacccaggaaaaggactagaatacatgggatacatatcatacaacggaataacataccacaacccatcactaaaatcaagaataacaataaacagagacacatcaaaaaaccaatactcactacaactaaactcagtaacaccagaagacacagcagtatacttctgcgcaagatacagatacgactacgacggaggacacgcaatggactactggggacaaggaacactagtaacagtatcatca

SEQ ID NO: 51425 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggagactcattctcatcaggatactggaactggataagaaaacacccaggaaaaggactagaatacataggatacatatcatacaacggaataacataccacaacccatcactaaaatcaagaataacaataaacagagacacatcaaaaaaccaatactcactacaactaaactcagtaacaccagaagacacagcagtatacttctgcgcaagatacagatacgactacgacggaggacacgcaatggactactggggacaaggaacactagtaacagtatcatca

SEQ ID NO: 51426 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggagacagcttctcatcaggatactggaactggataagaaaacacccaggaaaaggactagaatacataggatacatatcatacaacggaataacataccacaacccatcactaaaatcaagaataacaataaacagagacacatcaaaaaaccaattctcactacaactaaactcagtaacaccagaagacacagcagtatacttctgcgcaagatacagatacgactacgacggaggacacgcaatggactactggggacaaggaacactagtaacagtatcatca

SEQ ID NO: 51427 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggagactcattctcatcaggatactggaactggataagaaaacacccaggaaaaggattagaatacataggatacatatcatacaacggaataacataccacaacccatcactaaaatcaagaataacaataaacagagacacatcaaaaaaccaatactcactacaattaaattcagtaacaccagaagacacagcagtatactactgcgcaagatacagatacgactacgacggaggacacgcaatggactactggggacaaggaacattagtaacagtatcatca

SEQ ID NO: 51428 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggattagtaaaaccatcacaaacactatcactaacatgcgcagtatacggagactcattctcatcaggatactggaactggataagaaaacacccaggaaaaggactagaatacataggatacatatcatacaacggaataacataccacaacccatcactaaaatcaagaataacaataaacagagacacaagcaaaaaccaattctcactacaactaaactcagtaacaccagaagacacagcagtatactactgcgcaagatacagatacgactacgacggaggacacgcaatggactactggggacaaggaacattagtaacagtatcatca

SEQ ID NO: 51429 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattcagctcaggatactggaactggataagaaaacacccaggaaaaggattagaatacataggatacatatcatacaacggaataacataccacaacccatcactaaaatcaagaataacaataaacccagacacatcaaaaaaccaatactcactacaactaaactcagtaacaccagaagacacagcagtatacttctgcgcaagatacagatacgactacgacggaggacacgcaatggactactggggacaaggaacactagtaacagtatcatca

SEQ ID NO: 51430 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccaagccaaacactatcactaacatgcgcagtatacggaggatcattctcatcaggatactggaactggataagaaaacacccaggaaaaggactagaatacataggatacatatcatacaacggaataacataccacaacccatcactaaaatcaagaataacaataaacagagacacatcaaaaaaccaatactcactacaactaaactcagtaacaccagaagacacagcagtatacttctgcgcaagatacagatacgactacgacggaggacacgcaatggactactggggacaaggaacactagtaacagtatcatca

SEQ ID NO: 51431 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggcggatcattctcatcaggatactggaactggataagaaaacacccaggaaaaggactagaatacataggatacatatcatacaacggaataacataccacaacccatcactaaaatcaagaataacaataaacagagacacatcaaaaaaccaatactcactacaactaaactcagtaacaccagaagacacagcagtatactactgcgcaagatacagatacgactacgacggaggacacgcaatggactactggggacaaggaacactagtaacagtatcatca

SEQ ID NO: 51432 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattctcatcaggatactggaactggataagaaaacacccaggaaaaggactagaatacataggatacatatcatacaacggaataacataccacaacccatcactaaaaagcagaataacaataaacccagacacatcaaaaaaccaatactcactacaactaaactcagtaacaccagaagacacagcagtatactactgcgcaagatacagatacgactacgacggaggacacgcaatggactactggggacaaggaacactagtaacagtatcatca

SEQ ID NO: 51433 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcattaacatgcgcagtatacggaggatcattctcatcaggatactggaactggataagaaaacacccaggaaaaggactagaatacataggatacatatcatacaacgcaataacataccacaacccatcactaaaatcaagaataacaataaacagagacacatcaaaaaaccaatactcactacaactaaactcagtaacaccagaagacacagcagtatactactgcgcaagatacaaatacgactacgacgcaggacacgcaatggactactggggacaaggaacactagtaacagtatcatca

SEQ ID NO: 51434 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggcctagtaaaaccatcacaaacactatcactaacatgcgcagtatacggaggatcattctcatcaggatactggaactggataagaaaacacccaggaaaaggactagaatacataggatacatatcatacaacgcaataacataccacaacccatcactaaaatcaagaataacaataaacagagacacaagcaaaaaccaatactcactacaactaaactcagtaacaccagaagacacagcagtatactactgcgcaagatacagatacgactacgacggaggacacgcaatggactactggggacaaggaacattagtaacagtatcatca

SEQ ID NO: 51435 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattctcatcaggatactggaactggataagaaaacacccaggaaaaggactagaatacataggatacatatcatacaacggaataacataccacaacccatcactaaaatcaagaataacaataaacagagacacatcaaaaaaccaatactcactacaactaaactcagtaacaccagaagacacagcagtatactactgcgcaagatacaaatacgactacgacggaggacacgcaatggactactggggacaaggaacactagtaacagtatcatca

SEQ ID NO: 51436 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattctcatcaggatactggaactggataagaaaacacccaggaaaaggactagaatacataggatacatatcatactcaggaataacataccacaacccatcactaaaatcaagaataacaataaacagagacacatcaaaaaaccaatactcactacaactaaactcagtaacaccagaagacacagcagtatactactgcgcaagatacagatacgactacgacggaggacacgcaatggactactggggacaaggaacactagtaacagtatcatca

SEQ ID NO: 51437 - RNA, 363 nt, synthetic construct
  misc_feature 1..363: note = derived and/or modified sequence opt6 from anti-OX40_HeavyChain
  source 1..363: mol_type = other RNA
caagtacaactacaagaatcaggaccaggactagtaaaaccatcacaaacactatcactaacatgcgcagtatacggaggatcattctcatcaggatactggaactggataagaaaacacccaggaaaaggactagaatacataggatacatatcatacagcggaataacataccacaacccaagcctaaaatcaagaataacaataaacagagacacatcaaaaaaccaatactcactacaactaaactcagtaacaccagaagacacagcagtatactactgcgcaagatacaaatacgactacgacggaggacacgcaatggactactggggacaaggaacactagtaacagtatcatca

SEQ ID NO: 51438 - RNA, 363 nt, synthetic construct
  misc_feature 1..363: note = derived and/or modified sequence opt6 from anti-OX40_HeavyChain
  source 1..363: mol_type = other RNA
gaagtacaactacaagaatcaggaccatcattagtaaaaccatcacaaacactatcactaacatgctcagtaacaggagactcattcacatcaggatactggaactggataagaaaattcccaggaaacagactagaatacatgggatacatatcatacaacgcaataacataccacaacccatcactaaaatcaagaatatcaataacaagagacacatcaaaaaaccactactacctacaactaaactcagtaacaacagaagacacagcaacatacttctgcgcaagatacagatacgactacgacggaggacacgcaatggactactggggacaaggaacactagtaacagtttcatca

SEQ ID NO: 51439 - RNA, 363 nt, synthetic construct
  misc_feature 1..363: note = derived and/or modified sequence opt6 from anti-OX40_HeavyChain
  source 1..363: mol_type = other RNA
caagtacaattacaagaatcaggaccaggactagtaaaaccatcacaaacactatcactaacatgcgcagtatacggaggatcattctcatcaggatactggaattggataagaaaacacccaggaaaaggactagaatacataggatacatatcatacaacgcaataacataccacaacccatcactaaaatcaagaataacaataaacagagacacatcaaaaaaccaatactcactacaactaaactcagtaacaccagaagacacagcagtatactactgcgcaagatacaaatacgactacgacggaggacacgcaatggactactggggacaaggaacactagtaacagtatcatca

SEQ ID NO: 51440 - RNA, 372 nt, synthetic construct
  misc_feature 1..372: note = derived and/or modified sequence opt6 from anti-OX40_HeavyChain
  source 1..372: mol_type = other RNA
gaagtacaattagtagaaagtggaggaggattagtacaaccaggaagaagtttaagattaagttgtgcagcaagtggatttacatttgatgattatgcaatgcattgggtaagacaagcaccaggaaaaggattagaatgggtaagcggaataagttggaatagtggaagtataggatatgcagatagtgtaaaaggaagatttacaataagtagagataatgcaaaaaatagcttatatttacaaatgaatagtttaagggcagaagatacagcattatattattgtgcaaaagatcaaagtacagcagattattatttttattatggaatggatgtatggggacaaggaacaacagtaacagtaagtagt

SEQ ID NO: 51441 - RNA, 381 nt, synthetic construct
  misc_feature 1..381: note = derived and/or modified sequence opt6 from anti-OX40_LightChain
  source 1..381: mol_type = other RNA
atggaaacaccagcacaactactatttctactactattatggttaccagatacaacaggagaaatagtactaacacaatcaccaggaacattaagtttaagcccaggagaaagagcaatattaagctgtagagcaagtcaaagcgtaagttcaagttttctagcatggtatcaacaaaaaccaggacaagcaccaagattactaatatacggagcatttagcagagcaacaggaataccagatagatttagcggaagcggaagtggaacagatttcacactaacaatatcaagattagaaccagaagatttcgcagtatattactgtcaacaatacgatagttcaagaacattcggacaaggaacaaaagtagaaataaaa

SEQ ID NO: 51442 - RNA, 381 nt, synthetic construct
  misc_feature 1..381: note = derived and/or modified sequence opt6 from anti-OX40_LightChain
  source 1..381: mol_type = other RNA
atggaagcaccagcacaactactatttctactactactatggttaccagacacaacaggagaaatagtactaacacaatcaccagcaacactatcactatcaccaggagaaagagcaacactatcatgcagagcatcacaaggagtatcatcatatctagcatggtaccaacaaaaaccaggacaagcaccaagactactaatatacgacgcatcaaacagagcaacaggaataccagcaagattctcaggatcaggaccaggaacagactttacactaacaataagttcattagaaccagaagacttcgcagtatactactgccaacaaagatcaaactggcacccaacattcggacaaggaacaaaagtagaaataaaa

SEQ ID NO: 51443 - RNA, 381 nt, synthetic construct
  misc_feature 1..381: note = derived and/or modified sequence opt6 from anti-OX40_LightChain
  source 1..381: mol_type = other RNA
atggaagcaccagcacaactactattcttactactactatggttaccagacacaacaggagaaatagtactaacacaatcaccagcaacactatcattatcaccaggagaaagagcaacactatcatgcagagcatcacaatcagtatcatcatacctagcatggtaccaacaaaaacccggacaagcaccaagactactaatatacgacgcatcaaacagagcaacaggaataccagcaagattctcaggatcaggatcaggaacagacttcacactaacaatatcctcactagaacccgaagacttcgcagtatactactgccaacaaagatcaaactggccaataacattcggacaaggaaccagactagaaataaaa

SEQ ID NO: 51444 - RNA, 387 nt, synthetic construct
  misc_feature 1..387: note = derived and/or modified sequence opt6 from anti-OX40_LightChain
  source 1..387: mol_type = other RNA
atggaaacaccagcacaattactatttctactactattatggctaccagacacaacaggagaaatagtactaacacaatcaccaggaacactatcattatcaccaggagaaagagcaacattatcatgcagagcatcacaatcagtatcatcatcatacctagcatggtatcaacaaaaaccaggacaagcaccaagactactaatatacggagcatcatcaagagccacaggaataccagacagattctcaggatcaggatcaggaacagatttcacattaacaatatcaagactagaaccagaagacttcgccgtatattactgtcaacaatacgactcatcactaacattcggaggaggaacaaaagtagaaataaaacgaaca

SEQ ID NO: 51445 - RNA, 390 nt, synthetic construct
  misc_feature 1..390: note = derived and/or modified sequence opt6 from anti-OX40_LightChain
  source 1..390: mol_type = other RNA
atggacatgagagtactagcacaactactaggactactactactatgcttcccaggagcaagatgcgacatacaaatgacacaatcaccatcatcactatcagcatcagtaggaaacagagtaacaataacatgcagagcatcacaagacatatcatcatggctagcatggtaccaacaaaaaccagaaaaagcaccaaaatcactaatatacgcagcatcatcactacaatcaggagtaccatcaagattctcaggatcaggatcaggaacagacttcacattaacaatatcatcattacaaccagaagacttcgccacatactactgccaacaatacaactcatacccactaacattcggacaaggaacaagactagaaataaaaaga

SEQ ID NO: 51446 - RNA, 408 nt, synthetic construct
  misc_feature 1..408: note = derived and/or modified sequence opt6 from anti-OX40_HeavyChain
  source 1..408: mol_type = other RNA
atggacacactatgctcaacactattactattaacaataccatcatgggtactatcacaaataacactaaaagaatcaggaccaacactagtaaaaccaacacaaacattaacactatcatgcacattctcaggattctcactatcaacatcaggagtaggagtaggatggataagacaaccaccaggaaaagcactagaatggctagcactaatacactgggacgacgcagaaagatactcaccatcactaaaatcaagactaacaataacaaaagacacatcaaaaaaccaagtagtacttacaatgacaaacatggacctagtagacacagcaacatactactgcgcacacacaagaggagcattcgacatatggggacaaggaacaatggtaacagtatcatca

SEQ ID NO: 51447 - RNA, 408 nt, synthetic construct
  misc_feature 1..408: note = derived and/or modified sequence opt6 from anti-OX40_HeavyChain
  source 1..408: mol_type = other RNA
atggacacactatgctcaacactactactattaacaataccatcatgggtactatcacaaataacactaaaagaatcaggaccaacactagtaaaaccaacacaaacactaacactaacatgcacattctcaggattctcattatcaacatcaggagtaggagtaggatggataagacaaccaccaggaaaagcattagaatggctagcattaatatactgggatgaccactcaccatactcaccatcactaaaatcaagactaacaataacaaaagacacatcaaaaaatcaagtagtactaacaatgacaaacatggacccagtagacacagcaacatattactgcgcaagaacaagaggagcattcgacatatggggacaaggaacaatggtaacagtatcatca

SEQ ID NO: 51448 - RNA, 420 nt, synthetic construct
  misc_feature 1..420: note = derived and/or modified sequence opt6 from anti-OX40_HeavyChain
  source 1..420: mol_type = other RNA
atggaatggggaccatgttgggtatttttagtagtaatattagaaggagtacaatgtggagtacaattagtagaaagcggaggaggattagtacaaccaggaggaagtttaagattaagttgtgcagcaagtggatttacatttagtagttatagtatgaattgggtaagacaagcaccaggaaaaggattagaatgggtaagttatataagtagtagcagtagtacaatatattatgcagatagtgtaaaaggaagatttacaataagtagagataatgcaaaaaatagtttatatttacaaatgaatagtttaagagatgaagatacagcagtatattattgtgcaagaggagtatatcataatggatggagtttttttgattattggggacaaggaacattattaacagtaagtagt

SEQ ID NO: 51449 - RNA, 423 nt, synthetic construct
  misc_feature 1..423: note = derived and/or modified sequence opt6 from anti-OX40_HeavyChain
  source 1..423: mol_type = other RNA
atggacacactatgctcaacactactactactaacaataccatcatgggtattatcacaaataacactaaaagaatcaggaccaacattagtaaaaccaaaacaaacactaacactaacatgcacattctcaggattctcactatcaacatcaggaatgggagtaggatggataagacaaccaccaggaaaagcactagaatggctagcagtaatatactgggacgaccaccaattatactcaccatcactaaaatcaagactaacaataacaaaagacacaagcaaaaaccaagtagtactaacaatgacaaacatggacccagtagacacagcaacatactactgcgcacacagaagaggagcattccaacactggggacaaggaacattagtcacagtatcatcagcatcaacaaaagga

SEQ ID NO: 51450 - RNA, 462 nt, synthetic construct
  misc_feature 1..462: note = derived and/or modified sequence opt6 from anti-OX40_HeavyChain
  source 1..462: mol_type = other RNA
atgacaatgataacgccatcactagtaccatcaagcgatccattagtaacagcagcaagcgtactagaattcgcactattaataagactaacaataggacaagcagtagtaagcacacaatcaacaggaggaggattagtacaaccaggaagaagcttaagattaagctgtgcagcaagcgggttcacactagatgactatggaatgcactgggtaagacaagcaccaggaaaaggactagaatgggtaagcggaatatcatggaatagcgatagcataggatatgtagatagcgtaaaaggaagatttacaataagcagagacaatgcaaaaaactcactatatctacaaatgaatagcttaagagtagaagatacagcactatattactgtgtaaaagacataagcggatggtatagctttgactattggggacaaggaacattagtaacagtatcaagc

SEQ ID NO: 51451 - RNA, 639 nt, synthetic construct
  misc_feature 1..639: note = derived and/or modified sequence opt6 from anti-OX40_LightChain
  source 1..639: mol_type = other RNA
gaaatagtagtaacccaatcaccagcaacactatcactatcaccaggagaaagagcaacactatcatgcagagcatcacaatcagtatcatcatacctagcatggtaccaacaaaaaccaggacaagcaccaagactactaatatacgacgcatcaaatagagccaccggcatcccagcacgattctcaggatccggatccggaacagacttcacattaacaatatcatccttagaaccagaagacttcgcagtatactactgccaacaaagatcaaactggccaacattcggacaaggaactaaagtagaaataaaaagaacagtagcagcaccatccgtattcatattcccaccatcagacgaacaattaaaatcaggaacagcatccgtagtatgcctactaaacaacttttacccaagagaagcaaaagtacaatggaaagtagacaacgcactacaatccggaaactcacaagaatcagtaaccgaacaagactcaaaagactccacatactcactatcttcaacactaacactatctaaagcagactacgaaaaacacaaagtatacgcatgcgaagttacacaccaaggcctatcatcacccgtaacaaaatcattcaacagaggagaatgc

SEQ ID NO: 51452 - RNA, 1350 nt, synthetic construct
  misc_feature 1..1350: note = derived and/or modified sequence opt6 from anti-OX40_HeavyChain
  source 1..1350: mol_type = other RNA
gaagtacaattagtagaatcaggaggaggtctagtacaaccaggaagatcactaagactatcttgcgcagcctcaggatttacatttgatgactacgctatgcactgggtccgacaagcacctggaaaaggtctagaatgggtatcaggaatatcttggaatagtggatcaataggatacgcagactcagtaaagggaagatttacaataagccgagacaatgctaaaaatagtttatacttacaaatgaatagtttaagagcagaagatacagcattatactattgcgctaaagatcaatcaactgcagattattatttttactacggaatggatgtatggggacaaggtacaactgtaacagtttcatcagcatcaactaaaggtccatcagtattcccattagcaccttgctcaagatcaacatccgaatcaacagcagcactaggatgcctagttaaagactattttccagaaccagtaacagtgagttggaactcaggagcactaacaagcggagtacatacatttccagcagtattacaatcttctggactatatagcttatcatcagtagtaacagtaccgtcatcaaactttggtacacaaacttatacatgcaacgtagatcataaaccatcaaatacaaaagtcgacaaaacagtagaaagaaaatgctgtgtagagtgtccaccatgtcccgcaccacctgtagcaggtccaagtgtattcttattccctccaaaacctaaagacacattaatgatatcacgtacaccagaagtcacttgcgtagtagtagacgtttcacacgaagatcctgaagtacaattcaactggtatgtagatggagtagaagttcacaatgccaaaacaaaaccccgagaagaacaatttaactcaacatttagagtagtatcagtcctaaccgttgtacaccaagactggctaaatggaaaagaatataaatgcaaagtatcaaacaaaggattacccgctccaattgagaaaacaatatcaaaaacaaaaggacaaccaagagaacctcaagtatacacacttccaccatcaagagaagaaatgactaaaaaccaagtatcgctaacatgtcttgtcaaaggcttttatccatcagacatcgcagtagaatgggaatcaaatggacaaccagaaaacaattacaagacaacaccaccaatgttagactcagacggctctttctttctatactcaaaactaacagtagataaaagtagatggcaacaaggaaacgtattttcttgctcagtaatgcacgaagcattacacaatcactatacacaaaaatctctttcactcagcccaggaaaa

SEQ ID NO: 51453 - RNA, 21 nt, synthetic construct
  misc_feature 1..21: note = derived and/or modified sequence opt6 from anti-HIV_VRC01_VRC02_NIH45-46_LightChain_CDR
  source 1..21: mol_type = other RNA
tgccagcaatatgaatttttc

SEQ ID NO: 51454 - RNA, 42 nt, synthetic construct
  misc_feature 1..42: note = derived and/or modified sequence opt6 from anti-HIV_VRC01_HeavyChain_CDR
  source 1..42: mol_type = other RNA
acaagagggaaaaattgcgattacaattgggatttcgagcac

SEQ ID NO: 51455 - RNA, 21 nt, synthetic construct
  misc_feature 1..21: note = derived and/or modified sequence opt6 from anti-HIV_3BNC60_LightChain_CDR
  source 1..21: mol_type = other RNA
tgtcaggtgtatgagtttata

SEQ ID NO: 51456 - RNA, 36 nt, synthetic construct
  misc_feature 1..36: note = derived and/or modified sequence opt6 from anti-HIV_3BNC60_HeavyChain_CDR
  source 1..36: mol_type = other RNA
gcaagacagagaagtgacttttgggattttgatgta

SEQ ID NO: 51457 - RNA, 36 nt, synthetic construct
  misc_feature 1..36: note = derived and/or modified sequence opt6 from anti-HIV_5H/I1-BMV-D5_HeavyChain_CDR
  source 1..36: mol_type = other RNA
gcaagagataacccaacattactcggaagcgattac

SEQ ID NO: 51458 - RNA, 33 nt, synthetic construct
  misc_feature 1..33: note = derived and/or modified sequence opt6 from anti-HIV_8ANC195_LightChain_CDR
  source 1..33: mol_type = other RNA
tgtcaacaatacgacacatatccaggcacattt

SEQ ID NO: 51459 - RNA, 33 nt, synthetic construct
  misc_feature 1..33: note = derived and/or modified sequence opt6 from anti-HIV_CH01_CH02_CH03_LightChain_CDR
  source 1..33: mol_type = other RNA
tgtcaacaatacggcggaagtccatatacattt

SEQ ID NO: 51460 - RNA, 78 nt, synthetic construct
  misc_feature 1..78: note = derived and/or modified sequence opt6 from anti-HIV_CH01_HeavyChain_CDR
  source 1..78: mol_type = other RNA
gcaagaggaacagattacacaatagatgacgcaggaatacactatcaaggaagcggaacattttggtatttcgatcta

SEQ ID NO: 51461 - RNA, 78 nt, synthetic construct
  misc_feature 1..78: note = derived and/or modified sequence opt6 from anti-HIV_CH02_HeavyChain_CDR
  source 1..78: mol_type = other RNA
gcaagaggaacagattacacaatagatgaccaaggaagattctatcaaggaagcggaacattttggtattttgatttt

SEQ ID NO: 51462 - RNA, 78 nt, synthetic construct
  misc_feature 1..78: note = derived and/or modified sequence opt6 from anti-HIV_CH03_HeavyChain_CDR
  source 1..78: mol_type = other RNA
gcaagaggaacagattacacaatagatgaccaaggaatattctataaaggaagcggaacattttggtatttcgatcta

SEQ ID NO: 51463 - RNA, 33 nt, synthetic construct
  misc_feature 1..33: note = derived and/or modified sequence opt6 from anti-HIV_CH04_LightChain_CDR
  source 1..33: mol_type = other RNA
tgtcaacaatacggcagatctccatatacattt

SEQ ID NO: 51464 - RNA, 78 nt, synthetic construct
  misc_feature 1..78: note = derived and/or modified sequence opt6 from anti-HIV_CH04_HeavyChain_CDR
  source 1..78: mol_type = other RNA
gcaagaggaacagattacacaatagatgaccaaggaataagatatcaaggaagcggaacattttggtatttcgatgta

SEQ ID NO: 51465 - RNA, 54 nt, synthetic construct
  misc_feature 1..54: note = derived and/or modified sequence opt6 from anti-HIV_NIH45-46_HeavyChain_CDR
  source 1..54: mol_type = other RNA
acaagaggaaaatactgcacagcaagagactattataactgggactttgaacat

SEQ ID NO: 51466 - RNA, 90 nt, synthetic construct
  misc_feature 1..90: note = derived and/or modified sequence opt6 from anti-HIV_PG16_HeavyChain_CDR
  source 1..90: mol_type = other RNA
gcaagagaagcaggaggaccaatatggcatgatgacgtaaaatattacgattttaatgacggatactataattatcattatatggatgta

SEQ ID NO: 51467 - RNA, 36 nt, synthetic construct
  misc_feature 1..36: note = derived and/or modified sequence opt6 from anti-HIV_PGT122_LightChain_CDR
  source 1..36: mol_type = other RNA
catatatgggatagcagaagaccgacaaattgggta

SEQ ID NO: 51468 - RNA, 72 nt, synthetic construct
  misc_feature 1..72: note = derived and/or modified sequence opt6 from anti-HIV_PGT122_HeavyChain_CDR
  source 1..72: mol_type = other RNA
actaaacatggacgtagaatttacggtgtagttgcatttaaagaatggtttacatatttctatatggatgta

SEQ ID NO: 51469 - RNA, 36 nt, synthetic construct
  misc_feature 1..36: note = derived and/or modified sequence opt6 from anti-HIV_PGT123_LightChain_CDR
  source 1..36: mol_type = other RNA
catatatatgacgctagaggtggaactaattgggta

SEQ ID NO: 51470 - RNA, 72 nt, synthetic construct
  misc_feature 1..72: note = derived and/or modified sequence opt6 from anti-HIV_PGT123_HeavyChain_CDR
  source 1..72: mol_type = other RNA
gctctacatggaaaaagaatttacggtatagttgcattaggagaactatttacatatttctatatggatgta

SEQ ID NO: 51471 - RNA, 30 nt, synthetic construct
  misc_feature 1..30: note = derived and/or modified sequence opt6 from anti-HIV_PGT125_PGT128_LightChain_CDR
  source 1..30: mol_type = other RNA
gggagtttggtggggaattgggatgtgata

SEQ ID NO: 51472 - RNA, 57 nt, synthetic construct
  misc_feature 1..57: note = derived and/or modified sequence opt6 from anti-HIV_PGT125_HeavyChain_CDR
  source 1..57: mol_type = other RNA
tttgatggagaagtattagtatataatcattggcctaaacctgcatgggtagattta

SEQ ID NO: 51473 - RNA, 30 nt, synthetic construct
  misc_feature 1..30: note = derived and/or modified sequence opt6 from anti-HIV_PGT126_PGT127_LightChain_CDR
  source 1..30: mol_type = other RNA
agttcgttagtgggtaattgggatgttata

SEQ ID NO: 51474 - RNA, 57 nt, synthetic construct
  misc_feature 1..57: note = derived and/or modified sequence opt6 from anti-HIV_PGT126_HeavyChain_CDR
  source 1..57: mol_type = other RNA
tttgatggagaagtattagtatatcatgattggcctaaacctgcatgggtagattta

SEQ ID NO: 51475 - RNA, 57 nt, synthetic construct
  misc_feature 1..57: note = derived and/or modified sequence opt6 from anti-HIV_PGT127_HeavyChain_CDR
  source 1..57: mol_type = other RNA
tttggtggagaagtattagtatatagagattggcctaaacctgcatgggtagattta

SEQ ID NO: 51476 - RNA, 57 nt, synthetic construct
  misc_feature 1..57: note = derived and/or modified sequence opt6 from anti-HIV_PGT128_HeavyChain_CDR
  source 1..57: mol_type = other RNA
ttcggtggagaagtattaagatatacagattggcctaaacctgcatgggtagattta

SEQ ID NO: 51477 - RNA, 30 nt, synthetic construct
  misc_feature 1..30: note = derived and/or modified sequence opt6 from anti-HIV_PGT130_LightChain_CDR
  source 1..30: mol_type = other RNA
agtagtttgtttgggaggtgggatgtggtg

SEQ ID NO: 51478 - RNA, 57 nt, synthetic construct
  misc_feature 1..57: note = derived and/or modified sequence opt6 from anti-HIV_PGT130_HeavyChain_CDR
  source 1..57: mol_type = other RNA
tcaggaggagatatattatactattacgaatggcaaaaaccacactggttctcacca

SEQ ID NO: 51479 - RNA, 30 nt, synthetic construct
  misc_feature 1..30: note = derived and/or modified sequence opt6 from anti-HIV_PGT131_LightChain_CDR
  source 1..30: mol_type = other RNA
agtagtttgagtgggaggtgggatatagtg

SEQ ID NO: 51480 - RNA, 57 nt, synthetic construct
  misc_feature 1..57: note = derived and/or modified sequence opt6 from anti-HIV_PGT131_HeavyChain_CDR
  source 1..57: mol_type = other RNA
tcaggtggagatatattatactatatagaatggcaaaaacctcactggttctatcca

SEQ ID NO: 51481 - RNA, 27 nt, synthetic construct
  misc_feature 1..27: note = derived and/or modified sequence opt6 from anti-HIV_PGT135_PGT136_PGT137_LightChain_CDR
  source 1..27: mol_type = other RNA
caacaatatgaagaatggccaagaaca

SEQ ID NO: 51482 - RNA, 54 nt, synthetic construct
  misc_feature 1..54: note = derived and/or modified sequence opt6 from anti-HIV_PGT135_HeavyChain_CDR
  source 1..54: mol_type = other RNA
catagacatcatgatgtatttatgttagtacctatagctggatggtttgatgta

SEQ ID NO: 51483 - RNA, 54 nt, synthetic construct
  misc_feature 1..54: note = derived and/or modified sequence opt6 from anti-HIV_PGT136_HeavyChain_CDR
  source 1..54: mol_type = other RNA
cataaatatcacgatatatttagagttgtacctgtagctggatggttcgatcca

SEQ ID NO: 51484 - RNA, 54 nt, synthetic construct
  misc_feature 1..54: note = derived and/or modified sequence opt6 from anti-HIV_PGT137_HeavyChain_CDR
  source 1..54: mol_type = other RNA
cataaatatcacgatatagttatggttgtacctatagctggatggttcgatcca

SEQ ID NO: 51485 - RNA, 27 nt, synthetic construct
  misc_feature 1..27: note = derived and/or modified sequence opt6 from anti-HIV_PGT141_PGT142_PGT143_PGT144_LightChain_CDR
  source 1..27: mol_type = other RNA
atgcaaggactaaatagaccgtggaca

SEQ ID NO: 51486 - RNA, 96 nt, synthetic construct
  misc_feature 1..96: note = derived and/or modified sequence opt6 from anti-HIV_PGT141_HeavyChain_CDR
  source 1..96: mol_type = other RNA
ggatcaaaacatagattaagagattacgtactatatgacgattacggactaataaactatcaagaatggaatgactatctagaattcttagacgta

SEQ ID NO: 51487 - RNA, 96 nt, synthetic construct
  misc_feature 1..96: note = derived and/or modified sequence opt6 from anti-HIV_PGT144_HeavyChain_CDR
  source 1..96: mol_type = other RNA
ggatcaaaacatagattaagagattacgtactatatgacgattacggactaataaaccaacaagaatggaatgactatctagaattcttagacgta

SEQ ID NO: 51488 - RNA, 27 nt, synthetic construct
  misc_feature 1..27: note = derived and/or modified sequence opt6 from anti-HIV_PGT145_LightChain_CDR
  source 1..27: mol_type = other RNA
atgcaaggactacatagtccatggaca

SEQ ID NO: 51489 - RNA, 93 nt, synthetic construct
  misc_feature 1..93: note = derived and/or modified sequence opt6 from anti-HIV_PGT145_HeavyChain_CDR
  source 1..93: mol_type = other RNA
ggatcaaaacatagattaagagattactttctatataacgaatacggaccaaattacgaagaatggggagattacttagcaacactagatgta

SEQ ID NO: 51490 - RNA, 21 nt, synthetic construct
  misc_feature 1..21: note = derived and/or modified sequence opt6 from anti-HIV_VRC-CH30_VRC-CH31_VRC-CH32_VRC-CH33_VRC-CH34_Light Chain _CDR
  source 1..21: mol_type = other RNA
tgccaacaatacgaaacattc

SEQ ID NO: 51491 - RNA, 45 nt, synthetic construct
  misc_feature 1..45: note = derived and/or modified sequence opt6 from anti-HIV_VRC-CH30_VRC-CH31_VRC-CH32_VRC-CH34_HeavyChain_CDR
  source 1..45: mol_type = other RNA
gcaagagcacaaaaaagaggaagaagtgaatgggcatatgcacat

SEQ ID NO: 51492 - RNA, 45 nt, synthetic construct
  misc_feature 1..45: note = derived and/or modified sequence opt6 from anti-HIV_VRC-CH33_HeavyChain_CDR
  source 1..45: mol_type = other RNA
gcaagagcacaaaaaagagcaagatcagaatgggcatatgcacat

SEQ ID NO: 51493 - RNA, 21 nt, synthetic construct
  misc_feature 1..21: note = derived and/or modified sequence opt6 from anti-HIV_VRC-PG04_LightChain_CDR
  source 1..21: mol_type = other RNA
tgtcaacaattagaattcttc

SEQ ID NO: 51494 - RNA, 48 nt, synthetic construct
  misc_feature 1..48: note = derived and/or modified sequence opt6 from anti-HIV_VRC-PG04_HeavyChain_CDR
  source 1..48: mol_type = other RNA
gcaagacagaaattttatacaggaggacaaggatggtatttcgatcta

SEQ ID NO: 51495 - RNA, 21 nt, synthetic construct
  misc_feature 1..21: note = derived and/or modified sequence opt6 from anti-HIV_VRC-PG04b_LightChain_CDR
  source 1..21: mol_type = other RNA
tgtcagcaagttgaatttttc

SEQ ID NO: 51496 - RNA, 48 nt, synthetic construct
  misc_feature 1..48: note = derived and/or modified sequence opt6 from anti-HIV_VRC-PG04b_HeavyChain_CDR
  source 1..48: mol_type = other RNA
gcaagacagaaatttgaaagaggaggacaaggatggtattttgattta

SEQ ID NO: 51497 - RNA, 21 nt, synthetic construct
  misc_feature 1..21: note = derived and/or modified sequence opt6 from anti-HIV_VRC03_LightChain_CDR
  source 1..21: mol_type = other RNA
tgtcaacaattcgaatttttc

SEQ ID NO: 51498 - RNA, 48 nt, synthetic construct
  misc_feature 1..48: note = derived and/or modified sequence opt6 from anti-HIV_VRC03_HeavyChain_CDR
  source 1..48: mol_type = other RNA
gtaagaagaggtagttgtgattattgtggtgattttccatggcaatat

SEQ ID NO: 51499 - RNA, 21 nt, synthetic construct
  misc_feature 1..21: note = derived and/or modified sequence opt6 from anti-HIV_1TJG_P-Chain
  source 1..21: mol_type = other RNA
gaattggataagtgggcgagt

SEQ ID NO: 51500 - RNA, 69 nt, synthetic construct
  misc_feature 1..69: note = derived and/or modified sequence opt6 from anti-HIV_2B1H_P-Chain
  source 1..69: mol_type = other RNA
aacaacacaaaaaaaagcataaaaataagaccaagacaagcattctacgcaacaaacggaataatagga

SEQ ID NO: 51501 - RNA, 69 nt, synthetic construct
  misc_feature 1..69: note = derived and/or modified sequence opt6 from anti-HIV_2B1A_P-Chain
  source 1..69: mol_type = other RNA
aacaatacaagaaaatcaatacatctaggaccaggaagagcattctatgcaacaggagacataatagga

SEQ ID NO: 51502 - RNA, 57 nt, synthetic construct
  misc_feature 1..57: note = derived and/or modified sequence opt6 from anti-HIV_2B0S_P-Chain
  source 1..57: mol_type = other RNA
aaaagaaaaagaatacacataggaccaggaagagcattctacacaacaaaaaacgca

SEQ ID NO: 51503 - RNA, 69 nt, synthetic construct
  misc_feature 1..69: note = derived and/or modified sequence opt6 from anti-HIV_3UJJ_P-Chain
  source 1..69: mol_type = other RNA
aataacacaagaaaaagcataagaataggaccaggacaagcattctacgcaacaggagacataatagga

SEQ ID NO: 51504 - RNA, 69 nt, synthetic construct
  misc_feature 1..69: note = derived and/or modified sequence opt6 from anti-HIV_3UJI_P-Chain
  source 1..69: mol_type = other RNA
tacaacaaaagaaaaagaatacacataggaccaggaagagcattctacacaacaaaaaacataatagga

SEQ ID NO: 51505 - RNA, 75 nt, synthetic construct
  misc_feature 1..75: note = derived and/or modified sequence opt6 from anti-HIV_3MLZ_P-Chain
  source 1..75: mol_type = other RNA
agtaacaatacaagaaaaggaatacatataggaccaggaagagcattctatgcaacaggacaaataacaggagac

SEQ ID NO: 51506 - RNA, 60 nt, synthetic construct
  misc_feature 1..60: note = derived and/or modified sequence opt6 from anti-HIV_3MLV_Q-Chain
  source 1..60: mol_type = other RNA
aataacacaagaaaaagaataagagtaggaccaggacaaacagtatacgcaacaaatgca

SEQ ID NO: 51507 - RNA, 69 nt, synthetic construct
  misc_feature 1..69: note = derived and/or modified sequence opt6 from anti-HIV_3MLU_P-Chain
  source 1..69: mol_type = other RNA
aataacacaagaaaaagcataagaataggaccaggacaagcattttacgcaacaggaggaataatagga

SEQ ID NO: 51508 - RNA, 60 nt, synthetic construct
  misc_feature 1..60: note = derived and/or modified sequence opt6 from anti-HIV_3MLR_P-Chain
  source 1..60: mol_type = other RNA
aacaacacaaaaaaaggaatagcaataggaccaggaagaacactatacgcaagagaaaaa

SEQ ID NO: 51509 - RNA, 48 nt, synthetic construct
  misc_feature 1..48: note = derived and/or modified sequence opt6 from anti-HIV_4XCF_P-Chain
  source 1..48: mol_type = other RNA
aactggtgggacataacaaactggctatggtacataaaaaaaaaaaaa

SEQ ID NO: 51510 - RNA, 45 nt, synthetic construct
  misc_feature 1..45: note = derived and/or modified sequence opt6 from anti-HIV_4XBE_P-Chain
  source 1..45: mol_type = other RNA
aactggttcgacataacaaactggctatggtacataaaaaaaaaa

SEQ ID NO: 51511 - RNA, 48 nt, synthetic construct
  misc_feature 1..48: note = derived and/or modified sequence opt6 from anti-HIV_4XAW_P-Chain
  source 1..48: mol_type = other RNA
aactggttcgacataacaaactggctatggtacataaaaaaaaaaaaa

SEQ ID NO: 51512 - RNA, 45 nt, synthetic construct
  misc_feature 1..45: note = derived and/or modified sequence opt6 from anti-HIV_2QSC_P-Chain
  source 1..45: mol_type = other RNA
agaaaaagaatacatataggaccaggaagagcattctacacaaca

SEQ ID NO: 51513 - RNA, 60 nt, synthetic construct
  misc_feature 1..60: note = derived and/or modified sequence opt6 from anti-HIV_3MLS_S-Chain
  source 1..60: mol_type = other RNA
gcatgtcaagcattctatgcatcaagcccaagaaaaagcatacacataggagcatgcgca

SEQ ID NO: 51514 - RNA, 42 nt, synthetic construct
  misc_feature 1..42: note = derived and/or modified sequence opt6 from anti-HIV_3GO1_P-Chain
  source 1..42: mol_type = other RNA
cgtaaacgtatacatataggtccaggtagagctttctataca

SEQ ID NO: 51515 - RNA, 42 nt, synthetic construct
  misc_feature 1..42: note = derived and/or modified sequence opt6 from anti-HIV_4M1D_Q-Chain
  source 1..42: mol_type = other RNA
tgccgtatacatataggtccaggtagagctttctatacatgt

SEQ ID NO: 51516 - RNA, 39 nt, synthetic construct
  misc_feature 1..39: note = derived and/or modified sequence opt6 from anti-HIV_3C2A_Q-Chain
  source 1..39: mol_type = other RNA
aaatctatacatctaggtccaggtagagctttctatgca

SEQ ID NO: 51517 - RNA, 12 nt, synthetic construct
  misc_feature 1..12: note = derived and/or modified sequence opt6 from anti-HIV_CDR
  source 1..12: mol_type = other RNA
caatccaaaacc

SEQ ID NO: 51518 - RNA, 12 nt, synthetic construct
  misc_feature 1..12: note = derived and/or modified sequence opt6 from anti-HIV_CDR
  source 1..12: mol_type = other RNA
gatttgattgat

SEQ ID NO: 51519 - RNA, 15 nt, synthetic construct
  misc_feature 1..15: note = derived and/or modified sequence opt6 from anti-HIV_CDR
  source 1..15: mol_type = other RNA
gatcattattggtcg

SEQ ID NO: 51520 - RNA, 15 nt, synthetic construct
  misc_feature 1..15: note = derived and/or modified sequence opt6 from anti-HIV_CDR
  source 1..15: mol_type = other RNA
gggaggttttggagt

SEQ ID NO: 51521 - RNA, 15 nt, synthetic construct
  misc_feature 1..15: note = derived and/or modified sequence opt6 from anti-HIV_CDR
  source 1..15: mol_type = other RNA
aattattactggacc

SEQ ID NO: 51522 - RNA, 15 nt, synthetic construct
  misc_feature 1..15: note = derived and/or modified sequence opt6 from anti-HIV_CDR
  source 1..15: mol_type = other RNA
gatgcgtattggagt

SEQ ID NO: 51523 - RNA, 15 nt, synthetic construct
  misc_feature 1..15: note = derived and/or modified sequence opt6 from anti-HIV_CDR
  source 1..15: mol_type = other RNA
gatagttattggtct

SEQ ID NO: 51524 - RNA, 15 nt, synthetic construct
  misc_feature 1..15: note = derived and/or modified sequence opt6 from anti-HIV_CDR
  source 1..15: mol_type = other RNA
gataattattggtcg

SEQ ID NO: 51525 - RNA, 15 nt, synthetic construct
  misc_feature 1..15: note = derived and/or modified sequence opt6 from anti-HIV_CDR
  source 1..15: mol_type = other RNA
aacagttactggaca

SEQ ID NO: 51526 - RNA, 15 nt, synthetic construct
  misc_feature 1..15: note = derived and/or modified sequence opt6 from anti-HIV_CDR
  source 1..15: mol_type = other RNA
tcttattactggtcc

SEQ ID NO: 51527 - RNA, 15 nt, synthetic construct
  misc_feature 1..15: note = derived and/or modified sequence opt6 from anti-HIV_CDR
  source 1..15: mol_type = other RNA
agttttggcatgcat

SEQ ID NO: 51528 - RNA, 15 nt, synthetic construct
  misc_feature 1..15: note = derived and/or modified sequence opt6 from anti-HIV_CDR
  source 1..15: mol_type = other RNA
gctgcatttcaatgg

SEQ ID NO: 51529 - RNA, 15 nt, synthetic construct
  misc_feature 1..15: note = derived and/or modified sequence opt6 from anti-HIV_CDR
  source 1..15: mol_type = other RNA
caacaattacgcacc

SEQ ID NO: 51530 - RNA, 15 nt, synthetic construct
  misc_feature 1..15: note = derived and/or modified sequence opt6 from anti-HIV_CDR
  source 1..15: mol_type = other RNA
caacaatacgacagc

SEQ ID NO: 51531 - RNA, 15 nt, synthetic construct
  misc_feature 1..15: note = derived and/or modified sequence opt6 from anti-HIV_CDR
  source 1..15: mol_type = other RNA
caacaactcgccacc

SEQ ID NO: 51532 - RNA, 15 nt, synthetic construct
  misc_feature 1..15: note = derived and/or modified sequence opt6 from anti-HIV_CDR
  source 1..15: mol_type = other RNA
gagagttttcagtgg

SEQ ID NO: 51533 - RNA, 15 nt, synthetic construct
  misc_feature 1..15: note = derived and/or modified sequence opt6 from anti-HIV_CDR
  source 1..15: mol_type = other RNA
gaggtgtatgaattt

SEQ ID NO: 51534 - RNA, 15 nt, synthetic construct
  misc_feature 1..15: note = derived and/or modified sequence opt6 from anti-HIV_CDR
  source 1..15: mol_type = other RNA
gcctcattagaattt

SEQ ID NO: 51535 - RNA, 15 nt, synthetic construct
  misc_feature 1..15: note = derived and/or modified sequence opt6 from anti-HIV_CDR
  source 1..15: mol_type = other RNA
agcgtgtacgagttc

SEQ ID NO: 51536 - RNA, 15 nt, synthetic construct
  misc_feature 1..15: note = derived and/or modified sequence opt6 from anti-HIV_CDR
  source 1..15: mol_type = other RNA
gccgcattagaattt

SEQ ID NO: 51537 - RNA, 15 nt, synthetic construct
  misc_feature 1..15: note = derived and/or modified sequence opt6 from anti-HIV_CDR
  source 1..15: mol_type = other RNA
gctgtagttgaattt

SEQ ID NO: 51538 - RNA, 15 nt, synthetic construct
  misc_feature 1..15: note = derived and/or modified sequence opt6 from anti-HIV_CDR
  source 1..15: mol_type = other RNA
caattgttcgagttc

SEQ ID NO: 51539 - RNA, 15 nt, synthetic construct
  misc_feature 1..15: note = derived and/or modified sequence opt6 from anti-HIV_CDR
  source 1..15: mol_type = other RNA
gctgtatttcaatgg

SEQ ID NO: 51540 - RNA, 15 nt, synthetic construct
  misc_feature 1..15: note = derived and/or modified sequence opt6 from anti-HIV_CDR
  source 1..15: mol_type = other RNA
gccgtacttgaattt

SEQ ID NO: 51541 - RNA, 15 nt, synthetic construct
  misc_feature 1..15: note = derived and/or modified sequence opt6 from anti-HIV_CDR
  source 1..15: mol_type = other RNA
aatgggtttgatgtg

SEQ ID NO: 51542 - RNA, 15 nt, synthetic construct
  misc_feature 1..15: note = derived and/or modified sequence opt6 from anti-HIV_CDR
  source 1..15: mol_type = other RNA
caacagtacgaattc

SEQ ID NO: 51543 - RNA, 15 nt, synthetic construct
  misc_feature 1..15: note = derived and/or modified sequence opt6 from anti-HIV_CDR
  source 1..15: mol_type = other RNA
caacattacgaattc

SEQ ID NO: 51544 - RNA, 15 nt, synthetic construct
  misc_feature 1..15: note = derived and/or modified sequence opt6 from anti-HIV_CDR
  source 1..15: mol_type = other RNA
caagtgtatgaagtc

SEQ ID NO: 51545 - RNA, 15 nt, synthetic construct
  misc_feature 1..15: note = derived and/or modified sequence opt6 from anti-HIV_CDR
  source 1..15: mol_type = other RNA
caagtgtacgaattc

SEQ ID NO: 51546 - RNA, 15 nt, synthetic construct
  misc_feature 1..15: note = derived and/or modified sequence opt6 from anti-HIV_CDR
  source 1..15: mol_type = other RNA
ttcagtaaagagagt

SEQ ID NO: 51547 - RNA, 15 nt, synthetic construct
  misc_feature 1..15: note = derived and/or modified sequence opt6 from anti-HIV_CDR
  source 1..15: mol_type = other RNA
ctaaaactatcctcc

SEQ ID NO: 51548 - RNA, 15 nt, synthetic construct
  misc_feature 1..15: note = derived and/or modified sequence opt6 from anti-HIV_CDR
  source 1..15: mol_type = other RNA
tataaagtcagctct

SEQ ID NO: 51549 - RNA, 15 nt, synthetic construct
  misc_feature 1..15: note = derived and/or modified sequence opt6 from anti-HIV_CDR
  source 1..15: mol_type = other RNA
cccccacaagaatca

SEQ ID NO: 51550 - RNA, 15 nt, synthetic construct
  misc_feature 1..15: note = derived and/or modified sequence opt6 from anti-HIV_CDR
  source 1..15: mol_type = other RNA
accgcacgcgattac

SEQ ID NO: 51551 - RNA, 15 nt, synthetic construct
  misc_feature 1..15: note = derived and/or modified sequence opt6 from anti-HIV_CDR
  source 1..15: mol_type = other RNA
atgcagtcaattcag

SEQ ID NO: 51552 - RNA, 15 nt, synthetic construct
  misc_feature 1..15: note = derived and/or modified sequence opt6 from anti-HIV_CDR
  source 1..15: mol_type = other RNA
caccaactcgacacc

SEQ ID NO: 51553 - RNA, 15 nt, synthetic construct
  misc_feature 1..15: note = derived and/or modified sequence opt6 from anti-HIV_CDR
  source 1..15: mol_type = other RNA
caccaactcgacagc

SEQ ID NO: 51554 - RNA, 15 nt, synthetic construct
  misc_feature 1..15: note = derived and/or modified sequence opt6 from anti-HIV_CDR
  source 1..15: mol_type = other RNA
caacaattaggcacc

SEQ ID NO: 51555 - RNA, 15 nt, synthetic construct
  misc_feature 1..15: note = derived and/or modified sequence opt6 from anti-HIV_CDR
  source 1..15: mol_type = other RNA
caaaaagccacaaca

SEQ ID NO: 51556 - RNA, 15 nt, synthetic construct
  misc_feature 1..15: note = derived and/or modified sequence opt6 from anti-HIV_CDR
  source 1..15: mol_type = other RNA
ttgtttgctggcact

SEQ ID NO: 51557 - RNA, 18 nt, synthetic construct
  misc_feature 1..18: note = derived and/or modified sequence opt6 from anti-HIV_CDR
  source 1..18: mol_type = other RNA
gtaagaggaagtagtccg

SEQ ID NO: 51558 - RNA, 18 nt, synthetic construct
  misc_feature 1..18: note = derived and/or modified sequence opt6 from anti-HIV_CDR
  source 1..18: mol_type = other RNA
ggtttgttgtttgttgtt

SEQ ID NO: 51559 - RNA, 18 nt, synthetic construct
  misc_feature 1..18: note = derived and/or modified sequence opt6 from anti-HIV_CDR
  source 1..18: mol_type = other RNA
atggattggacttggagt

SEQ ID NO: 51560 - RNA, 18 nt, synthetic construct
  misc_feature 1..18: note = derived and/or modified sequence opt6 from anti-HIV_CDR
  source 1..18: mol_type = other RNA
atggattggacgtggagg

SEQ ID NO: 51561 - RNA, 18 nt, synthetic construct
  misc_feature 1..18: note = derived and/or modified sequence opt6 from anti-HIV_CDR
  source 1..18: mol_type = other RNA
atgaaacatctctggttc

SEQ ID NO: 51562 - RNA, 18 nt, synthetic construct
  misc_feature 1..18: note = derived and/or modified sequence opt6 from anti-HIV_CDR
  source 1..18: mol_type = other RNA
atggactggatatggaga

SEQ ID NO: 51563 - RNA, 18 nt, synthetic construct
  misc_feature 1..18: note = derived and/or modified sequence opt6 from anti-HIV_CDR
  source 1..18: mol_type = other RNA
atggattggacgtggacg

SEQ ID NO: 51564 - RNA, 18 nt, synthetic construct
  misc_feature 1..18: note = derived and/or modified sequence opt6 from anti-HIV_CDR
  source 1..18: mol_type = other RNA
atgaaacatctcttcctc

SEQ ID NO: 51565 - RNA, 18 nt, synthetic construct
  misc_feature 1..18: note = derived and/or modified sequence opt6 from anti-HIV_CDR
  source 1..18: mol_type = other RNA
caactcctccaatccaac

SEQ ID NO: 51566 - RNA, 18 nt, synthetic construct
  misc_feature 1..18: note = derived and/or modified sequence opt6 from anti-HIV_CDR
  source 1..18: mol_type = other RNA
ggaggaagtccagaacat

SEQ ID NO: 51567 - RNA, 18 nt, synthetic construct
  misc_feature 1..18: note = derived and/or modified sequence opt6 from anti-HIV_CDR
  source 1..18: mol_type = other RNA
ttagaggggacggattat

SEQ ID NO: 51568 - RNA, 18 nt, synthetic construct
  misc_feature 1..18: note = derived and/or modified sequence opt6 from anti-HIV_CDR
  source 1..18: mol_type = other RNA
caacaatacccctccacc

SEQ ID NO: 51569 - RNA, 21 nt, synthetic construct
  misc_feature 1..21: note = derived and/or modified sequence opt6 from anti-HIV_CDR
  source 1..21: mol_type = other RNA
aacaatcacgacagaccaagc

SEQ ID NO: 51570 - RNA, 21 nt, synthetic construct
  misc_feature 1..21: note = derived and/or modified sequence opt6 from anti-HIV_CDR
  source 1..21: mol_type = other RNA
aataatcaagacagaccagcc

SEQ ID NO: 51571 - RNA, 21 nt, synthetic construct
  misc_feature 1..21: note = derived and/or modified sequence opt6 from anti-HIV_CDR
  source 1..21: mol_type = other RNA
aacaataacgatcgcccgagc

SEQ ID NO: 51572 - RNA, 21 nt, synthetic construct
  misc_feature 1..21: note = derived and/or modified sequence opt6 from anti-HIV_CDR
  source 1..21: mol_type = other RNA
aacaatcaagaccgaccaagc

SEQ ID NO: 51573 - RNA, 21 nt, synthetic construct
  misc_feature 1..21: note = derived and/or modified sequence opt6 from anti-HIV_CDR
  source 1..21: mol_type = other RNA
gacgatagcgatagaccgagc

SEQ ID NO: 51574 - RNA, 21 nt, synthetic construct
  misc_feature 1..21: note = derived and/or modified sequence opt6 from anti-HIV_CDR
  source 1..21: mol_type = other RNA
tgggcaagcacaagacataca

SEQ ID NO: 51575 - RNA, 21 nt, synthetic construct
  misc_feature 1..21: note = derived and/or modified sequence opt6 from anti-HIV_CDR
  source 1..21: mol_type = other RNA
ggcgcgacagcaagagatttt

SEQ ID NO: 51576 - RNA, 21 nt, synthetic construct
  misc_feature 1..21: note = derived and/or modified sequence opt6 from anti-HIV_CDR
  source 1..21: mol_type = other RNA
gcctcaataaaactagcccta

SEQ ID NO: 51577 - RNA, 21 nt, synthetic construct
  misc_feature 1..21: note = derived and/or modified sequence opt6 from anti-HIV_CDR
  source 1..21: mol_type = other RNA
caacaatacggccgatcacca

SEQ ID NO: 51578 - RNA, 21 nt, synthetic construct
  misc_feature 1..21: note = derived and/or modified sequence opt6 from anti-HIV_CDR
  source 1..21: mol_type = other RNA
caacaatactacatctccccc

SEQ ID NO: 51579 - RNA, 21 nt, synthetic construct
  misc_feature 1..21: note = derived and/or modified sequence opt6 from anti-HIV_CDR
  source 1..21: mol_type = other RNA
caacaatcccactccccatcc

SEQ ID NO: 51580 - RNA, 21 nt, synthetic construct
  misc_feature 1..21: note = derived and/or modified sequence opt6 from anti-HIV_CDR
  source 1..21: mol_type = other RNA
ggtaggtgtgcgagaaggtgg

SEQ ID NO: 51581 - RNA, 21 nt, synthetic construct
  misc_feature 1..21: note = derived and/or modified sequence opt6 from anti-HIV_CDR
  source 1..21: mol_type = other RNA
agatttctgtttgtagttgca

SEQ ID NO: 51582 - RNA, 21 nt, synthetic construct
  misc_feature 1..21: note = derived and/or modified sequence opt6 from anti-HIV_CDR
  source 1..21: mol_type = other RNA
atgtccgtctcttttctcata

SEQ ID NO: 51583 - RNA, 21 nt, synthetic construct
  misc_feature 1..21: note = derived and/or modified sequence opt6 from anti-HIV_CDR
  source 1..21: mol_type = other RNA
ggaagtagtaatagatgtccg

SEQ ID NO: 51584 - RNA, 21 nt, synthetic construct
  misc_feature 1..21: note = derived and/or modified sequence opt6 from anti-HIV_CDR
  source 1..21: mol_type = other RNA
atgaaacatctctggttcttt

SEQ ID NO: 51585 - RNA, 21 nt, synthetic construct
  misc_feature 1..21: note = derived and/or modified sequence opt6 from anti-HIV_CDR
  source 1..21: mol_type = other RNA
gcttcttgggattttgatttt

SEQ ID NO: 51586 - RNA, 21 nt, synthetic construct
  misc_feature 1..21: note = derived and/or modified sequence opt6 from anti-HIV_CDR
  source 1..21: mol_type = other RNA
gaaataggagtggcagaacat

SEQ ID NO: 51587 - RNA, 21 nt, synthetic construct
  misc_feature 1..21: note = derived and/or modified sequence opt6 from anti-HIV_CDR
  source 1..21: mol_type = other RNA
caaaaatacgacaccgcaccc

SEQ ID NO: 51588 - RNA, 21 nt, synthetic construct
  misc_feature 1..21: note = derived and/or modified sequence opt6 from anti-HIV_CDR
  source 1..21: mol_type = other RNA
caacaatcctcatccaccccc

SEQ ID NO: 51589 - RNA, 21 nt, synthetic construct
  misc_feature 1..21: note = derived and/or modified sequence opt6 from anti-HIV_CDR
  source 1..21: mol_type = other RNA
caacaatcagccggcacacca

SEQ ID NO: 51590 - RNA, 21 nt, synthetic construct
  misc_feature 1..21: note = derived and/or modified sequence opt6 from anti-HIV_CDR
  source 1..21: mol_type = other RNA
caacaatcctcctccaaaccc

SEQ ID NO: 51591 - RNA, 21 nt, synthetic construct
  misc_feature 1..21: note = derived and/or modified sequence opt6 from anti-HIV_CDR
  source 1..21: mol_type = other RNA
caagaatacaacacctatacc

SEQ ID NO: 51592 - RNA, 21 nt, synthetic construct
  misc_feature 1..21: note = derived and/or modified sequence opt6 from anti-HIV_CDR
  source 1..21: mol_type = other RNA
caagaatacaacaactacaac

SEQ ID NO: 51593 - RNA, 21 nt, synthetic construct
  misc_feature 1..21: note = derived and/or modified sequence opt6 from anti-HIV_CDR
  source 1..21: mol_type = other RNA
cactatgacgcactagactat

SEQ ID NO: 51594 - RNA, 24 nt, synthetic construct
  misc_feature 1..24: note = derived and/or modified sequence opt6 from anti-HIV_CDR
  source 1..24: mol_type = other RNA
gcaatatttaaaggagtccagtgt

SEQ ID NO: 51595 - RNA, 24 nt, synthetic construct
  misc_feature 1..24: note = derived and/or modified sequence opt6 from anti-HIV_CDR
  source 1..24: mol_type = other RNA
gggccgttaggtgattatgatttt

SEQ ID NO: 51596 - RNA, 24 nt, synthetic construct
  misc_feature 1..24: note = derived and/or modified sequence opt6 from anti-HIV_CDR
  source 1..24: mol_type = other RNA
cagcaatatggcagctcattaaga

SEQ ID NO: 51597 - RNA, 24 nt, synthetic construct
  misc_feature 1..24: note = derived and/or modified sequence opt6 from anti-HIV_CDR
  source 1..24: mol_type = other RNA
caacaatactcacactaccgcacc

SEQ ID NO: 51598 - RNA, 24 nt, synthetic construct
  misc_feature 1..24: note = derived and/or modified sequence opt6 from anti-HIV_CDR
  source 1..24: mol_type = other RNA
caatattatggcatgtccgtaact

SEQ ID NO: 51599 - RNA, 24 nt, synthetic construct
  misc_feature 1..24: note = derived and/or modified sequence opt6 from anti-HIV_CDR
  source 1..24: mol_type = other RNA
caacaatacgaaaactggctaaca

SEQ ID NO: 51600 - RNA, 24 nt, synthetic construct
  misc_feature 1..24: note = derived and/or modified sequence opt6 from anti-HIV_CDR
  source 1..24: mol_type = other RNA
tctggagttcattatatggatgta

SEQ ID NO: 51601 - RNA, 24 nt, synthetic construct
  misc_feature 1..24: note = derived and/or modified sequence opt6 from anti-HIV_CDR
  source 1..24: mol_type = other RNA
caacaatactccggcccactaaca

SEQ ID NO: 51602 - RNA, 24 nt, synthetic construct
  misc_feature 1..24: note = derived and/or modified sequence opt6 from anti-HIV_CDR
  source 1..24: mol_type = other RNA
caacaatactacaccgtcccctca

SEQ ID NO: 51603 - RNA, 24 nt, synthetic construct
  misc_feature 1..24: note = derived and/or modified sequence opt6 from anti-HIV_CDR
  source 1..24: mol_type = other RNA
caacaatacggctcatcaataaca

SEQ ID NO: 51604 - RNA, 24 nt, synthetic construct
  misc_feature 1..24: note = derived and/or modified sequence opt6 from anti-HIV_CDR
  source 1..24: mol_type = other RNA
catcaatataacaaatgggacaca

SEQ ID NO: 51605 - RNA, 24 nt, synthetic construct
  misc_feature 1..24: note = derived and/or modified sequence opt6 from anti-HIV_CDR
  source 1..24: mol_type = other RNA
caacaatcctacaccacccccctc

SEQ ID NO: 51606 - RNA, 24 nt, synthetic construct
  misc_feature 1..24: note = derived and/or modified sequence opt6 from anti-HIV_CDR
  source 1..24: mol_type = other RNA
cagagatgggaaacaatagattac

SEQ ID NO: 51607 - RNA, 24 nt, synthetic construct
  misc_feature 1..24: note = derived and/or modified sequence opt6 from anti-HIV_CDR
  source 1..24: mol_type = other RNA
tgttcgtatgcgggttcgtatacg

SEQ ID NO: 51608 - RNA, 24 nt, synthetic construct
  misc_feature 1..24: note = derived and/or modified sequence opt6 from anti-HIV_CDR
  source 1..24: mol_type = other RNA
caacaatacgacaacctacccaca

SEQ ID NO: 51609 - RNA, 24 nt, synthetic construct
  misc_feature 1..24: note = derived and/or modified sequence opt6 from anti-HIV_CDR
  source 1..24: mol_type = other RNA
caacaatgcacactcccactcaca

SEQ ID NO: 51610 - RNA, 24 nt, synthetic construct
  misc_feature 1..24: note = derived and/or modified sequence opt6 from anti-HIV_CDR
  source 1..24: mol_type = other RNA
caacaatcatactcatccgtcacc

SEQ ID NO: 51611 - RNA, 24 nt, synthetic construct
  misc_feature 1..24: note = derived and/or modified sequence opt6 from anti-HIV_CDR
  source 1..24: mol_type = other RNA
caacaatcacacacatccgtcacc

SEQ ID NO: 51612 - RNA, 24 nt, synthetic construct
  misc_feature 1..24: note = derived and/or modified sequence opt6 from anti-HIV_CDR
  source 1..24: mol_type = other RNA
caacaaacatacgcatccgtaacc

SEQ ID NO: 51613 - RNA, 24 nt, synthetic construct
  misc_feature 1..24: note = derived and/or modified sequence opt6 from anti-HIV_CDR
  source 1..24: mol_type = other RNA
caacaatacaactccgactacaca

SEQ ID NO: 51614 - RNA, 24 nt, synthetic construct
  misc_feature 1..24: note = derived and/or modified sequence opt6 from anti-HIV_CDR
  source 1..24: mol_type = other RNA
catctatatgtatctagacctgta

SEQ ID NO: 51615 - RNA, 24 nt, synthetic construct
  misc_feature 1..24: note = derived and/or modified sequence opt6 from anti-HIV_CDR
  source 1..24: mol_type = other RNA
caacaatacggccgatcaccacta

SEQ ID NO: 51616 - RNA, 24 nt, synthetic construct
  misc_feature 1..24: note = derived and/or modified sequence opt6 from anti-HIV_CDR
  source 1..24: mol_type = other RNA
caacaatacggctcatcaccacta

SEQ ID NO: 51617 - RNA, 24 nt, synthetic construct
  misc_feature 1..24: note = derived and/or modified sequence opt6 from anti-HIV_CDR
  source 1..24: mol_type = other RNA
caacaatataatgactggccagca

SEQ ID NO: 51618 - RNA, 24 nt, synthetic construct
  misc_feature 1..24: note = derived and/or modified sequence opt6 from anti-HIV_CDR
  source 1..24: mol_type = other RNA
catcaatatggctcaagccaaaga

SEQ ID NO: 51619 - RNA, 24 nt, synthetic construct
  misc_feature 1..24: note = derived and/or modified sequence opt6 from anti-HIV_CDR
  source 1..24: mol_type = other RNA
caacaaacatactcatccgtcacc

SEQ ID NO: 51620 - RNA, 24 nt, synthetic construct
  misc_feature 1..24: note = derived and/or modified sequence opt6 from anti-HIV_CDR
  source 1..24: mol_type = other RNA
caacaaacatacagatcagtcaca

SEQ ID NO: 51621 - RNA, 24 nt, synthetic construct
  misc_feature 1..24: note = derived and/or modified sequence opt6 from anti-HIV_CDR
  source 1..24: mol_type = other RNA
caacagtacggaagttcatggaca

SEQ ID NO: 51622 - RNA, 24 nt, synthetic construct
  misc_feature 1..24: note = derived and/or modified sequence opt6 from anti-HIV_CDR
  source 1..24: mol_type = other RNA
agctcgtacgcgggaataaataat

SEQ ID NO: 51623 - RNA, 24 nt, synthetic construct
  misc_feature 1..24: note = derived and/or modified sequence opt6 from anti-HIV_CDR
  source 1..24: mol_type = other RNA
caaaaatacggcagttcactaaca

SEQ ID NO: 51624 - RNA, 24 nt, synthetic construct
  misc_feature 1..24: note = derived and/or modified sequence opt6 from anti-HIV_CDR
  source 1..24: mol_type = other RNA
atgcaagcactagaaacattaggc

SEQ ID NO: 51625 - RNA, 24 nt, synthetic construct
  misc_feature 1..24: note = derived and/or modified sequence opt6 from anti-HIV_CDR
  source 1..24: mol_type = other RNA
caacaatacgccggatcactaaca

SEQ ID NO: 51626 - RNA, 24 nt, synthetic construct
  misc_feature 1..24: note = derived and/or modified sequence opt6 from anti-HIV_CDR
  source 1..24: mol_type = other RNA
agaaattggggtaattttgaccat

SEQ ID NO: 51627 - RNA, 27 nt, synthetic construct
  misc_feature 1..27: note = derived and/or modified sequence opt6 from anti-HIV_CDR
  source 1..27: mol_type = other RNA
caacaacactacacaacaccctggacc

SEQ ID NO: 51628 - RNA, 27 nt, synthetic construct
  misc_feature 1..27: note = derived and/or modified sequence opt6 from anti-HIV_CDR
  source 1..27: mol_type = other RNA
caacaatcatttgccgtcccctataca

SEQ ID NO: 51629 - RNA, 27 nt, synthetic construct
  misc_feature 1..27: note = derived and/or modified sequence opt6 from anti-HIV_CDR
  source 1..27: mol_type = other RNA
caacaatacaaatcatactccggcacc

SEQ ID NO: 51630 - RNA, 27 nt, synthetic construct
  misc_feature 1..27: note = derived and/or modified sequence opt6 from anti-HIV_CDR
  source 1..27: mol_type = other RNA
catcaatatgcctattcacccagaacc

SEQ ID NO: 51631 - RNA, 27 nt, synthetic construct
  misc_feature 1..27: note = derived and/or modified sequence opt6 from anti-HIV_CDR
  source 1..27: mol_type = other RNA
caacaatacaactccttcccccccacc

SEQ ID NO: 51632 - RNA, 27 nt, synthetic construct
  misc_feature 1..27: note = derived and/or modified sequence opt6 from anti-HIV_CDR
  source 1..27: mol_type = other RNA
caacaaacatactcaaacccacgcatg

SEQ ID NO: 51633 - RNA, 27 nt, synthetic construct
  misc_feature 1..27: note = derived and/or modified sequence opt6 from anti-HIV_CDR
  source 1..27: mol_type = other RNA
caacaatacgaagacccaccatggaca

SEQ ID NO: 51634 - RNA, 27 nt, synthetic construct
  misc_feature 1..27: note = derived and/or modified sequence opt6 from anti-HIV_CDR
  source 1..27: mol_type = other RNA
caccaatacttcaataccccccgcacc

SEQ ID NO: 51635 - RNA, 27 nt, synthetic construct
  misc_feature 1..27: note = derived and/or modified sequence opt6 from anti-HIV_CDR
  source 1..27: mol_type = other RNA
catcaatatttctctaccccccgcacc

SEQ ID NO: 51636 - RNA, 27 nt, synthetic construct
  misc_feature 1..27: note = derived and/or modified sequence opt6 from anti-HIV_CDR
  source 1..27: mol_type = other RNA
caacatagaagtaactggccatggaca

SEQ ID NO: 51637 - RNA, 27 nt, synthetic construct
  misc_feature 1..27: note = derived and/or modified sequence opt6 from anti-HIV_CDR
  source 1..27: mol_type = other RNA
agagggagaaggcaaataggagattac

SEQ ID NO: 51638 - RNA, 27 nt, synthetic construct
  misc_feature 1..27: note = derived and/or modified sequence opt6 from anti-HIV_CDR
  source 1..27: mol_type = other RNA
caacaatacggactaagtccatggaca

SEQ ID NO: 51639 - RNA, 27 nt, synthetic construct
  misc_feature 1..27: note = derived and/or modified sequence opt6 from anti-HIV_CDR
  source 1..27: mol_type = other RNA
caacaaacctacacctcccccatcaca

SEQ ID NO: 51640 - RNA, 27 nt, synthetic construct
  misc_feature 1..27: note = derived and/or modified sequence opt6 from anti-HIV_CDR
  source 1..27: mol_type = other RNA
caacaatacggctcatcaccaccaaca

SEQ ID NO: 51641 - RNA, 27 nt, synthetic construct
  misc_feature 1..27: note = derived and/or modified sequence opt6 from anti-HIV_CDR
  source 1..27: mol_type = other RNA
cagcaatatggcacaagttcatgcaca

SEQ ID NO: 51642 - RNA, 27 nt, synthetic construct
  misc_feature 1..27: note = derived and/or modified sequence opt6 from anti-HIV_CDR
  source 1..27: mol_type = other RNA
caacaatacgacgacgcaccaataaca

SEQ ID NO: 51643 - RNA, 27 nt, synthetic construct
  misc_feature 1..27: note = derived and/or modified sequence opt6 from anti-HIV_CDR
  source 1..27: mol_type = other RNA
ggcccgctattaagatatctagatagc

SEQ ID NO: 51644 - RNA, 27 nt, synthetic construct
  misc_feature 1..27: note = derived and/or modified sequence opt6 from anti-HIV_CDR
  source 1..27: mol_type = other RNA
tgtctaaagaaaacgagctcgtacgtg

SEQ ID NO: 51645 - RNA, 27 nt, synthetic construct
  misc_feature 1..27: note = derived and/or modified sequence opt6 from anti-HIV_CDR
  source 1..27: mol_type = other RNA
caacaatacaaccactggccacaaaca

SEQ ID NO: 51646 - RNA, 27 nt, synthetic construct
  misc_feature 1..27: note = derived and/or modified sequence opt6 from anti-HIV_CDR
  source 1..27: mol_type = other RNA
caacaatactccaacctcccctacacc

SEQ ID NO: 51647 - RNA, 27 nt, synthetic construct
  misc_feature 1..27: note = derived and/or modified sequence opt6 from anti-HIV_CDR
  source 1..27: mol_type = other RNA
caacaatacgacacatatcccggaacc

SEQ ID NO: 51648 - RNA, 27 nt, synthetic construct
  misc_feature 1..27: note = derived and/or modified sequence opt6 from anti-HIV_CDR
  source 1..27: mol_type = other RNA
caagaatactcaagcacgccctataac

SEQ ID NO: 51649 - RNA, 27 nt, synthetic construct
  misc_feature 1..27: note = derived and/or modified sequence opt6 from anti-HIV_CDR
  source 1..27: mol_type = other RNA
ggagcttgggatgatacgttatatgta

SEQ ID NO: 51650 - RNA, 27 nt, synthetic construct
  misc_feature 1..27: note = derived and/or modified sequence opt6 from anti-HIV_CDR
  source 1..27: mol_type = other RNA
gcagcctgggatgatacattatatgta

SEQ ID NO: 51651 - RNA, 27 nt, synthetic construct
  misc_feature 1..27: note = derived and/or modified sequence opt6 from anti-HIV_CDR
  source 1..27: mol_type = other RNA
caacaatactactccgactccataacc

SEQ ID NO: 51652 - RNA, 27 nt, synthetic construct
  misc_feature 1..27: note = derived and/or modified sequence opt6 from anti-HIV_CDR
  source 1..27: mol_type = other RNA
caacaatacggccgatcaccatataca

SEQ ID NO: 51653 - RNA, 27 nt, synthetic construct
  misc_feature 1..27: note = derived and/or modified sequence opt6 from anti-HIV_CDR
  source 1..27: mol_type = other RNA
caacaatacacaaactacccctggacc

SEQ ID NO: 51654 - RNA, 27 nt, synthetic construct
  misc_feature 1..27: note = derived and/or modified sequence opt6 from anti-HIV_CDR
  source 1..27: mol_type = other RNA
caacaaagacataactggccaataagc

SEQ ID NO: 51655 - RNA, 27 nt, synthetic construct
  misc_feature 1..27: note = derived and/or modified sequence opt6 from anti-HIV_CDR
  source 1..27: mol_type = other RNA
caacaataccacaactggccaagaaca

SEQ ID NO: 51656 - RNA, 27 nt, synthetic construct
  misc_feature 1..27: note = derived and/or modified sequence opt6 from anti-HIV_CDR
  source 1..27: mol_type = other RNA
caacaaagatcaacctggccaccaaca

SEQ ID NO: 51657 - RNA, 27 nt, synthetic construct
  misc_feature 1..27: note = derived and/or modified sequence opt6 from anti-HIV_CDR
  source 1..27: mol_type = other RNA
caacaatacgatagctttagctggacc

SEQ ID NO: 51658 - RNA, 27 nt, synthetic construct
  misc_feature 1..27: note = derived and/or modified sequence opt6 from anti-HIV_CDR
  source 1..27: mol_type = other RNA
caacaatacaacaacctacccgtcacc

SEQ ID NO: 51659 - RNA, 27 nt, synthetic construct
  misc_feature 1..27: note = derived and/or modified sequence opt6 from anti-HIV_CDR
  source 1..27: mol_type = other RNA
caacaatacaaccgctactcctacacc

SEQ ID NO: 51660 - RNA, 27 nt, synthetic construct
  misc_feature 1..27: note = derived and/or modified sequence opt6 from anti-HIV_CDR
  source 1..27: mol_type = other RNA
caagaatactatatattgccctgtagc

SEQ ID NO: 51661 - RNA, 27 nt, synthetic construct
  misc_feature 1..27: note = derived and/or modified sequence opt6 from anti-HIV_CDR
  source 1..27: mol_type = other RNA
caacaatacgacaacctactcgcacac

SEQ ID NO: 51662 - RNA, 27 nt, synthetic construct
  misc_feature 1..27: note = derived and/or modified sequence opt6 from anti-HIV_CDR
  source 1..27: mol_type = other RNA
caccagtgcgataacttaatcgcacgc

SEQ ID NO: 51663 - RNA, 27 nt, synthetic construct
  misc_feature 1..27: note = derived and/or modified sequence opt6 from anti-HIV_CDR
  source 1..27: mol_type = other RNA
caacaatcattctcaactctctggacc

SEQ ID NO: 51664 - RNA, 27 nt, synthetic construct
  misc_feature 1..27: note = derived and/or modified sequence opt6 from anti-HIV_CDR
  source 1..27: mol_type = other RNA
caccaatcctactccaccccccccacc

SEQ ID NO: 51665 - RNA, 27 nt, synthetic construct
  misc_feature 1..27: note = derived and/or modified sequence opt6 from anti-HIV_CDR
  source 1..27: mol_type = other RNA
caacaaggatattcaactccatggaca

SEQ ID NO: 51666 - RNA, 27 nt, synthetic construct
  misc_feature 1..27: note = derived and/or modified sequence opt6 from anti-HIV_CDR
  source 1..27: mol_type = other RNA
caacaatactcaaccacaccccgcacc

SEQ ID NO: 51667 - RNA, 27 nt, synthetic construct
  misc_feature 1..27: note = derived and/or modified sequence opt6 from anti-HIV_CDR
  source 1..27: mol_type = other RNA
caactatacaattccgtcccccaaacc

SEQ ID NO: 51668 - RNA, 27 nt, synthetic construct
  misc_feature 1..27: note = derived and/or modified sequence opt6 from anti-HIV_CDR
  source 1..27: mol_type = other RNA
caacaaagaacaagctggccacaaaca

SEQ ID NO: 51669 - RNA, 27 nt, synthetic construct
  misc_feature 1..27: note = derived and/or modified sequence opt6 from anti-HIV_CDR
  source 1..27: mol_type = other RNA
caacaattcaacacctactcccaaacc

SEQ ID NO: 51670 - RNA, 27 nt, synthetic construct
  misc_feature 1..27: note = derived and/or modified sequence opt6 from anti-HIV_CDR
  source 1..27: mol_type = other RNA
atgcaatcactccaaaccccaatcaca

SEQ ID NO: 51671 - RNA, 27 nt, synthetic construct
  misc_feature 1..27: note = derived and/or modified sequence opt6 from anti-HIV_CDR
  source 1..27: mol_type = other RNA
caacaatacaactcctaccccctcacc

SEQ ID NO: 51672 - RNA, 27 nt, synthetic construct
  misc_feature 1..27: note = derived and/or modified sequence opt6 from anti-HIV_CDR
  source 1..27: mol_type = other RNA
caacaatacaactcatactccggcacc

SEQ ID NO: 51673 - RNA, 27 nt, synthetic construct
  misc_feature 1..27: note = derived and/or modified sequence opt6 from anti-HIV_CDR
  source 1..27: mol_type = other RNA
cagagttatgacagtagtttaagcgga

SEQ ID NO: 51674 - RNA, 27 nt, synthetic construct
  misc_feature 1..27: note = derived and/or modified sequence opt6 from anti-HIV_CDR
  source 1..27: mol_type = other RNA
agccaaggcaatacagcaatagattac

SEQ ID NO: 51675 - RNA, 27 nt, synthetic construct
  misc_feature 1..27: note = derived and/or modified sequence opt6 from anti-HIV_CDR
  source 1..27: mol_type = other RNA
gaggaaccaagagacgcatttgattta

SEQ ID NO: 51676 - RNA, 27 nt, synthetic construct
  misc_feature 1..27: note = derived and/or modified sequence opt6 from anti-HIV_CDR
  source 1..27: mol_type = other RNA
caacaatcctacaccacacccgtcacc

SEQ ID NO: 51677 - RNA, 27 nt, synthetic construct
  misc_feature 1..27: note = derived and/or modified sequence opt6 from anti-HIV_CDR
  source 1..27: mol_type = other RNA
gcaggaagagaaggatggtttgatccg

SEQ ID NO: 51678 - RNA, 27 nt, synthetic construct
  misc_feature 1..27: note = derived and/or modified sequence opt6 from anti-HIV_CDR
  source 1..27: mol_type = other RNA
caacaatactactccaccccccacacc

SEQ ID NO: 51679 - RNA, 27 nt, synthetic construct
  misc_feature 1..27: note = derived and/or modified sequence opt6 from anti-HIV_CDR
  source 1..27: mol_type = other RNA
caacaatcatactcaatagccggcaca

SEQ ID NO: 51680 - RNA, 27 nt, synthetic construct
  misc_feature 1..27: note = derived and/or modified sequence opt6 from anti-HIV_CDR
  source 1..27: mol_type = other RNA
caaaactacaacaaaccaccccgaacc

SEQ ID NO: 51681 - RNA, 27 nt, synthetic construct
  misc_feature 1..27: note = derived and/or modified sequence opt6 from anti-HIV_CDR
  source 1..27: mol_type = other RNA
atgcaatcaatccaactccccctcaca

SEQ ID NO: 51682 - RNA, 27 nt, synthetic construct
  misc_feature 1..27: note = derived and/or modified sequence opt6 from anti-HIV_CDR
  source 1..27: mol_type = other RNA
atgcaagcactccagacctcactcaca

SEQ ID NO: 51683 - RNA, 27 nt, synthetic construct
  misc_feature 1..27: note = derived and/or modified sequence opt6 from anti-HIV_CDR
  source 1..27: mol_type = other RNA
caacaatacagctcaagcccaagaaca

SEQ ID NO: 51684 - RNA, 27 nt, synthetic construct
  misc_feature 1..27: note = derived and/or modified sequence opt6 from anti-HIV_CDR
  source 1..27: mol_type = other RNA
caagcatgggatagctcgacagcagta

SEQ ID NO: 51685 - RNA, 27 nt, synthetic construct
  misc_feature 1..27: note = derived and/or modified sequence opt6 from anti-HIV_CDR
  source 1..27: mol_type = other RNA
caacactacaataactggccatacaca

SEQ ID NO: 51686 - RNA, 27 nt, synthetic construct
  misc_feature 1..27: note = derived and/or modified sequence opt6 from anti-HIV_CDR
  source 1..27: mol_type = other RNA
caacaatacgaccgcctacccataacc

SEQ ID NO: 51687 - RNA, 27 nt, synthetic construct
  misc_feature 1..27: note = derived and/or modified sequence opt6 from anti-HIV_CDR
  source 1..27: mol_type = other RNA
caacaatacggctcatcaccaataaca

SEQ ID NO: 51688 - RNA, 27 nt, synthetic construct
  misc_feature 1..27: note = derived and/or modified sequence opt6 from anti-HIV_CDR
  source 1..27: mol_type = other RNA
caacaatacgacgtctggccattaaca

SEQ ID NO: 51689 - RNA, 27 nt, synthetic construct
  misc_feature 1..27: note = derived and/or modified sequence opt6 from anti-HIV_CDR
  source 1..27: mol_type = other RNA
caccaatacgcctcatcacccagaacc

SEQ ID NO: 51690 - RNA, 27 nt, synthetic construct
  misc_feature 1..27: note = derived and/or modified sequence opt6 from anti-HIV_CDR
  source 1..27: mol_type = other RNA
atgcaatcactccacctcccctacaca

SEQ ID NO: 51691 - RNA, 27 nt, synthetic construct
  misc_feature 1..27: note = derived and/or modified sequence opt6 from anti-HIV_CDR
  source 1..27: mol_type = other RNA
caacaatactactcctcccccctcacc

SEQ ID NO: 51692 - RNA, 27 nt, synthetic construct
  misc_feature 1..27: note = derived and/or modified sequence opt6 from anti-HIV_CDR
  source 1..27: mol_type = other RNA
caacaacacgacacctttcccttcacc

SEQ ID NO: 51693 - RNA, 27 nt, synthetic construct
  misc_feature 1..27: note = derived and/or modified sequence opt6 from anti-HIV_CDR
  source 1..27: mol_type = other RNA
caacaatcctactccaccccctacacc

SEQ ID NO: 51694 - RNA, 27 nt, synthetic construct
  misc_feature 1..27: note = derived and/or modified sequence opt6 from anti-HIV_CDR
  source 1..27: mol_type = other RNA
caacaatacaaaacctaccccgtcacc

SEQ ID NO: 51695 - RNA, 27 nt, synthetic construct
  misc_feature 1..27: note = derived and/or modified sequence opt6 from anti-HIV_CDR
  source 1..27: mol_type = other RNA
caacaatactactccacacccgtcacc

SEQ ID NO: 51696 - RNA, 27 nt, synthetic construct
  misc_feature 1..27: note = derived and/or modified sequence opt6 from anti-HIV_CDR
  source 1..27: mol_type = other RNA
caacaatacaactggccaccattcaca

SEQ ID NO: 51697 - RNA, 27 nt, synthetic construct
  misc_feature 1..27: note = derived and/or modified sequence opt6 from anti-HIV_CDR
  source 1..27: mol_type = other RNA
atgcaaggaactcattggccatggaca

SEQ ID NO: 51698 - RNA, 27 nt, synthetic construct
  misc_feature 1..27: note = derived and/or modified sequence opt6 from anti-HIV_CDR
  source 1..27: mol_type = other RNA
catcaatgtggatctagtcctagaact

SEQ ID NO: 51699 - RNA, 27 nt, synthetic construct
  misc_feature 1..27: note = derived and/or modified sequence opt6 from anti-HIV_CDR
  source 1..27: mol_type = other RNA
caacaatacaactcatacttccgcacc

SEQ ID NO: 51700 - RNA, 27 nt, synthetic construct
  misc_feature 1..27: note = derived and/or modified sequence opt6 from anti-HIV_CDR
  source 1..27: mol_type = other RNA
caacaataccacaactggccaccatca

SEQ ID NO: 51701 - RNA, 27 nt, synthetic construct
  misc_feature 1..27: note = derived and/or modified sequence opt6 from anti-HIV_CDR
  source 1..27: mol_type = other RNA
atgcaagggacttattggttatggaca

SEQ ID NO: 51702 - RNA, 27 nt, synthetic construct
  misc_feature 1..27: note = derived and/or modified sequence opt6 from anti-HIV_CDR
  source 1..27: mol_type = other RNA
caacaaggcttttcagctccatttaca

SEQ ID NO: 51703 - RNA, 27 nt, synthetic construct
  misc_feature 1..27: note = derived and/or modified sequence opt6 from anti-HIV_CDR
  source 1..27: mol_type = other RNA
caacaatacaacacctaccccctcacc

SEQ ID NO: 51704 - RNA, 27 nt, synthetic construct
  misc_feature 1..27: note = derived and/or modified sequence opt6 from anti-HIV_CDR
  source 1..27: mol_type = other RNA
atgcaaggaacacattggccaagaaca

SEQ ID NO: 51705 - RNA, 27 nt, synthetic construct
  misc_feature 1..27: note = derived and/or modified sequence opt6 from anti-HIV_CDR
  source 1..27: mol_type = other RNA
tttggtcgtactccttggtttgatcct

SEQ ID NO: 51706 - RNA, 27 nt, synthetic construct
  misc_feature 1..27: note = derived and/or modified sequence opt6 from anti-HIV_CDR
  source 1..27: mol_type = other RNA
caacaatacttcacatccgtcatcaca

SEQ ID NO: 51707 - RNA, 27 nt, synthetic construct
  misc_feature 1..27: note = derived and/or modified sequence opt6 from anti-HIV_CDR
  source 1..27: mol_type = other RNA
caccattacatgtccgacctccaaacc

SEQ ID NO: 51708 - RNA, 27 nt, synthetic construct
  misc_feature 1..27: note = derived and/or modified sequence opt6 from anti-HIV_CDR
  source 1..27: mol_type = other RNA
caccactactcctcctcctcccacacc

SEQ ID NO: 51709 - RNA, 27 nt, synthetic construct
  misc_feature 1..27: note = derived and/or modified sequence opt6 from anti-HIV_CDR
  source 1..27: mol_type = other RNA
caccattacaaatccgactgccaaacc

SEQ ID NO: 51710 - RNA, 27 nt, synthetic construct
  misc_feature 1..27: note = derived and/or modified sequence opt6 from anti-HIV_CDR
  source 1..27: mol_type = other RNA
caacacagatcatcctggccattaaca

SEQ ID NO: 51711 - RNA, 27 nt, synthetic construct
  misc_feature 1..27: note = derived and/or modified sequence opt6 from anti-HIV_CDR
  source 1..27: mol_type = other RNA
ctacaacaccattcatatccctggacc

SEQ ID NO: 51712 - RNA, 27 nt, synthetic construct
  misc_feature 1..27: note = derived and/or modified sequence opt6 from anti-HIV_CDR
  source 1..27: mol_type = other RNA
caacaatacggaacaagtccaggaaca

SEQ ID NO: 51713 - RNA, 27 nt, synthetic construct
  misc_feature 1..27: note = derived and/or modified sequence opt6 from anti-HIV_CDR
  source 1..27: mol_type = other RNA
caacaatacggctcatcaccaacaaca

SEQ ID NO: 51714 - RNA, 27 nt, synthetic construct
  misc_feature 1..27: note = derived and/or modified sequence opt6 from anti-HIV_CDR
  source 1..27: mol_type = other RNA
caacaatacggcacatcaccaacaaca

SEQ ID NO: 51715 - RNA, 27 nt, synthetic construct
  misc_feature 1..27: note = derived and/or modified sequence opt6 from anti-HIV_CDR
  source 1..27: mol_type = other RNA
atgcaagcaacacattggccaccagga

SEQ ID NO: 51716 - RNA, 27 nt, synthetic construct
  misc_feature 1..27: note = derived and/or modified sequence opt6 from anti-HIV_CDR
  source 1..27: mol_type = other RNA
caaagatacaatagagacccatacata

SEQ ID NO: 51717 - RNA, 27 nt, synthetic construct
  misc_feature 1..27: note = derived and/or modified sequence opt6 from anti-HIV_CDR
  source 1..27: mol_type = other RNA
caacaatacgacaacctaccactagcc

SEQ ID NO: 51718 - RNA, 27 nt, synthetic construct
  misc_feature 1..27: note = derived and/or modified sequence opt6 from anti-HIV_CDR
  source 1..27: mol_type = other RNA
tcttcatattcagctacaggtgtagct

SEQ ID NO: 51719 - RNA, 27 nt, synthetic construct
  misc_feature 1..27: note = derived and/or modified sequence opt6 from anti-HIV_CDR
  source 1..27: mol_type = other RNA
caacattacggaaacagtagatggaca

SEQ ID NO: 51720 - RNA, 27 nt, synthetic construct
  misc_feature 1..27: note = derived and/or modified sequence opt6 from anti-HIV_CDR
  source 1..27: mol_type = other RNA
caacaatacgaaacatatccctggacc

SEQ ID NO: 51721 - RNA, 27 nt, synthetic construct
  misc_feature 1..27: note = derived and/or modified sequence opt6 from anti-HIV_CDR
  source 1..27: mol_type = other RNA
caacaatacggctcatcaccatcaaca

SEQ ID NO: 51722 - RNA, 27 nt, synthetic construct
  misc_feature 1..27: note = derived and/or modified sequence opt6 from anti-HIV_CDR
  source 1..27: mol_type = other RNA
caacaatcccaacgcacaccccacacc

SEQ ID NO: 51723 - RNA, 27 nt, synthetic construct
  misc_feature 1..27: note = derived and/or modified sequence opt6 from anti-HIV_CDR
  source 1..27: mol_type = other RNA
caacaatacgacatcctacccctaacc

SEQ ID NO: 51724 - RNA, 27 nt, synthetic construct
  misc_feature 1..27: note = derived and/or modified sequence opt6 from anti-HIV_CDR
  source 1..27: mol_type = other RNA
caacaatcaaactcatcaccctggacc

SEQ ID NO: 51725 - RNA, 27 nt, synthetic construct
  misc_feature 1..27: note = derived and/or modified sequence opt6 from anti-HIV_CDR
  source 1..27: mol_type = other RNA
caacaatcatacgacaccccacgcaca

SEQ ID NO: 51726 - RNA, 27 nt, synthetic construct
  misc_feature 1..27: note = derived and/or modified sequence opt6 from anti-HIV_CDR
  source 1..27: mol_type = other RNA
caacaattcggatcaagtccaggaaca

SEQ ID NO: 51727 - RNA, 27 nt, synthetic construct
  misc_feature 1..27: note = derived and/or modified sequence opt6 from anti-HIV_CDR
  source 1..27: mol_type = other RNA
caccaatacggctcatcaccacaaaca

SEQ ID NO: 51728 - RNA, 27 nt, synthetic construct
  misc_feature 1..27: note = derived and/or modified sequence opt6 from anti-HIV_CDR
  source 1..27: mol_type = other RNA
catcaatacggctcatctcctcaatct

SEQ ID NO: 51729 - RNA, 27 nt, synthetic construct
  misc_feature 1..27: note = derived and/or modified sequence opt6 from anti-HIV_CDR
  source 1..27: mol_type = other RNA
ctccaacacaactcctaccccctcacc

SEQ ID NO: 51730 - RNA, 27 nt, synthetic construct
  misc_feature 1..27: note = derived and/or modified sequence opt6 from anti-HIV_CDR
  source 1..27: mol_type = other RNA
caacaatacaacgactggccaataaca

SEQ ID NO: 51731 - RNA, 27 nt, synthetic construct
  misc_feature 1..27: note = derived and/or modified sequence opt6 from anti-HIV_CDR
  source 1..27: mol_type = other RNA
caacaaaccttcaccttcccctacacc

SEQ ID NO: 51732 - RNA, 27 nt, synthetic construct
  misc_feature 1..27: note = derived and/or modified sequence opt6 from anti-HIV_CDR
  source 1..27: mol_type = other RNA
caacaatcctacaccttcccctacatc

SEQ ID NO: 51733 - RNA, 27 nt, synthetic construct
  misc_feature 1..27: note = derived and/or modified sequence opt6 from anti-HIV_CDR
  source 1..27: mol_type = other RNA
caatattacggctcatcaccatacaca

SEQ ID NO: 51734 - RNA, 27 nt, synthetic construct
  misc_feature 1..27: note = derived and/or modified sequence opt6 from anti-HIV_CDR
  source 1..27: mol_type = other RNA
caacaatcattcggaacaccaagaaca

SEQ ID NO: 51735 - RNA, 27 nt, synthetic construct
  misc_feature 1..27: note = derived and/or modified sequence opt6 from anti-HIV_CDR
  source 1..27: mol_type = other RNA
caacaatataacgactggccaagaaca

SEQ ID NO: 51736 - RNA, 27 nt, synthetic construct
  misc_feature 1..27: note = derived and/or modified sequence opt6 from anti-HIV_CDR
  source 1..27: mol_type = other RNA
caacaatacggctcaagcccaagaaca

SEQ ID NO: 51737 - RNA, 27 nt, synthetic construct
  misc_feature 1..27: note = derived and/or modified sequence opt6 from anti-HIV_CDR
  source 1..27: mol_type = other RNA
ctacaacacaatagatatccctggacc

SEQ ID NO: 51738 - RNA, 27 nt, synthetic construct
  misc_feature 1..27: note = derived and/or modified sequence opt6 from anti-HIV_CDR
  source 1..27: mol_type = other RNA
ctacaacacaataactacccctggacc

SEQ ID NO: 51739 - RNA, 27 nt, synthetic construct
  misc_feature 1..27: note = derived and/or modified sequence opt6 from anti-HIV_CDR
  source 1..27: mol_type = other RNA
ctccaatactccacctaccccctcacc

SEQ ID NO: 51740 - RNA, 27 nt, synthetic construct
  misc_feature 1..27: note = derived and/or modified sequence opt6 from anti-HIV_CDR
  source 1..27: mol_type = other RNA
ctacaatacaacgcctacccactcaca

SEQ ID NO: 51741 - RNA, 27 nt, synthetic construct
  misc_feature 1..27: note = derived and/or modified sequence opt6 from anti-HIV_CDR
  source 1..27: mol_type = other RNA
caacaatacgattccgcacccgtaacc

SEQ ID NO: 51742 - RNA, 27 nt, synthetic construct
  misc_feature 1..27: note = derived and/or modified sequence opt6 from anti-HIV_CDR
  source 1..27: mol_type = other RNA
caacaaacctacaccttcccctactcc

SEQ ID NO: 51743 - RNA, 27 nt, synthetic construct
  misc_feature 1..27: note = derived and/or modified sequence opt6 from anti-HIV_CDR
  source 1..27: mol_type = other RNA
ggatatgataatagtgggccggattat

SEQ ID NO: 51744 - RNA, 27 nt, synthetic construct
  misc_feature 1..27: note = derived and/or modified sequence opt6 from anti-HIV_CDR
  source 1..27: mol_type = other RNA
caacaatacaacaactggccaccagca

SEQ ID NO: 51745 - RNA, 27 nt, synthetic construct
  misc_feature 1..27: note = derived and/or modified sequence opt6 from anti-HIV_CDR
  source 1..27: mol_type = other RNA
caccaatacgcattatcaccctggacc

SEQ ID NO: 51746 - RNA, 27 nt, synthetic construct
  misc_feature 1..27: note = derived and/or modified sequence opt6 from anti-HIV_CDR
  source 1..27: mol_type = other RNA
caaaaatacgataccgatcccatgacc

SEQ ID NO: 51747 - RNA, 27 nt, synthetic construct
  misc_feature 1..27: note = derived and/or modified sequence opt6 from anti-HIV_CDR
  source 1..27: mol_type = other RNA
caacaatacaactactaccccatcacc

SEQ ID NO: 51748 - RNA, 27 nt, synthetic construct
  misc_feature 1..27: note = derived and/or modified sequence opt6 from anti-HIV_CDR
  source 1..27: mol_type = other RNA
caacaaacctttaccgaccccgtaacc

SEQ ID NO: 51749 - RNA, 27 nt, synthetic construct
  misc_feature 1..27: note = derived and/or modified sequence opt6 from anti-HIV_CDR
  source 1..27: mol_type = other RNA
gcggcttgggatgatagtttacatgta

SEQ ID NO: 51750 - RNA, 27 nt, synthetic construct
  misc_feature 1..27: note = derived and/or modified sequence opt6 from anti-HIV_CDR
  source 1..27: mol_type = other RNA
caacaatacgcctcctcacccttcacc

SEQ ID NO: 51751 - RNA, 27 nt, synthetic construct
  misc_feature 1..27: note = derived and/or modified sequence opt6 from anti-HIV_CDR
  source 1..27: mol_type = other RNA
caacaatcctcctccacccccttcacc

SEQ ID NO: 51752 - RNA, 27 nt, synthetic construct
  misc_feature 1..27: note = derived and/or modified sequence opt6 from anti-HIV_CDR
  source 1..27: mol_type = other RNA
caacaaagaagtaactgggcaataaca

SEQ ID NO: 51753 - RNA, 27 nt, synthetic construct
  misc_feature 1..27: note = derived and/or modified sequence opt6 from anti-HIV_CDR
  source 1..27: mol_type = other RNA
caacaatacggctcatcaccattcaca

SEQ ID NO: 51754 - RNA, 27 nt, synthetic construct
  misc_feature 1..27: note = derived and/or modified sequence opt6 from anti-HIV_CDR
  source 1..27: mol_type = other RNA
caaaaatacaatggagcaccatggaca

SEQ ID NO: 51755 - RNA, 27 nt, synthetic construct
  misc_feature 1..27: note = derived and/or modified sequence opt6 from anti-HIV_CDR
  source 1..27: mol_type = other RNA
caaaaatacaataacgcaccctggacc

SEQ ID NO: 51756 - RNA, 27 nt, synthetic construct
  misc_feature 1..27: note = derived and/or modified sequence opt6 from anti-HIV_CDR
  source 1..27: mol_type = other RNA
caacaaagagtaaactggccaccaaac

SEQ ID NO: 51757 - RNA, 27 nt, synthetic construct
  misc_feature 1..27: note = derived and/or modified sequence opt6 from anti-HIV_CDR
  source 1..27: mol_type = other RNA
caacaaagaggacactggccattaaca

SEQ ID NO: 51758 - RNA, 27 nt, synthetic construct
  misc_feature 1..27: note = derived and/or modified sequence opt6 from anti-HIV_CDR
  source 1..27: mol_type = other RNA
caacaatatcgctacagcgtaatcata

SEQ ID NO: 51759 - RNA, 27 nt, synthetic construct
  misc_feature 1..27: note = derived and/or modified sequence opt6 from anti-HIV_CDR
  source 1..27: mol_type = other RNA
caacaatccggcacatcactactaaca

SEQ ID NO: 51760 - RNA, 27 nt, synthetic construct
  misc_feature 1..27: note = derived and/or modified sequence opt6 from anti-HIV_CDR
  source 1..27: mol_type = other RNA
atgaaatcacaacacagcccacgcaca

SEQ ID NO: 51761 - RNA, 27 nt, synthetic construct
  misc_feature 1..27: note = derived and/or modified sequence opt6 from anti-HIV_CDR
  source 1..27: mol_type = other RNA
atgcaaccactccaaaccccatacaca

SEQ ID NO: 51762 - RNA, 27 nt, synthetic construct
  misc_feature 1..27: note = derived and/or modified sequence opt6 from anti-HIV_CDR
  source 1..27: mol_type = other RNA
caacaatacacagcatacccatggaca

SEQ ID NO: 51763 - RNA, 27 nt, synthetic construct
  misc_feature 1..27: note = derived and/or modified sequence opt6 from anti-HIV_CDR
  source 1..27: mol_type = other RNA
ctacaaaaccacaactacccccgcacc

SEQ ID NO: 51764 - RNA, 27 nt, synthetic construct
  misc_feature 1..27: note = derived and/or modified sequence opt6 from anti-HIV_CDR
  source 1..27: mol_type = other RNA
ctacaaacacactcatacccccgcacc

SEQ ID NO: 51765 - RNA, 30 nt, synthetic construct
  misc_feature 1..30: note = derived and/or modified sequence opt6 from anti-HIV_CDR
  source 1..30: mol_type = other RNA
gctgcatgggatgattcatttgattatgta

SEQ ID NO: 51766 - RNA, 30 nt, synthetic construct
  misc_feature 1..30: note = derived and/or modified sequence opt6 from anti-HIV_CDR
  source 1..30: mol_type = other RNA
caacactcattcggatcaccaccatggaca

SEQ ID NO: 51767 - RNA, 30 nt, synthetic construct
  misc_feature 1..30: note = derived and/or modified sequence opt6 from anti-HIV_CDR
  source 1..30: mol_type = other RNA
tcttcattcacacccacaaacacactcgtc

SEQ ID NO: 51768 - RNA, 30 nt, synthetic construct
  misc_feature 1..30: note = derived and/or modified sequence opt6 from anti-HIV_CDR
  source 1..30: mol_type = other RNA
caacaatacggaacactacacccaagaaca

SEQ ID NO: 51769 - RNA, 30 nt, synthetic construct
  misc_feature 1..30: note = derived and/or modified sequence opt6 from anti-HIV_CDR
  source 1..30: mol_type = other RNA
caacaatacaacaactggccaccaataaca

SEQ ID NO: 51770 - RNA, 30 nt, synthetic construct
  misc_feature 1..30: note = derived and/or modified sequence opt6 from anti-HIV_CDR
  source 1..30: mol_type = other RNA
caacaatactaccaatggctatcctacacc

SEQ ID NO: 51771 - RNA, 30 nt, synthetic construct
  misc_feature 1..30: note = derived and/or modified sequence opt6 from anti-HIV_CDR
  source 1..30: mol_type = other RNA
caacaaagagcaaactggcgactactaaca

SEQ ID NO: 51772 - RNA, 30 nt, synthetic construct
  misc_feature 1..30: note = derived and/or modified sequence opt6 from anti-HIV_CDR
  source 1..30: mol_type = other RNA
cgtcattctgattattgtgatttagatgtt

SEQ ID NO: 51773 - RNA, 30 nt, synthetic construct
  misc_feature 1..30: note = derived and/or modified sequence opt6 from anti-HIV_CDR
  source 1..30: mol_type = other RNA
cgtaggtctgattattgtgattttgatgta

SEQ ID NO: 51774 - RNA, 30 nt, synthetic construct
  misc_feature 1..30: note = derived and/or modified sequence opt6 from anti-HIV_CDR
  source 1..30: mol_type = other RNA
agacatacagattactgtgattttgacgtt

SEQ ID NO: 51775 - RNA, 30 nt, synthetic construct
  misc_feature 1..30: note = derived and/or modified sequence opt6 from anti-HIV_CDR
  source 1..30: mol_type = other RNA
cagaggtctgattattgggattttgatgta

SEQ ID NO: 51776 - RNA, 30 nt, synthetic construct
  misc_feature 1..30: note = derived and/or modified sequence opt6 from anti-HIV_CDR
  source 1..30: mol_type = other RNA
cgtcattctgattattgtgattttgatatt

SEQ ID NO: 51777 - RNA, 30 nt, synthetic construct
  misc_feature 1..30: note = derived and/or modified sequence opt6 from anti-HIV_CDR
  source 1..30: mol_type = other RNA
tgcgaagtagatgcagatgaaacaataaca

SEQ ID NO: 51778 - RNA, 30 nt, synthetic construct
  misc_feature 1..30: note = derived and/or modified sequence opt6 from anti-HIV_CDR
  source 1..30: mol_type = other RNA
tgtgaagtagatgcagaagagacaataata

SEQ ID NO: 51779 - RNA, 30 nt, synthetic construct
  misc_feature 1..30: note = derived and/or modified sequence opt6 from anti-HIV_CDR
  source 1..30: mol_type = other RNA
cagaggtctgatttttgggattttgatgta

SEQ ID NO: 51780 - RNA, 30 nt, synthetic construct
  misc_feature 1..30: note = derived and/or modified sequence opt6 from anti-HIV_CDR
  source 1..30: mol_type = other RNA
cgtcattctgattattgtgattttgatgtt

SEQ ID NO: 51781 - RNA, 30 nt, synthetic construct
  misc_feature 1..30: note = derived and/or modified sequence opt6 from anti-HIV_CDR
  source 1..30: mol_type = other RNA
tgttcgtatgcagggggtcgtacggttgtg

SEQ ID NO: 51782 - RNA, 30 nt, synthetic construct
  misc_feature 1..30: note = derived and/or modified sequence opt6 from anti-HIV_CDR
  source 1..30: mol_type = other RNA
gctgcatgggatgattcattagattatgta

SEQ ID NO: 51783 - RNA, 30 nt, synthetic construct
  misc_feature 1..30: note = derived and/or modified sequence opt6 from anti-HIV_CDR
  source 1..30: mol_type = other RNA
caacaaagatcaaactggccaagactaaca

SEQ ID NO: 51784 - RNA, 30 nt, synthetic construct
  misc_feature 1..30: note = derived and/or modified sequence opt6 from anti-HIV_CDR
  source 1..30: mol_type = other RNA
caacaatacaacaactggccaccattcaca

SEQ ID NO: 51785 - RNA, 30 nt, synthetic construct
  misc_feature 1..30: note = derived and/or modified sequence opt6 from anti-HIV_CDR
  source 1..30: mol_type = other RNA
atgcaaggaacatactggccaccattaaca

SEQ ID NO: 51786 - RNA, 30 nt, synthetic construct
  misc_feature 1..30: note = derived and/or modified sequence opt6 from anti-HIV_CDR
  source 1..30: mol_type = other RNA
caacaatacggctcatcactactatacaca

SEQ ID NO: 51787 - RNA, 30 nt, synthetic construct
  misc_feature 1..30: note = derived and/or modified sequence opt6 from anti-HIV_CDR
  source 1..30: mol_type = other RNA
caacaatctttcggtatacctccatggaca

SEQ ID NO: 51788 - RNA, 30 nt, synthetic construct
  misc_feature 1..30: note = derived and/or modified sequence opt6 from anti-HIV_CDR
  source 1..30: mol_type = other RNA
tgttcgtatgcgggctcgtattcgtatgtg

SEQ ID NO: 51789 - RNA, 30 nt, synthetic construct
  misc_feature 1..30: note = derived and/or modified sequence opt6 from anti-HIV_CDR
  source 1..30: mol_type = other RNA
tattcgtatgcgggtaatagtttgggtgtg

SEQ ID NO: 51790 - RNA, 30 nt, synthetic construct
  misc_feature 1..30: note = derived and/or modified sequence opt6 from anti-HIV_CDR
  source 1..30: mol_type = other RNA
agttcatacacaatctcaagcccgcgcgta

SEQ ID NO: 51791 - RNA, 30 nt, synthetic construct
  misc_feature 1..30: note = derived and/or modified sequence opt6 from anti-HIV_CDR
  source 1..30: mol_type = other RNA
caagaatgggaattacagccatttgactat

SEQ ID NO: 51792 - RNA, 30 nt, synthetic construct
  misc_feature 1..30: note = derived and/or modified sequence opt6 from anti-HIV_CDR
  source 1..30: mol_type = other RNA
ttaatacctgtatctggagcttttgatgta

SEQ ID NO: 51793 - RNA, 30 nt, synthetic construct
  misc_feature 1..30: note = derived and/or modified sequence opt6 from anti-HIV_CDR
  source 1..30: mol_type = other RNA
gatcgagattacgatgaagatttcgatttc

SEQ ID NO: 51794 - RNA, 30 nt, synthetic construct
  misc_feature 1..30: note = derived and/or modified sequence opt6 from anti-HIV_CDR
  source 1..30: mol_type = other RNA
caagaatacggacgatcaccaccatttcca

SEQ ID NO: 51795 - RNA, 30 nt, synthetic construct
  misc_feature 1..30: note = derived and/or modified sequence opt6 from anti-HIV_CDR
  source 1..30: mol_type = other RNA
actttagatggcaatttccattgggatttc

SEQ ID NO: 51796 - RNA, 30 nt, synthetic construct
  misc_feature 1..30: note = derived and/or modified sequence opt6 from anti-HIV_CDR
  source 1..30: mol_type = other RNA
tttacacaaagacaaggcggattcgattac

SEQ ID NO: 51797 - RNA, 30 nt, synthetic construct
  misc_feature 1..30: note = derived and/or modified sequence opt6 from anti-HIV_CDR
  source 1..30: mol_type = other RNA
caacaatactacaaatggccaccaataaca

SEQ ID NO: 51798 - RNA, 30 nt, synthetic construct
  misc_feature 1..30: note = derived and/or modified sequence opt6 from anti-HIV_CDR
  source 1..30: mol_type = other RNA
caacaatacggatcatcagcaccatataca

SEQ ID NO: 51799 - RNA, 30 nt, synthetic construct
  misc_feature 1..30: note = derived and/or modified sequence opt6 from anti-HIV_CDR
  source 1..30: mol_type = other RNA
caacaactaaactcagacccaccatggaca

SEQ ID NO: 51800 - RNA, 30 nt, synthetic construct
  misc_feature 1..30: note = derived and/or modified sequence opt6 from anti-HIV_CDR
  source 1..30: mol_type = other RNA
caacaccacggatcatcaccaacatggaca

SEQ ID NO: 51801 - RNA, 30 nt, synthetic construct
  misc_feature 1..30: note = derived and/or modified sequence opt6 from anti-HIV_CDR
  source 1..30: mol_type = other RNA
caacaatacaaaaaatggccaccatggaca

SEQ ID NO: 51802 - RNA, 30 nt, synthetic construct
  misc_feature 1..30: note = derived and/or modified sequence opt6 from anti-HIV_CDR
  source 1..30: mol_type = other RNA
caacaatacggcttttcattacccgtcaca

SEQ ID NO: 51803 - RNA, 30 nt, synthetic construct
  misc_feature 1..30: note = derived and/or modified sequence opt6 from anti-HIV_CDR
  source 1..30: mol_type = other RNA
caatcatacaacggagacccaccagtaaca

SEQ ID NO: 51804 - RNA, 30 nt, synthetic construct
  misc_feature 1..30: note = derived and/or modified sequence opt6 from anti-HIV_CDR
  source 1..30: mol_type = other RNA
caacagtacggaagttcaagaagatggaca

SEQ ID NO: 51805 - RNA, 30 nt, synthetic construct
  misc_feature 1..30: note = derived and/or modified sequence opt6 from anti-HIV_CDR
  source 1..30: mol_type = other RNA
caacaattcaactcctacccccccctcacc

SEQ ID NO: 51806 - RNA, 30 nt, synthetic construct
  misc_feature 1..30: note = derived and/or modified sequence opt6 from anti-HIV_CDR
  source 1..30: mol_type = other RNA
agagaaggaagtcagggagcatttgatata

SEQ ID NO: 51807 - RNA, 30 nt, synthetic construct
  misc_feature 1..30: note = derived and/or modified sequence opt6 from anti-HIV_CDR
  source 1..30: mol_type = other RNA
ggagatagtgggccgacaggatttgattat

SEQ ID NO: 51808 - RNA, 30 nt, synthetic construct
  misc_feature 1..30: note = derived and/or modified sequence opt6 from anti-HIV_CDR
  source 1..30: mol_type = other RNA
gtaagaagaggctcaagttatccagattat

SEQ ID NO: 51809 - RNA, 30 nt, synthetic construct
  misc_feature 1..30: note = derived and/or modified sequence opt6 from anti-HIV_CDR
  source 1..30: mol_type = other RNA
tctgcatattaccgtaattggtttgattca

SEQ ID NO: 51810 - RNA, 30 nt, synthetic construct
  misc_feature 1..30: note = derived and/or modified sequence opt6 from anti-HIV_CDR
  source 1..30: mol_type = other RNA
caatcttatgattcatctgtatctgtcgtt

SEQ ID NO: 51811 - RNA, 30 nt, synthetic construct
  misc_feature 1..30: note = derived and/or modified sequence opt6 from anti-HIV_CDR
  source 1..30: mol_type = other RNA
tcttcatacacctcctcactcaccctcgtc

SEQ ID NO: 51812 - RNA, 30 nt, synthetic construct
  misc_feature 1..30: note = derived and/or modified sequence opt6 from anti-HIV_CDR
  source 1..30: mol_type = other RNA
tatgaggggaagaggagtgggatggatgtg

SEQ ID NO: 51813 - RNA, 30 nt, synthetic construct
  misc_feature 1..30: note = derived and/or modified sequence opt6 from anti-HIV_CDR
  source 1..30: mol_type = other RNA
caacaatacggaagctcaccagaatacaca

SEQ ID NO: 51814 - RNA, 30 nt, synthetic construct
  misc_feature 1..30: note = derived and/or modified sequence opt6 from anti-HIV_CDR
  source 1..30: mol_type = other RNA
caatactacgaccacagaccagcaatagca

SEQ ID NO: 51815 - RNA, 30 nt, synthetic construct
  misc_feature 1..30: note = derived and/or modified sequence opt6 from anti-HIV_CDR
  source 1..30: mol_type = other RNA
caacaatacgacaacctaccaagagtaaca

SEQ ID NO: 51816 - RNA, 30 nt, synthetic construct
  misc_feature 1..30: note = derived and/or modified sequence opt6 from anti-HIV_CDR
  source 1..30: mol_type = other RNA
ggagcatacacaacaacaagcacgctagta

SEQ ID NO: 51817 - RNA, 30 nt, synthetic construct
  misc_feature 1..30: note = derived and/or modified sequence opt6 from anti-HIV_CDR
  source 1..30: mol_type = other RNA
caacaatacaaatcctactcccccctcacc

SEQ ID NO: 51818 - RNA, 30 nt, synthetic construct
  misc_feature 1..30: note = derived and/or modified sequence opt6 from anti-HIV_CDR
  source 1..30: mol_type = other RNA
caacaatcatacaacacccgcccactcaca

SEQ ID NO: 51819 - RNA, 30 nt, synthetic construct
  misc_feature 1..30: note = derived and/or modified sequence opt6 from anti-HIV_CDR
  source 1..30: mol_type = other RNA
caacaatatggcggatcaccaccagataca

SEQ ID NO: 51820 - RNA, 30 nt, synthetic construct
  misc_feature 1..30: note = derived and/or modified sequence opt6 from anti-HIV_CDR
  source 1..30: mol_type = other RNA
tgttcatatacatcttcagctacagttgta

SEQ ID NO: 51821 - RNA, 30 nt, synthetic construct
  misc_feature 1..30: note = derived and/or modified sequence opt6 from anti-HIV_CDR
  source 1..30: mol_type = other RNA
tgttcacatacgagttcggacacacttgtg

SEQ ID NO: 51822 - RNA, 30 nt, synthetic construct
  misc_feature 1..30: note = derived and/or modified sequence opt6 from anti-HIV_CDR
  source 1..30: mol_type = other RNA
caacactatggcaatagcccaagagtaaca

SEQ ID NO: 51823 - RNA, 30 nt, synthetic construct
  misc_feature 1..30: note = derived and/or modified sequence opt6 from anti-HIV_CDR
  source 1..30: mol_type = other RNA
gatgcatttgtaagttcggctatggatgta

SEQ ID NO: 51824 - RNA, 30 nt, synthetic construct
  misc_feature 1..30: note = derived and/or modified sequence opt6 from anti-HIV_CDR
  source 1..30: mol_type = other RNA
ttacgtgcaactacacccggatttgattat

SEQ ID NO: 51825 - RNA, 30 nt, synthetic construct
  misc_feature 1..30: note = derived and/or modified sequence opt6 from anti-HIV_CDR
  source 1..30: mol_type = other RNA
ttacgtgcaactatacccggatttgattat

SEQ ID NO: 51826 - RNA, 30 nt, synthetic construct
  misc_feature 1..30: note = derived and/or modified sequence opt6 from anti-HIV_CDR
  source 1..30: mol_type = other RNA
ttaagagcaacaatagccggatttgattat

SEQ ID NO: 51827 - RNA, 30 nt, synthetic construct
  misc_feature 1..30: note = derived and/or modified sequence opt6 from anti-HIV_CDR
  source 1..30: mol_type = other RNA
tgttcgtatgcgggttcgtatatatgggtg

SEQ ID NO: 51828 - RNA, 30 nt, synthetic construct
  misc_feature 1..30: note = derived and/or modified sequence opt6 from anti-HIV_CDR
  source 1..30: mol_type = other RNA
tgttcgtatgcgggtacgtattcgtatgtg

SEQ ID NO: 51829 - RNA, 30 nt, synthetic construct
  misc_feature 1..30: note = derived and/or modified sequence opt6 from anti-HIV_CDR
  source 1..30: mol_type = other RNA
agttcgtacgcgggctcgaataatttcgtg

SEQ ID NO: 51830 - RNA, 30 nt, synthetic construct
  misc_feature 1..30: note = derived and/or modified sequence opt6 from anti-HIV_CDR
  source 1..30: mol_type = other RNA
ggatctttcactacatctctaactctagtt

SEQ ID NO: 51831 - RNA, 30 nt, synthetic construct
  misc_feature 1..30: note = derived and/or modified sequence opt6 from anti-HIV_CDR
  source 1..30: mol_type = other RNA
caacaatacgccacctcatcactatacaca

SEQ ID NO: 51832 - RNA, 30 nt, synthetic construct
  misc_feature 1..30: note = derived and/or modified sequence opt6 from anti-HIV_CDR
  source 1..30: mol_type = other RNA
caatggtacggaacactacatccaagaaca

SEQ ID NO: 51833 - RNA, 30 nt, synthetic construct
  misc_feature 1..30: note = derived and/or modified sequence opt6 from anti-HIV_CDR
  source 1..30: mol_type = other RNA
agttcgtactcgagcacgaacacgtacgtg

SEQ ID NO: 51834 - RNA, 30 nt, synthetic construct
  misc_feature 1..30: note = derived and/or modified sequence opt6 from anti-HIV_CDR
  source 1..30: mol_type = other RNA
acatttataactgcatcttggtttgactct

SEQ ID NO: 51835 - RNA, 30 nt, synthetic construct
  misc_feature 1..30: note = derived and/or modified sequence opt6 from anti-HIV_CDR
  source 1..30: mol_type = other RNA
acaggaggactattaagatttccagaagta

SEQ ID NO: 51836 - RNA, 30 nt, synthetic construct
  misc_feature 1..30: note = derived and/or modified sequence opt6 from anti-HIV_CDR
  source 1..30: mol_type = other RNA
tgttcgtatgcgggctcgtatacgtatgtg

SEQ ID NO: 51837 - RNA, 30 nt, synthetic construct
  misc_feature 1..30: note = derived and/or modified sequence opt6 from anti-HIV_CDR
  source 1..30: mol_type = other RNA
caacaaagatacagctggccatcactaaca

SEQ ID NO: 51838 - RNA, 30 nt, synthetic construct
  misc_feature 1..30: note = derived and/or modified sequence opt6 from anti-HIV_CDR
  source 1..30: mol_type = other RNA
cttcaatgcggatcttcacctccatataca

SEQ ID NO: 51839 - RNA, 30 nt, synthetic construct
  misc_feature 1..30: note = derived and/or modified sequence opt6 from anti-HIV_CDR
  source 1..30: mol_type = other RNA
agttcatatgcaggcacaaatcattgggta

SEQ ID NO: 51840 - RNA, 30 nt, synthetic construct
  misc_feature 1..30: note = derived and/or modified sequence opt6 from anti-HIV_CDR
  source 1..30: mol_type = other RNA
tctagttatgcagctacaaatcactgggta

SEQ ID NO: 51841 - RNA, 30 nt, synthetic construct
  misc_feature 1..30: note = derived and/or modified sequence opt6 from anti-HIV_CDR
  source 1..30: mol_type = other RNA
caatactacggcacatcaccaccatcaaca

SEQ ID NO: 51842 - RNA, 30 nt, synthetic construct
  misc_feature 1..30: note = derived and/or modified sequence opt6 from anti-HIV_CDR
  source 1..30: mol_type = other RNA
caatactacggctcatcaccaccatcaaca

SEQ ID NO: 51843 - RNA, 30 nt, synthetic construct
  misc_feature 1..30: note = derived and/or modified sequence opt6 from anti-HIV_CDR
  source 1..30: mol_type = other RNA
caagaattcggacgagcaccaccatatcca

SEQ ID NO: 51844 - RNA, 30 nt, synthetic construct
  misc_feature 1..30: note = derived and/or modified sequence opt6 from anti-HIV_CDR
  source 1..30: mol_type = other RNA
caagaatacggacgatcaccaccatatcca

SEQ ID NO: 51845 - RNA, 30 nt, synthetic construct
  misc_feature 1..30: note = derived and/or modified sequence opt6 from anti-HIV_CDR
  source 1..30: mol_type = other RNA
caagaatacggacgtgcacctccatatcca

SEQ ID NO: 51846 - RNA, 30 nt, synthetic construct
  misc_feature 1..30: note = derived and/or modified sequence opt6 from anti-HIV_CDR
  source 1..30: mol_type = other RNA
catatagcagtaggaggaagtgaagaacat

SEQ ID NO: 51847 - RNA, 30 nt, synthetic construct
  misc_feature 1..30: note = derived and/or modified sequence opt6 from anti-HIV_CDR
  source 1..30: mol_type = other RNA
catatagcagtaggaggaagtgaagatcat

SEQ ID NO: 51848 - RNA, 30 nt, synthetic construct
  misc_feature 1..30: note = derived and/or modified sequence opt6 from anti-HIV_CDR
  source 1..30: mol_type = other RNA
catatagcagtaggaggaagagaagaagaa

SEQ ID NO: 51849 - RNA, 33 nt, synthetic construct
  misc_feature 1..33: note = derived and/or modified sequence opt6 from anti-HIV_CDR
  source 1..33: mol_type = other RNA
ggagaaaaaagtagaggaagtagggcagtacag

SEQ ID NO: 51850 - RNA, 33 nt, synthetic construct
  misc_feature 1..33: note = derived and/or modified sequence opt6 from anti-HIV_CDR
  source 1..33: mol_type = other RNA
ggagaaaaatcattcgcaagcagggcagtacaa

SEQ ID NO: 51851 - RNA, 33 nt, synthetic construct
  misc_feature 1..33: note = derived and/or modified sequence opt6 from anti-HIV_CDR
  source 1..33: mol_type = other RNA
ggaagacaagcattaggaagtagggcagtacaa

SEQ ID NO: 51852 - RNA, 33 nt, synthetic construct
  misc_feature 1..33: note = derived and/or modified sequence opt6 from anti-HIV_CDR
  source 1..33: mol_type = other RNA
ggggaggagagtttggggagtaggagtgtgata

SEQ ID NO: 51853 - RNA, 33 nt, synthetic construct
  misc_feature 1..33: note = derived and/or modified sequence opt6 from anti-HIV_CDR
  source 1..33: mol_type = other RNA
ggagaaaaaagtttaggaagtagggcagtacag

SEQ ID NO: 51854 - RNA, 33 nt, synthetic construct
  misc_feature 1..33: note = derived and/or modified sequence opt6 from anti-HIV_CDR
  source 1..33: mol_type = other RNA
ggaaaagaaagtataggaagtagggcagtacag

SEQ ID NO: 51855 - RNA, 33 nt, synthetic construct
  misc_feature 1..33: note = derived and/or modified sequence opt6 from anti-HIV_CDR
  source 1..33: mol_type = other RNA
ggagggaacaatatagggagcaagagcgtgcat

SEQ ID NO: 51856 - RNA, 33 nt, synthetic construct
  misc_feature 1..33: note = derived and/or modified sequence opt6 from anti-HIV_CDR
  source 1..33: mol_type = other RNA
ggagaaaaaagtataggaagcagggcagtacaa

SEQ ID NO: 51857 - RNA, 33 nt, synthetic construct
  misc_feature 1..33: note = derived and/or modified sequence opt6 from anti-HIV_CDR
  source 1..33: mol_type = other RNA
aaagcatcacaagacgtatcaacagcagtagca

SEQ ID NO: 51858 - RNA, 33 nt, synthetic construct
  misc_feature 1..33: note = derived and/or modified sequence opt6 from anti-HIV_CDR
  source 1..33: mol_type = other RNA
ggctctagaaatttatctcaccgtctactttca

SEQ ID NO: 51859 - RNA, 33 nt, synthetic construct
  misc_feature 1..33: note = derived and/or modified sequence opt6 from anti-HIV_CDR
  source 1..33: mol_type = other RNA
gggacatatgacagtcaaggaagtacaagatta

SEQ ID NO: 51860 - RNA, 33 nt, synthetic construct
  misc_feature 1..33: note = derived and/or modified sequence opt6 from anti-HIV_CDR
  source 1..33: mol_type = other RNA
caacaaagaacaatatggccaccaggatgtagc

SEQ ID NO: 51861 - RNA, 33 nt, synthetic construct
  misc_feature 1..33: note = derived and/or modified sequence opt6 from anti-HIV_CDR
  source 1..33: mol_type = other RNA
ggaacatgggatagttcattatcggcagtatta

SEQ ID NO: 51862 - RNA, 33 nt, synthetic construct
  misc_feature 1..33: note = derived and/or modified sequence opt6 from anti-HIV_CDR
  source 1..33: mol_type = other RNA
gcatcttgggataattctttatctggacctgta

SEQ ID NO: 51863 - RNA, 33 nt, synthetic construct
  misc_feature 1..33: note = derived and/or modified sequence opt6 from anti-HIV_CDR
  source 1..33: mol_type = other RNA
gcgagttgggatgatagtttgagtgggtgggtg

SEQ ID NO: 51864 - RNA, 33 nt, synthetic construct
  misc_feature 1..33: note = derived and/or modified sequence opt6 from anti-HIV_CDR
  source 1..33: mol_type = other RNA
ttattattaccttattatggcggtccttggatt

SEQ ID NO: 51865 - RNA, 33 nt, synthetic construct
  misc_feature 1..33: note = derived and/or modified sequence opt6 from anti-HIV_CDR
  source 1..33: mol_type = other RNA
caacacagaacaaactggccaccatcaataaca

SEQ ID NO: 51866 - RNA, 33 nt, synthetic construct
  misc_feature 1..33: note = derived and/or modified sequence opt6 from anti-HIV_CDR
  source 1..33: mol_type = other RNA
cagagttatgacagaagtttaagaggaagcgta

SEQ ID NO: 51867 - RNA, 33 nt, synthetic construct
  misc_feature 1..33: note = derived and/or modified sequence opt6 from anti-HIV_CDR
  source 1..33: mol_type = other RNA
agctcgggcaattacgatttcgcgtttgatatc

SEQ ID NO: 51868 - RNA, 33 nt, synthetic construct
  misc_feature 1..33: note = derived and/or modified sequence opt6 from anti-HIV_CDR
  source 1..33: mol_type = other RNA
agctcgggcaattacgatttcgcgtacgatata

SEQ ID NO: 51869 - RNA, 33 nt, synthetic construct
  misc_feature 1..33: note = derived and/or modified sequence opt6 from anti-HIV_CDR
  source 1..33: mol_type = other RNA
agctcgggcaatttcgagttcgcgtttgagatc

SEQ ID NO: 51870 - RNA, 33 nt, synthetic construct
  misc_feature 1..33: note = derived and/or modified sequence opt6 from anti-HIV_CDR
  source 1..33: mol_type = other RNA
gcaacatacgacagtcacggatcaataagacta

SEQ ID NO: 51871 - RNA, 33 nt, synthetic construct
  misc_feature 1..33: note = derived and/or modified sequence opt6 from anti-HIV_CDR
  source 1..33: mol_type = other RNA
ggaacttacgatacatctctatctctacgtcta

SEQ ID NO: 51872 - RNA, 33 nt, synthetic construct
  misc_feature 1..33: note = derived and/or modified sequence opt6 from anti-HIV_CDR
  source 1..33: mol_type = other RNA
gccgcttttgattctgctctttctcttcctctt

SEQ ID NO: 51873 - RNA, 33 nt, synthetic construct
  misc_feature 1..33: note = derived and/or modified sequence opt6 from anti-HIV_CDR
  source 1..33: mol_type = other RNA
gcaacatacgacagtgacggatcaataagacta

SEQ ID NO: 51874 - RNA, 33 nt, synthetic construct
  misc_feature 1..33: note = derived and/or modified sequence opt6 from anti-HIV_CDR
  source 1..33: mol_type = other RNA
gcgacatatgacagtggatggagtataagatta

SEQ ID NO: 51875 - RNA, 33 nt, synthetic construct
  misc_feature 1..33: note = derived and/or modified sequence opt6 from anti-HIV_CDR
  source 1..33: mol_type = other RNA
gcaacatatgacacaggactatcattaagacta

SEQ ID NO: 51876 - RNA, 33 nt, synthetic construct
  misc_feature 1..33: note = derived and/or modified sequence opt6 from anti-HIV_CDR
  source 1..33: mol_type = other RNA
gctgcctatgactctacactttcacttagactt

SEQ ID NO: 51877 - RNA, 33 nt, synthetic construct
  misc_feature 1..33: note = derived and/or modified sequence opt6 from anti-HIV_CDR
  source 1..33: mol_type = other RNA
gcagcttatgattcagctgtatctttacctgta

SEQ ID NO: 51878 - RNA, 33 nt, synthetic construct
  misc_feature 1..33: note = derived and/or modified sequence opt6 from anti-HIV_CDR
  source 1..33: mol_type = other RNA
gcaacatacgacacagacctatcactaagacta

SEQ ID NO: 51879 - RNA, 33 nt, synthetic construct
  misc_feature 1..33: note = derived and/or modified sequence opt6 from anti-HIV_CDR
  source 1..33: mol_type = other RNA
gccgcctatgactcatcattatcactcagacta

SEQ ID NO: 51880 - RNA, 33 nt, synthetic construct
  misc_feature 1..33: note = derived and/or modified sequence opt6 from anti-HIV_CDR
  source 1..33: mol_type = other RNA
gctgcctatgactctacattttcacttccagtt

SEQ ID NO: 51881 - RNA, 33 nt, synthetic construct
  misc_feature 1..33: note = derived and/or modified sequence opt6 from anti-HIV_CDR
  source 1..33: mol_type = other RNA
gcgacatatgacagtcaaggaagtacaagatta

SEQ ID NO: 51882 - RNA, 33 nt, synthetic construct
  misc_feature 1..33: note = derived and/or modified sequence opt6 from anti-HIV_CDR
  source 1..33: mol_type = other RNA
gcaacatacgacagccaaagatcaataagacta

SEQ ID NO: 51883 - RNA, 33 nt, synthetic construct
  misc_feature 1..33: note = derived and/or modified sequence opt6 from anti-HIV_CDR
  source 1..33: mol_type = other RNA
gctgtttatgattcttctctttctcttggtctt

SEQ ID NO: 51884 - RNA, 33 nt, synthetic construct
  misc_feature 1..33: note = derived and/or modified sequence opt6 from anti-HIV_CDR
  source 1..33: mol_type = other RNA
caacatagatctatatggccacttatgtgtaca

SEQ ID NO: 51885 - RNA, 33 nt, synthetic construct
  misc_feature 1..33: note = derived and/or modified sequence opt6 from anti-HIV_CDR
  source 1..33: mol_type = other RNA
ttacagcctgtatatatatttagaggtacatgg

SEQ ID NO: 51886 - RNA, 33 nt, synthetic construct
  misc_feature 1..33: note = derived and/or modified sequence opt6 from anti-HIV_CDR
  source 1..33: mol_type = other RNA
tgtgaagtagatgcagatgaaacagtaacatgt

SEQ ID NO: 51887 - RNA, 33 nt, synthetic construct
  misc_feature 1..33: note = derived and/or modified sequence opt6 from anti-HIV_CDR
  source 1..33: mol_type = other RNA
tgtgaagtagacgcagaagtaacaatgacagta

SEQ ID NO: 51888 - RNA, 33 nt, synthetic construct
  misc_feature 1..33: note = derived and/or modified sequence opt6 from anti-HIV_CDR
  source 1..33: mol_type = other RNA
agttcgtatgcggatacgaatgattttggggtc

SEQ ID NO: 51889 - RNA, 33 nt, synthetic construct
  misc_feature 1..33: note = derived and/or modified sequence opt6 from anti-HIV_CDR
  source 1..33: mol_type = other RNA
tgctcattcacatacgtaaacccgacctatctc

SEQ ID NO: 51890 - RNA, 33 nt, synthetic construct
  misc_feature 1..33: note = derived and/or modified sequence opt6 from anti-HIV_CDR
  source 1..33: mol_type = other RNA
ggaacatgggatggaagtttaacgacaggagta

SEQ ID NO: 51891 - RNA, 33 nt, synthetic construct
  misc_feature 1..33: note = derived and/or modified sequence opt6 from anti-HIV_CDR
  source 1..33: mol_type = other RNA
cagagttatgacaatagtttaagtggatgggta

SEQ ID NO: 51892 - RNA, 33 nt, synthetic construct
  misc_feature 1..33: note = derived and/or modified sequence opt6 from anti-HIV_CDR
  source 1..33: mol_type = other RNA
caacaatattactccatacccccctggacattc

SEQ ID NO: 51893 - RNA, 33 nt, synthetic construct
  misc_feature 1..33: note = derived and/or modified sequence opt6 from anti-HIV_CDR
  source 1..33: mol_type = other RNA
atgcaaggaacatactggccaccatcaataaca

SEQ ID NO: 51894 - RNA, 33 nt, synthetic construct
  misc_feature 1..33: note = derived and/or modified sequence opt6 from anti-HIV_CDR
  source 1..33: mol_type = other RNA
cagagttatgatagtagtttaggggtagaggta

SEQ ID NO: 51895 - RNA, 33 nt, synthetic construct
  misc_feature 1..33: note = derived and/or modified sequence opt6 from anti-HIV_CDR
  source 1..33: mol_type = other RNA
caagtgtgggatagcgggagagatagctgggta

SEQ ID NO: 51896 - RNA, 33 nt, synthetic construct
  misc_feature 1..33: note = derived and/or modified sequence opt6 from anti-HIV_CDR
  source 1..33: mol_type = other RNA
caatcttatgatagttctttatctggctgggtc

SEQ ID NO: 51897 - RNA, 33 nt, synthetic construct
  misc_feature 1..33: note = derived and/or modified sequence opt6 from anti-HIV_CDR
  source 1..33: mol_type = other RNA
gggagttgggatgggagtttgaatgcgggagtg

SEQ ID NO: 51898 - RNA, 33 nt, synthetic construct
  misc_feature 1..33: note = derived and/or modified sequence opt6 from anti-HIV_CDR
  source 1..33: mol_type = other RNA
ctttccgctgactcttcctctacttatcaagtt

SEQ ID NO: 51899 - RNA, 33 nt, synthetic construct
  misc_feature 1..33: note = derived and/or modified sequence opt6 from anti-HIV_CDR
  source 1..33: mol_type = other RNA
tgtagttatgcgggtagggatacgagttgggtt

SEQ ID NO: 51900 - RNA, 33 nt, synthetic construct
  misc_feature 1..33: note = derived and/or modified sequence opt6 from anti-HIV_CDR
  source 1..33: mol_type = other RNA
caacaaagatcaaactggccaccaggactaaca

SEQ ID NO: 51901 - RNA, 33 nt, synthetic construct
  misc_feature 1..33: note = derived and/or modified sequence opt6 from anti-HIV_CDR
  source 1..33: mol_type = other RNA
aaggggagggggtatgggtattggtttgatagt

SEQ ID NO: 51902 - RNA, 33 nt, synthetic construct
  misc_feature 1..33: note = derived and/or modified sequence opt6 from anti-HIV_CDR
  source 1..33: mol_type = other RNA
gaaatggcagcaacatcagacgcatttgacata

SEQ ID NO: 51903 - RNA, 33 nt, synthetic construct
  misc_feature 1..33: note = derived and/or modified sequence opt6 from anti-HIV_CDR
  source 1..33: mol_type = other RNA
tctatatattcaactggacctgcacctgtatat

SEQ ID NO: 51904 - RNA, 33 nt, synthetic construct
  misc_feature 1..33: note = derived and/or modified sequence opt6 from anti-HIV_CDR
  source 1..33: mol_type = other RNA
cgcgggagcttgctaataaaatatttcgattac

SEQ ID NO: 51905 - RNA, 33 nt, synthetic construct
  misc_feature 1..33: note = derived and/or modified sequence opt6 from anti-HIV_CDR
  source 1..33: mol_type = other RNA
caacaatacgacaacttacccccacgcgtaacc

SEQ ID NO: 51906 - RNA, 33 nt, synthetic construct
  misc_feature 1..33: note = derived and/or modified sequence opt6 from anti-HIV_CDR
  source 1..33: mol_type = other RNA
gatgtaagattagtagcagtaccgggagcagat

SEQ ID NO: 51907 - RNA, 33 nt, synthetic construct
  misc_feature 1..33: note = derived and/or modified sequence opt6 from anti-HIV_CDR
  source 1..33: mol_type = other RNA
caacaaagaacaacatggccaccagaatacaca

SEQ ID NO: 51908 - RNA, 33 nt, synthetic construct
  misc_feature 1..33: note = derived and/or modified sequence opt6 from anti-HIV_CDR
  source 1..33: mol_type = other RNA
gcggcttgggatgatagtttaaatggatgggta

SEQ ID NO: 51909 - RNA, 33 nt, synthetic construct
  misc_feature 1..33: note = derived and/or modified sequence opt6 from anti-HIV_CDR
  source 1..33: mol_type = other RNA
agaagaagatcagcatggagtccattcgatagc

SEQ ID NO: 51910 - RNA, 33 nt, synthetic construct
  misc_feature 1..33: note = derived and/or modified sequence opt6 from anti-HIV_CDR
  source 1..33: mol_type = other RNA
gcaacatgggacagttcattaagaacagcacta

SEQ ID NO: 51911 - RNA, 33 nt, synthetic construct
  misc_feature 1..33: note = derived and/or modified sequence opt6 from anti-HIV_CDR
  source 1..33: mol_type = other RNA
ggaacatgggatagtagtttaagggcagcatta

SEQ ID NO: 51912 - RNA, 33 nt, synthetic construct
  misc_feature 1..33: note = derived and/or modified sequence opt6 from anti-HIV_CDR
  source 1..33: mol_type = other RNA
caacaaagatcaatctggccaccatcactaaca

SEQ ID NO: 51913 - RNA, 33 nt, synthetic construct
  misc_feature 1..33: note = derived and/or modified sequence opt6 from anti-HIV_CDR
  source 1..33: mol_type = other RNA
gaatttcagacgagtggggtagtgagagaggga

SEQ ID NO: 51914 - RNA, 33 nt, synthetic construct
  misc_feature 1..33: note = derived and/or modified sequence opt6 from anti-HIV_CDR
  source 1..33: mol_type = other RNA
catataggtgcaggcgggccttatagtgaatat

SEQ ID NO: 51915 - RNA, 33 nt, synthetic construct
  misc_feature 1..33: note = derived and/or modified sequence opt6 from anti-HIV_CDR
  source 1..33: mol_type = other RNA
cgcggacactcattcacaagtccgtttgatagt

SEQ ID NO: 51916 - RNA, 33 nt, synthetic construct
  misc_feature 1..33: note = derived and/or modified sequence opt6 from anti-HIV_CDR
  source 1..33: mol_type = other RNA
caacacctaaactcatacccacgcatgtacaca

SEQ ID NO: 51917 - RNA, 33 nt, synthetic construct
  misc_feature 1..33: note = derived and/or modified sequence opt6 from anti-HIV_CDR
  source 1..33: mol_type = other RNA
caacaaagatcaaactggccaccaaaaataaca

SEQ ID NO: 51918 - RNA, 33 nt, synthetic construct
  misc_feature 1..33: note = derived and/or modified sequence opt6 from anti-HIV_CDR
  source 1..33: mol_type = other RNA
gcggcatgggatgatagtttaggaggagtagta

SEQ ID NO: 51919 - RNA, 33 nt, synthetic construct
  misc_feature 1..33: note = derived and/or modified sequence opt6 from anti-HIV_CDR
  source 1..33: mol_type = other RNA
gggacatgggatagtagtttaagtgcagtagta

SEQ ID NO: 51920 - RNA, 33 nt, synthetic construct
  misc_feature 1..33: note = derived and/or modified sequence opt6 from anti-HIV_CDR
  source 1..33: mol_type = other RNA
caacaaagagcaaactggccaccaggaggaaca

SEQ ID NO: 51921 - RNA, 33 nt, synthetic construct
  misc_feature 1..33: note = derived and/or modified sequence opt6 from anti-HIV_CDR
  source 1..33: mol_type = other RNA
ggaggaggatatccgagaggaaatatggatgta

SEQ ID NO: 51922 - RNA, 33 nt, synthetic construct
  misc_feature 1..33: note = derived and/or modified sequence opt6 from anti-HIV_CDR
  source 1..33: mol_type = other RNA
ttattattattatattatggcggtccttggatt

SEQ ID NO: 51923 - RNA, 33 nt, synthetic construct
  misc_feature 1..33: note = derived and/or modified sequence opt6 from anti-HIV_CDR
  source 1..33: mol_type = other RNA
caacaaagaggaatatggccactacaaataaca

SEQ ID NO: 51924 - RNA, 33 nt, synthetic construct
  misc_feature 1..33: note = derived and/or modified sequence opt6 from anti-HIV_CDR
  source 1..33: mol_type = other RNA
agatcgccaggaggcggatatgcatttgatata

SEQ ID NO: 51925 - RNA, 33 nt, synthetic construct
  misc_feature 1..33: note = derived and/or modified sequence opt6 from anti-HIV_CDR
  source 1..33: mol_type = other RNA
agtgggcctggattattacgtggatttgattat

SEQ ID NO: 51926 - RNA, 33 nt, synthetic construct
  misc_feature 1..33: note = derived and/or modified sequence opt6 from anti-HIV_CDR
  source 1..33: mol_type = other RNA
caacaaagaacaacaagaccaccagaatacaca

SEQ ID NO: 51927 - RNA, 33 nt, synthetic construct
  misc_feature 1..33: note = derived and/or modified sequence opt6 from anti-HIV_CDR
  source 1..33: mol_type = other RNA
caacaaagaacaacaagaccaccagactacaca

SEQ ID NO: 51928 - RNA, 33 nt, synthetic construct
  misc_feature 1..33: note = derived and/or modified sequence opt6 from anti-HIV_CDR
  source 1..33: mol_type = other RNA
caaggcagaacaacaagaccaccagactacaca

SEQ ID NO: 51929 - RNA, 33 nt, synthetic construct
  misc_feature 1..33: note = derived and/or modified sequence opt6 from anti-HIV_CDR
  source 1..33: mol_type = other RNA
caacaaagatcaacaacaccaccagaatacaca

SEQ ID NO: 51930 - RNA, 33 nt, synthetic construct
  misc_feature 1..33: note = derived and/or modified sequence opt6 from anti-HIV_CDR
  source 1..33: mol_type = other RNA
caacaaagaacatcatggccactagcactatca

SEQ ID NO: 51931 - RNA, 33 nt, synthetic construct
  misc_feature 1..33: note = derived and/or modified sequence opt6 from anti-HIV_CDR
  source 1..33: mol_type = other RNA
cgcggtcattctttttctcttccttttgattct

SEQ ID NO: 51932 - RNA, 36 nt, synthetic construct
  misc_feature 1..36: note = derived and/or modified sequence opt6 from anti-HIV_CDR
  source 1..36: mol_type = other RNA
cattattgggatagtagaagtccgataagttgggta

SEQ ID NO: 51933 - RNA, 36 nt, synthetic construct
  misc_feature 1..36: note = derived and/or modified sequence opt6 from anti-HIV_CDR
  source 1..36: mol_type = other RNA
cataaatgggatagtagaagtccgttaagttgggta

SEQ ID NO: 51934 - RNA, 36 nt, synthetic construct
  misc_feature 1..36: note = derived and/or modified sequence opt6 from anti-HIV_CDR
  source 1..36: mol_type = other RNA
catatgtgggatagtaggagtgggtttagttggagt

SEQ ID NO: 51935 - RNA, 36 nt, synthetic construct
  misc_feature 1..36: note = derived and/or modified sequence opt6 from anti-HIV_CDR
  source 1..36: mol_type = other RNA
catatatgggacagtagagtaccaacaaaatgggta

SEQ ID NO: 51936 - RNA, 36 nt, synthetic construct
  misc_feature 1..36: note = derived and/or modified sequence opt6 from anti-HIV_CDR
  source 1..36: mol_type = other RNA
caagtatgggatagttcaagtgatcatccgtgggta

SEQ ID NO: 51937 - RNA, 36 nt, synthetic construct
  misc_feature 1..36: note = derived and/or modified sequence opt6 from anti-HIV_CDR
  source 1..36: mol_type = other RNA
catatatatgacgccagaagaccaacaaactgggta

SEQ ID NO: 51938 - RNA, 36 nt, synthetic construct
  misc_feature 1..36: note = derived and/or modified sequence opt6 from anti-HIV_CDR
  source 1..36: mol_type = other RNA
ctagatggagaggcatttagatattatttagactta

SEQ ID NO: 51939 - RNA, 36 nt, synthetic construct
  misc_feature 1..36: note = derived and/or modified sequence opt6 from anti-HIV_CDR
  source 1..36: mol_type = other RNA
ccacaatacaatctaggaagagacccattagacgta

SEQ ID NO: 51940 - RNA, 36 nt, synthetic construct
  misc_feature 1..36: note = derived and/or modified sequence opt6 from anti-HIV_CDR
  source 1..36: mol_type = other RNA
cctgaaccttcttctattgtcgcccctctttattat

SEQ ID NO: 51941 - RNA, 36 nt, synthetic construct
  misc_feature 1..36: note = derived and/or modified sequence opt6 from anti-HIV_CDR
  source 1..36: mol_type = other RNA
ggaggaggagatggaagaaattggcatttacatccg

SEQ ID NO: 51942 - RNA, 36 nt, synthetic construct
  misc_feature 1..36: note = derived and/or modified sequence opt6 from anti-HIV_CDR
  source 1..36: mol_type = other RNA
ccaaaaagcggaagagattactggagttttgactta

SEQ ID NO: 51943 - RNA, 36 nt, synthetic construct
  misc_feature 1..36: note = derived and/or modified sequence opt6 from anti-HIV_CDR
  source 1..36: mol_type = other RNA
ccaagaggaggaagagataattggagttttcatgta

SEQ ID NO: 51944 - RNA, 36 nt, synthetic construct
  misc_feature 1..36: note = derived and/or modified sequence opt6 from anti-HIV_CDR
  source 1..36: mol_type = other RNA
ccacattcaccagatgacgcatggtcattagatgta

SEQ ID NO: 51945 - RNA, 36 nt, synthetic construct
  misc_feature 1..36: note = derived and/or modified sequence opt6 from anti-HIV_CDR
  source 1..36: mol_type = other RNA
ccattaagaggaggagatacatggcattatcactca

SEQ ID NO: 51946 - RNA, 36 nt, synthetic construct
  misc_feature 1..36: note = derived and/or modified sequence opt6 from anti-HIV_CDR
  source 1..36: mol_type = other RNA
cttcaacccgtatacatactcagatctatatgtcac

SEQ ID NO: 51947 - RNA, 36 nt, synthetic construct
  misc_feature 1..36: note = derived and/or modified sequence opt6 from anti-HIV_CDR
  source 1..36: mol_type = other RNA
cttcaacctgtatatatacttaaatgtaactggtgc

SEQ ID NO: 51948 - RNA, 36 nt, synthetic construct
  misc_feature 1..36: note = derived and/or modified sequence opt6 from anti-HIV_CDR
  source 1..36: mol_type = other RNA
gaatatagatttgatgactggggaccgttagatcat

SEQ ID NO: 51949 - RNA, 36 nt, synthetic construct
  misc_feature 1..36: note = derived and/or modified sequence opt6 from anti-HIV_CDR
  source 1..36: mol_type = other RNA
gcggcatgggatgatagtttaaatggacatggagta

SEQ ID NO: 51950 - RNA, 36 nt, synthetic construct
  misc_feature 1..36: note = derived and/or modified sequence opt6 from anti-HIV_CDR
  source 1..36: mol_type = other RNA
ttatattttgattgggctcctcatgcttttgatatt

SEQ ID NO: 51951 - RNA, 36 nt, synthetic construct
  misc_feature 1..36: note = derived and/or modified sequence opt6 from anti-HIV_CDR
  source 1..36: mol_type = other RNA
gggttgtatgatagtagtgggtattattttgggtat

SEQ ID NO: 51952 - RNA, 36 nt, synthetic construct
  misc_feature 1..36: note = derived and/or modified sequence opt6 from anti-HIV_CDR
  source 1..36: mol_type = other RNA
ttggggtgtagtggggggagttgttatgaggatagt

SEQ ID NO: 51953 - RNA, 36 nt, synthetic construct
  misc_feature 1..36: note = derived and/or modified sequence opt6 from anti-HIV_CDR
  source 1..36: mol_type = other RNA
gcttcaggttcatatatattaggaactatggatgta

SEQ ID NO: 51954 - RNA, 36 nt, synthetic construct
  misc_feature 1..36: note = derived and/or modified sequence opt6 from anti-HIV_CDR
  source 1..36: mol_type = other RNA
tactcaacagacaactcaggcaaacaacactgggta

SEQ ID NO: 51955 - RNA, 36 nt, synthetic construct
  misc_feature 1..36: note = derived and/or modified sequence opt6 from anti-HIV_CDR
  source 1..36: mol_type = other RNA
gttaaacagttcttagaatggctctatttagattat

SEQ ID NO: 51956 - RNA, 36 nt, synthetic construct
  misc_feature 1..36: note = derived and/or modified sequence opt6 from anti-HIV_CDR
  source 1..36: mol_type = other RNA
ggagtgagatcaatagtgggagcgcactttgattat

SEQ ID NO: 51957 - RNA, 36 nt, synthetic construct
  misc_feature 1..36: note = derived and/or modified sequence opt6 from anti-HIV_CDR
  source 1..36: mol_type = other RNA
ggtgtgggtacgcgttattatgtatattttgattcg

SEQ ID NO: 51958 - RNA, 36 nt, synthetic construct
  misc_feature 1..36: note = derived and/or modified sequence opt6 from anti-HIV_CDR
  source 1..36: mol_type = other RNA
gctccatatatatcttcatctcaccttgactattgg

SEQ ID NO: 51959 - RNA, 36 nt, synthetic construct
  misc_feature 1..36: note = derived and/or modified sequence opt6 from anti-HIV_CDR
  source 1..36: mol_type = other RNA
agaggtatagctgcagctggattttattttcaacat

SEQ ID NO: 51960 - RNA, 36 nt, synthetic construct
  misc_feature 1..36: note = derived and/or modified sequence opt6 from anti-HIV_CDR
  source 1..36: mol_type = other RNA
cgtggaattgcagctgcagctttttattttcaaaca

SEQ ID NO: 51961 - RNA, 36 nt, synthetic construct
  misc_feature 1..36: note = derived and/or modified sequence opt6 from anti-HIV_CDR
  source 1..36: mol_type = other RNA
agaggaatagcggcagcaggattttattttcaaaat

SEQ ID NO: 51962 - RNA, 36 nt, synthetic construct
  misc_feature 1..36: note = derived and/or modified sequence opt6 from anti-HIV_CDR
  source 1..36: mol_type = other RNA
caatcatacgacacatcactaacagacacaggagta

SEQ ID NO: 51963 - RNA, 36 nt, synthetic construct
  misc_feature 1..36: note = derived and/or modified sequence opt6 from anti-HIV_CDR
  source 1..36: mol_type = other RNA
caatcatatgacacttcattatcagatacaggcgtc

SEQ ID NO: 51964 - RNA, 36 nt, synthetic construct
  misc_feature 1..36: note = derived and/or modified sequence opt6 from anti-HIV_CDR
  source 1..36: mol_type = other RNA
agaactacacttgtaaatttcggtgtatttgacctt

SEQ ID NO: 51965 - RNA, 36 nt, synthetic construct
  misc_feature 1..36: note = derived and/or modified sequence opt6 from anti-HIV_CDR
  source 1..36: mol_type = other RNA
cctgtagttaacactatattaccatattgtgatgtc

SEQ ID NO: 51966 - RNA, 36 nt, synthetic construct
  misc_feature 1..36: note = derived and/or modified sequence opt6 from anti-HIV_CDR
  source 1..36: mol_type = other RNA
tgttattctggtcgttctcgttatttttttgattct

SEQ ID NO: 51967 - RNA, 36 nt, synthetic construct
  misc_feature 1..36: note = derived and/or modified sequence opt6 from anti-HIV_CDR
  source 1..36: mol_type = other RNA
gcggcatgggatgatagtttagatggattttgggta

SEQ ID NO: 51968 - RNA, 36 nt, synthetic construct
  misc_feature 1..36: note = derived and/or modified sequence opt6 from anti-HIV_CDR
  source 1..36: mol_type = other RNA
ttgaggagggggtattatgatagtggggaggattat

SEQ ID NO: 51969 - RNA, 36 nt, synthetic construct
  misc_feature 1..36: note = derived and/or modified sequence opt6 from anti-HIV_CDR
  source 1..36: mol_type = other RNA
ttaagaaggggatattttgatagcgggggagatcat

SEQ ID NO: 51970 - RNA, 36 nt, synthetic construct
  misc_feature 1..36: note = derived and/or modified sequence opt6 from anti-HIV_CDR
  source 1..36: mol_type = other RNA
tcttcatatacatcttcatctacacttggcgttgtc

SEQ ID NO: 51971 - RNA, 36 nt, synthetic construct
  misc_feature 1..36: note = derived and/or modified sequence opt6 from anti-HIV_CDR
  source 1..36: mol_type = other RNA
ttagatggagaggcatttagatattattttgacagt

SEQ ID NO: 51972 - RNA, 36 nt, synthetic construct
  misc_feature 1..36: note = derived and/or modified sequence opt6 from anti-HIV_CDR
  source 1..36: mol_type = other RNA
cgcagaggtcagagattattagcatattttgactat

SEQ ID NO: 51973 - RNA, 36 nt, synthetic construct
  misc_feature 1..36: note = derived and/or modified sequence opt6 from anti-HIV_CDR
  source 1..36: mol_type = other RNA
ccacaatacaatctaggacgagaaccattaaacgta

SEQ ID NO: 51974 - RNA, 36 nt, synthetic construct
  misc_feature 1..36: note = derived and/or modified sequence opt6 from anti-HIV_CDR
  source 1..36: mol_type = other RNA
gctcatcatgatttttggcgtgcacctgtagatgta

SEQ ID NO: 51975 - RNA, 36 nt, synthetic construct
  misc_feature 1..36: note = derived and/or modified sequence opt6 from anti-HIV_CDR
  source 1..36: mol_type = other RNA
gggaggagggaggggttgaattttttgttggattat

SEQ ID NO: 51976 - RNA, 36 nt, synthetic construct
  misc_feature 1..36: note = derived and/or modified sequence opt6 from anti-HIV_CDR
  source 1..36: mol_type = other RNA
ccagaaccatcatcaatagtcggcgcactatattac

SEQ ID NO: 51977 - RNA, 36 nt, synthetic construct
  misc_feature 1..36: note = derived and/or modified sequence opt6 from anti-HIV_CDR
  source 1..36: mol_type = other RNA
ggacctgatgatttttggtcaggttatcctaaatat

SEQ ID NO: 51978 - RNA, 36 nt, synthetic construct
  misc_feature 1..36: note = derived and/or modified sequence opt6 from anti-HIV_CDR
  source 1..36: mol_type = other RNA
gattattcagctgcaggcagacatttatttgacagt

SEQ ID NO: 51979 - RNA, 36 nt, synthetic construct
  misc_feature 1..36: note = derived and/or modified sequence opt6 from anti-HIV_CDR
  source 1..36: mol_type = other RNA
gactatacagctagaggtagacatttctttgactat

SEQ ID NO: 51980 - RNA, 36 nt, synthetic construct
  misc_feature 1..36: note = derived and/or modified sequence opt6 from anti-HIV_CDR
  source 1..36: mol_type = other RNA
gactatacagcttcaggtagacatttttttgactat

SEQ ID NO: 51981 - RNA, 36 nt, synthetic construct
  misc_feature 1..36: note = derived and/or modified sequence opt6 from anti-HIV_CDR
  source 1..36: mol_type = other RNA
caatcgtatgatagttcgctttcgggttcgtgggta

SEQ ID NO: 51982 - RNA, 36 nt, synthetic construct
  misc_feature 1..36: note = derived and/or modified sequence opt6 from anti-HIV_CDR
  source 1..36: mol_type = other RNA
ccagcacaagcaggagtaggaccaagatttgattat

SEQ ID NO: 51983 - RNA, 36 nt, synthetic construct
  misc_feature 1..36: note = derived and/or modified sequence opt6 from anti-HIV_CDR
  source 1..36: mol_type = other RNA
ggtgcaattaactcttcacctctatatttcgattca

SEQ ID NO: 51984 - RNA, 36 nt, synthetic construct
  misc_feature 1..36: note = derived and/or modified sequence opt6 from anti-HIV_CDR
  source 1..36: mol_type = other RNA
ggtgatattacttcttctcctctttattttgatttt

SEQ ID NO: 51985 - RNA, 36 nt, synthetic construct
  misc_feature 1..36: note = derived and/or modified sequence opt6 from anti-HIV_CDR
  source 1..36: mol_type = other RNA
ggtgcaattaactcttcaccttcatatttcgattca

SEQ ID NO: 51986 - RNA, 36 nt, synthetic construct
  misc_feature 1..36: note = derived and/or modified sequence opt6 from anti-HIV_CDR
  source 1..36: mol_type = other RNA
tgggtagtaacggcagcagaagaatattttgattat

SEQ ID NO: 51987 - RNA, 39 nt, synthetic construct
  misc_feature 1..39: note = derived and/or modified sequence opt6 from anti-HIV_CDR
  source 1..39: mol_type = other RNA
gacccgcaagtagaagtaagaggaaatgcattcgatata

SEQ ID NO: 51988 - RNA, 39 nt, synthetic construct
  misc_feature 1..39: note = derived and/or modified sequence opt6 from anti-HIV_CDR
  source 1..39: mol_type = other RNA
gatcatggtgatcctagaactggatattattttgattat

SEQ ID NO: 51989 - RNA, 39 nt, synthetic construct
  misc_feature 1..39: note = derived and/or modified sequence opt6 from anti-HIV_CDR
  source 1..39: mol_type = other RNA
gacgaaagcggatacgatctaaattggcatctagatagt

SEQ ID NO: 51990 - RNA, 39 nt, synthetic construct
  misc_feature 1..39: note = derived and/or modified sequence opt6 from anti-HIV_CDR
  source 1..39: mol_type = other RNA
gatggaagtggagatgatagaaattggcatttagatccg

SEQ ID NO: 51991 - RNA, 39 nt, synthetic construct
  misc_feature 1..39: note = derived and/or modified sequence opt6 from anti-HIV_CDR
  source 1..39: mol_type = other RNA
gacagaagagatgacggattagattggttattagatcca

SEQ ID NO: 51992 - RNA, 39 nt, synthetic construct
  misc_feature 1..39: note = derived and/or modified sequence opt6 from anti-HIV_CDR
  source 1..39: mol_type = other RNA
gatggaggaggagatgataggacatggttattagatgca

SEQ ID NO: 51993 - RNA, 39 nt, synthetic construct
  misc_feature 1..39: note = derived and/or modified sequence opt6 from anti-HIV_CDR
  source 1..39: mol_type = other RNA
gacggaagtggagatgcaagagattggcatttacatcca

SEQ ID NO: 51994 - RNA, 39 nt, synthetic construct
  misc_feature 1..39: note = derived and/or modified sequence opt6 from anti-HIV_CDR
  source 1..39: mol_type = other RNA
gatggaagtggagatgatacaagttggtatttagatccg

SEQ ID NO: 51995 - RNA, 39 nt, synthetic construct
  misc_feature 1..39: note = derived and/or modified sequence opt6 from anti-HIV_CDR
  source 1..39: mol_type = other RNA
gatggatcaggagatgatacaagttggcatttagatccg

SEQ ID NO: 51996 - RNA, 39 nt, synthetic construct
  misc_feature 1..39: note = derived and/or modified sequence opt6 from anti-HIV_CDR
  source 1..39: mol_type = other RNA
gacagaagagatgacgatagagcatggttactagatcca

SEQ ID NO: 51997 - RNA, 39 nt, synthetic construct
  misc_feature 1..39: note = derived and/or modified sequence opt6 from anti-HIV_CDR
  source 1..39: mol_type = other RNA
gacggaagtggagatgcaagagattggcatttagatcca

SEQ ID NO: 51998 - RNA, 39 nt, synthetic construct
  misc_feature 1..39: note = derived and/or modified sequence opt6 from anti-HIV_CDR
  source 1..39: mol_type = other RNA
gacggttcaggtgatgctacatcttggcatttacatcca

SEQ ID NO: 51999 - RNA, 39 nt, synthetic construct
  misc_feature 1..39: note = derived and/or modified sequence opt6 from anti-HIV_CDR
  source 1..39: mol_type = other RNA
gacgaatcaggagacgacttaaaatggcatttacatcca

SEQ ID NO: 52000 - RNA, 39 nt, synthetic construct
  misc_feature 1..39: note = derived and/or modified sequence opt6 from anti-HIV_CDR
  source 1..39: mol_type = other RNA
gatggttcaggtgatgatacaagttggcatttacatccg

SEQ ID NO: 52001 - RNA, 39 nt, synthetic construct
  misc_feature 1..39: note = derived and/or modified sequence opt6 from anti-HIV_CDR
  source 1..39: mol_type = other RNA
gcacaaggagatatattaacagaaggatatttcgattac

SEQ ID NO: 52002 - RNA, 39 nt, synthetic construct
  misc_feature 1..39: note = derived and/or modified sequence opt6 from anti-HIV_CDR
  source 1..39: mol_type = other RNA
gatagaatgttctggcaacagctagcaaaatatgactca

SEQ ID NO: 52003 - RNA, 39 nt, synthetic construct
  misc_feature 1..39: note = derived and/or modified sequence opt6 from anti-HIV_CDR
  source 1..39: mol_type = other RNA
tcaacttgggattattctttatctgcacatgaagatgta

SEQ ID NO: 52004 - RNA, 39 nt, synthetic construct
  misc_feature 1..39: note = derived and/or modified sequence opt6 from anti-HIV_CDR
  source 1..39: mol_type = other RNA
gcggcttgggatgatagtttaagtggattaaattgggta

SEQ ID NO: 52005 - RNA, 39 nt, synthetic construct
  misc_feature 1..39: note = derived and/or modified sequence opt6 from anti-HIV_CDR
  source 1..39: mol_type = other RNA
ctatcaagtgatagaatagtagtagtcgggccagattac

SEQ ID NO: 52006 - RNA, 39 nt, synthetic construct
  misc_feature 1..39: note = derived and/or modified sequence opt6 from anti-HIV_CDR
  source 1..39: mol_type = other RNA
gaagcaggatcagtaacagcaacaggaccatttgatagt

SEQ ID NO: 52007 - RNA, 39 nt, synthetic construct
  misc_feature 1..39: note = derived and/or modified sequence opt6 from anti-HIV_CDR
  source 1..39: mol_type = other RNA
gattttgggcgtgcgtatgcgattgggtattttgaatat

SEQ ID NO: 52008 - RNA, 39 nt, synthetic construct
  misc_feature 1..39: note = derived and/or modified sequence opt6 from anti-HIV_CDR
  source 1..39: mol_type = other RNA
gatagagctccatatggcgcttttgaaccatttgacttt

SEQ ID NO: 52009 - RNA, 39 nt, synthetic construct
  misc_feature 1..39: note = derived and/or modified sequence opt6 from anti-HIV_CDR
  source 1..39: mol_type = other RNA
aatggacattcaagtttaggtggaggttattttccgcat

SEQ ID NO: 52010 - RNA, 39 nt, synthetic construct
  misc_feature 1..39: note = derived and/or modified sequence opt6 from anti-HIV_CDR
  source 1..39: mol_type = other RNA
aatggacatagcgcactaggaggagaatactttcaacat

SEQ ID NO: 52011 - RNA, 39 nt, synthetic construct
  misc_feature 1..39: note = derived and/or modified sequence opt6 from anti-HIV_CDR
  source 1..39: mol_type = other RNA
gcggctagacgtgcattttattattattatatggatgta

SEQ ID NO: 52012 - RNA, 39 nt, synthetic construct
  misc_feature 1..39: note = derived and/or modified sequence opt6 from anti-HIV_CDR
  source 1..39: mol_type = other RNA
gcaaattattatgacagttcaggatatggattagacata

SEQ ID NO: 52013 - RNA, 39 nt, synthetic construct
  misc_feature 1..39: note = derived and/or modified sequence opt6 from anti-HIV_CDR
  source 1..39: mol_type = other RNA
cattctcgtcctggcgctcctcctcattattttgattat

SEQ ID NO: 52014 - RNA, 39 nt, synthetic construct
  misc_feature 1..39: note = derived and/or modified sequence opt6 from anti-HIV_CDR
  source 1..39: mol_type = other RNA
ggattaacagtagcaacattatatgatgcatttgatgta

SEQ ID NO: 52015 - RNA, 39 nt, synthetic construct
  misc_feature 1..39: note = derived and/or modified sequence opt6 from anti-HIV_CDR
  source 1..39: mol_type = other RNA
agagatagatataactggaaatattactatctagatgta

SEQ ID NO: 52016 - RNA, 39 nt, synthetic construct
  misc_feature 1..39: note = derived and/or modified sequence opt6 from anti-HIV_CDR
  source 1..39: mol_type = other RNA
gatagaggaagtagtggatggtatggatggttagatccg

SEQ ID NO: 52017 - RNA, 39 nt, synthetic construct
  misc_feature 1..39: note = derived and/or modified sequence opt6 from anti-HIV_CDR
  source 1..39: mol_type = other RNA
gataggttaagtagtttttggagtggagggatagatcag

SEQ ID NO: 52018 - RNA, 39 nt, synthetic construct
  misc_feature 1..39: note = derived and/or modified sequence opt6 from anti-HIV_CDR
  source 1..39: mol_type = other RNA
gacgtgatagtgggagcgctattgggagcgttcgatata

SEQ ID NO: 52019 - RNA, 39 nt, synthetic construct
  misc_feature 1..39: note = derived and/or modified sequence opt6 from anti-HIV_CDR
  source 1..39: mol_type = other RNA
cacttaatagccccaactgccggcaactatttctatcca

SEQ ID NO: 52020 - RNA, 39 nt, synthetic construct
  misc_feature 1..39: note = derived and/or modified sequence opt6 from anti-HIV_CDR
  source 1..39: mol_type = other RNA
gactctagacctcaagctctagttgcagctctagatgta

SEQ ID NO: 52021 - RNA, 39 nt, synthetic construct
  misc_feature 1..39: note = derived and/or modified sequence opt6 from anti-HIV_CDR
  source 1..39: mol_type = other RNA
gacgagatagtgggagcgctattgggagcgttcgatata

SEQ ID NO: 52022 - RNA, 39 nt, synthetic construct
  misc_feature 1..39: note = derived and/or modified sequence opt6 from anti-HIV_CDR
  source 1..39: mol_type = other RNA
agcgatccagcaatagcagcagcaggatcactagatcta

SEQ ID NO: 52023 - RNA, 39 nt, synthetic construct
  misc_feature 1..39: note = derived and/or modified sequence opt6 from anti-HIV_CDR
  source 1..39: mol_type = other RNA
ccatatgtccaaacagtcgcaactacaactttcgacttc

SEQ ID NO: 52024 - RNA, 39 nt, synthetic construct
  misc_feature 1..39: note = derived and/or modified sequence opt6 from anti-HIV_CDR
  source 1..39: mol_type = other RNA
ggccctaaatctgtcgcttcattatcatatttcgataaa

SEQ ID NO: 52025 - RNA, 39 nt, synthetic construct
  misc_feature 1..39: note = derived and/or modified sequence opt6 from anti-HIV_CDR
  source 1..39: mol_type = other RNA
ggagcattatggttcggacaattaagaggactagatcca

SEQ ID NO: 52026 - RNA, 39 nt, synthetic construct
  misc_feature 1..39: note = derived and/or modified sequence opt6 from anti-HIV_CDR
  source 1..39: mol_type = other RNA
gatttaagaccaatgagaggaaactgggcaatgcatgta

SEQ ID NO: 52027 - RNA, 39 nt, synthetic construct
  misc_feature 1..39: note = derived and/or modified sequence opt6 from anti-HIV_CDR
  source 1..39: mol_type = other RNA
gatccacaagtaaatagaagaggaaattgttttgaccat

SEQ ID NO: 52028 - RNA, 39 nt, synthetic construct
  misc_feature 1..39: note = derived and/or modified sequence opt6 from anti-HIV_CDR
  source 1..39: mol_type = other RNA
gacccacaaatagaaataagaggaaatgcattcgacata

SEQ ID NO: 52029 - RNA, 39 nt, synthetic construct
  misc_feature 1..39: note = derived and/or modified sequence opt6 from anti-HIV_CDR
  source 1..39: mol_type = other RNA
gtaccaagaacaacagcaacaagaaacgcattcgacata

SEQ ID NO: 52030 - RNA, 39 nt, synthetic construct
  misc_feature 1..39: note = derived and/or modified sequence opt6 from anti-HIV_CDR
  source 1..39: mol_type = other RNA
cacaagagcgtgctcttgtggtttcgcgagctcgattac

SEQ ID NO: 52031 - RNA, 39 nt, synthetic construct
  misc_feature 1..39: note = derived and/or modified sequence opt6 from anti-HIV_CDR
  source 1..39: mol_type = other RNA
gatagtgaggactatgtcgattattattatatggacgtg

SEQ ID NO: 52032 - RNA, 39 nt, synthetic construct
  misc_feature 1..39: note = derived and/or modified sequence opt6 from anti-HIV_CDR
  source 1..39: mol_type = other RNA
ctaccaagaacaacaggaataagaaacgcattcgacata

SEQ ID NO: 52033 - RNA, 39 nt, synthetic construct
  misc_feature 1..39: note = derived and/or modified sequence opt6 from anti-HIV_CDR
  source 1..39: mol_type = other RNA
ctaccaagaacaacaggaataagaaacgcattcgacttc

SEQ ID NO: 52034 - RNA, 42 nt, synthetic construct
  misc_feature 1..42: note = derived and/or modified sequence opt6 from anti-HIV_CDR
  source 1..42: mol_type = other RNA
ggaacattatggtttggagaaagtggattaagattagatcat

SEQ ID NO: 52035 - RNA, 42 nt, synthetic construct
  misc_feature 1..42: note = derived and/or modified sequence opt6 from anti-HIV_CDR
  source 1..42: mol_type = other RNA
gttgcatatgtacatgtagttacaactagatctctagataac

SEQ ID NO: 52036 - RNA, 42 nt, synthetic construct
  misc_feature 1..42: note = derived and/or modified sequence opt6 from anti-HIV_CDR
  source 1..42: mol_type = other RNA
gccgattatgaccttcttacttcttcttatcattttgattct

SEQ ID NO: 52037 - RNA, 42 nt, synthetic construct
  misc_feature 1..42: note = derived and/or modified sequence opt6 from anti-HIV_CDR
  source 1..42: mol_type = other RNA
actagatgttttggtgcaaattgttttaattttatggatgta

SEQ ID NO: 52038 - RNA, 42 nt, synthetic construct
  misc_feature 1..42: note = derived and/or modified sequence opt6 from anti-HIV_CDR
  source 1..42: mol_type = other RNA
ggggggttgtattgtagtagtataagttgtataatggatgtg

SEQ ID NO: 52039 - RNA, 42 nt, synthetic construct
  misc_feature 1..42: note = derived and/or modified sequence opt6 from anti-HIV_CDR
  source 1..42: mol_type = other RNA
aacgaaccacaatatcactcactaccaggaatgttcgactac

SEQ ID NO: 52040 - RNA, 42 nt, synthetic construct
  misc_feature 1..42: note = derived and/or modified sequence opt6 from anti-HIV_CDR
  source 1..42: mol_type = other RNA
gaaccaagagaaatgggaacattaacagcaggatttgaatat

SEQ ID NO: 52041 - RNA, 42 nt, synthetic construct
  misc_feature 1..42: note = derived and/or modified sequence opt6 from anti-HIV_CDR
  source 1..42: mol_type = other RNA
gcgactggatattcatatggatatttagatgcatttgatatt

SEQ ID NO: 52042 - RNA, 42 nt, synthetic construct
  misc_feature 1..42: note = derived and/or modified sequence opt6 from anti-HIV_CDR
  source 1..42: mol_type = other RNA
ggaagtttgtggtttggagagagtgggttaaggttagatcat

SEQ ID NO: 52043 - RNA, 42 nt, synthetic construct
  misc_feature 1..42: note = derived and/or modified sequence opt6 from anti-HIV_CDR
  source 1..42: mol_type = other RNA
gataatacaatatcaggagtagtaccgagatggttcgattat

SEQ ID NO: 52044 - RNA, 42 nt, synthetic construct
  misc_feature 1..42: note = derived and/or modified sequence opt6 from anti-HIV_CDR
  source 1..42: mol_type = other RNA
atttatgacggtcgtggttattatagttatttttttgatttg

SEQ ID NO: 52045 - RNA, 42 nt, synthetic construct
  misc_feature 1..42: note = derived and/or modified sequence opt6 from anti-HIV_CDR
  source 1..42: mol_type = other RNA
gataggtttaattggaatgatggggggtatttttttgatagt

SEQ ID NO: 52046 - RNA, 42 nt, synthetic construct
  misc_feature 1..42: note = derived and/or modified sequence opt6 from anti-HIV_CDR
  source 1..42: mol_type = other RNA
ggacattcaagttcatggacaaaatttaattggtttggacca

SEQ ID NO: 52047 - RNA, 42 nt, synthetic construct
  misc_feature 1..42: note = derived and/or modified sequence opt6 from anti-HIV_CDR
  source 1..42: mol_type = other RNA
tctatagctgcagatgactattactattattatatggatgta

SEQ ID NO: 52048 - RNA, 42 nt, synthetic construct
  misc_feature 1..42: note = derived and/or modified sequence opt6 from anti-HIV_CDR
  source 1..42: mol_type = other RNA
agtttttatgataatggtggttattatttgggtttggattat

SEQ ID NO: 52049 - RNA, 42 nt, synthetic construct
  misc_feature 1..42: note = derived and/or modified sequence opt6 from anti-HIV_CDR
  source 1..42: mol_type = other RNA
gataaagatgcatcaatatatggatacagaatactaaatcac

SEQ ID NO: 52050 - RNA, 42 nt, synthetic construct
  misc_feature 1..42: note = derived and/or modified sequence opt6 from anti-HIV_CDR
  source 1..42: mol_type = other RNA
gtattaacagatctagatcaaggaaacccaagaatggacgta

SEQ ID NO: 52051 - RNA, 42 nt, synthetic construct
  misc_feature 1..42: note = derived and/or modified sequence opt6 from anti-HIV_CDR
  source 1..42: mol_type = other RNA
agggaaattaaatttggagagctatcgttctatttcgatagc

SEQ ID NO: 52052 - RNA, 42 nt, synthetic construct
  misc_feature 1..42: note = derived and/or modified sequence opt6 from anti-HIV_CDR
  source 1..42: mol_type = other RNA
agggagattaggtttggggagttgagtttttattttgattat

SEQ ID NO: 52053 - RNA, 42 nt, synthetic construct
  misc_feature 1..42: note = derived and/or modified sequence opt6 from anti-HIV_CDR
  source 1..42: mol_type = other RNA
ccacattcacccacaaacataccctcacgcccactcgactac

SEQ ID NO: 52054 - RNA, 42 nt, synthetic construct
  misc_feature 1..42: note = derived and/or modified sequence opt6 from anti-HIV_CDR
  source 1..42: mol_type = other RNA
ggcgattacgatatacttacatcttcatatcaatttgactat

SEQ ID NO: 52055 - RNA, 42 nt, synthetic construct
  misc_feature 1..42: note = derived and/or modified sequence opt6 from anti-HIV_CDR
  source 1..42: mol_type = other RNA
tcaacaccactagtatggccaccagcaaacggactagatgta

SEQ ID NO: 52056 - RNA, 42 nt, synthetic construct
  misc_feature 1..42: note = derived and/or modified sequence opt6 from anti-HIV_CDR
  source 1..42: mol_type = other RNA
acaagaaatacaggaaactcactaccatactggttcgaccta

SEQ ID NO: 52057 - RNA, 45 nt, synthetic construct
  misc_feature 1..45: note = derived and/or modified sequence opt6 from anti-HIV_CDR
  source 1..45: mol_type = other RNA
gaaaaaggccaatggctaacagtaccaccatactattttgactca

SEQ ID NO: 52058 - RNA, 45 nt, synthetic construct
  misc_feature 1..45: note = derived and/or modified sequence opt6 from anti-HIV_CDR
  source 1..45: mol_type = other RNA
ggaagtggaagatggacaataggggcaagaatatattttgataat

SEQ ID NO: 52059 - RNA, 45 nt, synthetic construct
  misc_feature 1..45: note = derived and/or modified sequence opt6 from anti-HIV_CDR
  source 1..45: mol_type = other RNA
ctagaagcagatggagcagactatagcccaaaaatgttcgatttc

SEQ ID NO: 52060 - RNA, 45 nt, synthetic construct
  misc_feature 1..45: note = derived and/or modified sequence opt6 from anti-HIV_CDR
  source 1..45: mol_type = other RNA
ttagaagcagatggaggagactatagtccaaaaatgtttgattac

SEQ ID NO: 52061 - RNA, 45 nt, synthetic construct
  misc_feature 1..45: note = derived and/or modified sequence opt6 from anti-HIV_CDR
  source 1..45: mol_type = other RNA
ctagaagcagatggagataactatagcccaaaaatggtagattac

SEQ ID NO: 52062 - RNA, 45 nt, synthetic construct
  misc_feature 1..45: note = derived and/or modified sequence opt6 from anti-HIV_CDR
  source 1..45: mol_type = other RNA
ctagaagcagatggagatgactatagcccaaaaatgttcgattac

SEQ ID NO: 52063 - RNA, 45 nt, synthetic construct
  misc_feature 1..45: note = derived and/or modified sequence opt6 from anti-HIV_CDR
  source 1..45: mol_type = other RNA
ctagaagcagatggatcagactatagcccaaaaatgttcgatttc

SEQ ID NO: 52064 - RNA, 45 nt, synthetic construct
  misc_feature 1..45: note = derived and/or modified sequence opt6 from anti-HIV_CDR
  source 1..45: mol_type = other RNA
ctagaagcagatggagatgactatagcccaaaaatgttcgatcac

SEQ ID NO: 52065 - RNA, 45 nt, synthetic construct
  misc_feature 1..45: note = derived and/or modified sequence opt6 from anti-HIV_CDR
  source 1..45: mol_type = other RNA
ctagaagcagatggagatgactatagcccaaaaatggtagattac

SEQ ID NO: 52066 - RNA, 45 nt, synthetic construct
  misc_feature 1..45: note = derived and/or modified sequence opt6 from anti-HIV_CDR
  source 1..45: mol_type = other RNA
gctcctcgtttagatttaggtgaattatcttctggttttcatttt

SEQ ID NO: 52067 - RNA, 45 nt, synthetic construct
  misc_feature 1..45: note = derived and/or modified sequence opt6 from anti-HIV_CDR
  source 1..45: mol_type = other RNA
gcgccaagactagaattaggagaattaagttcaggatttcattat

SEQ ID NO: 52068 - RNA, 45 nt, synthetic construct
  misc_feature 1..45: note = derived and/or modified sequence opt6 from anti-HIV_CDR
  source 1..45: mol_type = other RNA
ggaagattattaatgcaatggccaccaagaggaggatttgaccca

SEQ ID NO: 52069 - RNA, 45 nt, synthetic construct
  misc_feature 1..45: note = derived and/or modified sequence opt6 from anti-HIV_CDR
  source 1..45: mol_type = other RNA
ggaagattatttatgcaatggccaccaagaggaggatttgatcca

SEQ ID NO: 52070 - RNA, 45 nt, synthetic construct
  misc_feature 1..45: note = derived and/or modified sequence opt6 from anti-HIV_CDR
  source 1..45: mol_type = other RNA
ggaagattatttgtacaatggccaccacaaggaggatttgatcca

SEQ ID NO: 52071 - RNA, 45 nt, synthetic construct
  misc_feature 1..45: note = derived and/or modified sequence opt6 from anti-HIV_CDR
  source 1..45: mol_type = other RNA
ggaagattatttatgcaatggccaccacaaggaggatttgatcca

SEQ ID NO: 52072 - RNA, 45 nt, synthetic construct
  misc_feature 1..45: note = derived and/or modified sequence opt6 from anti-HIV_CDR
  source 1..45: mol_type = other RNA
ggaagattatttgtacaatggccaccacaaggaggatttgataca

SEQ ID NO: 52073 - RNA, 45 nt, synthetic construct
  misc_feature 1..45: note = derived and/or modified sequence opt6 from anti-HIV_CDR
  source 1..45: mol_type = other RNA
aataacaatacaagaaaatcaataaacataggaccaggaagagca

SEQ ID NO: 52074 - RNA, 45 nt, synthetic construct
  misc_feature 1..45: note = derived and/or modified sequence opt6 from anti-HIV_CDR
  source 1..45: mol_type = other RNA
cccggatactgcaataacaatatatgtacacactggtttgacact

SEQ ID NO: 52075 - RNA, 45 nt, synthetic construct
  misc_feature 1..45: note = derived and/or modified sequence opt6 from anti-HIV_CDR
  source 1..45: mol_type = other RNA
gacctattaccagattacccagtctcatcagcaccagaagacttt

SEQ ID NO: 52076 - RNA, 45 nt, synthetic construct
  misc_feature 1..45: note = derived and/or modified sequence opt6 from anti-HIV_CDR
  source 1..45: mol_type = other RNA
gagagctggctatatagcaatggagattactattacatggacgtg

SEQ ID NO: 52077 - RNA, 45 nt, synthetic construct
  misc_feature 1..45: note = derived and/or modified sequence opt6 from anti-HIV_CDR
  source 1..45: mol_type = other RNA
cgttattgttcatctacaacttgttacagaggtcattttgattat

SEQ ID NO: 52078 - RNA, 45 nt, synthetic construct
  misc_feature 1..45: note = derived and/or modified sequence opt6 from anti-HIV_CDR
  source 1..45: mol_type = other RNA
caaacaacagatgaaggaagacaatggctagtaggatttcaacat

SEQ ID NO: 52079 - RNA, 45 nt, synthetic construct
  misc_feature 1..45: note = derived and/or modified sequence opt6 from anti-HIV_CDR
  source 1..45: mol_type = other RNA
cctagttatggaggttatgatgatcaaggatggtattttgaatat

SEQ ID NO: 52080 - RNA, 45 nt, synthetic construct
  misc_feature 1..45: note = derived and/or modified sequence opt6 from anti-HIV_CDR
  source 1..45: mol_type = other RNA
gcagctatacctataggtgactctaaatattcatatttcgattca

SEQ ID NO: 52081 - RNA, 45 nt, synthetic construct
  misc_feature 1..45: note = derived and/or modified sequence opt6 from anti-HIV_CDR
  source 1..45: mol_type = other RNA
gctccacctccaggttcaactgaatgggcatattattttgattat

SEQ ID NO: 52082 - RNA, 45 nt, synthetic construct
  misc_feature 1..45: note = derived and/or modified sequence opt6 from anti-HIV_CDR
  source 1..45: mol_type = other RNA
gcccaatttcataattctggctattattattccggtcttgattat

SEQ ID NO: 52083 - RNA, 45 nt, synthetic construct
  misc_feature 1..45: note = derived and/or modified sequence opt6 from anti-HIV_CDR
  source 1..45: mol_type = other RNA
gggggttatgattatggtgatcattattattattatatggatgtg

SEQ ID NO: 52084 - RNA, 45 nt, synthetic construct
  misc_feature 1..45: note = derived and/or modified sequence opt6 from anti-HIV_CDR
  source 1..45: mol_type = other RNA
ggaactcaatcttattctgcagttgcacctggatggtttgatcca

SEQ ID NO: 52085 - RNA, 45 nt, synthetic construct
  misc_feature 1..45: note = derived and/or modified sequence opt6 from anti-HIV_CDR
  source 1..45: mol_type = other RNA
ataaaaggaccaccaagaggaaattttggagtagcattttacttt

SEQ ID NO: 52086 - RNA, 45 nt, synthetic construct
  misc_feature 1..45: note = derived and/or modified sequence opt6 from anti-HIV_CDR
  source 1..45: mol_type = other RNA
aaagtatattcagatggatggtcacctccaactggatttgtatat

SEQ ID NO: 52087 - RNA, 45 nt, synthetic construct
  misc_feature 1..45: note = derived and/or modified sequence opt6 from anti-HIV_CDR
  source 1..45: mol_type = other RNA
agatataaatatctacctggagatcaacatatgccttgggataac

SEQ ID NO: 52088 - RNA, 45 nt, synthetic construct
  misc_feature 1..45: note = derived and/or modified sequence opt6 from anti-HIV_CDR
  source 1..45: mol_type = other RNA
agatataaatatctacctggagatcaacatatgccttgggattac

SEQ ID NO: 52089 - RNA, 45 nt, synthetic construct
  misc_feature 1..45: note = derived and/or modified sequence opt6 from anti-HIV_CDR
  source 1..45: mol_type = other RNA
ggaggaggatatgcagtagtaggaccgaaatatggattagatgta

SEQ ID NO: 52090 - RNA, 45 nt, synthetic construct
  misc_feature 1..45: note = derived and/or modified sequence opt6 from anti-HIV_CDR
  source 1..45: mol_type = other RNA
ttagatagcagtagtgggtgggaggaagtgggatatttcgataga

SEQ ID NO: 52091 - RNA, 45 nt, synthetic construct
  misc_feature 1..45: note = derived and/or modified sequence opt6 from anti-HIV_CDR
  source 1..45: mol_type = other RNA
gagaattatagtgatggatgggaagaggtagggcattttgattat

SEQ ID NO: 52092 - RNA, 45 nt, synthetic construct
  misc_feature 1..45: note = derived and/or modified sequence opt6 from anti-HIV_CDR
  source 1..45: mol_type = other RNA
gagaattatagtgatggatgggaagaggtagggcattttgatagt

SEQ ID NO: 52093 - RNA, 45 nt, synthetic construct
  misc_feature 1..45: note = derived and/or modified sequence opt6 from anti-HIV_CDR
  source 1..45: mol_type = other RNA
gagaattatagtgatggatggaatgaggtagggcattttgacttt

SEQ ID NO: 52094 - RNA, 45 nt, synthetic construct
  misc_feature 1..45: note = derived and/or modified sequence opt6 from anti-HIV_CDR
  source 1..45: mol_type = other RNA
gagaattatagtgatggatggtatgaggtagggcattttgacttg

SEQ ID NO: 52095 - RNA, 45 nt, synthetic construct
  misc_feature 1..45: note = derived and/or modified sequence opt6 from anti-HIV_CDR
  source 1..45: mol_type = other RNA
gatagaaggagatttctagagtggtcgctatatggaatggacgtg

SEQ ID NO: 52096 - RNA, 45 nt, synthetic construct
  misc_feature 1..45: note = derived and/or modified sequence opt6 from anti-HIV_CDR
  source 1..45: mol_type = other RNA
ggtccacgtgtattttttgaatcatctggatattattttagagat

SEQ ID NO: 52097 - RNA, 45 nt, synthetic construct
  misc_feature 1..45: note = derived and/or modified sequence opt6 from anti-HIV_CDR
  source 1..45: mol_type = other RNA
ggaccgagagtattatttgaaagtagtggacattatttaagagat

SEQ ID NO: 52098 - RNA, 45 nt, synthetic construct
  misc_feature 1..45: note = derived and/or modified sequence opt6 from anti-HIV_CDR
  source 1..45: mol_type = other RNA
ggtccacgtgtattttttgaatcatctggatattattttagaaat

SEQ ID NO: 52099 - RNA, 45 nt, synthetic construct
  misc_feature 1..45: note = derived and/or modified sequence opt6 from anti-HIV_CDR
  source 1..45: mol_type = other RNA
gaaggaggaagtttatggtttggaggagcaaattggttagatcca

SEQ ID NO: 52100 - RNA, 45 nt, synthetic construct
  misc_feature 1..45: note = derived and/or modified sequence opt6 from anti-HIV_CDR
  source 1..45: mol_type = other RNA
gcggattatgataatatatgggatagtagagggggatttgatttg

SEQ ID NO: 52101 - RNA, 45 nt, synthetic construct
  misc_feature 1..45: note = derived and/or modified sequence opt6 from anti-HIV_CDR
  source 1..45: mol_type = other RNA
gtaggggggacggtatggagtgggtatagtaattatttagattat

SEQ ID NO: 52102 - RNA, 45 nt, synthetic construct
  misc_feature 1..45: note = derived and/or modified sequence opt6 from anti-HIV_CDR
  source 1..45: mol_type = other RNA
gacaatagagatcaatggctagtactaagaagctggttcgatcca

SEQ ID NO: 52103 - RNA, 45 nt, synthetic construct
  misc_feature 1..45: note = derived and/or modified sequence opt6 from anti-HIV_CDR
  source 1..45: mol_type = other RNA
gaaaaaggccaatgggtaacattaccaccatactattttgactca

SEQ ID NO: 52104 - RNA, 48 nt, synthetic construct
  misc_feature 1..48: note = derived and/or modified sequence opt6 from anti-HIV_CDR
  source 1..48: mol_type = other RNA
tacttttccgataccgatcgctctgaatattcaccttcacttcgctct

SEQ ID NO: 52105 - RNA, 48 nt, synthetic construct
  misc_feature 1..48: note = derived and/or modified sequence opt6 from anti-HIV_CDR
  source 1..48: mol_type = other RNA
tacatatccgaccgcgaatccgcaacctacaacccatccctaaactca

SEQ ID NO: 52106 - RNA, 48 nt, synthetic construct
  misc_feature 1..48: note = derived and/or modified sequence opt6 from anti-HIV_CDR
  source 1..48: mol_type = other RNA
tacttctccgacaccgaaaaatcaaactacaacccatcactacgctca

SEQ ID NO: 52107 - RNA, 48 nt, synthetic construct
  misc_feature 1..48: note = derived and/or modified sequence opt6 from anti-HIV_CDR
  source 1..48: mol_type = other RNA
tacatatccgaccgcgcatccgcaacctacaacccatccctaaactca

SEQ ID NO: 52108 - RNA, 48 nt, synthetic construct
  misc_feature 1..48: note = derived and/or modified sequence opt6 from anti-HIV_CDR
  source 1..48: mol_type = other RNA
tacgtacaccactcaggagacacaaactacaatccatcactaaaaaga

SEQ ID NO: 52109 - RNA, 48 nt, synthetic construct
  misc_feature 1..48: note = derived and/or modified sequence opt6 from anti-HIV_CDR
  source 1..48: mol_type = other RNA
tacgtacacaaatccggagacacaaactactcaccatcactaaaatca

SEQ ID NO: 52110 - RNA, 48 nt, synthetic construct
  misc_feature 1..48: note = derived and/or modified sequence opt6 from anti-HIV_CDR
  source 1..48: mol_type = other RNA
tacgtacacgacagcggagacacaaactataacccaagcctaaaatca

SEQ ID NO: 52111 - RNA, 48 nt, synthetic construct
  misc_feature 1..48: note = derived and/or modified sequence opt6 from anti-HIV_CDR
  source 1..48: mol_type = other RNA
tacataagcaaaagcgaaagcgcaaactataacccgagcttaaactca

SEQ ID NO: 52112 - RNA, 48 nt, synthetic construct
  misc_feature 1..48: note = derived and/or modified sequence opt6 from anti-HIV_CDR
  source 1..48: mol_type = other RNA
tacatatactactccggctccacaaactacaacccctccctcaaatca

SEQ ID NO: 52113 - RNA, 48 nt, synthetic construct
  misc_feature 1..48: note = derived and/or modified sequence opt6 from anti-HIV_CDR
  source 1..48: mol_type = other RNA
tacgtacacgactccggagacataaactacaacccatcactaaaaaac

SEQ ID NO: 52114 - RNA, 48 nt, synthetic construct
  misc_feature 1..48: note = derived and/or modified sequence opt6 from anti-HIV_CDR
  source 1..48: mol_type = other RNA
agttattatgattttagtataggagatggaaatgatgcgtttgatgta

SEQ ID NO: 52115 - RNA, 48 nt, synthetic construct
  misc_feature 1..48: note = derived and/or modified sequence opt6 from anti-HIV_CDR
  source 1..48: mol_type = other RNA
ggttttcgtggatctccattttcatctggatctttatattttgattca

SEQ ID NO: 52116 - RNA, 48 nt, synthetic construct
  misc_feature 1..48: note = derived and/or modified sequence opt6 from anti-HIV_CDR
  source 1..48: mol_type = other RNA
gttatatctggccgtataactatattttactataactatatagatgta

SEQ ID NO: 52117 - RNA, 48 nt, synthetic construct
  misc_feature 1..48: note = derived and/or modified sequence opt6 from anti-HIV_CDR
  source 1..48: mol_type = other RNA
gatggattaggagaagtagcgccagattatagatatggaatagatgta

SEQ ID NO: 52118 - RNA, 48 nt, synthetic construct
  misc_feature 1..48: note = derived and/or modified sequence opt6 from anti-HIV_CDR
  source 1..48: mol_type = other RNA
gatggattaggagaactagcaccagcatatcaatacggaatagatgta

SEQ ID NO: 52119 - RNA, 48 nt, synthetic construct
  misc_feature 1..48: note = derived and/or modified sequence opt6 from anti-HIV_CDR
  source 1..48: mol_type = other RNA
gatggattaggagaactagcaccagcatatcattacggaatagatgta

SEQ ID NO: 52120 - RNA, 48 nt, synthetic construct
  misc_feature 1..48: note = derived and/or modified sequence opt6 from anti-HIV_CDR
  source 1..48: mol_type = other RNA
gatggattaggagaagtagcaccagcatatttatatggaatagatgca

SEQ ID NO: 52121 - RNA, 48 nt, synthetic construct
  misc_feature 1..48: note = derived and/or modified sequence opt6 from anti-HIV_CDR
  source 1..48: mol_type = other RNA
gcagtaaaaggattttggtttgatgaagtatataattggtttgggcca

SEQ ID NO: 52122 - RNA, 48 nt, synthetic construct
  misc_feature 1..48: note = derived and/or modified sequence opt6 from anti-HIV_CDR
  source 1..48: mol_type = other RNA
gctgtaaaaggattttggtttgatgatccatatacatggtttggtcca

SEQ ID NO: 52123 - RNA, 48 nt, synthetic construct
  misc_feature 1..48: note = derived and/or modified sequence opt6 from anti-HIV_CDR
  source 1..48: mol_type = other RNA
gcagtaaaaggattttggtttgatgaaccaagtacatggtttggacca

SEQ ID NO: 52124 - RNA, 48 nt, synthetic construct
  misc_feature 1..48: note = derived and/or modified sequence opt6 from anti-HIV_CDR
  source 1..48: mol_type = other RNA
gcagtaaaaggattatggtttgatgaaacatatacatggttcggacca

SEQ ID NO: 52125 - RNA, 48 nt, synthetic construct
  misc_feature 1..48: note = derived and/or modified sequence opt6 from anti-HIV_CDR
  source 1..48: mol_type = other RNA
gcagtagctggattatggtttgaagatgcatataattggtttggacca

SEQ ID NO: 52126 - RNA, 48 nt, synthetic construct
  misc_feature 1..48: note = derived and/or modified sequence opt6 from anti-HIV_CDR
  source 1..48: mol_type = other RNA
gcagaagcagaatcacaatcacactcaagaccaataatgttcgactac

SEQ ID NO: 52127 - RNA, 48 nt, synthetic construct
  misc_feature 1..48: note = derived and/or modified sequence opt6 from anti-HIV_CDR
  source 1..48: mol_type = other RNA
gcagaagcagcatcagactcacactcaagaccaataatgtttgatcat

SEQ ID NO: 52128 - RNA, 48 nt, synthetic construct
  misc_feature 1..48: note = derived and/or modified sequence opt6 from anti-HIV_CDR
  source 1..48: mol_type = other RNA
ctagaagcagaatcagactcacactcaagaccaataatgtttgaccat

SEQ ID NO: 52129 - RNA, 48 nt, synthetic construct
  misc_feature 1..48: note = derived and/or modified sequence opt6 from anti-HIV_CDR
  source 1..48: mol_type = other RNA
gcagaagcagaatcacaatcacactcaagaccaataatgttcgacagc

SEQ ID NO: 52130 - RNA, 48 nt, synthetic construct
  misc_feature 1..48: note = derived and/or modified sequence opt6 from anti-HIV_CDR
  source 1..48: mol_type = other RNA
gcagaagcagaatcacaatcacactcaagaccaataatgttcgacttc

SEQ ID NO: 52131 - RNA, 48 nt, synthetic construct
  misc_feature 1..48: note = derived and/or modified sequence opt6 from anti-HIV_CDR
  source 1..48: mol_type = other RNA
gacaacccactattacaatcaggcgaattctcaagctcactagaaaac

SEQ ID NO: 52132 - RNA, 48 nt, synthetic construct
  misc_feature 1..48: note = derived and/or modified sequence opt6 from anti-HIV_CDR
  source 1..48: mol_type = other RNA
gacaacccactattacaatcaggcgaattctcaagctcactagacaac

SEQ ID NO: 52133 - RNA, 48 nt, synthetic construct
  misc_feature 1..48: note = derived and/or modified sequence opt6 from anti-HIV_CDR
  source 1..48: mol_type = other RNA
ggaagagattataatttttggggaggaggaggaaaaataaattttccg

SEQ ID NO: 52134 - RNA, 48 nt, synthetic construct
  misc_feature 1..48: note = derived and/or modified sequence opt6 from anti-HIV_CDR
  source 1..48: mol_type = other RNA
acaaattgggctaacgatttcgttacaggttactatagatttgacttt

SEQ ID NO: 52135 - RNA, 48 nt, synthetic construct
  misc_feature 1..48: note = derived and/or modified sequence opt6 from anti-HIV_CDR
  source 1..48: mol_type = other RNA
gcaggacattgctcaagcacaagctcagtatattgcccattcgatatg

SEQ ID NO: 52136 - RNA, 48 nt, synthetic construct
  misc_feature 1..48: note = derived and/or modified sequence opt6 from anti-HIV_CDR
  source 1..48: mol_type = other RNA
caggtatcaagttatagctcaagcggatacagaagagaattcgattac

SEQ ID NO: 52137 - RNA, 48 nt, synthetic construct
  misc_feature 1..48: note = derived and/or modified sequence opt6 from anti-HIV_CDR
  source 1..48: mol_type = other RNA
cgtatggctacacttacaggtggatattattattattatatggatgta

SEQ ID NO: 52138 - RNA, 48 nt, synthetic construct
  misc_feature 1..48: note = derived and/or modified sequence opt6 from anti-HIV_CDR
  source 1..48: mol_type = other RNA
gagggggggtatagtgatttttggagtgggtatagtgggtttgattat

SEQ ID NO: 52139 - RNA, 48 nt, synthetic construct
  misc_feature 1..48: note = derived and/or modified sequence opt6 from anti-HIV_CDR
  source 1..48: mol_type = other RNA
ttatattataattttggttcgggttatgatacgggtataggtgatcat

SEQ ID NO: 52140 - RNA, 48 nt, synthetic construct
  misc_feature 1..48: note = derived and/or modified sequence opt6 from anti-HIV_CDR
  source 1..48: mol_type = other RNA
gcgagagagggaaggtggtttagtgataattattacgcgatggatgta

SEQ ID NO: 52141 - RNA, 48 nt, synthetic construct
  misc_feature 1..48: note = derived and/or modified sequence opt6 from anti-HIV_CDR
  source 1..48: mol_type = other RNA
gatagggtagggagaaggttaggggaattgagtgcgggatttgattat

SEQ ID NO: 52142 - RNA, 48 nt, synthetic construct
  misc_feature 1..48: note = derived and/or modified sequence opt6 from anti-HIV_CDR
  source 1..48: mol_type = other RNA
gcaagaccaagaagtccatgggatagtacaggatggagtgtaggatat

SEQ ID NO: 52143 - RNA, 48 nt, synthetic construct
  misc_feature 1..48: note = derived and/or modified sequence opt6 from anti-HIV_CDR
  source 1..48: mol_type = other RNA
tcttattatgattttagatctgattctggtaatgatgcttttgatatt

SEQ ID NO: 52144 - RNA, 48 nt, synthetic construct
  misc_feature 1..48: note = derived and/or modified sequence opt6 from anti-HIV_CDR
  source 1..48: mol_type = other RNA
tcatattacgatttccaaacagattcaggtaacgatgcatttgacgtt

SEQ ID NO: 52145 - RNA, 48 nt, synthetic construct
  misc_feature 1..48: note = derived and/or modified sequence opt6 from anti-HIV_CDR
  source 1..48: mol_type = other RNA
gataacccagtattacaattaggagaactatcaagctcactagactac

SEQ ID NO: 52146 - RNA, 48 nt, synthetic construct
  misc_feature 1..48: note = derived and/or modified sequence opt6 from anti-HIV_CDR
  source 1..48: mol_type = other RNA
ggttttcgtggatctccattttcatctggatctatgtattttgattca

SEQ ID NO: 52147 - RNA, 48 nt, synthetic construct
  misc_feature 1..48: note = derived and/or modified sequence opt6 from anti-HIV_CDR
  source 1..48: mol_type = other RNA
ggttttcgtggttctcctctttcttctggttctctttattttgattct

SEQ ID NO: 52148 - RNA, 48 nt, synthetic construct
  misc_feature 1..48: note = derived and/or modified sequence opt6 from anti-HIV_CDR
  source 1..48: mol_type = other RNA
ggttttcgtggaaatgtattttcgactggatggttttatttagatttt

SEQ ID NO: 52149 - RNA, 48 nt, synthetic construct
  misc_feature 1..48: note = derived and/or modified sequence opt6 from anti-HIV_CDR
  source 1..48: mol_type = other RNA
gatcgactcagctttagcgtacaagtagaacagggcgtattagattac

SEQ ID NO: 52150 - RNA, 48 nt, synthetic construct
  misc_feature 1..48: note = derived and/or modified sequence opt6 from anti-HIV_CDR
  source 1..48: mol_type = other RNA
gatcgcttaagttttagcgtacaagtagaacaaggcgtactccaattt

SEQ ID NO: 52151 - RNA, 48 nt, synthetic construct
  misc_feature 1..48: note = derived and/or modified sequence opt6 from anti-HIV_CDR
  source 1..48: mol_type = other RNA
gttctatctggacgtataactatattttactattactatatggatgta

SEQ ID NO: 52152 - RNA, 51 nt, synthetic construct
  misc_feature 1..51: note = derived and/or modified sequence opt6 from anti-HIV_CDR
  source 1..51: mol_type = other RNA
tatatatcttcaggttcatctacacttcactatgcagatacagttaaaggt

SEQ ID NO: 52153 - RNA, 51 nt, synthetic construct
  misc_feature 1..51: note = derived and/or modified sequence opt6 from anti-HIV_CDR
  source 1..51: mol_type = other RNA
agatatttagattggagtccaataggaagagatacatatggaacagatgta

SEQ ID NO: 52154 - RNA, 51 nt, synthetic construct
  misc_feature 1..51: note = derived and/or modified sequence opt6 from anti-HIV_CDR
  source 1..51: mol_type = other RNA
agatatttcgattggtcaccatttagaagagacacatacggaacagatgta

SEQ ID NO: 52155 - RNA, 51 nt, synthetic construct
  misc_feature 1..51: note = derived and/or modified sequence opt6 from anti-HIV_CDR
  source 1..51: mol_type = other RNA
gggagggattataatttttggagtgggggggggaggtattattttgatttt

SEQ ID NO: 52156 - RNA, 51 nt, synthetic construct
  misc_feature 1..51: note = derived and/or modified sequence opt6 from anti-HIV_CDR
  source 1..51: mol_type = other RNA
ggaatacaagaagactatgatttctggagagaatacagagaattagactat

SEQ ID NO: 52157 - RNA, 51 nt, synthetic construct
  misc_feature 1..51: note = derived and/or modified sequence opt6 from anti-HIV_CDR
  source 1..51: mol_type = other RNA
gtactaaataacaatacaagaaaatcaataaacataggaccaggaagagca

SEQ ID NO: 52158 - RNA, 51 nt, synthetic construct
  misc_feature 1..51: note = derived and/or modified sequence opt6 from anti-HIV_CDR
  source 1..51: mol_type = other RNA
gatcttaatttcggtgtcgttactccttattattattattatttagacgtt

SEQ ID NO: 52159 - RNA, 51 nt, synthetic construct
  misc_feature 1..51: note = derived and/or modified sequence opt6 from anti-HIV_CDR
  source 1..51: mol_type = other RNA
catggtagaactgtatttggagttgtacgtaattattattatatggatgta

SEQ ID NO: 52160 - RNA, 51 nt, synthetic construct
  misc_feature 1..51: note = derived and/or modified sequence opt6 from anti-HIV_CDR
  source 1..51: mol_type = other RNA
cactattacggctcaggactaacaaaagactactatgaatatatagacgta

SEQ ID NO: 52161 - RNA, 51 nt, synthetic construct
  misc_feature 1..51: note = derived and/or modified sequence opt6 from anti-HIV_CDR
  source 1..51: mol_type = other RNA
acatattacaatttctggtcagatcaatctcaaggtctagatttcgattac

SEQ ID NO: 52162 - RNA, 51 nt, synthetic construct
  misc_feature 1..51: note = derived and/or modified sequence opt6 from anti-HIV_CDR
  source 1..51: mol_type = other RNA
ggagtatgggaagcaccagatggaagtagttattattattatatggcagat

SEQ ID NO: 52163 - RNA, 51 nt, synthetic construct
  misc_feature 1..51: note = derived and/or modified sequence opt6 from anti-HIV_CDR
  source 1..51: mol_type = other RNA
gatcaaggaggatatccagtaagtccagtaggaccaaaatggtttgatcca

SEQ ID NO: 52164 - RNA, 51 nt, synthetic construct
  misc_feature 1..51: note = derived and/or modified sequence opt6 from anti-HIV_CDR
  source 1..51: mol_type = other RNA
agagataaatatcaatatatagatagctcaggcgattacccgttcgataga

SEQ ID NO: 52165 - RNA, 51 nt, synthetic construct
  misc_feature 1..51: note = derived and/or modified sequence opt6 from anti-HIV_CDR
  source 1..51: mol_type = other RNA
caactaagagcaccaacaacaagattcagacacggaggatacttcgaaaat

SEQ ID NO: 52166 - RNA, 51 nt, synthetic construct
  misc_feature 1..51: note = derived and/or modified sequence opt6 from anti-HIV_CDR
  source 1..51: mol_type = other RNA
caagtaagagcaccaacactaagattcagacacggaggatatttcgaaaca

SEQ ID NO: 52167 - RNA, 51 nt, synthetic construct
  misc_feature 1..51: note = derived and/or modified sequence opt6 from anti-HIV_CDR
  source 1..51: mol_type = other RNA
gtatctataacttatgctggattaatagttgtacctggagcttttgatgta

SEQ ID NO: 52168 - RNA, 51 nt, synthetic construct
  misc_feature 1..51: note = derived and/or modified sequence opt6 from anti-HIV_CDR
  source 1..51: mol_type = other RNA
gtagctatatcttatgctggattaatagttgtacctggaccttttgatgta

SEQ ID NO: 52169 - RNA, 51 nt, synthetic construct
  misc_feature 1..51: note = derived and/or modified sequence opt6 from anti-HIV_CDR
  source 1..51: mol_type = other RNA
agcttaacaggaagattacacttaggagaactatcaagcggaataggacca

SEQ ID NO: 52170 - RNA, 51 nt, synthetic construct
  misc_feature 1..51: note = derived and/or modified sequence opt6 from anti-HIV_CDR
  source 1..51: mol_type = other RNA
ggaggaagcgcactaataacaatattcggagtagatccaaaattcgatcca

SEQ ID NO: 52171 - RNA, 51 nt, synthetic construct
  misc_feature 1..51: note = derived and/or modified sequence opt6 from anti-HIV_CDR
  source 1..51: mol_type = other RNA
atggcattaacaagcgggccatatgacgtaagcggatattattttgattat

SEQ ID NO: 52172 - RNA, 51 nt, synthetic construct
  misc_feature 1..51: note = derived and/or modified sequence opt6 from anti-HIV_CDR
  source 1..51: mol_type = other RNA
atggcattagcaagcgggccatatgacgtaagcggatattattttgattat

SEQ ID NO: 52173 - RNA, 51 nt, synthetic construct
  misc_feature 1..51: note = derived and/or modified sequence opt6 from anti-HIV_CDR
  source 1..51: mol_type = other RNA
atggcattaccatcaggaccactagatagatcaggatattactttgacgat

SEQ ID NO: 52174 - RNA, 54 nt, synthetic construct
  misc_feature 1..54: note = derived and/or modified sequence opt6 from anti-HIV_CDR
  source 1..54: mol_type = other RNA
gttgttcctatgttttctatttttggtgttgttaaagctaattattttgattat

SEQ ID NO: 52175 - RNA, 54 nt, synthetic construct
  misc_feature 1..54: note = derived and/or modified sequence opt6 from anti-HIV_CDR
  source 1..54: mol_type = other RNA
aatagacgtgtagctatgcctgaagctatgattttaagtttttatatggatgta

SEQ ID NO: 52176 - RNA, 54 nt, synthetic construct
  misc_feature 1..54: note = derived and/or modified sequence opt6 from anti-HIV_CDR
  source 1..54: mol_type = other RNA
ggattatgtagaggaggaaattgtagattaggaccaagtggatggttagatcca

SEQ ID NO: 52177 - RNA, 54 nt, synthetic construct
  misc_feature 1..54: note = derived and/or modified sequence opt6 from anti-HIV_CDR
  source 1..54: mol_type = other RNA
acacctccacattacgacgtacttacaggctacccttcatctgtacttgaattt

SEQ ID NO: 52178 - RNA, 54 nt, synthetic construct
  misc_feature 1..54: note = derived and/or modified sequence opt6 from anti-HIV_CDR
  source 1..54: mol_type = other RNA
ataccataccattcagaatcatattacaaagtagtaataggaggatttgacgta

SEQ ID NO: 52179 - RNA, 54 nt, synthetic construct
  misc_feature 1..54: note = derived and/or modified sequence opt6 from anti-HIV_CDR
  source 1..54: mol_type = other RNA
gcagatccgtttaaagttgcacaagatgaaggattatttgtaatatttgattat

SEQ ID NO: 52180 - RNA, 54 nt, synthetic construct
  misc_feature 1..54: note = derived and/or modified sequence opt6 from anti-HIV_CDR
  source 1..54: mol_type = other RNA
gcagatccgtttaaagtagcacaagatgaaggactatatgtaatatttgattat

SEQ ID NO: 52181 - RNA, 54 nt, synthetic construct
  misc_feature 1..54: note = derived and/or modified sequence opt6 from anti-HIV_CDR
  source 1..54: mol_type = other RNA
gcggataggtttaaggtagcgcaagatgaaggattatttgtaatatttgattat

SEQ ID NO: 52182 - RNA, 54 nt, synthetic construct
  misc_feature 1..54: note = derived and/or modified sequence opt6 from anti-HIV_CDR
  source 1..54: mol_type = other RNA
ggaagacaaacatttagagcaatatggagcggaccaccagcagtattcgatata

SEQ ID NO: 52183 - RNA, 54 nt, synthetic construct
  misc_feature 1..54: note = derived and/or modified sequence opt6 from anti-HIV_CDR
  source 1..54: mol_type = other RNA
ggaagacaaacatttagagcaatatggagcggaccaccagtagtattcgatata

SEQ ID NO: 52184 - RNA, 54 nt, synthetic construct
  misc_feature 1..54: note = derived and/or modified sequence opt6 from anti-HIV_CDR
  source 1..54: mol_type = other RNA
tctagaggtgactataacttttggtctggatatccagaataccatttcgataga

SEQ ID NO: 52185 - RNA, 54 nt, synthetic construct
  misc_feature 1..54: note = derived and/or modified sequence opt6 from anti-HIV_CDR
  source 1..54: mol_type = other RNA
ttaccaaaatcaagaatggtcggaggagatcatttaccattttatccagacttt

SEQ ID NO: 52186 - RNA, 54 nt, synthetic construct
  misc_feature 1..54: note = derived and/or modified sequence opt6 from anti-HIV_CDR
  source 1..54: mol_type = other RNA
ttaacaggtccatctggatattgtgattcatctggatgttactggtttgatcca

SEQ ID NO: 52187 - RNA, 54 nt, synthetic construct
  misc_feature 1..54: note = derived and/or modified sequence opt6 from anti-HIV_CDR
  source 1..54: mol_type = other RNA
ggtggaagtatgattagaggtgtacctagtcctttttattatggtatggatgta

SEQ ID NO: 52188 - RNA, 54 nt, synthetic construct
  misc_feature 1..54: note = derived and/or modified sequence opt6 from anti-HIV_CDR
  source 1..54: mol_type = other RNA
ttatttggagcaaaaagattaggagtagcgccaagtggatattatatggatgta

SEQ ID NO: 52189 - RNA, 54 nt, synthetic construct
  misc_feature 1..54: note = derived and/or modified sequence opt6 from anti-HIV_CDR
  source 1..54: mol_type = other RNA
gatagatatgaggcagcatggtttggagcagataaagtatatggaatggatgta

SEQ ID NO: 52190 - RNA, 54 nt, synthetic construct
  misc_feature 1..54: note = derived and/or modified sequence opt6 from anti-HIV_CDR
  source 1..54: mol_type = other RNA
gaacacagactaccaccaccaacaggaagaagaacaagaaactggttcgaccca

SEQ ID NO: 52191 - RNA, 54 nt, synthetic construct
  misc_feature 1..54: note = derived and/or modified sequence opt6 from anti-HIV_CDR
  source 1..54: mol_type = other RNA
ggaagaggaagttttcaaggatttcagcaatatgaatattatggaatggatgta

SEQ ID NO: 52192 - RNA, 54 nt, synthetic construct
  misc_feature 1..54: note = derived and/or modified sequence opt6 from anti-HIV_CDR
  source 1..54: mol_type = other RNA
ggaagaggatatagtcatggatttcaacaatataattattatggaatggacgta

SEQ ID NO: 52193 - RNA, 54 nt, synthetic construct
  misc_feature 1..54: note = derived and/or modified sequence opt6 from anti-HIV_CDR
  source 1..54: mol_type = other RNA
ggtagaggtagttttacaggttttgatcaatatcattattacggtatggatgta

SEQ ID NO: 52194 - RNA, 54 nt, synthetic construct
  misc_feature 1..54: note = derived and/or modified sequence opt6 from anti-HIV_CDR
  source 1..54: mol_type = other RNA
ggtcgtggttctacttttccttctgctcaattttcttattttggtcttgatgtt

SEQ ID NO: 52195 - RNA, 54 nt, synthetic construct
  misc_feature 1..54: note = derived and/or modified sequence opt6 from anti-HIV_CDR
  source 1..54: mol_type = other RNA
gatctagcaagatatggagtaacatcaatagtaccagaattcggattcgatttc

SEQ ID NO: 52196 - RNA, 54 nt, synthetic construct
  misc_feature 1..54: note = derived and/or modified sequence opt6 from anti-HIV_CDR
  source 1..54: mol_type = other RNA
cgtggacgtctaaatataccttcaccttcagctatacttacagctttcgatgta

SEQ ID NO: 52197 - RNA, 54 nt, synthetic construct
  misc_feature 1..54: note = derived and/or modified sequence opt6 from anti-HIV_CDR
  source 1..54: mol_type = other RNA
ggaccgggaagtatggtaagaggattaatagtaacaagttatggaatggatgta

SEQ ID NO: 52198 - RNA, 54 nt, synthetic construct
  misc_feature 1..54: note = derived and/or modified sequence opt6 from anti-HIV_CDR
  source 1..54: mol_type = other RNA
aaaagagtaacaatattcggagtagtagatacaccaagaggatactttgactat

SEQ ID NO: 52199 - RNA, 54 nt, synthetic construct
  misc_feature 1..54: note = derived and/or modified sequence opt6 from anti-HIV_CDR
  source 1..54: mol_type = other RNA
ggacaaagaaatgtattacacttcctagaaagaaaaaacgacgcattcgacata

SEQ ID NO: 52200 - RNA, 54 nt, synthetic construct
  misc_feature 1..54: note = derived and/or modified sequence opt6 from anti-HIV_CDR
  source 1..54: mol_type = other RNA
gagcagaaggattatgatttttggaatggattgtataagtatgggatggatgta

SEQ ID NO: 52201 - RNA, 57 nt, synthetic construct
  misc_feature 1..57: note = derived and/or modified sequence opt6 from anti-HIV_CDR
  source 1..57: mol_type = other RNA
gatacaacaacatttacaacatttggaggaggaccaaatatgggaggatttgaccca

SEQ ID NO: 52202 - RNA, 57 nt, synthetic construct
  misc_feature 1..57: note = derived and/or modified sequence opt6 from anti-HIV_CDR
  source 1..57: mol_type = other RNA
gcaggattagattataatttctggaacggaaaaggaagaaaaggagcatttgatgta

SEQ ID NO: 52203 - RNA, 57 nt, synthetic construct
  misc_feature 1..57: note = derived and/or modified sequence opt6 from anti-HIV_CDR
  source 1..57: mol_type = other RNA
aatgaagctgactatcatgatggaaatggacatagtttaagaggtatgtttgattat

SEQ ID NO: 52204 - RNA, 57 nt, synthetic construct
  misc_feature 1..57: note = derived and/or modified sequence opt6 from anti-HIV_CDR
  source 1..57: mol_type = other RNA
aacgaaccacaatatcatgacggaaacggacactcactaccaggaatgttcgatagc

SEQ ID NO: 52205 - RNA, 57 nt, synthetic construct
  misc_feature 1..57: note = derived and/or modified sequence opt6 from anti-HIV_CDR
  source 1..57: mol_type = other RNA
aacgaaccacaataccatgacgacaacggacactcactaccaggaatgatagattac

SEQ ID NO: 52206 - RNA, 57 nt, synthetic construct
  misc_feature 1..57: note = derived and/or modified sequence opt6 from anti-HIV_CDR
  source 1..57: mol_type = other RNA
aatgaaccacaatatcatgacggaaacggacactcattaccaggaatgtttgatttc

SEQ ID NO: 52207 - RNA, 57 nt, synthetic construct
  misc_feature 1..57: note = derived and/or modified sequence opt6 from anti-HIV_CDR
  source 1..57: mol_type = other RNA
aatgaacctcaatattttgatggatctggacattcacttccaggtatgtttgattat

SEQ ID NO: 52208 - RNA, 57 nt, synthetic construct
  misc_feature 1..57: note = derived and/or modified sequence opt6 from anti-HIV_CDR
  source 1..57: mol_type = other RNA
cgtgaagctgattatcatgatggaaatggacatacattaccaggtatgtttgatttt

SEQ ID NO: 52209 - RNA, 57 nt, synthetic construct
  misc_feature 1..57: note = derived and/or modified sequence opt6 from anti-HIV_CDR
  source 1..57: mol_type = other RNA
aatgaacctcaatattatgacggatctggacattcattaccaggtatgtttgattat

SEQ ID NO: 52210 - RNA, 57 nt, synthetic construct
  misc_feature 1..57: note = derived and/or modified sequence opt6 from anti-HIV_CDR
  source 1..57: mol_type = other RNA
aatgaacctcaatatcatgacggaaatggacattcattaccaggcatgtttgattat

SEQ ID NO: 52211 - RNA, 57 nt, synthetic construct
  misc_feature 1..57: note = derived and/or modified sequence opt6 from anti-HIV_CDR
  source 1..57: mol_type = other RNA
caagatagtgattttcatgacggacacggacatacattaagaggaatgtttgatagt

SEQ ID NO: 52212 - RNA, 57 nt, synthetic construct
  misc_feature 1..57: note = derived and/or modified sequence opt6 from anti-HIV_CDR
  source 1..57: mol_type = other RNA
ttagattgggtaagaggagtaatgaatttagtagaaaatcattacgcaatggatgta

SEQ ID NO: 52213 - RNA, 57 nt, synthetic construct
  misc_feature 1..57: note = derived and/or modified sequence opt6 from anti-HIV_CDR
  source 1..57: mol_type = other RNA
acaaatggaacagaaatatttagaccaggaggaggagatatgagagataattggaga

SEQ ID NO: 52214 - RNA, 57 nt, synthetic construct
  misc_feature 1..57: note = derived and/or modified sequence opt6 from anti-HIV_CDR
  source 1..57: mol_type = other RNA
gacggtagatattcaggtgacgatcaatattattatcattattattatatggatgta

SEQ ID NO: 52215 - RNA, 57 nt, synthetic construct
  misc_feature 1..57: note = derived and/or modified sequence opt6 from anti-HIV_CDR
  source 1..57: mol_type = other RNA
ctaacaaaaaacccatcacaagacttctggggatcatacctatactacttcgaagac

SEQ ID NO: 52216 - RNA, 57 nt, synthetic construct
  misc_feature 1..57: note = derived and/or modified sequence opt6 from anti-HIV_CDR
  source 1..57: mol_type = other RNA
ggagcaacatattactatgactcaagcggacaccaaagcagaagagcattcgatata

SEQ ID NO: 52217 - RNA, 57 nt, synthetic construct
  misc_feature 1..57: note = derived and/or modified sequence opt6 from anti-HIV_CDR
  source 1..57: mol_type = other RNA
gcatttcaagcaagtatggtaagaggagtaatagtagatccatatggaatggatgta

SEQ ID NO: 52218 - RNA, 57 nt, synthetic construct
  misc_feature 1..57: note = derived and/or modified sequence opt6 from anti-HIV_CDR
  source 1..57: mol_type = other RNA
cacagagcagattatgatttctggaacggaagtaatttaagaggatattttgatcca

SEQ ID NO: 52219 - RNA, 57 nt, synthetic construct
  misc_feature 1..57: note = derived and/or modified sequence opt6 from anti-HIV_CDR
  source 1..57: mol_type = other RNA
catagagcaaattatgatttttggggaggaagtaatttaagaggatattttgatcca

SEQ ID NO: 52220 - RNA, 57 nt, synthetic construct
  misc_feature 1..57: note = derived and/or modified sequence opt6 from anti-HIV_CDR
  source 1..57: mol_type = other RNA
ggatttcacttttggtcaggaacaggaacaagaccgagaaattggtattttgattta

SEQ ID NO: 52221 - RNA, 57 nt, synthetic construct
  misc_feature 1..57: note = derived and/or modified sequence opt6 from anti-HIV_CDR
  source 1..57: mol_type = other RNA
aactatctaatagaatcaagatatgacgaaaaagactactattacgcaatggacgta

SEQ ID NO: 52222 - RNA, 57 nt, synthetic construct
  misc_feature 1..57: note = derived and/or modified sequence opt6 from anti-HIV_CDR
  source 1..57: mol_type = other RNA
tcacgtggatatgcatatgattctggaggtcattattttcctacatggtttgatcca

SEQ ID NO: 52223 - RNA, 57 nt, synthetic construct
  misc_feature 1..57: note = derived and/or modified sequence opt6 from anti-HIV_CDR
  source 1..57: mol_type = other RNA
gatacaacaacatttggagcatttggaggaagtccaaatatgggaggattagatcca

SEQ ID NO: 52224 - RNA, 57 nt, synthetic construct
  misc_feature 1..57: note = derived and/or modified sequence opt6 from anti-HIV_CDR
  source 1..57: mol_type = other RNA
catttagtagtagcagtagcagcaggaccagattattttagttatggaatggatgta

SEQ ID NO: 52225 - RNA, 57 nt, synthetic construct
  misc_feature 1..57: note = derived and/or modified sequence opt6 from anti-HIV_CDR
  source 1..57: mol_type = other RNA
gacacaacaacattttcatcattcggatcaccaccaaatatgggcggactagaccca

SEQ ID NO: 52226 - RNA, 57 nt, synthetic construct
  misc_feature 1..57: note = derived and/or modified sequence opt6 from anti-HIV_CDR
  source 1..57: mol_type = other RNA
gatacaacaacatttggagcatttggaggaggagcaaatatgggaggattagatcca

SEQ ID NO: 52227 - RNA, 57 nt, synthetic construct
  misc_feature 1..57: note = derived and/or modified sequence opt6 from anti-HIV_CDR
  source 1..57: mol_type = other RNA
gacacaacaacattcacatcatttggaagcccaccaagaatgggaggactagatcca

SEQ ID NO: 52228 - RNA, 57 nt, synthetic construct
  misc_feature 1..57: note = derived and/or modified sequence opt6 from anti-HIV_CDR
  source 1..57: mol_type = other RNA
gacacaacaacattttcatcattcggatcaccaccacatatgggcggactagaccca

SEQ ID NO: 52229 - RNA, 57 nt, synthetic construct
  misc_feature 1..57: note = derived and/or modified sequence opt6 from anti-HIV_CDR
  source 1..57: mol_type = other RNA
gatagggtgagtgattatgatttttggagtgggaagagggggtatgggatggatgtg

SEQ ID NO: 52230 - RNA, 57 nt, synthetic construct
  misc_feature 1..57: note = derived and/or modified sequence opt6 from anti-HIV_CDR
  source 1..57: mol_type = other RNA
gaactatcaggagaataccatttctggagcggaacatatagatatggagtagacgta

SEQ ID NO: 52231 - RNA, 57 nt, synthetic construct
  misc_feature 1..57: note = derived and/or modified sequence opt6 from anti-HIV_CDR
  source 1..57: mol_type = other RNA
catggagcatcagaaaattatggaccaggatcatactcagcagaacactttcaacat

SEQ ID NO: 52232 - RNA, 57 nt, synthetic construct
  misc_feature 1..57: note = derived and/or modified sequence opt6 from anti-HIV_CDR
  source 1..57: mol_type = other RNA
catggagcatcagcaaattatggaccaggatcatactcagcagaacactttcaacat

SEQ ID NO: 52233 - RNA, 60 nt, synthetic construct
  misc_feature 1..60: note = derived and/or modified sequence opt6 from anti-HIV_CDR
  source 1..60: mol_type = other RNA
catgaagcacctagatattcatatgcatttagacgttactatcactatggacttgacgtt

SEQ ID NO: 52234 - RNA, 60 nt, synthetic construct
  misc_feature 1..60: note = derived and/or modified sequence opt6 from anti-HIV_CDR
  source 1..60: mol_type = other RNA
acaagcacatatgatcaatggagcggactacatcatgatggagtaatggcattctcaagc

SEQ ID NO: 52235 - RNA, 60 nt, synthetic construct
  misc_feature 1..60: note = derived and/or modified sequence opt6 from anti-HIV_CDR
  source 1..60: mol_type = other RNA
ggagaatttgatagtagtggatttgattatgaaagttggtatccgtattatatggatgta

SEQ ID NO: 52236 - RNA, 60 nt, synthetic construct
  misc_feature 1..60: note = derived and/or modified sequence opt6 from anti-HIV_CDR
  source 1..60: mol_type = other RNA
ggacaaacagatctaaatgacgatttctggtcagaatactcaacaccaggatttgactat

SEQ ID NO: 52237 - RNA, 60 nt, synthetic construct
  misc_feature 1..60: note = derived and/or modified sequence opt6 from anti-HIV_CDR
  source 1..60: mol_type = other RNA
ggacaaacagatctaaatgacgatctatggtcagattactctacacctggatttgactat

SEQ ID NO: 52238 - RNA, 60 nt, synthetic construct
  misc_feature 1..60: note = derived and/or modified sequence opt6 from anti-HIV_CDR
  source 1..60: mol_type = other RNA
aacctaatagaagaaagccaaacacaacaagaaataaacgaaagagacctactagcacta

SEQ ID NO: 52239 - RNA, 60 nt, synthetic construct
  misc_feature 1..60: note = derived and/or modified sequence opt6 from anti-HIV_CDR
  source 1..60: mol_type = other RNA
aacctaatagaagaaagccaaatacaacaagaaaaaaacgaaaaagaactactagaacta

SEQ ID NO: 52240 - RNA, 60 nt, synthetic construct
  misc_feature 1..60: note = derived and/or modified sequence opt6 from anti-HIV_CDR
  source 1..60: mol_type = other RNA
agcctaatcgaaaactcacaaatacaacaagaaaaaaacgaacaagacctactacaacta

SEQ ID NO: 52241 - RNA, 60 nt, synthetic construct
  misc_feature 1..60: note = derived and/or modified sequence opt6 from anti-HIV_CDR
  source 1..60: mol_type = other RNA
agcctaatagaagaaagccaaatacaacaagaaaaaaacgaaaaagaactactagaacta

SEQ ID NO: 52242 - RNA, 60 nt, synthetic construct
  misc_feature 1..60: note = derived and/or modified sequence opt6 from anti-HIV_CDR
  source 1..60: mol_type = other RNA
agactaatagaagaaagccaaacacaacaagaaaaaaacgaacaagaactactagaacta

SEQ ID NO: 52243 - RNA, 60 nt, synthetic construct
  misc_feature 1..60: note = derived and/or modified sequence opt6 from anti-HIV_CDR
  source 1..60: mol_type = other RNA
agcctaatagaagaaagccaaacacaacaagaaaaaaacgaaaaagaactactagaacta

SEQ ID NO: 52244 - RNA, 60 nt, synthetic construct
  misc_feature 1..60: note = derived and/or modified sequence opt6 from anti-HIV_CDR
  source 1..60: mol_type = other RNA
aacctactagaagaatcacaaaaccaacaagaaaaaaacgaacaagaactactagaacta

SEQ ID NO: 52245 - RNA, 60 nt, synthetic construct
  misc_feature 1..60: note = derived and/or modified sequence opt6 from anti-HIV_CDR
  source 1..60: mol_type = other RNA
acactaatagaagaaagccaaaaccaacaagaaaaaaacgaactagaactactagaacta

SEQ ID NO: 52246 - RNA, 60 nt, synthetic construct
  misc_feature 1..60: note = derived and/or modified sequence opt6 from anti-HIV_CDR
  source 1..60: mol_type = other RNA
acactacaagaagaaagccaaaaccaacaagaaaaaaacgaacaagaactactagaacta

SEQ ID NO: 52247 - RNA, 60 nt, synthetic construct
  misc_feature 1..60: note = derived and/or modified sequence opt6 from anti-HIV_CDR
  source 1..60: mol_type = other RNA
tcactactagaagaaagccaaaaccaacaagaaaaaaacgaacaagaactactagaacta

SEQ ID NO: 52248 - RNA, 60 nt, synthetic construct
  misc_feature 1..60: note = derived and/or modified sequence opt6 from anti-HIV_CDR
  source 1..60: mol_type = other RNA
acactaatagaagaaagccaaaaccaacaagaaaaaaaccaacaagaactactacaacta

SEQ ID NO: 52249 - RNA, 60 nt, synthetic construct
  misc_feature 1..60: note = derived and/or modified sequence opt6 from anti-HIV_CDR
  source 1..60: mol_type = other RNA
acactaatagaagaaagccaaaaccaacaagaaaaaaacgaacaagaactactaggacta

SEQ ID NO: 52250 - RNA, 60 nt, synthetic construct
  misc_feature 1..60: note = derived and/or modified sequence opt6 from anti-HIV_CDR
  source 1..60: mol_type = other RNA
acactaatagaagaaagccaaaaccaacaagaaaaaaacgaacaagaactactagaacta

SEQ ID NO: 52251 - RNA, 60 nt, synthetic construct
  misc_feature 1..60: note = derived and/or modified sequence opt6 from anti-HIV_CDR
  source 1..60: mol_type = other RNA
agcctaatagaagacagccaaatacaacaagaaaaaaacgaaaaagaactactagaacta

SEQ ID NO: 52252 - RNA, 60 nt, synthetic construct
  misc_feature 1..60: note = derived and/or modified sequence opt6 from anti-HIV_CDR
  source 1..60: mol_type = other RNA
agcctactagaaaaatcacaaacacaacaagaaaaaaacgaacaagaactactagaacta

SEQ ID NO: 52253 - RNA, 60 nt, synthetic construct
  misc_feature 1..60: note = derived and/or modified sequence opt6 from anti-HIV_CDR
  source 1..60: mol_type = other RNA
agcctaatagaagaatcacaaaaccaacaagaaaaaaacgaacaagaactactagaacta

SEQ ID NO: 52254 - RNA, 60 nt, synthetic construct
  misc_feature 1..60: note = derived and/or modified sequence opt6 from anti-HIV_CDR
  source 1..60: mol_type = other RNA
ggtgatttattaggctatactgatagttggtatgaatttgattattattacatggacgta

SEQ ID NO: 52255 - RNA, 60 nt, synthetic construct
  misc_feature 1..60: note = derived and/or modified sequence opt6 from anti-HIV_CDR
  source 1..60: mol_type = other RNA
gatacaaatggaacagaaatatttagaccaggaggaggagacatgagagataattggaga

SEQ ID NO: 52256 - RNA, 60 nt, synthetic construct
  misc_feature 1..60: note = derived and/or modified sequence opt6 from anti-HIV_CDR
  source 1..60: mol_type = other RNA
gatgtagtagaaaggccgggatttggagattttagatatgattattatggaatggatgta

SEQ ID NO: 52257 - RNA, 60 nt, synthetic construct
  misc_feature 1..60: note = derived and/or modified sequence opt6 from anti-HIV_CDR
  source 1..60: mol_type = other RNA
gatcaaagggattgtagtacgaataggtgttttggagtgtttgggtattatatggatgta

SEQ ID NO: 52258 - RNA, 60 nt, synthetic construct
  misc_feature 1..60: note = derived and/or modified sequence opt6 from anti-HIV_CDR
  source 1..60: mol_type = other RNA
gatagatgggtaagaccacaattcccatcaatggactttcaatataacggattagatgta

SEQ ID NO: 52259 - RNA, 60 nt, synthetic construct
  misc_feature 1..60: note = derived and/or modified sequence opt6 from anti-HIV_CDR
  source 1..60: mol_type = other RNA
gatagcgggttcgatctagattactatgacacgaacgagctatatttcgggttcgattac

SEQ ID NO: 52260 - RNA, 60 nt, synthetic construct
  misc_feature 1..60: note = derived and/or modified sequence opt6 from anti-HIV_CDR
  source 1..60: mol_type = other RNA
aaatacccagcctactacgacatcctaaccgcaaactaccgatcatactacttcgactac

SEQ ID NO: 52261 - RNA, 60 nt, synthetic construct
  misc_feature 1..60: note = derived and/or modified sequence opt6 from anti-HIV_CDR
  source 1..60: mol_type = other RNA
aaatacccagcctactacgacatcctaaccggatactaccgaaactactacttcgactac

SEQ ID NO: 52262 - RNA, 60 nt, synthetic construct
  misc_feature 1..60: note = derived and/or modified sequence opt6 from anti-HIV_CDR
  source 1..60: mol_type = other RNA
cgtgtaaaatttcctttatggtttggtgaaactacatattattattatggtatggatgta

SEQ ID NO: 52263 - RNA, 60 nt, synthetic construct
  misc_feature 1..60: note = derived and/or modified sequence opt6 from anti-HIV_CDR
  source 1..60: mol_type = other RNA
gaaagatcaacaaaatactcattctggagcgcagtaatgagaccagacgcattcgatcta

SEQ ID NO: 52264 - RNA, 60 nt, synthetic construct
  misc_feature 1..60: note = derived and/or modified sequence opt6 from anti-HIV_CDR
  source 1..60: mol_type = other RNA
cacgaagcacctagatattcatatgcatttagaaattactatcactatggacttgacgtt

SEQ ID NO: 52265 - RNA, 60 nt, synthetic construct
  misc_feature 1..60: note = derived and/or modified sequence opt6 from anti-HIV_CDR
  source 1..60: mol_type = other RNA
gaaaatgtactaatggaatcagacgactacaatgactattactattactacatggacgta

SEQ ID NO: 52266 - RNA, 60 nt, synthetic construct
  misc_feature 1..60: note = derived and/or modified sequence opt6 from anti-HIV_CDR
  source 1..60: mol_type = other RNA
gaacgtgttcttgtttttcctgatcaagatgctgattattattattatttttttgatgtt

SEQ ID NO: 52267 - RNA, 60 nt, synthetic construct
  misc_feature 1..60: note = derived and/or modified sequence opt6 from anti-HIV_CDR
  source 1..60: mol_type = other RNA
gaacgtgttttagttgttcctgatcaagatgctgattattattattatttttttgatgtt

SEQ ID NO: 52268 - RNA, 63 nt, synthetic construct
  misc_feature 1..63: note = derived and/or modified sequence opt6 from anti-HIV_CDR
  source 1..63: mol_type = other RNA
gatagatcttcagctataggttactgttcatctatatcttgctataaaggttcatttgacatt

SEQ ID NO: 52269 - RNA, 63 nt, synthetic construct
  misc_feature 1..63: note = derived and/or modified sequence opt6 from anti-HIV_CDR
  source 1..63: mol_type = other RNA
gtagtaaaaatagaaccactaggagtagcaccaacaaaagcaaaaagagtagcaagagaaaaa

SEQ ID NO: 52270 - RNA, 63 nt, synthetic construct
  misc_feature 1..63: note = derived and/or modified sequence opt6 from anti-HIV_CDR
  source 1..63: mol_type = other RNA
gtagtaagaatagaaccactaggagtagcaccaacaaaagcaaaaagagtagaaagagaaaaa

SEQ ID NO: 52271 - RNA, 63 nt, synthetic construct
  misc_feature 1..63: note = derived and/or modified sequence opt6 from anti-HIV_CDR
  source 1..63: mol_type = other RNA
gtagtaagaatagaaccactaggaatagcaccaacaagagcaaaaagagtagaaagagaaaaa

SEQ ID NO: 52272 - RNA, 63 nt, synthetic construct
  misc_feature 1..63: note = derived and/or modified sequence opt6 from anti-HIV_CDR
  source 1..63: mol_type = other RNA
gtagtaaaaatagaaccaataggagtagcaccaacaaaagcaagaagagtagaaagagaaaaa

SEQ ID NO: 52273 - RNA, 63 nt, synthetic construct
  misc_feature 1..63: note = derived and/or modified sequence opt6 from anti-HIV_CDR
  source 1..63: mol_type = other RNA
gtagtaaaaatagaaccactaggagtagcaccaacaagagcaaaaagagtagaaagagaaaaa

SEQ ID NO: 52274 - RNA, 63 nt, synthetic construct
  misc_feature 1..63: note = derived and/or modified sequence opt6 from anti-HIV_CDR
  source 1..63: mol_type = other RNA
gtagtacaaatagaaccactaggagtagcaccaacaagagcaaaaagagtagaaagagaaaaa

SEQ ID NO: 52275 - RNA, 63 nt, synthetic construct
  misc_feature 1..63: note = derived and/or modified sequence opt6 from anti-HIV_CDR
  source 1..63: mol_type = other RNA
gtagtaagaatagaaccactaggagtagcaccaacaaaagcaaaaagagtacaaagagaaaaa

SEQ ID NO: 52276 - RNA, 63 nt, synthetic construct
  misc_feature 1..63: note = derived and/or modified sequence opt6 from anti-HIV_CDR
  source 1..63: mol_type = other RNA
gtagtaaaaatagaaccactaggagtagcaccaacaaaagcaaaaagagtacaaagaaaaaaa

SEQ ID NO: 52277 - RNA, 63 nt, synthetic construct
  misc_feature 1..63: note = derived and/or modified sequence opt6 from anti-HIV_CDR
  source 1..63: mol_type = other RNA
gtaataaaaatagaaccactaatagtagcaccaacaaaagcaaaaagagtacaaagagaaaaa

SEQ ID NO: 52278 - RNA, 63 nt, synthetic construct
  misc_feature 1..63: note = derived and/or modified sequence opt6 from anti-HIV_CDR
  source 1..63: mol_type = other RNA
gtagtaaaaatagaaccactaggagtagcaccaacaaaagcaagaagagtacaaagagaaaaa

SEQ ID NO: 52279 - RNA, 63 nt, synthetic construct
  misc_feature 1..63: note = derived and/or modified sequence opt6 from anti-HIV_CDR
  source 1..63: mol_type = other RNA
gtagtaaaaatagaactactaggagtagcaccaacaaaagcaaaaagagtacaaagagaaaaa

SEQ ID NO: 52280 - RNA, 63 nt, synthetic construct
  misc_feature 1..63: note = derived and/or modified sequence opt6 from anti-HIV_CDR
  source 1..63: mol_type = other RNA
gtagtaacaatagaaccactaggagtagcaccaacaaaagcaaaaagagtacaaagagaaaaa

SEQ ID NO: 52281 - RNA, 63 nt, synthetic construct
  misc_feature 1..63: note = derived and/or modified sequence opt6 from anti-HIV_CDR
  source 1..63: mol_type = other RNA
gtagtaaaaatagaaccactaggagtagcaccaacaaaagcaaaaagagtacaaagagaaaaa

SEQ ID NO: 52282 - RNA, 63 nt, synthetic construct
  misc_feature 1..63: note = derived and/or modified sequence opt6 from anti-HIV_CDR
  source 1..63: mol_type = other RNA
gatctagtaagcgtaagcccaccatatggaaattacggaccagataacaattggtttgacttt

SEQ ID NO: 52283 - RNA, 63 nt, synthetic construct
  misc_feature 1..63: note = derived and/or modified sequence opt6 from anti-HIV_CDR
  source 1..63: mol_type = other RNA
atgaatccaccttggtttagaggtggatctaacaatccatattcatattactatatggatgta

SEQ ID NO: 52284 - RNA, 63 nt, synthetic construct
  misc_feature 1..63: note = derived and/or modified sequence opt6 from anti-HIV_CDR
  source 1..63: mol_type = other RNA
gattggatagggtatgattatgatggaagtggaagtcatttgagagatgaaagttttgatata

SEQ ID NO: 52285 - RNA, 63 nt, synthetic construct
  misc_feature 1..63: note = derived and/or modified sequence opt6 from anti-HIV_CDR
  source 1..63: mol_type = other RNA
tgtagtatagtaggaaatggagactttttagaagaagatagtcattatccagcaatggatgta

SEQ ID NO: 52286 - RNA, 63 nt, synthetic construct
  misc_feature 1..63: note = derived and/or modified sequence opt6 from anti-HIV_CDR
  source 1..63: mol_type = other RNA
gattttgtaagtatatatggagttgcatattttactggaggtggaccttcaagtccagatata

SEQ ID NO: 52287 - RNA, 66 nt, synthetic construct
  misc_feature 1..66: note = derived and/or modified sequence opt6 from anti-HIV_CDR
  source 1..66: mol_type = other RNA
aaagcaaaagactactactacgaatcctcagactactccccatactactactactacatggacgta

SEQ ID NO: 52288 - RNA, 66 nt, synthetic construct
  misc_feature 1..66: note = derived and/or modified sequence opt6 from anti-HIV_CDR
  source 1..66: mol_type = other RNA
gatcacggtataaagccagataactattacgatatatctggatataacttagactatttcgattac

SEQ ID NO: 52289 - RNA, 66 nt, synthetic construct
  misc_feature 1..66: note = derived and/or modified sequence opt6 from anti-HIV_CDR
  source 1..66: mol_type = other RNA
ggatcactatatgactacagagacaacgcagacttaaaaccatcatattactatgcaatggacgta

SEQ ID NO: 52290 - RNA, 66 nt, synthetic construct
  misc_feature 1..66: note = derived and/or modified sequence opt6 from anti-HIV_CDR
  source 1..66: mol_type = other RNA
gatgaagcaagttgggtagaagcagcagatgaatgggatgaacatttatttagagaaatggcagta

SEQ ID NO: 52291 - RNA, 66 nt, synthetic construct
  misc_feature 1..66: note = derived and/or modified sequence opt6 from anti-HIV_CDR
  source 1..66: mol_type = other RNA
gatgaagtaagttgggtagaagcagcagatgaatgggatgaacatttatttagagaaatggcagta

SEQ ID NO: 52292 - RNA, 66 nt, synthetic construct
  misc_feature 1..66: note = derived and/or modified sequence opt6 from anti-HIV_CDR
  source 1..66: mol_type = other RNA
gatgaaggaagttgggtagaagcagcagatgaatgggatgaacatttatttagagaaatggcagta

SEQ ID NO: 52293 - RNA, 66 nt, synthetic construct
  misc_feature 1..66: note = derived and/or modified sequence opt6 from anti-HIV_CDR
  source 1..66: mol_type = other RNA
gatcaaagaggaagatattcattcggatttgtgacaggacaaacaaaagtaagtgcaatatcagat

SEQ ID NO: 52294 - RNA, 66 nt, synthetic construct
  misc_feature 1..66: note = derived and/or modified sequence opt6 from anti-HIV_CDR
  source 1..66: mol_type = other RNA
gatcaattaggaagatattcattcggatttgtgacaggacaaaataaagtaagcgcaatatcagac

SEQ ID NO: 52295 - RNA, 66 nt, synthetic construct
  misc_feature 1..66: note = derived and/or modified sequence opt6 from anti-HIV_CDR
  source 1..66: mol_type = other RNA
gatcaagtaggaagatattcattcggatttgcaacaggacaacaaagagtaagcgcaatatcagac

SEQ ID NO: 52296 - RNA, 69 nt, synthetic construct
  misc_feature 1..69: note = derived and/or modified sequence opt6 from anti-HIV_CDR
  source 1..69: mol_type = other RNA
gtagtaaaaatagaaccactaggagtagcaccaacaaaagcaaaaagaagagtagtacaaagagaaaaa

SEQ ID NO: 52297 - RNA, 69 nt, synthetic construct
  misc_feature 1..69: note = derived and/or modified sequence opt6 from anti-HIV_CDR
  source 1..69: mol_type = other RNA
agaatttcatcttcatcttggtatatggttgacaattcacatacacttcacttttactatatggatgta

SEQ ID NO: 52298 - RNA, 69 nt, synthetic construct
  misc_feature 1..69: note = derived and/or modified sequence opt6 from anti-HIV_CDR
  source 1..69: mol_type = other RNA
gacaaaccagcatacgacgaatacgcagaagaaacaatagcaccacacaactatcacgcaatggaccta

SEQ ID NO: 52299 - RNA, 69 nt, synthetic construct
  misc_feature 1..69: note = derived and/or modified sequence opt6 from anti-HIV_CDR
  source 1..69: mol_type = other RNA
caaaacatagcagcaagagcagcagaaaaattatacgaaaacgattactatttctatggaatggacgta

SEQ ID NO: 52300 - RNA, 69 nt, synthetic construct
  misc_feature 1..69: note = derived and/or modified sequence opt6 from anti-HIV_CDR
  source 1..69: mol_type = other RNA
caaaacatagcagcaagaacagcagaaagattatacgaaaacgattactatttctatggaatggacgta

SEQ ID NO: 52301 - RNA, 72 nt, synthetic construct
  misc_feature 1..72: note = derived and/or modified sequence opt6 from anti-HIV_CDR
  source 1..72: mol_type = other RNA
gcacaacaaggaaaaagaatatacggaatagtaagctttggagaattcttttactattactatatggatgca

SEQ ID NO: 52302 - RNA, 72 nt, synthetic construct
  misc_feature 1..72: note = derived and/or modified sequence opt6 from anti-HIV_CDR
  source 1..72: mol_type = other RNA
acacaacaaggaaaaagaatatacggagtagtaagcttcggagaattctttcactattactatatggatgca

SEQ ID NO: 52303 - RNA, 72 nt, synthetic construct
  misc_feature 1..72: note = derived and/or modified sequence opt6 from anti-HIV_CDR
  source 1..72: mol_type = other RNA
gcaagaagaggacagagaatatatggagtagtaagttttggagaatttttttattattatagtatggatgta

SEQ ID NO: 52304 - RNA, 72 nt, synthetic construct
  misc_feature 1..72: note = derived and/or modified sequence opt6 from anti-HIV_CDR
  source 1..72: mol_type = other RNA
actctacatggacgtagaatttacggtatagttgcatttaatgaatggtttacatatttctatatggatgta

SEQ ID NO: 52305 - RNA, 72 nt, synthetic construct
  misc_feature 1..72: note = derived and/or modified sequence opt6 from anti-HIV_CDR
  source 1..72: mol_type = other RNA
actaaacatggacgtagaatttacggtatagttgcatttaatgaatggtttacatatttctatatggatgta

SEQ ID NO: 52306 - RNA, 72 nt, synthetic construct
  misc_feature 1..72: note = derived and/or modified sequence opt6 from anti-HIV_CDR
  source 1..72: mol_type = other RNA
gctagacatggacaaagaatttacggtgtagttagctttggagaatttttcacatattacagtatggatgta

SEQ ID NO: 52307 - RNA, 72 nt, synthetic construct
  misc_feature 1..72: note = derived and/or modified sequence opt6 from anti-HIV_CDR
  source 1..72: mol_type = other RNA
acacaacaaggaaaaagaatatacggagtagtaagcttcggagattactattactattactatatggatgta

SEQ ID NO: 52308 - RNA, 72 nt, synthetic construct
  misc_feature 1..72: note = derived and/or modified sequence opt6 from anti-HIV_CDR
  source 1..72: mol_type = other RNA
actaaacatggacgtagaatttacggtgtagttgcatttggagaatggtttacatatttttatatggatgta

SEQ ID NO: 52309 - RNA, 72 nt, synthetic construct
  misc_feature 1..72: note = derived and/or modified sequence opt6 from anti-HIV_CDR
  source 1..72: mol_type = other RNA
gctgtaattacagatctacatacatttggagattacgaactagaagacccttcatattactatatggatgta

SEQ ID NO: 52310 - RNA, 72 nt, synthetic construct
  misc_feature 1..72: note = derived and/or modified sequence opt6 from anti-HIV_CDR
  source 1..72: mol_type = other RNA
gatagaggggatacgagattgttagattatggggattatgaagatgaaaggtattattatgggatggatgta

SEQ ID NO: 52311 - RNA, 72 nt, synthetic construct
  misc_feature 1..72: note = derived and/or modified sequence opt6 from anti-HIV_CDR
  source 1..72: mol_type = other RNA
ggaacaagatatgatttttggagtggatttagtaatagagatgggagagcattagcaggatattttgattat

SEQ ID NO: 52312 - RNA, 72 nt, synthetic construct
  misc_feature 1..72: note = derived and/or modified sequence opt6 from anti-HIV_CDR
  source 1..72: mol_type = other RNA
gatggaaaaggaaaagcatattatgatttctggagcggatacagaaatcaaaaatattacggactagatgta

SEQ ID NO: 52313 - RNA, 72 nt, synthetic construct
  misc_feature 1..72: note = derived and/or modified sequence opt6 from anti-HIV_CDR
  source 1..72: mol_type = other RNA
gctgtaattacagatctacatacatttgcagattacgaactaggtgacccttcatatttctatatggatgta

SEQ ID NO: 52314 - RNA, 72 nt, synthetic construct
  misc_feature 1..72: note = derived and/or modified sequence opt6 from anti-HIV_CDR
  source 1..72: mol_type = other RNA
tctgtaattacagatctacatacatttggagattacgaatcaggtgacccttcatattactatatggatgta

SEQ ID NO: 52315 - RNA, 81 nt, synthetic construct
  misc_feature 1..81: note = derived and/or modified sequence opt6 from anti-HIV_CDR
  source 1..81: mol_type = other RNA
gactttccacgttttcatagacttgtaggtaattatgacttttggcgtggaactttagatagattttcatatatggattta

SEQ ID NO: 52316 - RNA, 105 nt, synthetic construct
  misc_feature 1..105: note = derived and/or modified sequence opt6 from anti-HIV_CDR
  source 1..105: mol_type = other RNA
agaatactagcagtagaaagatatctaaaagaccaacaattactaggaatatggggatgtagcggaaaaataatatgtccaacaatggtaccatggaactcaagc

SEQ ID NO: 52317 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctacaagaccaaagattactaggaatgtggggatgtagcggaaaacatatatgtacaacattcgtaccatggaactcaagc

SEQ ID NO: 52318 - RNA, 105 nt, synthetic construct
  misc_feature 1..105: note = derived and/or modified sequence opt6 from anti-HIV_CDR
  source 1..105: mol_type = other RNA
agagtactagcagtagaaagctatctaaaagaccaacaattactaggaatatggggatgtagcggaaaacatatatgtacaacaacagtaccatggaactcaagc

SEQ ID NO: 52319 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaagagaccaacaattactaggaatatggggatgtagcggaagacatatatgtacaacaaacgtaccatggaactcaagc

SEQ ID NO: 52320 - RNA, 105 nt, synthetic construct
  misc_feature 1..105: note = derived and/or modified sequence opt6 from anti-HIV_CDR
  source 1..105: mol_type = other RNA
agaatactagcagtagaaagatatctaaaagaccaacaattactaggaatatggggatgtagcggaaaattaatatgtacaacaacagtaccatggaactcaagc

SEQ ID NO: 52321 - RNA, 105 nt, synthetic construct
  misc_feature 1..105: note = derived and/or modified sequence opt6 from anti-HIV_CDR
  source 1..105: mol_type = other RNA
agaatactagcagtagaaagatatctaaaagaccaacaattactaggaatatggggatgtagcggaaaacatatatgtacaacaaacgtaccatggaactcaagc

SEQ ID NO: 52322 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaagagaccaacaattactaggaatatggggatgtagcggaaaattaatatgtacaacaacagtaccatggaacgcaagc

SEQ ID NO: 52323 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaagagaccaacaattactaggaatatggggatgtagcggaaaattaatatgtacaacagcagtaccatggaacgcaagc

SEQ ID NO: 52324 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaaaagaccaacaattactaggaatatggggatgtagcggaaaattaatatgtacaacaacagtaccatggaacgcaagc

SEQ ID NO: 52325 - RNA, 105 nt, synthetic construct
  misc_feature 1..105: note = derived and/or modified sequence opt6 from anti-HIV_CDR
  source 1..105: mol_type = other RNA
agaatactagcagtagaaagatatctaaaagaccaacaattactaggattctggggatgtagcggaaaattaatatgtacaacagcagtaccatggaacgcaagc

SEQ ID NO: 52326 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaagagaccaacaattactaggaatatggggatgtagcggaaaattaatatgtacaacaacagtaccatggaacacaagc

SEQ ID NO: 52327 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaaaagaccaacaattactaggaatatggggatgtagcggaaaattaatatgtacaacagcagtaccatggaacgcaagc

SEQ ID NO: 52328 - RNA, 105 nt, synthetic construct
  misc_feature 1..105: note = derived and/or modified sequence opt6 from anti-HIV_CDR
  source 1..105: mol_type = other RNA
agagtactagcagtagaaagatatctaaaagaccaacaattactaggattctggggatgtagcggaaaattaatatgtacaacaacagtaccatggaacgcaagc

SEQ ID NO: 52329 - RNA, 105 nt, synthetic construct
  misc_feature 1..105: note = derived and/or modified sequence opt6 from anti-HIV_CDR
  source 1..105: mol_type = other RNA
agaatactagcagtagaaagatatctaaaagaccaacaattactaggaatatggggatgtagcggaaaattaatatgtacaacagcagtaccatggaacgcaagc

SEQ ID NO: 52330-52355 - skipped (26 entries)

SEQ ID NO: 52356 - RNA, 12 nt, synthetic construct
  misc_feature 1..12: note = derived and/or modified sequence opt6 from anti-influenza_CDR
  source 1..12: mol_type = other RNA
gatgtgccggat

SEQ ID NO: 52357 - RNA, 12 nt, synthetic construct
  misc_feature 1..12: note = derived and/or modified sequence opt6 from anti-influenza_CDR
  source 1..12: mol_type = other RNA
aggttgagtggg

SEQ ID NO: 52358 - RNA, 12 nt, synthetic construct
  misc_feature 1..12: note = derived and/or modified sequence opt6 from anti-influenza_CDR
  source 1..12: mol_type = other RNA
ttttgggatttg

SEQ ID NO: 52359 - RNA, 15 nt, synthetic construct
  misc_feature 1..15: note = derived and/or modified sequence opt6 from anti-influenza_CDR
  source 1..15: mol_type = other RNA
acaggactaagaaac

SEQ ID NO: 52360 - RNA, 15 nt, synthetic construct
  misc_feature 1..15: note = derived and/or modified sequence opt6 from anti-influenza_CDR
  source 1..15: mol_type = other RNA
caacaatcccgaacc

SEQ ID NO: 52361 - RNA, 15 nt, synthetic construct
  misc_feature 1..15: note = derived and/or modified sequence opt6 from anti-influenza_CDR
  source 1..15: mol_type = other RNA
caattatcccgcacc

SEQ ID NO: 52362 - RNA, 15 nt, synthetic construct
  misc_feature 1..15: note = derived and/or modified sequence opt6 from anti-influenza_CDR
  source 1..15: mol_type = other RNA
tccaactacatcacc

SEQ ID NO: 52363 - RNA, 15 nt, synthetic construct
  misc_feature 1..15: note = derived and/or modified sequence opt6 from anti-influenza_CDR
  source 1..15: mol_type = other RNA
gactatagttggaat

SEQ ID NO: 52364 - RNA, 15 nt, synthetic construct
  misc_feature 1..15: note = derived and/or modified sequence opt6 from anti-influenza_CDR
  source 1..15: mol_type = other RNA
aattacgccttctca

SEQ ID NO: 52365 - RNA, 15 nt, synthetic construct
  misc_feature 1..15: note = derived and/or modified sequence opt6 from anti-influenza_CDR
  source 1..15: mol_type = other RNA
aagaacgcgatctcg

SEQ ID NO: 52366 - RNA, 15 nt, synthetic construct
  misc_feature 1..15: note = derived and/or modified sequence opt6 from anti-influenza_CDR
  source 1..15: mol_type = other RNA
tcgcattggatgacg

SEQ ID NO: 52367 - RNA, 15 nt, synthetic construct
  misc_feature 1..15: note = derived and/or modified sequence opt6 from anti-influenza_CDR
  source 1..15: mol_type = other RNA
aattacgacatcaac

SEQ ID NO: 52368 - RNA, 15 nt, synthetic construct
  misc_feature 1..15: note = derived and/or modified sequence opt6 from anti-influenza_CDR
  source 1..15: mol_type = other RNA
gactatggagttaca

SEQ ID NO: 52369 - RNA, 15 nt, synthetic construct
  misc_feature 1..15: note = derived and/or modified sequence opt6 from anti-influenza_CDR
  source 1..15: mol_type = other RNA
aattacggcattaac

SEQ ID NO: 52370 - RNA, 15 nt, synthetic construct
  misc_feature 1..15: note = derived and/or modified sequence opt6 from anti-influenza_CDR
  source 1..15: mol_type = other RNA
ggctatacaattaca

SEQ ID NO: 52371 - RNA, 15 nt, synthetic construct
  misc_feature 1..15: note = derived and/or modified sequence opt6 from anti-influenza_CDR
  source 1..15: mol_type = other RNA
aattacggcatttca

SEQ ID NO: 52372 - RNA, 15 nt, synthetic construct
  misc_feature 1..15: note = derived and/or modified sequence opt6 from anti-influenza_CDR
  source 1..15: mol_type = other RNA
gacgattactggaca

SEQ ID NO: 52373 - RNA, 15 nt, synthetic construct
  misc_feature 1..15: note = derived and/or modified sequence opt6 from anti-influenza_CDR
  source 1..15: mol_type = other RNA
acttacgccatgcac

SEQ ID NO: 52374 - RNA, 15 nt, synthetic construct
  misc_feature 1..15: note = derived and/or modified sequence opt6 from anti-influenza_CDR
  source 1..15: mol_type = other RNA
tcttacgccatgcat

SEQ ID NO: 52375 - RNA, 15 nt, synthetic construct
  misc_feature 1..15: note = derived and/or modified sequence opt6 from anti-influenza_CDR
  source 1..15: mol_type = other RNA
agttattactggaac

SEQ ID NO: 52376 - RNA, 15 nt, synthetic construct
  misc_feature 1..15: note = derived and/or modified sequence opt6 from anti-influenza_CDR
  source 1..15: mol_type = other RNA
acatatccagttgcc

SEQ ID NO: 52377 - RNA, 15 nt, synthetic construct
  misc_feature 1..15: note = derived and/or modified sequence opt6 from anti-influenza_CDR
  source 1..15: mol_type = other RNA
cattatttctggtcc

SEQ ID NO: 52378 - RNA, 15 nt, synthetic construct
  misc_feature 1..15: note = derived and/or modified sequence opt6 from anti-influenza_CDR
  source 1..15: mol_type = other RNA
gactattactggaca

SEQ ID NO: 52379 - RNA, 15 nt, synthetic construct
  misc_feature 1..15: note = derived and/or modified sequence opt6 from anti-influenza_CDR
  source 1..15: mol_type = other RNA
gattattattggtcg

SEQ ID NO: 52380 - RNA, 15 nt, synthetic construct
  misc_feature 1..15: note = derived and/or modified sequence opt6 from anti-influenza_CDR
  source 1..15: mol_type = other RNA
ggctattatatgcat

SEQ ID NO: 52381 - RNA, 15 nt, synthetic construct
  misc_feature 1..15: note = derived and/or modified sequence opt6 from anti-influenza_CDR
  source 1..15: mol_type = other RNA
tctcattactggtcc

SEQ ID NO: 52382 - RNA, 15 nt, synthetic construct
  misc_feature 1..15: note = derived and/or modified sequence opt6 from anti-influenza_CDR
  source 1..15: mol_type = other RNA
aattactggattggg

SEQ ID NO: 52383 - RNA, 15 nt, synthetic construct
  misc_feature 1..15: note = derived and/or modified sequence opt6 from anti-influenza_CDR
  source 1..15: mol_type = other RNA
aactacgcaatcata

SEQ ID NO: 52384 - RNA, 15 nt, synthetic construct
  misc_feature 1..15: note = derived and/or modified sequence opt6 from anti-influenza_CDR
  source 1..15: mol_type = other RNA
gattactatatccat

SEQ ID NO: 52385 - RNA, 15 nt, synthetic construct
  misc_feature 1..15: note = derived and/or modified sequence opt6 from anti-influenza_CDR
  source 1..15: mol_type = other RNA
ggttatgatatgcat

SEQ ID NO: 52386 - RNA, 15 nt, synthetic construct
  misc_feature 1..15: note = derived and/or modified sequence opt6 from anti-influenza_CDR
  source 1..15: mol_type = other RNA
ggctactatattcat

SEQ ID NO: 52387 - RNA, 15 nt, synthetic construct
  misc_feature 1..15: note = derived and/or modified sequence opt6 from anti-influenza_CDR
  source 1..15: mol_type = other RNA
ggttattatgttcat

SEQ ID NO: 52388 - RNA, 15 nt, synthetic construct
  misc_feature 1..15: note = derived and/or modified sequence opt6 from anti-influenza_CDR
  source 1..15: mol_type = other RNA
aattactggatgtcg

SEQ ID NO: 52389 - RNA, 15 nt, synthetic construct
  misc_feature 1..15: note = derived and/or modified sequence opt6 from anti-influenza_CDR
  source 1..15: mol_type = other RNA
ggcgagagtacgtta

SEQ ID NO: 52390 - RNA, 15 nt, synthetic construct
  misc_feature 1..15: note = derived and/or modified sequence opt6 from anti-influenza_CDR
  source 1..15: mol_type = other RNA
aattattactggtcc

SEQ ID NO: 52391 - RNA, 15 nt, synthetic construct
  misc_feature 1..15: note = derived and/or modified sequence opt6 from anti-influenza_CDR
  source 1..15: mol_type = other RNA
agcaattacatgagc

SEQ ID NO: 52392 - RNA, 15 nt, synthetic construct
  misc_feature 1..15: note = derived and/or modified sequence opt6 from anti-influenza_CDR
  source 1..15: mol_type = other RNA
tctgattactggtcc

SEQ ID NO: 52393 - RNA, 15 nt, synthetic construct
  misc_feature 1..15: note = derived and/or modified sequence opt6 from anti-influenza_CDR
  source 1..15: mol_type = other RNA
tcatataactggatc

SEQ ID NO: 52394 - RNA, 15 nt, synthetic construct
  misc_feature 1..15: note = derived and/or modified sequence opt6 from anti-influenza_CDR
  source 1..15: mol_type = other RNA
agcacatacatgaac

SEQ ID NO: 52395 - RNA, 15 nt, synthetic construct
  misc_feature 1..15: note = derived and/or modified sequence opt6 from anti-influenza_CDR
  source 1..15: mol_type = other RNA
aattacgccatgtca

SEQ ID NO: 52396 - RNA, 15 nt, synthetic construct
  misc_feature 1..15: note = derived and/or modified sequence opt6 from anti-influenza_CDR
  source 1..15: mol_type = other RNA
tctgatttctggtcc

SEQ ID NO: 52397 - RNA, 15 nt, synthetic construct
  misc_feature 1..15: note = derived and/or modified sequence opt6 from anti-influenza_CDR
  source 1..15: mol_type = other RNA
tattacgccatgtct

SEQ ID NO: 52398 - RNA, 15 nt, synthetic construct
  misc_feature 1..15: note = derived and/or modified sequence opt6 from anti-influenza_CDR
  source 1..15: mol_type = other RNA
ggctattatgtttat

SEQ ID NO: 52399 - RNA, 15 nt, synthetic construct
  misc_feature 1..15: note = derived and/or modified sequence opt6 from anti-influenza_CDR
  source 1..15: mol_type = other RNA
tcttacgccatttct

SEQ ID NO: 52400 - RNA, 15 nt, synthetic construct
  misc_feature 1..15: note = derived and/or modified sequence opt6 from anti-influenza_CDR
  source 1..15: mol_type = other RNA
agctatagctggagc

SEQ ID NO: 52401 - RNA, 15 nt, synthetic construct
  misc_feature 1..15: note = derived and/or modified sequence opt6 from anti-influenza_CDR
  source 1..15: mol_type = other RNA
aatagtttttggggg

SEQ ID NO: 52402 - RNA, 15 nt, synthetic construct
  misc_feature 1..15: note = derived and/or modified sequence opt6 from anti-influenza_CDR
  source 1..15: mol_type = other RNA
gcttatcattggtca

SEQ ID NO: 52403 - RNA, 15 nt, synthetic construct
  misc_feature 1..15: note = derived and/or modified sequence opt6 from anti-influenza_CDR
  source 1..15: mol_type = other RNA
gacaactatataaat

SEQ ID NO: 52404 - RNA, 15 nt, synthetic construct
  misc_feature 1..15: note = derived and/or modified sequence opt6 from anti-influenza_CDR
  source 1..15: mol_type = other RNA
tcgggctttagtgtt

SEQ ID NO: 52405 - RNA, 15 nt, synthetic construct
  misc_feature 1..15: note = derived and/or modified sequence opt6 from anti-influenza_CDR
  source 1..15: mol_type = other RNA
gcgtacgcgtttaca

SEQ ID NO: 52406 - RNA, 15 nt, synthetic construct
  misc_feature 1..15: note = derived and/or modified sequence opt6 from anti-influenza_CDR
  source 1..15: mol_type = other RNA
gggtcggcaattagt

SEQ ID NO: 52407 - RNA, 15 nt, synthetic construct
  misc_feature 1..15: note = derived and/or modified sequence opt6 from anti-influenza_CDR
  source 1..15: mol_type = other RNA
tcatacgccatcaca

SEQ ID NO: 52408 - RNA, 15 nt, synthetic construct
  misc_feature 1..15: note = derived and/or modified sequence opt6 from anti-influenza_CDR
  source 1..15: mol_type = other RNA
tcctactacatgcac

SEQ ID NO: 52409 - RNA, 15 nt, synthetic construct
  misc_feature 1..15: note = derived and/or modified sequence opt6 from anti-influenza_CDR
  source 1..15: mol_type = other RNA
atttatgccatgtca

SEQ ID NO: 52410 - RNA, 15 nt, synthetic construct
  misc_feature 1..15: note = derived and/or modified sequence opt6 from anti-influenza_CDR
  source 1..15: mol_type = other RNA
agctatagcatgaac

SEQ ID NO: 52411 - RNA, 15 nt, synthetic construct
  misc_feature 1..15: note = derived and/or modified sequence opt6 from anti-influenza_CDR
  source 1..15: mol_type = other RNA
tcttacggcatttct

SEQ ID NO: 52412 - RNA, 15 nt, synthetic construct
  misc_feature 1..15: note = derived and/or modified sequence opt6 from anti-influenza_CDR
  source 1..15: mol_type = other RNA
ttctattccatgtcc

SEQ ID NO: 52413 - RNA, 15 nt, synthetic construct
  misc_feature 1..15: note = derived and/or modified sequence opt6 from anti-influenza_CDR
  source 1..15: mol_type = other RNA
actcacgccatctca

SEQ ID NO: 52414 - RNA, 15 nt, synthetic construct
  misc_feature 1..15: note = derived and/or modified sequence opt6 from anti-influenza_CDR
  source 1..15: mol_type = other RNA
gggtatgcgattagt

SEQ ID NO: 52415 - RNA, 15 nt, synthetic construct
  misc_feature 1..15: note = derived and/or modified sequence opt6 from anti-influenza_CDR
  source 1..15: mol_type = other RNA
agcaatagcataagc

SEQ ID NO: 52416 - RNA, 15 nt, synthetic construct
  misc_feature 1..15: note = derived and/or modified sequence opt6 from anti-influenza_CDR
  source 1..15: mol_type = other RNA
aatttcgccatcaat

SEQ ID NO: 52417 - RNA, 15 nt, synthetic construct
  misc_feature 1..15: note = derived and/or modified sequence opt6 from anti-influenza_CDR
  source 1..15: mol_type = other RNA
tctaatgccgtctct

SEQ ID NO: 52418 - RNA, 15 nt, synthetic construct
  misc_feature 1..15: note = derived and/or modified sequence opt6 from anti-influenza_CDR
  source 1..15: mol_type = other RNA
gataacgcgatctcg

SEQ ID NO: 52419 - RNA, 15 nt, synthetic construct
  misc_feature 1..15: note = derived and/or modified sequence opt6 from anti-influenza_CDR
  source 1..15: mol_type = other RNA
tttagtgaggtcgag

SEQ ID NO: 52420 - RNA, 15 nt, synthetic construct
  misc_feature 1..15: note = derived and/or modified sequence opt6 from anti-influenza_CDR
  source 1..15: mol_type = other RNA
gctcaccatatgcat

SEQ ID NO: 52421 - RNA, 15 nt, synthetic construct
  misc_feature 1..15: note = derived and/or modified sequence opt6 from anti-influenza_CDR
  source 1..15: mol_type = other RNA
agtcaatggataggg

SEQ ID NO: 52422 - RNA, 15 nt, synthetic construct
  misc_feature 1..15: note = derived and/or modified sequence opt6 from anti-influenza_CDR
  source 1..15: mol_type = other RNA
gactacgcaatgaat

SEQ ID NO: 52423 - RNA, 15 nt, synthetic construct
  misc_feature 1..15: note = derived and/or modified sequence opt6 from anti-influenza_CDR
  source 1..15: mol_type = other RNA
aatgcatggatgagt

SEQ ID NO: 52424 - RNA, 15 nt, synthetic construct
  misc_feature 1..15: note = derived and/or modified sequence opt6 from anti-influenza_CDR
  source 1..15: mol_type = other RNA
gactacgcaatcaat

SEQ ID NO: 52425 - RNA, 15 nt, synthetic construct
  misc_feature 1..15: note = derived and/or modified sequence opt6 from anti-influenza_CDR
  source 1..15: mol_type = other RNA
agacatggcataagc

SEQ ID NO: 52426 - RNA, 15 nt, synthetic construct
  misc_feature 1..15: note = derived and/or modified sequence opt6 from anti-influenza_CDR
  source 1..15: mol_type = other RNA
gaactatctatccat

SEQ ID NO: 52427 - RNA, 15 nt, synthetic construct
  misc_feature 1..15: note = derived and/or modified sequence opt6 from anti-influenza_CDR
  source 1..15: mol_type = other RNA
tcctccaactactac

SEQ ID NO: 52428 - RNA, 15 nt, synthetic construct
  misc_feature 1..15: note = derived and/or modified sequence opt6 from anti-influenza_CDR
  source 1..15: mol_type = other RNA
acttatgccatgtca

SEQ ID NO: 52429 - RNA, 15 nt, synthetic construct
  misc_feature 1..15: note = derived and/or modified sequence opt6 from anti-influenza_CDR
  source 1..15: mol_type = other RNA
aattacgccatctca

SEQ ID NO: 52430 - RNA, 18 nt, synthetic construct
  misc_feature 1..18: note = derived and/or modified sequence opt6 from anti-influenza_CDR
  source 1..18: mol_type = other RNA
tttggagcgatagcggga

SEQ ID NO: 52431 - RNA, 18 nt, synthetic construct
  misc_feature 1..18: note = derived and/or modified sequence opt6 from anti-influenza_CDR
  source 1..18: mol_type = other RNA
caagatatctctcgatat

SEQ ID NO: 52432 - RNA, 18 nt, synthetic construct
  misc_feature 1..18: note = derived and/or modified sequence opt6 from anti-influenza_CDR
  source 1..18: mol_type = other RNA
caaaatatagggccatgg

SEQ ID NO: 52433 - RNA, 18 nt, synthetic construct
  misc_feature 1..18: note = derived and/or modified sequence opt6 from anti-influenza_CDR
  source 1..18: mol_type = other RNA
caaagcgtaaatagacgc

SEQ ID NO: 52434 - RNA, 18 nt, synthetic construct
  misc_feature 1..18: note = derived and/or modified sequence opt6 from anti-influenza_CDR
  source 1..18: mol_type = other RNA
caatccatctccacctac

SEQ ID NO: 52435 - RNA, 18 nt, synthetic construct
  misc_feature 1..18: note = derived and/or modified sequence opt6 from anti-influenza_CDR
  source 1..18: mol_type = other RNA
cagggcataataacatac

SEQ ID NO: 52436 - RNA, 18 nt, synthetic construct
  misc_feature 1..18: note = derived and/or modified sequence opt6 from anti-influenza_CDR
  source 1..18: mol_type = other RNA
cagggaataagcagttac

SEQ ID NO: 52437 - RNA, 18 nt, synthetic construct
  misc_feature 1..18: note = derived and/or modified sequence opt6 from anti-influenza_CDR
  source 1..18: mol_type = other RNA
caggacgtaagtacatgg

SEQ ID NO: 52438 - RNA, 18 nt, synthetic construct
  misc_feature 1..18: note = derived and/or modified sequence opt6 from anti-influenza_CDR
  source 1..18: mol_type = other RNA
caggacatatatatatat

SEQ ID NO: 52439 - RNA, 18 nt, synthetic construct
  misc_feature 1..18: note = derived and/or modified sequence opt6 from anti-influenza_CDR
  source 1..18: mol_type = other RNA
gaaaacatatggaacaat

SEQ ID NO: 52440 - RNA, 18 nt, synthetic construct
  misc_feature 1..18: note = derived and/or modified sequence opt6 from anti-influenza_CDR
  source 1..18: mol_type = other RNA
gggtttacggttacgagt

SEQ ID NO: 52441 - RNA, 18 nt, synthetic construct
  misc_feature 1..18: note = derived and/or modified sequence opt6 from anti-influenza_CDR
  source 1..18: mol_type = other RNA
caagatatatctggacat

SEQ ID NO: 52442 - RNA, 18 nt, synthetic construct
  misc_feature 1..18: note = derived and/or modified sequence opt6 from anti-influenza_CDR
  source 1..18: mol_type = other RNA
tcactactgacagaagtc

SEQ ID NO: 52443 - RNA, 18 nt, synthetic construct
  misc_feature 1..18: note = derived and/or modified sequence opt6 from anti-influenza_CDR
  source 1..18: mol_type = other RNA
ggctcgagtataagtaat

SEQ ID NO: 52444 - RNA, 18 nt, synthetic construct
  misc_feature 1..18: note = derived and/or modified sequence opt6 from anti-influenza_CDR
  source 1..18: mol_type = other RNA
gggggaagtataacgagt

SEQ ID NO: 52445 - RNA, 18 nt, synthetic construct
  misc_feature 1..18: note = derived and/or modified sequence opt6 from anti-influenza_CDR
  source 1..18: mol_type = other RNA
ggggggagtataagtagt

SEQ ID NO: 52446 - RNA, 18 nt, synthetic construct
  misc_feature 1..18: note = derived and/or modified sequence opt6 from anti-influenza_CDR
  source 1..18: mol_type = other RNA
ggcttgagtgtgagttcg

SEQ ID NO: 52447 - RNA, 18 nt, synthetic construct
  misc_feature 1..18: note = derived and/or modified sequence opt6 from anti-influenza_CDR
  source 1..18: mol_type = other RNA
ggggcgagtataagtagt

SEQ ID NO: 52448 - RNA, 18 nt, synthetic construct
  misc_feature 1..18: note = derived and/or modified sequence opt6 from anti-influenza_CDR
  source 1..18: mol_type = other RNA
ggggatagtataagtagt

SEQ ID NO: 52449 - RNA, 18 nt, synthetic construct
  misc_feature 1..18: note = derived and/or modified sequence opt6 from anti-influenza_CDR
  source 1..18: mol_type = other RNA
ggcgggagtataagtaat

SEQ ID NO: 52450 - RNA, 18 nt, synthetic construct
  misc_feature 1..18: note = derived and/or modified sequence opt6 from anti-influenza_CDR
  source 1..18: mol_type = other RNA
ggtgggagtataagtgcg

SEQ ID NO: 52451 - RNA, 18 nt, synthetic construct
  misc_feature 1..18: note = derived and/or modified sequence opt6 from anti-influenza_CDR
  source 1..18: mol_type = other RNA
ggatttagcgtgagtgat

SEQ ID NO: 52452 - RNA, 18 nt, synthetic construct
  misc_feature 1..18: note = derived and/or modified sequence opt6 from anti-influenza_CDR
  source 1..18: mol_type = other RNA
tctagatctctagatgtc

SEQ ID NO: 52453 - RNA, 18 nt, synthetic construct
  misc_feature 1..18: note = derived and/or modified sequence opt6 from anti-influenza_CDR
  source 1..18: mol_type = other RNA
cgatcacaacaaaccgta

SEQ ID NO: 52454 - RNA, 18 nt, synthetic construct
  misc_feature 1..18: note = derived and/or modified sequence opt6 from anti-influenza_CDR
  source 1..18: mol_type = other RNA
caaaccataaacaactac

SEQ ID NO: 52455 - RNA, 18 nt, synthetic construct
  misc_feature 1..18: note = derived and/or modified sequence opt6 from anti-influenza_CDR
  source 1..18: mol_type = other RNA
aatatgggcccgacatca

SEQ ID NO: 52456 - RNA, 18 nt, synthetic construct
  misc_feature 1..18: note = derived and/or modified sequence opt6 from anti-influenza_CDR
  source 1..18: mol_type = other RNA
caagtagtcgggacaaat

SEQ ID NO: 52457 - RNA, 18 nt, synthetic construct
  misc_feature 1..18: note = derived and/or modified sequence opt6 from anti-influenza_CDR
  source 1..18: mol_type = other RNA
caaggcataaatacacat

SEQ ID NO: 52458 - RNA, 18 nt, synthetic construct
  misc_feature 1..18: note = derived and/or modified sequence opt6 from anti-influenza_CDR
  source 1..18: mol_type = other RNA
caggacataagaaataga

SEQ ID NO: 52459 - RNA, 18 nt, synthetic construct
  misc_feature 1..18: note = derived and/or modified sequence opt6 from anti-influenza_CDR
  source 1..18: mol_type = other RNA
caggggatagggagtaat

SEQ ID NO: 52460 - RNA, 18 nt, synthetic construct
  misc_feature 1..18: note = derived and/or modified sequence opt6 from anti-influenza_CDR
  source 1..18: mol_type = other RNA
cagacaatatacagatgg

SEQ ID NO: 52461 - RNA, 18 nt, synthetic construct
  misc_feature 1..18: note = derived and/or modified sequence opt6 from anti-influenza_CDR
  source 1..18: mol_type = other RNA
caaacaatcacccgattc

SEQ ID NO: 52462 - RNA, 18 nt, synthetic construct
  misc_feature 1..18: note = derived and/or modified sequence opt6 from anti-influenza_CDR
  source 1..18: mol_type = other RNA
agattgggcgagaaattt

SEQ ID NO: 52463 - RNA, 18 nt, synthetic construct
  misc_feature 1..18: note = derived and/or modified sequence opt6 from anti-influenza_CDR
  source 1..18: mol_type = other RNA
aagttgggggataagttt

SEQ ID NO: 52464 - RNA, 18 nt, synthetic construct
  misc_feature 1..18: note = derived and/or modified sequence opt6 from anti-influenza_CDR
  source 1..18: mol_type = other RNA
caagggctaggaagtaat

SEQ ID NO: 52465 - RNA, 18 nt, synthetic construct
  misc_feature 1..18: note = derived and/or modified sequence opt6 from anti-influenza_CDR
  source 1..18: mol_type = other RNA
tatatcgggagtaagagc

SEQ ID NO: 52466 - RNA, 18 nt, synthetic construct
  misc_feature 1..18: note = derived and/or modified sequence opt6 from anti-influenza_CDR
  source 1..18: mol_type = other RNA
caactcatctcctcctac

SEQ ID NO: 52467 - RNA, 18 nt, synthetic construct
  misc_feature 1..18: note = derived and/or modified sequence opt6 from anti-influenza_CDR
  source 1..18: mol_type = other RNA
caatccgtctcatcaaac

SEQ ID NO: 52468 - RNA, 18 nt, synthetic construct
  misc_feature 1..18: note = derived and/or modified sequence opt6 from anti-influenza_CDR
  source 1..18: mol_type = other RNA
caagtcatctcttcatat

SEQ ID NO: 52469 - RNA, 18 nt, synthetic construct
  misc_feature 1..18: note = derived and/or modified sequence opt6 from anti-influenza_CDR
  source 1..18: mol_type = other RNA
caaagcgtaaacagaaac

SEQ ID NO: 52470 - RNA, 18 nt, synthetic construct
  misc_feature 1..18: note = derived and/or modified sequence opt6 from anti-influenza_CDR
  source 1..18: mol_type = other RNA
gatatcgggagtaagagt

SEQ ID NO: 52471 - RNA, 18 nt, synthetic construct
  misc_feature 1..18: note = derived and/or modified sequence opt6 from anti-influenza_CDR
  source 1..18: mol_type = other RNA
caatccgtctcaacaaac

SEQ ID NO: 52472 - RNA, 18 nt, synthetic construct
  misc_feature 1..18: note = derived and/or modified sequence opt6 from anti-influenza_CDR
  source 1..18: mol_type = other RNA
atgatagcgggatggcac

SEQ ID NO: 52473 - RNA, 18 nt, synthetic construct
  misc_feature 1..18: note = derived and/or modified sequence opt6 from anti-influenza_CDR
  source 1..18: mol_type = other RNA
caagatatatcgacatgg

SEQ ID NO: 52474 - RNA, 18 nt, synthetic construct
  misc_feature 1..18: note = derived and/or modified sequence opt6 from anti-influenza_CDR
  source 1..18: mol_type = other RNA
gaaaaaatatacagcaac

SEQ ID NO: 52475 - RNA, 21 nt, synthetic construct
  misc_feature 1..21: note = derived and/or modified sequence opt6 from anti-influenza_CDR
  source 1..21: mol_type = other RNA
atctactacaactacaacatc

SEQ ID NO: 52476 - RNA, 21 nt, synthetic construct
  misc_feature 1..21: note = derived and/or modified sequence opt6 from anti-influenza_CDR
  source 1..21: mol_type = other RNA
caatcaatttcatccggctac

SEQ ID NO: 52477 - RNA, 21 nt, synthetic construct
  misc_feature 1..21: note = derived and/or modified sequence opt6 from anti-influenza_CDR
  source 1..21: mol_type = other RNA
caatccgtctcctcatcctat

SEQ ID NO: 52478 - RNA, 21 nt, synthetic construct
  misc_feature 1..21: note = derived and/or modified sequence opt6 from anti-influenza_CDR
  source 1..21: mol_type = other RNA
caaaccgtctcctcatcctat

SEQ ID NO: 52479 - RNA, 21 nt, synthetic construct
  misc_feature 1..21: note = derived and/or modified sequence opt6 from anti-influenza_CDR
  source 1..21: mol_type = other RNA
agtaataatgcggtctggaac

SEQ ID NO: 52480 - RNA, 21 nt, synthetic construct
  misc_feature 1..21: note = derived and/or modified sequence opt6 from anti-influenza_CDR
  source 1..21: mol_type = other RNA
agtaatagtgcggtctggaac

SEQ ID NO: 52481 - RNA, 21 nt, synthetic construct
  misc_feature 1..21: note = derived and/or modified sequence opt6 from anti-influenza_CDR
  source 1..21: mol_type = other RNA
gccgccacaacactacaatca

SEQ ID NO: 52482 - RNA, 21 nt, synthetic construct
  misc_feature 1..21: note = derived and/or modified sequence opt6 from anti-influenza_CDR
  source 1..21: mol_type = other RNA
agcaatagagcgacctggaac

SEQ ID NO: 52483 - RNA, 21 nt, synthetic construct
  misc_feature 1..21: note = derived and/or modified sequence opt6 from anti-influenza_CDR
  source 1..21: mol_type = other RNA
gccacctcaacacttcaatca

SEQ ID NO: 52484 - RNA, 21 nt, synthetic construct
  misc_feature 1..21: note = derived and/or modified sequence opt6 from anti-influenza_CDR
  source 1..21: mol_type = other RNA
tcaaattcagcaacctggaac

SEQ ID NO: 52485 - RNA, 21 nt, synthetic construct
  misc_feature 1..21: note = derived and/or modified sequence opt6 from anti-influenza_CDR
  source 1..21: mol_type = other RNA
gcctcctcaacccttcaatca

SEQ ID NO: 52486 - RNA, 21 nt, synthetic construct
  misc_feature 1..21: note = derived and/or modified sequence opt6 from anti-influenza_CDR
  source 1..21: mol_type = other RNA
agttataatgcggtctggaac

SEQ ID NO: 52487 - RNA, 21 nt, synthetic construct
  misc_feature 1..21: note = derived and/or modified sequence opt6 from anti-influenza_CDR
  source 1..21: mol_type = other RNA
gccgcttcttctcgtttatct

SEQ ID NO: 52488 - RNA, 21 nt, synthetic construct
  misc_feature 1..21: note = derived and/or modified sequence opt6 from anti-influenza_CDR
  source 1..21: mol_type = other RNA
gcagcaagcagtagaggaagt

SEQ ID NO: 52489 - RNA, 21 nt, synthetic construct
  misc_feature 1..21: note = derived and/or modified sequence opt6 from anti-influenza_CDR
  source 1..21: mol_type = other RNA
atataccatagcggaagtgca

SEQ ID NO: 52490 - RNA, 21 nt, synthetic construct
  misc_feature 1..21: note = derived and/or modified sequence opt6 from anti-influenza_CDR
  source 1..21: mol_type = other RNA
atatattactctggcgttaca

SEQ ID NO: 52491 - RNA, 21 nt, synthetic construct
  misc_feature 1..21: note = derived and/or modified sequence opt6 from anti-influenza_CDR
  source 1..21: mol_type = other RNA
tctagttatttagcttggtat

SEQ ID NO: 52492 - RNA, 21 nt, synthetic construct
  misc_feature 1..21: note = derived and/or modified sequence opt6 from anti-influenza_CDR
  source 1..21: mol_type = other RNA
caatccctctcctcctcctcc

SEQ ID NO: 52493 - RNA, 21 nt, synthetic construct
  misc_feature 1..21: note = derived and/or modified sequence opt6 from anti-influenza_CDR
  source 1..21: mol_type = other RNA
cagagcgtaagcataagctat

SEQ ID NO: 52494 - RNA, 21 nt, synthetic construct
  misc_feature 1..21: note = derived and/or modified sequence opt6 from anti-influenza_CDR
  source 1..21: mol_type = other RNA
gacgtaacagaaagaccaagc

SEQ ID NO: 52495 - RNA, 21 nt, synthetic construct
  misc_feature 1..21: note = derived and/or modified sequence opt6 from anti-influenza_CDR
  source 1..21: mol_type = other RNA
gctgcctctacattactagat

SEQ ID NO: 52496 - RNA, 21 nt, synthetic construct
  misc_feature 1..21: note = derived and/or modified sequence opt6 from anti-influenza_CDR
  source 1..21: mol_type = other RNA
gccgcctcaactcttcattca

SEQ ID NO: 52497 - RNA, 21 nt, synthetic construct
  misc_feature 1..21: note = derived and/or modified sequence opt6 from anti-influenza_CDR
  source 1..21: mol_type = other RNA
ggggcaagtagtttacaggga

SEQ ID NO: 52498 - RNA, 21 nt, synthetic construct
  misc_feature 1..21: note = derived and/or modified sequence opt6 from anti-influenza_CDR
  source 1..21: mol_type = other RNA
acgaatggggtaaatgtaggg

SEQ ID NO: 52499 - RNA, 21 nt, synthetic construct
  misc_feature 1..21: note = derived and/or modified sequence opt6 from anti-influenza_CDR
  source 1..21: mol_type = other RNA
gacgcaagcacaagagcaaca

SEQ ID NO: 52500 - RNA, 21 nt, synthetic construct
  misc_feature 1..21: note = derived and/or modified sequence opt6 from anti-influenza_CDR
  source 1..21: mol_type = other RNA
tctgaaacttattactggtcc

SEQ ID NO: 52501 - RNA, 21 nt, synthetic construct
  misc_feature 1..21: note = derived and/or modified sequence opt6 from anti-influenza_CDR
  source 1..21: mol_type = other RNA
gaagcggtaaatctagagagt

SEQ ID NO: 52502 - RNA, 21 nt, synthetic construct
  misc_feature 1..21: note = derived and/or modified sequence opt6 from anti-influenza_CDR
  source 1..21: mol_type = other RNA
ggcgcaagcacaagagcaaca

SEQ ID NO: 52503 - RNA, 21 nt, synthetic construct
  misc_feature 1..21: note = derived and/or modified sequence opt6 from anti-influenza_CDR
  source 1..21: mol_type = other RNA
gtgagtgggtattattggtcg

SEQ ID NO: 52504 - RNA, 21 nt, synthetic construct
  misc_feature 1..21: note = derived and/or modified sequence opt6 from anti-influenza_CDR
  source 1..21: mol_type = other RNA
ataacgggagtgagagtggga

SEQ ID NO: 52505 - RNA, 21 nt, synthetic construct
  misc_feature 1..21: note = derived and/or modified sequence opt6 from anti-influenza_CDR
  source 1..21: mol_type = other RNA
gacgcaagcaatagagcgaca

SEQ ID NO: 52506 - RNA, 21 nt, synthetic construct
  misc_feature 1..21: note = derived and/or modified sequence opt6 from anti-influenza_CDR
  source 1..21: mol_type = other RNA
gaagtaactaactggccatcg

SEQ ID NO: 52507 - RNA, 21 nt, synthetic construct
  misc_feature 1..21: note = derived and/or modified sequence opt6 from anti-influenza_CDR
  source 1..21: mol_type = other RNA
aaagatagcgaacgaccgagc

SEQ ID NO: 52508 - RNA, 21 nt, synthetic construct
  misc_feature 1..21: note = derived and/or modified sequence opt6 from anti-influenza_CDR
  source 1..21: mol_type = other RNA
agcgggaattattactggaac

SEQ ID NO: 52509 - RNA, 21 nt, synthetic construct
  misc_feature 1..21: note = derived and/or modified sequence opt6 from anti-influenza_CDR
  source 1..21: mol_type = other RNA
tccacaaccatacgccactcc

SEQ ID NO: 52510 - RNA, 21 nt, synthetic construct
  misc_feature 1..21: note = derived and/or modified sequence opt6 from anti-influenza_CDR
  source 1..21: mol_type = other RNA
gacgatagcggaagaccgagt

SEQ ID NO: 52511 - RNA, 21 nt, synthetic construct
  misc_feature 1..21: note = derived and/or modified sequence opt6 from anti-influenza_CDR
  source 1..21: mol_type = other RNA
agaaatgacttaagaccgagc

SEQ ID NO: 52512 - RNA, 21 nt, synthetic construct
  misc_feature 1..21: note = derived and/or modified sequence opt6 from anti-influenza_CDR
  source 1..21: mol_type = other RNA
tctgttgatcattattggtct

SEQ ID NO: 52513 - RNA, 21 nt, synthetic construct
  misc_feature 1..21: note = derived and/or modified sequence opt6 from anti-influenza_CDR
  source 1..21: mol_type = other RNA
gccgtctctatacttcaatct

SEQ ID NO: 52514 - RNA, 21 nt, synthetic construct
  misc_feature 1..21: note = derived and/or modified sequence opt6 from anti-influenza_CDR
  source 1..21: mol_type = other RNA
gacgatacagatagaccaagc

SEQ ID NO: 52515 - RNA, 21 nt, synthetic construct
  misc_feature 1..21: note = derived and/or modified sequence opt6 from anti-influenza_CDR
  source 1..21: mol_type = other RNA
gaaaacaacaaaagaccatca

SEQ ID NO: 52516 - RNA, 21 nt, synthetic construct
  misc_feature 1..21: note = derived and/or modified sequence opt6 from anti-influenza_CDR
  source 1..21: mol_type = other RNA
gactcaagcaatagagcgcca

SEQ ID NO: 52517 - RNA, 21 nt, synthetic construct
  misc_feature 1..21: note = derived and/or modified sequence opt6 from anti-influenza_CDR
  source 1..21: mol_type = other RNA
gaagtaacaaaaaggccatcg

SEQ ID NO: 52518 - RNA, 21 nt, synthetic construct
  misc_feature 1..21: note = derived and/or modified sequence opt6 from anti-influenza_CDR
  source 1..21: mol_type = other RNA
gccacctcaaacacacactca

SEQ ID NO: 52519 - RNA, 21 nt, synthetic construct
  misc_feature 1..21: note = derived and/or modified sequence opt6 from anti-influenza_CDR
  source 1..21: mol_type = other RNA
gccgcaagcaatctagaaaat

SEQ ID NO: 52520 - RNA, 21 nt, synthetic construct
  misc_feature 1..21: note = derived and/or modified sequence opt6 from anti-influenza_CDR
  source 1..21: mol_type = other RNA
gcagcatcaggactacaatca

SEQ ID NO: 52521 - RNA, 21 nt, synthetic construct
  misc_feature 1..21: note = derived and/or modified sequence opt6 from anti-influenza_CDR
  source 1..21: mol_type = other RNA
ggctttacagtttcgtctaat

SEQ ID NO: 52522 - RNA, 21 nt, synthetic construct
  misc_feature 1..21: note = derived and/or modified sequence opt6 from anti-influenza_CDR
  source 1..21: mol_type = other RNA
gggggggggtatagttggaat

SEQ ID NO: 52523 - RNA, 21 nt, synthetic construct
  misc_feature 1..21: note = derived and/or modified sequence opt6 from anti-influenza_CDR
  source 1..21: mol_type = other RNA
ggcgcaagcaatctacagagt

SEQ ID NO: 52524 - RNA, 21 nt, synthetic construct
  misc_feature 1..21: note = derived and/or modified sequence opt6 from anti-influenza_CDR
  source 1..21: mol_type = other RNA
ggcgcaacaaatctacaaagt

SEQ ID NO: 52525 - RNA, 21 nt, synthetic construct
  misc_feature 1..21: note = derived and/or modified sequence opt6 from anti-influenza_CDR
  source 1..21: mol_type = other RNA
ggcgctagcaatctacatagt

SEQ ID NO: 52526 - RNA, 21 nt, synthetic construct
  misc_feature 1..21: note = derived and/or modified sequence opt6 from anti-influenza_CDR
  source 1..21: mol_type = other RNA
ggcgcaagcacactacagagt

SEQ ID NO: 52527 - RNA, 21 nt, synthetic construct
  misc_feature 1..21: note = derived and/or modified sequence opt6 from anti-influenza_CDR
  source 1..21: mol_type = other RNA
gacaatagcgatagaccgagc

SEQ ID NO: 52528 - RNA, 21 nt, synthetic construct
  misc_feature 1..21: note = derived and/or modified sequence opt6 from anti-influenza_CDR
  source 1..21: mol_type = other RNA
ggcgcaagctcactacagagt

SEQ ID NO: 52529 - RNA, 21 nt, synthetic construct
  misc_feature 1..21: note = derived and/or modified sequence opt6 from anti-influenza_CDR
  source 1..21: mol_type = other RNA
ggcaatagcaatagaccgagc

SEQ ID NO: 52530 - RNA, 21 nt, synthetic construct
  misc_feature 1..21: note = derived and/or modified sequence opt6 from anti-influenza_CDR
  source 1..21: mol_type = other RNA
gccgcctcttcacttcaatct

SEQ ID NO: 52531 - RNA, 21 nt, synthetic construct
  misc_feature 1..21: note = derived and/or modified sequence opt6 from anti-influenza_CDR
  source 1..21: mol_type = other RNA
gccgcctcttctcttcattct

SEQ ID NO: 52532 - RNA, 21 nt, synthetic construct
  misc_feature 1..21: note = derived and/or modified sequence opt6 from anti-influenza_CDR
  source 1..21: mol_type = other RNA
ggcgcaagcacactacagaat

SEQ ID NO: 52533 - RNA, 21 nt, synthetic construct
  misc_feature 1..21: note = derived and/or modified sequence opt6 from anti-influenza_CDR
  source 1..21: mol_type = other RNA
ggcgcaacagatctacaaagt

SEQ ID NO: 52534 - RNA, 21 nt, synthetic construct
  misc_feature 1..21: note = derived and/or modified sequence opt6 from anti-influenza_CDR
  source 1..21: mol_type = other RNA
tcaggtgcgtattattggacg

SEQ ID NO: 52535 - RNA, 21 nt, synthetic construct
  misc_feature 1..21: note = derived and/or modified sequence opt6 from anti-influenza_CDR
  source 1..21: mol_type = other RNA
gtctccgataactatatcaat

SEQ ID NO: 52536 - RNA, 21 nt, synthetic construct
  misc_feature 1..21: note = derived and/or modified sequence opt6 from anti-influenza_CDR
  source 1..21: mol_type = other RNA
tgggcgagcacaagagaaagc

SEQ ID NO: 52537 - RNA, 21 nt, synthetic construct
  misc_feature 1..21: note = derived and/or modified sequence opt6 from anti-influenza_CDR
  source 1..21: mol_type = other RNA
tccaataaccaacgcccatcc

SEQ ID NO: 52538 - RNA, 21 nt, synthetic construct
  misc_feature 1..21: note = derived and/or modified sequence opt6 from anti-influenza_CDR
  source 1..21: mol_type = other RNA
gaagtaagcaatagaccgagc

SEQ ID NO: 52539 - RNA, 21 nt, synthetic construct
  misc_feature 1..21: note = derived and/or modified sequence opt6 from anti-influenza_CDR
  source 1..21: mol_type = other RNA
aaaaacacccaacgcccatcc

SEQ ID NO: 52540 - RNA, 21 nt, synthetic construct
  misc_feature 1..21: note = derived and/or modified sequence opt6 from anti-influenza_CDR
  source 1..21: mol_type = other RNA
gacaacaacaaaagaccatca

SEQ ID NO: 52541 - RNA, 21 nt, synthetic construct
  misc_feature 1..21: note = derived and/or modified sequence opt6 from anti-influenza_CDR
  source 1..21: mol_type = other RNA
gatgcctctacacttagatct

SEQ ID NO: 52542 - RNA, 21 nt, synthetic construct
  misc_feature 1..21: note = derived and/or modified sequence opt6 from anti-influenza_CDR
  source 1..21: mol_type = other RNA
caagataacagaagaccgagc

SEQ ID NO: 52543 - RNA, 21 nt, synthetic construct
  misc_feature 1..21: note = derived and/or modified sequence opt6 from anti-influenza_CDR
  source 1..21: mol_type = other RNA
gacgtaagcaaaagaccaagt

SEQ ID NO: 52544 - RNA, 21 nt, synthetic construct
  misc_feature 1..21: note = derived and/or modified sequence opt6 from anti-influenza_CDR
  source 1..21: mol_type = other RNA
gacgcaagctcaagagcgaca

SEQ ID NO: 52545 - RNA, 21 nt, synthetic construct
  misc_feature 1..21: note = derived and/or modified sequence opt6 from anti-influenza_CDR
  source 1..21: mol_type = other RNA
ctcgggagcaatagagcgagc

SEQ ID NO: 52546 - RNA, 21 nt, synthetic construct
  misc_feature 1..21: note = derived and/or modified sequence opt6 from anti-influenza_CDR
  source 1..21: mol_type = other RNA
ggagcaagcacaagagcggca

SEQ ID NO: 52547 - RNA, 21 nt, synthetic construct
  misc_feature 1..21: note = derived and/or modified sequence opt6 from anti-influenza_CDR
  source 1..21: mol_type = other RNA
gacgatagcgatagaccgagc

SEQ ID NO: 52548 - RNA, 21 nt, synthetic construct
  misc_feature 1..21: note = derived and/or modified sequence opt6 from anti-influenza_CDR
  source 1..21: mol_type = other RNA
agagatggacaaagaccaagc

SEQ ID NO: 52549 - RNA, 21 nt, synthetic construct
  misc_feature 1..21: note = derived and/or modified sequence opt6 from anti-influenza_CDR
  source 1..21: mol_type = other RNA
ggagcaagctcaagagcgaca

SEQ ID NO: 52550 - RNA, 21 nt, synthetic construct
  misc_feature 1..21: note = derived and/or modified sequence opt6 from anti-influenza_CDR
  source 1..21: mol_type = other RNA
ggcgcgagctcgagagcgagt

SEQ ID NO: 52551 - RNA, 21 nt, synthetic construct
  misc_feature 1..21: note = derived and/or modified sequence opt6 from anti-influenza_CDR
  source 1..21: mol_type = other RNA
gccgcctcaacacttcaatca

SEQ ID NO: 52552 - RNA, 21 nt, synthetic construct
  misc_feature 1..21: note = derived and/or modified sequence opt6 from anti-influenza_CDR
  source 1..21: mol_type = other RNA
ctcgtgagcaagcgcgcgagc

SEQ ID NO: 52553 - RNA, 21 nt, synthetic construct
  misc_feature 1..21: note = derived and/or modified sequence opt6 from anti-influenza_CDR
  source 1..21: mol_type = other RNA
gacgtaacatacagaccatca

SEQ ID NO: 52554 - RNA, 21 nt, synthetic construct
  misc_feature 1..21: note = derived and/or modified sequence opt6 from anti-influenza_CDR
  source 1..21: mol_type = other RNA
atgcaagcactcgaaaccccg

SEQ ID NO: 52555 - RNA, 21 nt, synthetic construct
  misc_feature 1..21: note = derived and/or modified sequence opt6 from anti-influenza_CDR
  source 1..21: mol_type = other RNA
caaaattacggcagtccattc

SEQ ID NO: 52556 - RNA, 21 nt, synthetic construct
  misc_feature 1..21: note = derived and/or modified sequence opt6 from anti-influenza_CDR
  source 1..21: mol_type = other RNA
caacaatacggctcactacca

SEQ ID NO: 52557 - RNA, 21 nt, synthetic construct
  misc_feature 1..21: note = derived and/or modified sequence opt6 from anti-influenza_CDR
  source 1..21: mol_type = other RNA
tgggggagttatttggagagt

SEQ ID NO: 52558 - RNA, 21 nt, synthetic construct
  misc_feature 1..21: note = derived and/or modified sequence opt6 from anti-influenza_CDR
  source 1..21: mol_type = other RNA
agcgcaagcacacgcgcaaca

SEQ ID NO: 52559 - RNA, 21 nt, synthetic construct
  misc_feature 1..21: note = derived and/or modified sequence opt6 from anti-influenza_CDR
  source 1..21: mol_type = other RNA
ggcgcgagcacgagagcaagt

SEQ ID NO: 52560 - RNA, 21 nt, synthetic construct
  misc_feature 1..21: note = derived and/or modified sequence opt6 from anti-influenza_CDR
  source 1..21: mol_type = other RNA
ggcgcaagcacaagagataca

SEQ ID NO: 52561 - RNA, 21 nt, synthetic construct
  misc_feature 1..21: note = derived and/or modified sequence opt6 from anti-influenza_CDR
  source 1..21: mol_type = other RNA
aaagtgagcacgctcgagagc

SEQ ID NO: 52562 - RNA, 21 nt, synthetic construct
  misc_feature 1..21: note = derived and/or modified sequence opt6 from anti-influenza_CDR
  source 1..21: mol_type = other RNA
agcaataccgaacgcccaagc

SEQ ID NO: 52563 - RNA, 21 nt, synthetic construct
  misc_feature 1..21: note = derived and/or modified sequence opt6 from anti-influenza_CDR
  source 1..21: mol_type = other RNA
aaaataagcaatcgcgacagc

SEQ ID NO: 52564 - RNA, 21 nt, synthetic construct
  misc_feature 1..21: note = derived and/or modified sequence opt6 from anti-influenza_CDR
  source 1..21: mol_type = other RNA
tccgctagccatcgctattcc

SEQ ID NO: 52565 - RNA, 21 nt, synthetic construct
  misc_feature 1..21: note = derived and/or modified sequence opt6 from anti-influenza_CDR
  source 1..21: mol_type = other RNA
cagagcgtacgctcaaacaat

SEQ ID NO: 52566 - RNA, 21 nt, synthetic construct
  misc_feature 1..21: note = derived and/or modified sequence opt6 from anti-influenza_CDR
  source 1..21: mol_type = other RNA
cagagtgttagatcaggctat

SEQ ID NO: 52567 - RNA, 21 nt, synthetic construct
  misc_feature 1..21: note = derived and/or modified sequence opt6 from anti-influenza_CDR
  source 1..21: mol_type = other RNA
atatattatcgcgggagtacg

SEQ ID NO: 52568 - RNA, 21 nt, synthetic construct
  misc_feature 1..21: note = derived and/or modified sequence opt6 from anti-influenza_CDR
  source 1..21: mol_type = other RNA
gtatattattccggaattaca

SEQ ID NO: 52569 - RNA, 21 nt, synthetic construct
  misc_feature 1..21: note = derived and/or modified sequence opt6 from anti-influenza_CDR
  source 1..21: mol_type = other RNA
tcccacttcgccaacttaaaa

SEQ ID NO: 52570 - RNA, 21 nt, synthetic construct
  misc_feature 1..21: note = derived and/or modified sequence opt6 from anti-influenza_CDR
  source 1..21: mol_type = other RNA
ctcaacaaatccaaaccctac

SEQ ID NO: 52571 - RNA, 21 nt, synthetic construct
  misc_feature 1..21: note = derived and/or modified sequence opt6 from anti-influenza_CDR
  source 1..21: mol_type = other RNA
aaattagcgaatacgggcacg

SEQ ID NO: 52572 - RNA, 21 nt, synthetic construct
  misc_feature 1..21: note = derived and/or modified sequence opt6 from anti-influenza_CDR
  source 1..21: mol_type = other RNA
gctgcctctacacttacatct

SEQ ID NO: 52573 - RNA, 21 nt, synthetic construct
  misc_feature 1..21: note = derived and/or modified sequence opt6 from anti-influenza_CDR
  source 1..21: mol_type = other RNA
gacgcgagtaagttagcgagt

SEQ ID NO: 52574 - RNA, 21 nt, synthetic construct
  misc_feature 1..21: note = derived and/or modified sequence opt6 from anti-influenza_CDR
  source 1..21: mol_type = other RNA
tttgcatctagacttgcatct

SEQ ID NO: 52575 - RNA, 21 nt, synthetic construct
  misc_feature 1..21: note = derived and/or modified sequence opt6 from anti-influenza_CDR
  source 1..21: mol_type = other RNA
tctgcatccacacttgcatct

SEQ ID NO: 52576 - RNA, 21 nt, synthetic construct
  misc_feature 1..21: note = derived and/or modified sequence opt6 from anti-influenza_CDR
  source 1..21: mol_type = other RNA
gaagtaagccaaagaccaagc

SEQ ID NO: 52577 - RNA, 21 nt, synthetic construct
  misc_feature 1..21: note = derived and/or modified sequence opt6 from anti-influenza_CDR
  source 1..21: mol_type = other RNA
ggcgggacattaaataattat

SEQ ID NO: 52578 - RNA, 21 nt, synthetic construct
  misc_feature 1..21: note = derived and/or modified sequence opt6 from anti-influenza_CDR
  source 1..21: mol_type = other RNA
gatatagtcatgactcaatct

SEQ ID NO: 52579 - RNA, 24 nt, synthetic construct
  misc_feature 1..24: note = derived and/or modified sequence opt6 from anti-influenza_CDR
  source 1..24: mol_type = other RNA
ggttttactttttctaattatgct

SEQ ID NO: 52580 - RNA, 24 nt, synthetic construct
  misc_feature 1..24: note = derived and/or modified sequence opt6 from anti-influenza_CDR
  source 1..24: mol_type = other RNA
ggttttactttttctaattatggt

SEQ ID NO: 52581 - RNA, 24 nt, synthetic construct
  misc_feature 1..24: note = derived and/or modified sequence opt6 from anti-influenza_CDR
  source 1..24: mol_type = other RNA
ggttttactttttcttcttatgct

SEQ ID NO: 52582 - RNA, 24 nt, synthetic construct
  misc_feature 1..24: note = derived and/or modified sequence opt6 from anti-influenza_CDR
  source 1..24: mol_type = other RNA
ggttttactttttctacttatgct

SEQ ID NO: 52583 - RNA, 24 nt, synthetic construct
  misc_feature 1..24: note = derived and/or modified sequence opt6 from anti-influenza_CDR
  source 1..24: mol_type = other RNA
ggaggtatatttataagtcaggct

SEQ ID NO: 52584 - RNA, 24 nt, synthetic construct
  misc_feature 1..24: note = derived and/or modified sequence opt6 from anti-influenza_CDR
  source 1..24: mol_type = other RNA
ggtggaatttttagtccgtatgca

SEQ ID NO: 52585 - RNA, 24 nt, synthetic construct
  misc_feature 1..24: note = derived and/or modified sequence opt6 from anti-influenza_CDR
  source 1..24: mol_type = other RNA
ggtgggccatttagtggatttgca

SEQ ID NO: 52586 - RNA, 24 nt, synthetic construct
  misc_feature 1..24: note = derived and/or modified sequence opt6 from anti-influenza_CDR
  source 1..24: mol_type = other RNA
ggtggaacttttaattcacatgca

SEQ ID NO: 52587 - RNA, 24 nt, synthetic construct
  misc_feature 1..24: note = derived and/or modified sequence opt6 from anti-influenza_CDR
  source 1..24: mol_type = other RNA
ggatcgaatataggatcgaatacg

SEQ ID NO: 52588 - RNA, 24 nt, synthetic construct
  misc_feature 1..24: note = derived and/or modified sequence opt6 from anti-influenza_CDR
  source 1..24: mol_type = other RNA
ggtgtgacttttagtatgtatgca

SEQ ID NO: 52589 - RNA, 24 nt, synthetic construct
  misc_feature 1..24: note = derived and/or modified sequence opt6 from anti-influenza_CDR
  source 1..24: mol_type = other RNA
ggcgtgacttttagtatgtataca

SEQ ID NO: 52590 - RNA, 24 nt, synthetic construct
  misc_feature 1..24: note = derived and/or modified sequence opt6 from anti-influenza_CDR
  source 1..24: mol_type = other RNA
ggcgtaacttcatctaattatcca

SEQ ID NO: 52591 - RNA, 24 nt, synthetic construct
  misc_feature 1..24: note = derived and/or modified sequence opt6 from anti-influenza_CDR
  source 1..24: mol_type = other RNA
ataatagcaatattcggaacaaca

SEQ ID NO: 52592 - RNA, 24 nt, synthetic construct
  misc_feature 1..24: note = derived and/or modified sequence opt6 from anti-influenza_CDR
  source 1..24: mol_type = other RNA
ataataccattattcggaacagca

SEQ ID NO: 52593 - RNA, 24 nt, synthetic construct
  misc_feature 1..24: note = derived and/or modified sequence opt6 from anti-influenza_CDR
  source 1..24: mol_type = other RNA
ataataccactattcggcacaaca

SEQ ID NO: 52594 - RNA, 24 nt, synthetic construct
  misc_feature 1..24: note = derived and/or modified sequence opt6 from anti-influenza_CDR
  source 1..24: mol_type = other RNA
ataataccaatgttcggagcaaca

SEQ ID NO: 52595 - RNA, 24 nt, synthetic construct
  misc_feature 1..24: note = derived and/or modified sequence opt6 from anti-influenza_CDR
  source 1..24: mol_type = other RNA
ataataccaatgttcggaacaaca

SEQ ID NO: 52596 - RNA, 24 nt, synthetic construct
  misc_feature 1..24: note = derived and/or modified sequence opt6 from anti-influenza_CDR
  source 1..24: mol_type = other RNA
ataaatagtggaggaggggcgacg

SEQ ID NO: 52597 - RNA, 24 nt, synthetic construct
  misc_feature 1..24: note = derived and/or modified sequence opt6 from anti-influenza_CDR
  source 1..24: mol_type = other RNA
atatcagcagtattcggaacagca

SEQ ID NO: 52598 - RNA, 24 nt, synthetic construct
  misc_feature 1..24: note = derived and/or modified sequence opt6 from anti-influenza_CDR
  source 1..24: mol_type = other RNA
ataagctacgacgcaaactacaaa

SEQ ID NO: 52599 - RNA, 24 nt, synthetic construct
  misc_feature 1..24: note = derived and/or modified sequence opt6 from anti-influenza_CDR
  source 1..24: mol_type = other RNA
atatcatacgacggaaattacaaa

SEQ ID NO: 52600 - RNA, 24 nt, synthetic construct
  misc_feature 1..24: note = derived and/or modified sequence opt6 from anti-influenza_CDR
  source 1..24: mol_type = other RNA
atatcgtacgatggatcgaacaag

SEQ ID NO: 52601 - RNA, 24 nt, synthetic construct
  misc_feature 1..24: note = derived and/or modified sequence opt6 from anti-influenza_CDR
  source 1..24: mol_type = other RNA
ataagttatgacgggagtaatcaa

SEQ ID NO: 52602 - RNA, 24 nt, synthetic construct
  misc_feature 1..24: note = derived and/or modified sequence opt6 from anti-influenza_CDR
  source 1..24: mol_type = other RNA
caacaatactaccgctcaccctca

SEQ ID NO: 52603 - RNA, 24 nt, synthetic construct
  misc_feature 1..24: note = derived and/or modified sequence opt6 from anti-influenza_CDR
  source 1..24: mol_type = other RNA
gttcttcctctttttggcgttact

SEQ ID NO: 52604 - RNA, 24 nt, synthetic construct
  misc_feature 1..24: note = derived and/or modified sequence opt6 from anti-influenza_CDR
  source 1..24: mol_type = other RNA
ggagggacatttagttcagatgca

SEQ ID NO: 52605 - RNA, 24 nt, synthetic construct
  misc_feature 1..24: note = derived and/or modified sequence opt6 from anti-influenza_CDR
  source 1..24: mol_type = other RNA
ataatacccgtattccaaaccgca

SEQ ID NO: 52606 - RNA, 24 nt, synthetic construct
  misc_feature 1..24: note = derived and/or modified sequence opt6 from anti-influenza_CDR
  source 1..24: mol_type = other RNA
acatcaaacataggctcaaacgca

SEQ ID NO: 52607 - RNA, 24 nt, synthetic construct
  misc_feature 1..24: note = derived and/or modified sequence opt6 from anti-influenza_CDR
  source 1..24: mol_type = other RNA
gggtatagttttacgagtaggtgg

SEQ ID NO: 52608 - RNA, 24 nt, synthetic construct
  misc_feature 1..24: note = derived and/or modified sequence opt6 from anti-influenza_CDR
  source 1..24: mol_type = other RNA
atatatccatctgactctgacgtc

SEQ ID NO: 52609 - RNA, 24 nt, synthetic construct
  misc_feature 1..24: note = derived and/or modified sequence opt6 from anti-influenza_CDR
  source 1..24: mol_type = other RNA
caacaatacgacaactggctatca

SEQ ID NO: 52610 - RNA, 24 nt, synthetic construct
  misc_feature 1..24: note = derived and/or modified sequence opt6 from anti-influenza_CDR
  source 1..24: mol_type = other RNA
ggagggacgtttagtaattatggg

SEQ ID NO: 52611 - RNA, 24 nt, synthetic construct
  misc_feature 1..24: note = derived and/or modified sequence opt6 from anti-influenza_CDR
  source 1..24: mol_type = other RNA
ggcgcttctatttcttcttcttat

SEQ ID NO: 52612 - RNA, 24 nt, synthetic construct
  misc_feature 1..24: note = derived and/or modified sequence opt6 from anti-influenza_CDR
  source 1..24: mol_type = other RNA
ggcgggacttttagttcatatgat

SEQ ID NO: 52613 - RNA, 24 nt, synthetic construct
  misc_feature 1..24: note = derived and/or modified sequence opt6 from anti-influenza_CDR
  source 1..24: mol_type = other RNA
ataataccaatatacggaacagca

SEQ ID NO: 52614 - RNA, 24 nt, synthetic construct
  misc_feature 1..24: note = derived and/or modified sequence opt6 from anti-influenza_CDR
  source 1..24: mol_type = other RNA
ggatacacaagtacaacatacgga

SEQ ID NO: 52615 - RNA, 24 nt, synthetic construct
  misc_feature 1..24: note = derived and/or modified sequence opt6 from anti-influenza_CDR
  source 1..24: mol_type = other RNA
ataaacccatacaacggcaaccca

SEQ ID NO: 52616 - RNA, 24 nt, synthetic construct
  misc_feature 1..24: note = derived and/or modified sequence opt6 from anti-influenza_CDR
  source 1..24: mol_type = other RNA
atatggtatgatggagataacaag

SEQ ID NO: 52617 - RNA, 24 nt, synthetic construct
  misc_feature 1..24: note = derived and/or modified sequence opt6 from anti-influenza_CDR
  source 1..24: mol_type = other RNA
ggctttacatttagtgatttctgg

SEQ ID NO: 52618 - RNA, 24 nt, synthetic construct
  misc_feature 1..24: note = derived and/or modified sequence opt6 from anti-influenza_CDR
  source 1..24: mol_type = other RNA
atagatcaagacggaaatgaaaga

SEQ ID NO: 52619 - RNA, 24 nt, synthetic construct
  misc_feature 1..24: note = derived and/or modified sequence opt6 from anti-influenza_CDR
  source 1..24: mol_type = other RNA
tcatcaaacatcggcaaaaactac

SEQ ID NO: 52620 - RNA, 24 nt, synthetic construct
  misc_feature 1..24: note = derived and/or modified sequence opt6 from anti-influenza_CDR
  source 1..24: mol_type = other RNA
ggatatacatttacaaattactgg

SEQ ID NO: 52621 - RNA, 24 nt, synthetic construct
  misc_feature 1..24: note = derived and/or modified sequence opt6 from anti-influenza_CDR
  source 1..24: mol_type = other RNA
atattcccacccgactcccaaacc

SEQ ID NO: 52622 - RNA, 24 nt, synthetic construct
  misc_feature 1..24: note = derived and/or modified sequence opt6 from anti-influenza_CDR
  source 1..24: mol_type = other RNA
ggctatagttttagtgattactgg

SEQ ID NO: 52623 - RNA, 24 nt, synthetic construct
  misc_feature 1..24: note = derived and/or modified sequence opt6 from anti-influenza_CDR
  source 1..24: mol_type = other RNA
atatatccagcctcatctgaaatt

SEQ ID NO: 52624 - RNA, 24 nt, synthetic construct
  misc_feature 1..24: note = derived and/or modified sequence opt6 from anti-influenza_CDR
  source 1..24: mol_type = other RNA
agtggggatagtgggacgtggaat

SEQ ID NO: 52625 - RNA, 24 nt, synthetic construct
  misc_feature 1..24: note = derived and/or modified sequence opt6 from anti-influenza_CDR
  source 1..24: mol_type = other RNA
ggcgggacattaaataattatgca

SEQ ID NO: 52626 - RNA, 24 nt, synthetic construct
  misc_feature 1..24: note = derived and/or modified sequence opt6 from anti-influenza_CDR
  source 1..24: mol_type = other RNA
atttctcctattttcggcactctt

SEQ ID NO: 52627 - RNA, 24 nt, synthetic construct
  misc_feature 1..24: note = derived and/or modified sequence opt6 from anti-influenza_CDR
  source 1..24: mol_type = other RNA
ggtgtattttttagttcgcatgcg

SEQ ID NO: 52628 - RNA, 24 nt, synthetic construct
  misc_feature 1..24: note = derived and/or modified sequence opt6 from anti-influenza_CDR
  source 1..24: mol_type = other RNA
atatcaccaatgttcggaacaaca

SEQ ID NO: 52629 - RNA, 24 nt, synthetic construct
  misc_feature 1..24: note = derived and/or modified sequence opt6 from anti-influenza_CDR
  source 1..24: mol_type = other RNA
ggttttactttttctcgttttggt

SEQ ID NO: 52630 - RNA, 24 nt, synthetic construct
  misc_feature 1..24: note = derived and/or modified sequence opt6 from anti-influenza_CDR
  source 1..24: mol_type = other RNA
atatggtatgacgggagtaataaa

SEQ ID NO: 52631 - RNA, 24 nt, synthetic construct
  misc_feature 1..24: note = derived and/or modified sequence opt6 from anti-influenza_CDR
  source 1..24: mol_type = other RNA
caaacatatggaggagtgagtaca

SEQ ID NO: 52632 - RNA, 24 nt, synthetic construct
  misc_feature 1..24: note = derived and/or modified sequence opt6 from anti-influenza_CDR
  source 1..24: mol_type = other RNA
gatagcgcaggcaatagacatagc

SEQ ID NO: 52633 - RNA, 24 nt, synthetic construct
  misc_feature 1..24: note = derived and/or modified sequence opt6 from anti-influenza_CDR
  source 1..24: mol_type = other RNA
tttagagggggcaatagtttgagt

SEQ ID NO: 52634 - RNA, 24 nt, synthetic construct
  misc_feature 1..24: note = derived and/or modified sequence opt6 from anti-influenza_CDR
  source 1..24: mol_type = other RNA
ggatatacatttacaacttactgg

SEQ ID NO: 52635 - RNA, 24 nt, synthetic construct
  misc_feature 1..24: note = derived and/or modified sequence opt6 from anti-influenza_CDR
  source 1..24: mol_type = other RNA
atagacccatatgactctgaaact

SEQ ID NO: 52636 - RNA, 24 nt, synthetic construct
  misc_feature 1..24: note = derived and/or modified sequence opt6 from anti-influenza_CDR
  source 1..24: mol_type = other RNA
atacgtaagtttttgaactggtac

SEQ ID NO: 52637 - RNA, 24 nt, synthetic construct
  misc_feature 1..24: note = derived and/or modified sequence opt6 from anti-influenza_CDR
  source 1..24: mol_type = other RNA
caacaatacgacggactaccattt

SEQ ID NO: 52638 - RNA, 24 nt, synthetic construct
  misc_feature 1..24: note = derived and/or modified sequence opt6 from anti-influenza_CDR
  source 1..24: mol_type = other RNA
ataagaaacagcctaaactggtac

SEQ ID NO: 52639 - RNA, 24 nt, synthetic construct
  misc_feature 1..24: note = derived and/or modified sequence opt6 from anti-influenza_CDR
  source 1..24: mol_type = other RNA
caacaagccaactcattcccactc

SEQ ID NO: 52640 - RNA, 24 nt, synthetic construct
  misc_feature 1..24: note = derived and/or modified sequence opt6 from anti-influenza_CDR
  source 1..24: mol_type = other RNA
tcactattaacagaagtcgaaaca

SEQ ID NO: 52641 - RNA, 24 nt, synthetic construct
  misc_feature 1..24: note = derived and/or modified sequence opt6 from anti-influenza_CDR
  source 1..24: mol_type = other RNA
caacaatcctattccatgcccgca

SEQ ID NO: 52642 - RNA, 24 nt, synthetic construct
  misc_feature 1..24: note = derived and/or modified sequence opt6 from anti-influenza_CDR
  source 1..24: mol_type = other RNA
ggagggccggtaagtggaggagga

SEQ ID NO: 52643 - RNA, 24 nt, synthetic construct
  misc_feature 1..24: note = derived and/or modified sequence opt6 from anti-influenza_CDR
  source 1..24: mol_type = other RNA
caacaatcattttccgtacccgca

SEQ ID NO: 52644 - RNA, 24 nt, synthetic construct
  misc_feature 1..24: note = derived and/or modified sequence opt6 from anti-influenza_CDR
  source 1..24: mol_type = other RNA
caacaaacctactccatccccctc

SEQ ID NO: 52645 - RNA, 24 nt, synthetic construct
  misc_feature 1..24: note = derived and/or modified sequence opt6 from anti-influenza_CDR
  source 1..24: mol_type = other RNA
caacaatcatattccgtacccgca

SEQ ID NO: 52646 - RNA, 24 nt, synthetic construct
  misc_feature 1..24: note = derived and/or modified sequence opt6 from anti-influenza_CDR
  source 1..24: mol_type = other RNA
caacaaaccttctccatccccctc

SEQ ID NO: 52647 - RNA, 24 nt, synthetic construct
  misc_feature 1..24: note = derived and/or modified sequence opt6 from anti-influenza_CDR
  source 1..24: mol_type = other RNA
ggagatagtataacaagtggggca

SEQ ID NO: 52648 - RNA, 24 nt, synthetic construct
  misc_feature 1..24: note = derived and/or modified sequence opt6 from anti-influenza_CDR
  source 1..24: mol_type = other RNA
caagcatgggatagttcgacagca

SEQ ID NO: 52649 - RNA, 24 nt, synthetic construct
  misc_feature 1..24: note = derived and/or modified sequence opt6 from anti-influenza_CDR
  source 1..24: mol_type = other RNA
caacaatacggatcatcattatgg

SEQ ID NO: 52650 - RNA, 24 nt, synthetic construct
  misc_feature 1..24: note = derived and/or modified sequence opt6 from anti-influenza_CDR
  source 1..24: mol_type = other RNA
gcatatggatatacatttgaccct

SEQ ID NO: 52651 - RNA, 24 nt, synthetic construct
  misc_feature 1..24: note = derived and/or modified sequence opt6 from anti-influenza_CDR
  source 1..24: mol_type = other RNA
atgcaagcactccaaacaccactc

SEQ ID NO: 52652 - RNA, 24 nt, synthetic construct
  misc_feature 1..24: note = derived and/or modified sequence opt6 from anti-influenza_CDR
  source 1..24: mol_type = other RNA
caacaatacggctcatcactaaca

SEQ ID NO: 52653 - RNA, 24 nt, synthetic construct
  misc_feature 1..24: note = derived and/or modified sequence opt6 from anti-influenza_CDR
  source 1..24: mol_type = other RNA
caaaaatataactccgccccctca

SEQ ID NO: 52654 - RNA, 24 nt, synthetic construct
  misc_feature 1..24: note = derived and/or modified sequence opt6 from anti-influenza_CDR
  source 1..24: mol_type = other RNA
caacaaagatcaaactggctaaaa

SEQ ID NO: 52655 - RNA, 24 nt, synthetic construct
  misc_feature 1..24: note = derived and/or modified sequence opt6 from anti-influenza_CDR
  source 1..24: mol_type = other RNA
tcctctcaatcccgctcctctact

SEQ ID NO: 52656 - RNA, 24 nt, synthetic construct
  misc_feature 1..24: note = derived and/or modified sequence opt6 from anti-influenza_CDR
  source 1..24: mol_type = other RNA
ccatatgacgtaccagattacgaa

SEQ ID NO: 52657 - RNA, 24 nt, synthetic construct
  misc_feature 1..24: note = derived and/or modified sequence opt6 from anti-influenza_CDR
  source 1..24: mol_type = other RNA
ccatatgacgttccagattacgct

SEQ ID NO: 52658 - RNA, 24 nt, synthetic construct
  misc_feature 1..24: note = derived and/or modified sequence opt6 from anti-influenza_CDR
  source 1..24: mol_type = other RNA
ccgggagattttaatgattatgaa

SEQ ID NO: 52659 - RNA, 24 nt, synthetic construct
  misc_feature 1..24: note = derived and/or modified sequence opt6 from anti-influenza_CDR
  source 1..24: mol_type = other RNA
ccgaaagtacgcgatcaagaaagc

SEQ ID NO: 52660 - RNA, 24 nt, synthetic construct
  misc_feature 1..24: note = derived and/or modified sequence opt6 from anti-influenza_CDR
  source 1..24: mol_type = other RNA
acctcctacacctcctccaacacc

SEQ ID NO: 52661 - RNA, 24 nt, synthetic construct
  misc_feature 1..24: note = derived and/or modified sequence opt6 from anti-influenza_CDR
  source 1..24: mol_type = other RNA
ggcgggaattttaataattatgcg

SEQ ID NO: 52662 - RNA, 24 nt, synthetic construct
  misc_feature 1..24: note = derived and/or modified sequence opt6 from anti-influenza_CDR
  source 1..24: mol_type = other RNA
atttcacctatattcggctctaca

SEQ ID NO: 52663 - RNA, 24 nt, synthetic construct
  misc_feature 1..24: note = derived and/or modified sequence opt6 from anti-influenza_CDR
  source 1..24: mol_type = other RNA
tcctcctacacctcctccaatacc

SEQ ID NO: 52664 - RNA, 24 nt, synthetic construct
  misc_feature 1..24: note = derived and/or modified sequence opt6 from anti-influenza_CDR
  source 1..24: mol_type = other RNA
ggcgggacatttaataattatgca

SEQ ID NO: 52665 - RNA, 24 nt, synthetic construct
  misc_feature 1..24: note = derived and/or modified sequence opt6 from anti-influenza_CDR
  source 1..24: mol_type = other RNA
atttctcctattttcggttctgtt

SEQ ID NO: 52666 - RNA, 24 nt, synthetic construct
  misc_feature 1..24: note = derived and/or modified sequence opt6 from anti-influenza_CDR
  source 1..24: mol_type = other RNA
tcctcaaatatcggccacaatttc

SEQ ID NO: 52667 - RNA, 24 nt, synthetic construct
  misc_feature 1..24: note = derived and/or modified sequence opt6 from anti-influenza_CDR
  source 1..24: mol_type = other RNA
ggcacttgggatagttcgttatcg

SEQ ID NO: 52668 - RNA, 24 nt, synthetic construct
  misc_feature 1..24: note = derived and/or modified sequence opt6 from anti-influenza_CDR
  source 1..24: mol_type = other RNA
ggagggataataagaaagtatgcg

SEQ ID NO: 52669 - RNA, 24 nt, synthetic construct
  misc_feature 1..24: note = derived and/or modified sequence opt6 from anti-influenza_CDR
  source 1..24: mol_type = other RNA
ataatagccatattcaatacagcc

SEQ ID NO: 52670 - RNA, 24 nt, synthetic construct
  misc_feature 1..24: note = derived and/or modified sequence opt6 from anti-influenza_CDR
  source 1..24: mol_type = other RNA
ggctatacatttacagcttacact

SEQ ID NO: 52671 - RNA, 24 nt, synthetic construct
  misc_feature 1..24: note = derived and/or modified sequence opt6 from anti-influenza_CDR
  source 1..24: mol_type = other RNA
ataaacgcaggaaatggacataca

SEQ ID NO: 52672 - RNA, 24 nt, synthetic construct
  misc_feature 1..24: note = derived and/or modified sequence opt6 from anti-influenza_CDR
  source 1..24: mol_type = other RNA
ggcggtacatttattaattatgct

SEQ ID NO: 52673 - RNA, 24 nt, synthetic construct
  misc_feature 1..24: note = derived and/or modified sequence opt6 from anti-influenza_CDR
  source 1..24: mol_type = other RNA
ataataccagtatacggaacatca

SEQ ID NO: 52674 - RNA, 24 nt, synthetic construct
  misc_feature 1..24: note = derived and/or modified sequence opt6 from anti-influenza_CDR
  source 1..24: mol_type = other RNA
ggttttacttttcgttctcatgct

SEQ ID NO: 52675 - RNA, 24 nt, synthetic construct
  misc_feature 1..24: note = derived and/or modified sequence opt6 from anti-influenza_CDR
  source 1..24: mol_type = other RNA
atatcatacgacgaagtaaacaaa

SEQ ID NO: 52676 - RNA, 24 nt, synthetic construct
  misc_feature 1..24: note = derived and/or modified sequence opt6 from anti-influenza_CDR
  source 1..24: mol_type = other RNA
ggttataattttgccgcttattat

SEQ ID NO: 52677 - RNA, 24 nt, synthetic construct
  misc_feature 1..24: note = derived and/or modified sequence opt6 from anti-influenza_CDR
  source 1..24: mol_type = other RNA
tcaaatccaaatacaggaggagca

SEQ ID NO: 52678 - RNA, 24 nt, synthetic construct
  misc_feature 1..24: note = derived and/or modified sequence opt6 from anti-influenza_CDR
  source 1..24: mol_type = other RNA
ggctatacattaatagattactat

SEQ ID NO: 52679 - RNA, 24 nt, synthetic construct
  misc_feature 1..24: note = derived and/or modified sequence opt6 from anti-influenza_CDR
  source 1..24: mol_type = other RNA
ataaatccaataaacggcggaaca

SEQ ID NO: 52680 - RNA, 24 nt, synthetic construct
  misc_feature 1..24: note = derived and/or modified sequence opt6 from anti-influenza_CDR
  source 1..24: mol_type = other RNA
ggttttactttttctgcttatgct

SEQ ID NO: 52681 - RNA, 24 nt, synthetic construct
  misc_feature 1..24: note = derived and/or modified sequence opt6 from anti-influenza_CDR
  source 1..24: mol_type = other RNA
acgagttatgacgggagagatagc

SEQ ID NO: 52682 - RNA, 24 nt, synthetic construct
  misc_feature 1..24: note = derived and/or modified sequence opt6 from anti-influenza_CDR
  source 1..24: mol_type = other RNA
ggatttacatttaccaattacgct

SEQ ID NO: 52683 - RNA, 24 nt, synthetic construct
  misc_feature 1..24: note = derived and/or modified sequence opt6 from anti-influenza_CDR
  source 1..24: mol_type = other RNA
atatcattcgacgaagacaacaaa

SEQ ID NO: 52684 - RNA, 24 nt, synthetic construct
  misc_feature 1..24: note = derived and/or modified sequence opt6 from anti-influenza_CDR
  source 1..24: mol_type = other RNA
ggttttaattttagttcgtatggg

SEQ ID NO: 52685 - RNA, 24 nt, synthetic construct
  misc_feature 1..24: note = derived and/or modified sequence opt6 from anti-influenza_CDR
  source 1..24: mol_type = other RNA
atatggagtggggggagtaataag

SEQ ID NO: 52686 - RNA, 24 nt, synthetic construct
  misc_feature 1..24: note = derived and/or modified sequence opt6 from anti-influenza_CDR
  source 1..24: mol_type = other RNA
ggatttatatttggcgattttgct

SEQ ID NO: 52687 - RNA, 24 nt, synthetic construct
  misc_feature 1..24: note = derived and/or modified sequence opt6 from anti-influenza_CDR
  source 1..24: mol_type = other RNA
ggttttaattttgatgagtatgtg

SEQ ID NO: 52688 - RNA, 24 nt, synthetic construct
  misc_feature 1..24: note = derived and/or modified sequence opt6 from anti-influenza_CDR
  source 1..24: mol_type = other RNA
ataggagcagacggaagagggaca

SEQ ID NO: 52689 - RNA, 24 nt, synthetic construct
  misc_feature 1..24: note = derived and/or modified sequence opt6 from anti-influenza_CDR
  source 1..24: mol_type = other RNA
ggcgggagtgtgagtaattattat

SEQ ID NO: 52690 - RNA, 24 nt, synthetic construct
  misc_feature 1..24: note = derived and/or modified sequence opt6 from anti-influenza_CDR
  source 1..24: mol_type = other RNA
ggcggtacttttagttattatgct

SEQ ID NO: 52691 - RNA, 24 nt, synthetic construct
  misc_feature 1..24: note = derived and/or modified sequence opt6 from anti-influenza_CDR
  source 1..24: mol_type = other RNA
ataattccaattgtcggtacagcc

SEQ ID NO: 52692 - RNA, 24 nt, synthetic construct
  misc_feature 1..24: note = derived and/or modified sequence opt6 from anti-influenza_CDR
  source 1..24: mol_type = other RNA
acatcaaacatcggctcaaacaca

SEQ ID NO: 52693 - RNA, 24 nt, synthetic construct
  misc_feature 1..24: note = derived and/or modified sequence opt6 from anti-influenza_CDR
  source 1..24: mol_type = other RNA
ggttataattttcctaaatactgg

SEQ ID NO: 52694 - RNA, 24 nt, synthetic construct
  misc_feature 1..24: note = derived and/or modified sequence opt6 from anti-influenza_CDR
  source 1..24: mol_type = other RNA
atatatccaggtgattctgatgtt

SEQ ID NO: 52695 - RNA, 24 nt, synthetic construct
  misc_feature 1..24: note = derived and/or modified sequence opt6 from anti-influenza_CDR
  source 1..24: mol_type = other RNA
ggtcatacttttatttcttacgct

SEQ ID NO: 52696 - RNA, 24 nt, synthetic construct
  misc_feature 1..24: note = derived and/or modified sequence opt6 from anti-influenza_CDR
  source 1..24: mol_type = other RNA
atagtaccaatattcggaacagta

SEQ ID NO: 52697 - RNA, 24 nt, synthetic construct
  misc_feature 1..24: note = derived and/or modified sequence opt6 from anti-influenza_CDR
  source 1..24: mol_type = other RNA
ggatttacatttagaacatacgga

SEQ ID NO: 52698 - RNA, 24 nt, synthetic construct
  misc_feature 1..24: note = derived and/or modified sequence opt6 from anti-influenza_CDR
  source 1..24: mol_type = other RNA
atatcatacgacggaacaaacaaa

SEQ ID NO: 52699 - RNA, 24 nt, synthetic construct
  misc_feature 1..24: note = derived and/or modified sequence opt6 from anti-influenza_CDR
  source 1..24: mol_type = other RNA
ggttttactttttcttcttatggt

SEQ ID NO: 52700 - RNA, 24 nt, synthetic construct
  misc_feature 1..24: note = derived and/or modified sequence opt6 from anti-influenza_CDR
  source 1..24: mol_type = other RNA
ataagctacgacgaaataaacaaa

SEQ ID NO: 52701 - RNA, 24 nt, synthetic construct
  misc_feature 1..24: note = derived and/or modified sequence opt6 from anti-influenza_CDR
  source 1..24: mol_type = other RNA
ggatttagtttgtggacgagtggg

SEQ ID NO: 52702 - RNA, 24 nt, synthetic construct
  misc_feature 1..24: note = derived and/or modified sequence opt6 from anti-influenza_CDR
  source 1..24: mol_type = other RNA
atgagctatgacgagacaaaaaaa

SEQ ID NO: 52703 - RNA, 24 nt, synthetic construct
  misc_feature 1..24: note = derived and/or modified sequence opt6 from anti-influenza_CDR
  source 1..24: mol_type = other RNA
ggttttactttttctcgttattct

SEQ ID NO: 52704 - RNA, 24 nt, synthetic construct
  misc_feature 1..24: note = derived and/or modified sequence opt6 from anti-influenza_CDR
  source 1..24: mol_type = other RNA
atatccgacacctcacgaacaatc

SEQ ID NO: 52705 - RNA, 24 nt, synthetic construct
  misc_feature 1..24: note = derived and/or modified sequence opt6 from anti-influenza_CDR
  source 1..24: mol_type = other RNA
ggttttacttttaattcttatgct

SEQ ID NO: 52706 - RNA, 24 nt, synthetic construct
  misc_feature 1..24: note = derived and/or modified sequence opt6 from anti-influenza_CDR
  source 1..24: mol_type = other RNA
ataagaggaagcggagaaaataca

SEQ ID NO: 52707 - RNA, 24 nt, synthetic construct
  misc_feature 1..24: note = derived and/or modified sequence opt6 from anti-influenza_CDR
  source 1..24: mol_type = other RNA
ggttttactttttctcgtttttct

SEQ ID NO: 52708 - RNA, 24 nt, synthetic construct
  misc_feature 1..24: note = derived and/or modified sequence opt6 from anti-influenza_CDR
  source 1..24: mol_type = other RNA
ataagcgataccggacgaacaata

SEQ ID NO: 52709 - RNA, 24 nt, synthetic construct
  misc_feature 1..24: note = derived and/or modified sequence opt6 from anti-influenza_CDR
  source 1..24: mol_type = other RNA
ggggatagttttacgagttattgg

SEQ ID NO: 52710 - RNA, 24 nt, synthetic construct
  misc_feature 1..24: note = derived and/or modified sequence opt6 from anti-influenza_CDR
  source 1..24: mol_type = other RNA
atatacccacgcgactccgaaacc

SEQ ID NO: 52711 - RNA, 24 nt, synthetic construct
  misc_feature 1..24: note = derived and/or modified sequence opt6 from anti-influenza_CDR
  source 1..24: mol_type = other RNA
ggctatacatttacagcttaccat

SEQ ID NO: 52712 - RNA, 24 nt, synthetic construct
  misc_feature 1..24: note = derived and/or modified sequence opt6 from anti-influenza_CDR
  source 1..24: mol_type = other RNA
ataaatccaaactcaggcgcaaca

SEQ ID NO: 52713 - RNA, 24 nt, synthetic construct
  misc_feature 1..24: note = derived and/or modified sequence opt6 from anti-influenza_CDR
  source 1..24: mol_type = other RNA
ggttttactttttctgattattgg

SEQ ID NO: 52714 - RNA, 24 nt, synthetic construct
  misc_feature 1..24: note = derived and/or modified sequence opt6 from anti-influenza_CDR
  source 1..24: mol_type = other RNA
atatcttcagacggatctacaact

SEQ ID NO: 52715 - RNA, 24 nt, synthetic construct
  misc_feature 1..24: note = derived and/or modified sequence opt6 from anti-influenza_CDR
  source 1..24: mol_type = other RNA
ggtttttcgttttctaatgcttgg

SEQ ID NO: 52716 - RNA, 24 nt, synthetic construct
  misc_feature 1..24: note = derived and/or modified sequence opt6 from anti-influenza_CDR
  source 1..24: mol_type = other RNA
gggttaacgttttcgaatgcgtgg

SEQ ID NO: 52717 - RNA, 24 nt, synthetic construct
  misc_feature 1..24: note = derived and/or modified sequence opt6 from anti-influenza_CDR
  source 1..24: mol_type = other RNA
gggtttacgttttcgaatgcgtgg

SEQ ID NO: 52718 - RNA, 24 nt, synthetic construct
  misc_feature 1..24: note = derived and/or modified sequence opt6 from anti-influenza_CDR
  source 1..24: mol_type = other RNA
ggattatcatttttaaatgcctgg

SEQ ID NO: 52719 - RNA, 24 nt, synthetic construct
  misc_feature 1..24: note = derived and/or modified sequence opt6 from anti-influenza_CDR
  source 1..24: mol_type = other RNA
gggttttcgtttttgaatgcgtgg

SEQ ID NO: 52720 - RNA, 24 nt, synthetic construct
  misc_feature 1..24: note = derived and/or modified sequence opt6 from anti-influenza_CDR
  source 1..24: mol_type = other RNA
gggttaacgtttttgaatgcgtgg

SEQ ID NO: 52721 - RNA, 24 nt, synthetic construct
  misc_feature 1..24: note = derived and/or modified sequence opt6 from anti-influenza_CDR
  source 1..24: mol_type = other RNA
gggtttacgtttttgaatgcgtgg

SEQ ID NO: 52722 - RNA, 24 nt, synthetic construct
  misc_feature 1..24: note = derived and/or modified sequence opt6 from anti-influenza_CDR
  source 1..24: mol_type = other RNA
ggctatacatttacagattactat

SEQ ID NO: 52723 - RNA, 24 nt, synthetic construct
  misc_feature 1..24: note = derived and/or modified sequence opt6 from anti-influenza_CDR
  source 1..24: mol_type = other RNA
gtaaatccatattcaggcggaact

SEQ ID NO: 52724 - RNA, 24 nt, synthetic construct
  misc_feature 1..24: note = derived and/or modified sequence opt6 from anti-influenza_CDR
  source 1..24: mol_type = other RNA
ggctatacatttacagattacaat

SEQ ID NO: 52725 - RNA, 24 nt, synthetic construct
  misc_feature 1..24: note = derived and/or modified sequence opt6 from anti-influenza_CDR
  source 1..24: mol_type = other RNA
atatatccaaataacggcggaacc

SEQ ID NO: 52726 - RNA, 24 nt, synthetic construct
  misc_feature 1..24: note = derived and/or modified sequence opt6 from anti-influenza_CDR
  source 1..24: mol_type = other RNA
gggtatacgtttacgggttataat

SEQ ID NO: 52727 - RNA, 24 nt, synthetic construct
  misc_feature 1..24: note = derived and/or modified sequence opt6 from anti-influenza_CDR
  source 1..24: mol_type = other RNA
atatatccaaataacggcgtaacc

SEQ ID NO: 52728 - RNA, 24 nt, synthetic construct
  misc_feature 1..24: note = derived and/or modified sequence opt6 from anti-influenza_CDR
  source 1..24: mol_type = other RNA
atggaaacggacacgttattgtta

SEQ ID NO: 52729 - RNA, 27 nt, synthetic construct
  misc_feature 1..27: note = derived and/or modified sequence opt6 from anti-influenza_CDR
  source 1..27: mol_type = other RNA
gacggcgtaacaaataaagtaaactca

SEQ ID NO: 52730 - RNA, 27 nt, synthetic construct
  misc_feature 1..27: note = derived and/or modified sequence opt6 from anti-influenza_CDR
  source 1..27: mol_type = other RNA
gggagtgatgtggggagtagtaatttg

SEQ ID NO: 52731 - RNA, 27 nt, synthetic construct
  misc_feature 1..27: note = derived and/or modified sequence opt6 from anti-influenza_CDR
  source 1..27: mol_type = other RNA
atgcaaaacatcctactcccactcaca

SEQ ID NO: 52732 - RNA, 27 nt, synthetic construct
  misc_feature 1..27: note = derived and/or modified sequence opt6 from anti-influenza_CDR
  source 1..27: mol_type = other RNA
atgcaatcactccaactccccctcaca

SEQ ID NO: 52733 - RNA, 27 nt, synthetic construct
  misc_feature 1..27: note = derived and/or modified sequence opt6 from anti-influenza_CDR
  source 1..27: mol_type = other RNA
caacaacactaccgcacaccaccaacc

SEQ ID NO: 52734 - RNA, 27 nt, synthetic construct
  misc_feature 1..27: note = derived and/or modified sequence opt6 from anti-influenza_CDR
  source 1..27: mol_type = other RNA
caacaatacggcaactcaccatacaca

SEQ ID NO: 52735 - RNA, 27 nt, synthetic construct
  misc_feature 1..27: note = derived and/or modified sequence opt6 from anti-influenza_CDR
  source 1..27: mol_type = other RNA
caacaatacggctcatcaccatacaca

SEQ ID NO: 52736 - RNA, 27 nt, synthetic construct
  misc_feature 1..27: note = derived and/or modified sequence opt6 from anti-influenza_CDR
  source 1..27: mol_type = other RNA
caacaatacggcacatcaccacaaaca

SEQ ID NO: 52737 - RNA, 27 nt, synthetic construct
  misc_feature 1..27: note = derived and/or modified sequence opt6 from anti-influenza_CDR
  source 1..27: mol_type = other RNA
caacaatacggatacctacccctaact

SEQ ID NO: 52738 - RNA, 27 nt, synthetic construct
  misc_feature 1..27: note = derived and/or modified sequence opt6 from anti-influenza_CDR
  source 1..27: mol_type = other RNA
caagcatgggatagctcgacagcagta

SEQ ID NO: 52739 - RNA, 27 nt, synthetic construct
  misc_feature 1..27: note = derived and/or modified sequence opt6 from anti-influenza_CDR
  source 1..27: mol_type = other RNA
cagcattataatgcatactggggaaca

SEQ ID NO: 52740 - RNA, 27 nt, synthetic construct
  misc_feature 1..27: note = derived and/or modified sequence opt6 from anti-influenza_CDR
  source 1..27: mol_type = other RNA
caacaaacctactcatccccccccacc

SEQ ID NO: 52741 - RNA, 27 nt, synthetic construct
  misc_feature 1..27: note = derived and/or modified sequence opt6 from anti-influenza_CDR
  source 1..27: mol_type = other RNA
caacaatactactccttcccctacacc

SEQ ID NO: 52742 - RNA, 27 nt, synthetic construct
  misc_feature 1..27: note = derived and/or modified sequence opt6 from anti-influenza_CDR
  source 1..27: mol_type = other RNA
atgcaagcactccaactcccactcgca

SEQ ID NO: 52743 - RNA, 27 nt, synthetic construct
  misc_feature 1..27: note = derived and/or modified sequence opt6 from anti-influenza_CDR
  source 1..27: mol_type = other RNA
caacaagccaactcattcccattcaca

SEQ ID NO: 52744 - RNA, 27 nt, synthetic construct
  misc_feature 1..27: note = derived and/or modified sequence opt6 from anti-influenza_CDR
  source 1..27: mol_type = other RNA
caacaactaaacggctacccactaaca

SEQ ID NO: 52745 - RNA, 27 nt, synthetic construct
  misc_feature 1..27: note = derived and/or modified sequence opt6 from anti-influenza_CDR
  source 1..27: mol_type = other RNA
atgcaagcactccaaaccccactcaca

SEQ ID NO: 52746 - RNA, 27 nt, synthetic construct
  misc_feature 1..27: note = derived and/or modified sequence opt6 from anti-influenza_CDR
  source 1..27: mol_type = other RNA
caacaaaactacaactggccactaaca

SEQ ID NO: 52747 - RNA, 27 nt, synthetic construct
  misc_feature 1..27: note = derived and/or modified sequence opt6 from anti-influenza_CDR
  source 1..27: mol_type = other RNA
caacaatacgacacatcatccggactc

SEQ ID NO: 52748 - RNA, 27 nt, synthetic construct
  misc_feature 1..27: note = derived and/or modified sequence opt6 from anti-influenza_CDR
  source 1..27: mol_type = other RNA
caacaatacaactcatggccaagaaca

SEQ ID NO: 52749 - RNA, 27 nt, synthetic construct
  misc_feature 1..27: note = derived and/or modified sequence opt6 from anti-influenza_CDR
  source 1..27: mol_type = other RNA
gttatatattcgcatgggcgtgcgtat

SEQ ID NO: 52750 - RNA, 27 nt, synthetic construct
  misc_feature 1..27: note = derived and/or modified sequence opt6 from anti-influenza_CDR
  source 1..27: mol_type = other RNA
caacaatacggagacagcagatacaca

SEQ ID NO: 52751 - RNA, 27 nt, synthetic construct
  misc_feature 1..27: note = derived and/or modified sequence opt6 from anti-influenza_CDR
  source 1..27: mol_type = other RNA
ctccaacacaactcatacccctacacc

SEQ ID NO: 52752 - RNA, 27 nt, synthetic construct
  misc_feature 1..27: note = derived and/or modified sequence opt6 from anti-influenza_CDR
  source 1..27: mol_type = other RNA
agaaaaatgacaacagcattcgacagc

SEQ ID NO: 52753 - RNA, 27 nt, synthetic construct
  misc_feature 1..27: note = derived and/or modified sequence opt6 from anti-influenza_CDR
  source 1..27: mol_type = other RNA
caaagaaaccactcaccatcatggaca

SEQ ID NO: 52754 - RNA, 27 nt, synthetic construct
  misc_feature 1..27: note = derived and/or modified sequence opt6 from anti-influenza_CDR
  source 1..27: mol_type = other RNA
caacaatcatacgacaacccacaaaca

SEQ ID NO: 52755 - RNA, 27 nt, synthetic construct
  misc_feature 1..27: note = derived and/or modified sequence opt6 from anti-influenza_CDR
  source 1..27: mol_type = other RNA
caacaatccagacgactaccatacaca

SEQ ID NO: 52756 - RNA, 27 nt, synthetic construct
  misc_feature 1..27: note = derived and/or modified sequence opt6 from anti-influenza_CDR
  source 1..27: mol_type = other RNA
agaaaaatgacaacagcaatagactac

SEQ ID NO: 52757 - RNA, 27 nt, synthetic construct
  misc_feature 1..27: note = derived and/or modified sequence opt6 from anti-influenza_CDR
  source 1..27: mol_type = other RNA
ataagatacaccggacaacaactacta

SEQ ID NO: 52758 - RNA, 27 nt, synthetic construct
  misc_feature 1..27: note = derived and/or modified sequence opt6 from anti-influenza_CDR
  source 1..27: mol_type = other RNA
caacactacggaacaatatcacaaaca

SEQ ID NO: 52759 - RNA, 27 nt, synthetic construct
  misc_feature 1..27: note = derived and/or modified sequence opt6 from anti-influenza_CDR
  source 1..27: mol_type = other RNA
caacaatactccacctccccccccacc

SEQ ID NO: 52760 - RNA, 27 nt, synthetic construct
  misc_feature 1..27: note = derived and/or modified sequence opt6 from anti-influenza_CDR
  source 1..27: mol_type = other RNA
caacaatacggcaactcaccaataaca

SEQ ID NO: 52761 - RNA, 27 nt, synthetic construct
  misc_feature 1..27: note = derived and/or modified sequence opt6 from anti-influenza_CDR
  source 1..27: mol_type = other RNA
caacaatactactcccgcccatacaca

SEQ ID NO: 52762 - RNA, 27 nt, synthetic construct
  misc_feature 1..27: note = derived and/or modified sequence opt6 from anti-influenza_CDR
  source 1..27: mol_type = other RNA
caggtgtgggataattttggaggggta

SEQ ID NO: 52763 - RNA, 27 nt, synthetic construct
  misc_feature 1..27: note = derived and/or modified sequence opt6 from anti-influenza_CDR
  source 1..27: mol_type = other RNA
caacaatcctactcctcccccctcacc

SEQ ID NO: 52764 - RNA, 27 nt, synthetic construct
  misc_feature 1..27: note = derived and/or modified sequence opt6 from anti-influenza_CDR
  source 1..27: mol_type = other RNA
caacaatatttcgccactccccgcacc

SEQ ID NO: 52765 - RNA, 27 nt, synthetic construct
  misc_feature 1..27: note = derived and/or modified sequence opt6 from anti-influenza_CDR
  source 1..27: mol_type = other RNA
caacaatactacttctcccccctcacc

SEQ ID NO: 52766 - RNA, 27 nt, synthetic construct
  misc_feature 1..27: note = derived and/or modified sequence opt6 from anti-influenza_CDR
  source 1..27: mol_type = other RNA
caacatttcggcacatctgtatttaca

SEQ ID NO: 52767 - RNA, 27 nt, synthetic construct
  misc_feature 1..27: note = derived and/or modified sequence opt6 from anti-influenza_CDR
  source 1..27: mol_type = other RNA
caacaatactataacgcccccctaacc

SEQ ID NO: 52768 - RNA, 27 nt, synthetic construct
  misc_feature 1..27: note = derived and/or modified sequence opt6 from anti-influenza_CDR
  source 1..27: mol_type = other RNA
gtcctttttacttctccttttgacttt

SEQ ID NO: 52769 - RNA, 27 nt, synthetic construct
  misc_feature 1..27: note = derived and/or modified sequence opt6 from anti-influenza_CDR
  source 1..27: mol_type = other RNA
ttgttatcgtattcgggtgtgtgggtg

SEQ ID NO: 52770 - RNA, 27 nt, synthetic construct
  misc_feature 1..27: note = derived and/or modified sequence opt6 from anti-influenza_CDR
  source 1..27: mol_type = other RNA
tttttatcgtattcgggtgcgtgggtg

SEQ ID NO: 52771 - RNA, 27 nt, synthetic construct
  misc_feature 1..27: note = derived and/or modified sequence opt6 from anti-influenza_CDR
  source 1..27: mol_type = other RNA
caacaatcattctcaaaatcctggacc

SEQ ID NO: 52772 - RNA, 27 nt, synthetic construct
  misc_feature 1..27: note = derived and/or modified sequence opt6 from anti-influenza_CDR
  source 1..27: mol_type = other RNA
gtacaatacgttcaatttccctggaca

SEQ ID NO: 52773 - RNA, 27 nt, synthetic construct
  misc_feature 1..27: note = derived and/or modified sequence opt6 from anti-influenza_CDR
  source 1..27: mol_type = other RNA
caacaatcctactccccccccctcacc

SEQ ID NO: 52774 - RNA, 27 nt, synthetic construct
  misc_feature 1..27: note = derived and/or modified sequence opt6 from anti-influenza_CDR
  source 1..27: mol_type = other RNA
ttcatatattacggcggaaatacaaaa

SEQ ID NO: 52775 - RNA, 27 nt, synthetic construct
  misc_feature 1..27: note = derived and/or modified sequence opt6 from anti-influenza_CDR
  source 1..27: mol_type = other RNA
gttatatattcgggtgggagtacgtat

SEQ ID NO: 52776 - RNA, 27 nt, synthetic construct
  misc_feature 1..27: note = derived and/or modified sequence opt6 from anti-influenza_CDR
  source 1..27: mol_type = other RNA
tttatgtttcattccggatctccacgt

SEQ ID NO: 52777 - RNA, 27 nt, synthetic construct
  misc_feature 1..27: note = derived and/or modified sequence opt6 from anti-influenza_CDR
  source 1..27: mol_type = other RNA
caacaaacctactccacccccatcacc

SEQ ID NO: 52778 - RNA, 27 nt, synthetic construct
  misc_feature 1..27: note = derived and/or modified sequence opt6 from anti-influenza_CDR
  source 1..27: mol_type = other RNA
tttttttataatggcggctctactaaa

SEQ ID NO: 52779 - RNA, 27 nt, synthetic construct
  misc_feature 1..27: note = derived and/or modified sequence opt6 from anti-influenza_CDR
  source 1..27: mol_type = other RNA
caacaatcctacaacacccccctcatc

SEQ ID NO: 52780 - RNA, 27 nt, synthetic construct
  misc_feature 1..27: note = derived and/or modified sequence opt6 from anti-influenza_CDR
  source 1..27: mol_type = other RNA
catatatatgattacgggcgtacgttt

SEQ ID NO: 52781 - RNA, 27 nt, synthetic construct
  misc_feature 1..27: note = derived and/or modified sequence opt6 from anti-influenza_CDR
  source 1..27: mol_type = other RNA
gttttctattcagaaacccgtacctat

SEQ ID NO: 52782 - RNA, 27 nt, synthetic construct
  misc_feature 1..27: note = derived and/or modified sequence opt6 from anti-influenza_CDR
  source 1..27: mol_type = other RNA
caagtgtgggggagttcgagtgatcat

SEQ ID NO: 52783 - RNA, 27 nt, synthetic construct
  misc_feature 1..27: note = derived and/or modified sequence opt6 from anti-influenza_CDR
  source 1..27: mol_type = other RNA
tacgtgtacaatcgcgggagcacgaaa

SEQ ID NO: 52784 - RNA, 27 nt, synthetic construct
  misc_feature 1..27: note = derived and/or modified sequence opt6 from anti-influenza_CDR
  source 1..27: mol_type = other RNA
tacatatacaatcgcgggagcacgaaa

SEQ ID NO: 52785 - RNA, 27 nt, synthetic construct
  misc_feature 1..27: note = derived and/or modified sequence opt6 from anti-influenza_CDR
  source 1..27: mol_type = other RNA
caacaatcctacaacacccccatcacc

SEQ ID NO: 52786 - RNA, 27 nt, synthetic construct
  misc_feature 1..27: note = derived and/or modified sequence opt6 from anti-influenza_CDR
  source 1..27: mol_type = other RNA
caacaatactactcctccccccccacc

SEQ ID NO: 52787 - RNA, 27 nt, synthetic construct
  misc_feature 1..27: note = derived and/or modified sequence opt6 from anti-influenza_CDR
  source 1..27: mol_type = other RNA
tacctatattactccggctccacaaaa

SEQ ID NO: 52788 - RNA, 27 nt, synthetic construct
  misc_feature 1..27: note = derived and/or modified sequence opt6 from anti-influenza_CDR
  source 1..27: mol_type = other RNA
caacaatcctactccccccccatcacc

SEQ ID NO: 52789 - RNA, 27 nt, synthetic construct
  misc_feature 1..27: note = derived and/or modified sequence opt6 from anti-influenza_CDR
  source 1..27: mol_type = other RNA
tacgtgtacaatagcgggaacacgaaa

SEQ ID NO: 52790 - RNA, 27 nt, synthetic construct
  misc_feature 1..27: note = derived and/or modified sequence opt6 from anti-influenza_CDR
  source 1..27: mol_type = other RNA
caacaatcctacaacacccccctcacc

SEQ ID NO: 52791 - RNA, 27 nt, synthetic construct
  misc_feature 1..27: note = derived and/or modified sequence opt6 from anti-influenza_CDR
  source 1..27: mol_type = other RNA
catatatttgactccggatctacatat

SEQ ID NO: 52792 - RNA, 27 nt, synthetic construct
  misc_feature 1..27: note = derived and/or modified sequence opt6 from anti-influenza_CDR
  source 1..27: mol_type = other RNA
gttttttattcagctgaccgtacttct

SEQ ID NO: 52793 - RNA, 27 nt, synthetic construct
  misc_feature 1..27: note = derived and/or modified sequence opt6 from anti-influenza_CDR
  source 1..27: mol_type = other RNA
caacaatactactccacccccctcacc

SEQ ID NO: 52794 - RNA, 27 nt, synthetic construct
  misc_feature 1..27: note = derived and/or modified sequence opt6 from anti-influenza_CDR
  source 1..27: mol_type = other RNA
tatatatattactccggcaatacatat

SEQ ID NO: 52795 - RNA, 27 nt, synthetic construct
  misc_feature 1..27: note = derived and/or modified sequence opt6 from anti-influenza_CDR
  source 1..27: mol_type = other RNA
caacaatcctactccacccccctcacc

SEQ ID NO: 52796 - RNA, 27 nt, synthetic construct
  misc_feature 1..27: note = derived and/or modified sequence opt6 from anti-influenza_CDR
  source 1..27: mol_type = other RNA
caacaatacggctcctcatccctaact

SEQ ID NO: 52797 - RNA, 27 nt, synthetic construct
  misc_feature 1..27: note = derived and/or modified sequence opt6 from anti-influenza_CDR
  source 1..27: mol_type = other RNA
tcttcctatacctcttcctctacctac

SEQ ID NO: 52798 - RNA, 27 nt, synthetic construct
  misc_feature 1..27: note = derived and/or modified sequence opt6 from anti-influenza_CDR
  source 1..27: mol_type = other RNA
caaagatacaactcagccccaccaata

SEQ ID NO: 52799 - RNA, 27 nt, synthetic construct
  misc_feature 1..27: note = derived and/or modified sequence opt6 from anti-influenza_CDR
  source 1..27: mol_type = other RNA
caacaatacggacgaacaccactaaca

SEQ ID NO: 52800 - RNA, 27 nt, synthetic construct
  misc_feature 1..27: note = derived and/or modified sequence opt6 from anti-influenza_CDR
  source 1..27: mol_type = other RNA
caacaatacggctcaagcccaagaaca

SEQ ID NO: 52801 - RNA, 27 nt, synthetic construct
  misc_feature 1..27: note = derived and/or modified sequence opt6 from anti-influenza_CDR
  source 1..27: mol_type = other RNA
caacaatacggctcatcaccactaaca

SEQ ID NO: 52802 - RNA, 27 nt, synthetic construct
  misc_feature 1..27: note = derived and/or modified sequence opt6 from anti-influenza_CDR
  source 1..27: mol_type = other RNA
caagtgtgggatagctcgagcgatcac

SEQ ID NO: 52803 - RNA, 27 nt, synthetic construct
  misc_feature 1..27: note = derived and/or modified sequence opt6 from anti-influenza_CDR
  source 1..27: mol_type = other RNA
aaggagtttagtgaggtggaggggagg

SEQ ID NO: 52804 - RNA, 27 nt, synthetic construct
  misc_feature 1..27: note = derived and/or modified sequence opt6 from anti-influenza_CDR
  source 1..27: mol_type = other RNA
aaagaattcaataacctggaaaaaaga

SEQ ID NO: 52805 - RNA, 27 nt, synthetic construct
  misc_feature 1..27: note = derived and/or modified sequence opt6 from anti-influenza_CDR
  source 1..27: mol_type = other RNA
caacaacactaccgcacacccccatcc

SEQ ID NO: 52806 - RNA, 27 nt, synthetic construct
  misc_feature 1..27: note = derived and/or modified sequence opt6 from anti-influenza_CDR
  source 1..27: mol_type = other RNA
atgcaagcaactcactggccactaaca

SEQ ID NO: 52807 - RNA, 27 nt, synthetic construct
  misc_feature 1..27: note = derived and/or modified sequence opt6 from anti-influenza_CDR
  source 1..27: mol_type = other RNA
caacaatactactcctacccctacacc

SEQ ID NO: 52808 - RNA, 27 nt, synthetic construct
  misc_feature 1..27: note = derived and/or modified sequence opt6 from anti-influenza_CDR
  source 1..27: mol_type = other RNA
agttcggatgtgggtgggtataattat

SEQ ID NO: 52809 - RNA, 27 nt, synthetic construct
  misc_feature 1..27: note = derived and/or modified sequence opt6 from anti-influenza_CDR
  source 1..27: mol_type = other RNA
agttcggacgtgggtgattataattat

SEQ ID NO: 52810 - RNA, 27 nt, synthetic construct
  misc_feature 1..27: note = derived and/or modified sequence opt6 from anti-influenza_CDR
  source 1..27: mol_type = other RNA
caacaatacaacaactggccactatca

SEQ ID NO: 52811 - RNA, 27 nt, synthetic construct
  misc_feature 1..27: note = derived and/or modified sequence opt6 from anti-influenza_CDR
  source 1..27: mol_type = other RNA
caacaatcatacaactacccccgcacc

SEQ ID NO: 52812 - RNA, 27 nt, synthetic construct
  misc_feature 1..27: note = derived and/or modified sequence opt6 from anti-influenza_CDR
  source 1..27: mol_type = other RNA
atgcaaggactacaaacaccatacaca

SEQ ID NO: 52813 - RNA, 27 nt, synthetic construct
  misc_feature 1..27: note = derived and/or modified sequence opt6 from anti-influenza_CDR
  source 1..27: mol_type = other RNA
caacaacactactccatccccctcacc

SEQ ID NO: 52814 - RNA, 27 nt, synthetic construct
  misc_feature 1..27: note = derived and/or modified sequence opt6 from anti-influenza_CDR
  source 1..27: mol_type = other RNA
ctacaacacaattcatacccctggacc

SEQ ID NO: 52815 - RNA, 27 nt, synthetic construct
  misc_feature 1..27: note = derived and/or modified sequence opt6 from anti-influenza_CDR
  source 1..27: mol_type = other RNA
caacaatacaacacctggccactaaca

SEQ ID NO: 52816 - RNA, 27 nt, synthetic construct
  misc_feature 1..27: note = derived and/or modified sequence opt6 from anti-influenza_CDR
  source 1..27: mol_type = other RNA
caacaatacaactccttcccctaccgc

SEQ ID NO: 52817 - RNA, 27 nt, synthetic construct
  misc_feature 1..27: note = derived and/or modified sequence opt6 from anti-influenza_CDR
  source 1..27: mol_type = other RNA
caacaatcctattccgccccctttacc

SEQ ID NO: 52818 - RNA, 27 nt, synthetic construct
  misc_feature 1..27: note = derived and/or modified sequence opt6 from anti-influenza_CDR
  source 1..27: mol_type = other RNA
caagcatgggatagctcgacagtagta

SEQ ID NO: 52819 - RNA, 27 nt, synthetic construct
  misc_feature 1..27: note = derived and/or modified sequence opt6 from anti-influenza_CDR
  source 1..27: mol_type = other RNA
caagcatgggatagcacgacagtagta

SEQ ID NO: 52820 - RNA, 27 nt, synthetic construct
  misc_feature 1..27: note = derived and/or modified sequence opt6 from anti-influenza_CDR
  source 1..27: mol_type = other RNA
ttacaatatggctcaagtccgagaaca

SEQ ID NO: 52821 - RNA, 27 nt, synthetic construct
  misc_feature 1..27: note = derived and/or modified sequence opt6 from anti-influenza_CDR
  source 1..27: mol_type = other RNA
agttcggatgtgggtgggtatgattat

SEQ ID NO: 52822 - RNA, 27 nt, synthetic construct
  misc_feature 1..27: note = derived and/or modified sequence opt6 from anti-influenza_CDR
  source 1..27: mol_type = other RNA
caacaatacacatactggccactaaca

SEQ ID NO: 52823 - RNA, 27 nt, synthetic construct
  misc_feature 1..27: note = derived and/or modified sequence opt6 from anti-influenza_CDR
  source 1..27: mol_type = other RNA
caacaatacgataaatggccaccagga

SEQ ID NO: 52824 - RNA, 27 nt, synthetic construct
  misc_feature 1..27: note = derived and/or modified sequence opt6 from anti-influenza_CDR
  source 1..27: mol_type = other RNA
atgcaatctctccagacctctatcact

SEQ ID NO: 52825 - RNA, 27 nt, synthetic construct
  misc_feature 1..27: note = derived and/or modified sequence opt6 from anti-influenza_CDR
  source 1..27: mol_type = other RNA
agccagatagaactagcagtattacta

SEQ ID NO: 52826 - RNA, 27 nt, synthetic construct
  misc_feature 1..27: note = derived and/or modified sequence opt6 from anti-influenza_CDR
  source 1..27: mol_type = other RNA
atgcaagcactccaaaccccatacaca

SEQ ID NO: 52827 - RNA, 27 nt, synthetic construct
  misc_feature 1..27: note = derived and/or modified sequence opt6 from anti-influenza_CDR
  source 1..27: mol_type = other RNA
caacaaagatcacactggccaccaata

SEQ ID NO: 52828 - RNA, 27 nt, synthetic construct
  misc_feature 1..27: note = derived and/or modified sequence opt6 from anti-influenza_CDR
  source 1..27: mol_type = other RNA
caacatttctggggaactccattaaca

SEQ ID NO: 52829 - RNA, 27 nt, synthetic construct
  misc_feature 1..27: note = derived and/or modified sequence opt6 from anti-influenza_CDR
  source 1..27: mol_type = other RNA
caacaaaactatgaagacccatggaca

SEQ ID NO: 52830 - RNA, 27 nt, synthetic construct
  misc_feature 1..27: note = derived and/or modified sequence opt6 from anti-influenza_CDR
  source 1..27: mol_type = other RNA
caacaagccaactcattcccacccaca

SEQ ID NO: 52831 - RNA, 27 nt, synthetic construct
  misc_feature 1..27: note = derived and/or modified sequence opt6 from anti-influenza_CDR
  source 1..27: mol_type = other RNA
caacaaagagatcactggccaccaata

SEQ ID NO: 52832 - RNA, 27 nt, synthetic construct
  misc_feature 1..27: note = derived and/or modified sequence opt6 from anti-influenza_CDR
  source 1..27: mol_type = other RNA
atggatagtcgtttgaatttggttttt

SEQ ID NO: 52833 - RNA, 27 nt, synthetic construct
  misc_feature 1..27: note = derived and/or modified sequence opt6 from anti-influenza_CDR
  source 1..27: mol_type = other RNA
atgaaattgcccgtacgcttactcgta

SEQ ID NO: 52834 - RNA, 30 nt, synthetic construct
  misc_feature 1..30: note = derived and/or modified sequence opt6 from anti-influenza_CDR
  source 1..30: mol_type = other RNA
ggggatagtgtgacgagagggggattttat

SEQ ID NO: 52835 - RNA, 30 nt, synthetic construct
  misc_feature 1..30: note = derived and/or modified sequence opt6 from anti-influenza_CDR
  source 1..30: mol_type = other RNA
caatccgtcaccttcaacaacaaaaactac

SEQ ID NO: 52836 - RNA, 30 nt, synthetic construct
  misc_feature 1..30: note = derived and/or modified sequence opt6 from anti-influenza_CDR
  source 1..30: mol_type = other RNA
caatccgtcaccttcaactacaaaaactac

SEQ ID NO: 52837 - RNA, 30 nt, synthetic construct
  misc_feature 1..30: note = derived and/or modified sequence opt6 from anti-influenza_CDR
  source 1..30: mol_type = other RNA
cgcgctcaatctctctcttcctatctacat

SEQ ID NO: 52838 - RNA, 30 nt, synthetic construct
  misc_feature 1..30: note = derived and/or modified sequence opt6 from anti-influenza_CDR
  source 1..30: mol_type = other RNA
tcttcatacacatcttcatccacatacgtc

SEQ ID NO: 52839 - RNA, 30 nt, synthetic construct
  misc_feature 1..30: note = derived and/or modified sequence opt6 from anti-influenza_CDR
  source 1..30: mol_type = other RNA
caaagatacaactcagccccaccaataaca

SEQ ID NO: 52840 - RNA, 30 nt, synthetic construct
  misc_feature 1..30: note = derived and/or modified sequence opt6 from anti-influenza_CDR
  source 1..30: mol_type = other RNA
ggcgggagtataagttcgggaacgtattat

SEQ ID NO: 52841 - RNA, 30 nt, synthetic construct
  misc_feature 1..30: note = derived and/or modified sequence opt6 from anti-influenza_CDR
  source 1..30: mol_type = other RNA
caacaatcctactcctcactcatgttcaca

SEQ ID NO: 52842 - RNA, 30 nt, synthetic construct
  misc_feature 1..30: note = derived and/or modified sequence opt6 from anti-influenza_CDR
  source 1..30: mol_type = other RNA
ctattgatatatggcgcgagcacgagagca

SEQ ID NO: 52843 - RNA, 30 nt, synthetic construct
  misc_feature 1..30: note = derived and/or modified sequence opt6 from anti-influenza_CDR
  source 1..30: mol_type = other RNA
tgtgcgtatgggggtaagtatttggttgtg

SEQ ID NO: 52844 - RNA, 30 nt, synthetic construct
  misc_feature 1..30: note = derived and/or modified sequence opt6 from anti-influenza_CDR
  source 1..30: mol_type = other RNA
aggccagatttttatggcgattttgaatac

SEQ ID NO: 52845 - RNA, 30 nt, synthetic construct
  misc_feature 1..30: note = derived and/or modified sequence opt6 from anti-influenza_CDR
  source 1..30: mol_type = other RNA
caacactacggatattcacctagatatgca

SEQ ID NO: 52846 - RNA, 30 nt, synthetic construct
  misc_feature 1..30: note = derived and/or modified sequence opt6 from anti-influenza_CDR
  source 1..30: mol_type = other RNA
caacaaagatcacactggccaccaataaca

SEQ ID NO: 52847 - RNA, 30 nt, synthetic construct
  misc_feature 1..30: note = derived and/or modified sequence opt6 from anti-influenza_CDR
  source 1..30: mol_type = other RNA
agttcgtatgcgggttcgagtacgtgggtg

SEQ ID NO: 52848 - RNA, 30 nt, synthetic construct
  misc_feature 1..30: note = derived and/or modified sequence opt6 from anti-influenza_CDR
  source 1..30: mol_type = other RNA
ttattatattcaggtggagatccggttgca

SEQ ID NO: 52849 - RNA, 30 nt, synthetic construct
  misc_feature 1..30: note = derived and/or modified sequence opt6 from anti-influenza_CDR
  source 1..30: mol_type = other RNA
caacaatacggcggatcaccaagatataca

SEQ ID NO: 52850 - RNA, 30 nt, synthetic construct
  misc_feature 1..30: note = derived and/or modified sequence opt6 from anti-influenza_CDR
  source 1..30: mol_type = other RNA
aggtatgggagtgggtatgggtttgatagt

SEQ ID NO: 52851 - RNA, 30 nt, synthetic construct
  misc_feature 1..30: note = derived and/or modified sequence opt6 from anti-influenza_CDR
  source 1..30: mol_type = other RNA
agttcatacgcgggcaattataatcacgtg

SEQ ID NO: 52852 - RNA, 30 nt, synthetic construct
  misc_feature 1..30: note = derived and/or modified sequence opt6 from anti-influenza_CDR
  source 1..30: mol_type = other RNA
caacaatacataaactggcgaccactatca

SEQ ID NO: 52853 - RNA, 30 nt, synthetic construct
  misc_feature 1..30: note = derived and/or modified sequence opt6 from anti-influenza_CDR
  source 1..30: mol_type = other RNA
ataggtgcaggttatgatgtgcattggtat

SEQ ID NO: 52854 - RNA, 30 nt, synthetic construct
  misc_feature 1..30: note = derived and/or modified sequence opt6 from anti-influenza_CDR
  source 1..30: mol_type = other RNA
ctactaatatacgacaataacaacagaccc

SEQ ID NO: 52855 - RNA, 30 nt, synthetic construct
  misc_feature 1..30: note = derived and/or modified sequence opt6 from anti-influenza_CDR
  source 1..30: mol_type = other RNA
caatcatacgacaactcactatccggctcc

SEQ ID NO: 52856 - RNA, 30 nt, synthetic construct
  misc_feature 1..30: note = derived and/or modified sequence opt6 from anti-influenza_CDR
  source 1..30: mol_type = other RNA
ctactaatatacgacgcctcaaacctacaa

SEQ ID NO: 52857 - RNA, 30 nt, synthetic construct
  misc_feature 1..30: note = derived and/or modified sequence opt6 from anti-influenza_CDR
  source 1..30: mol_type = other RNA
ctattaatacatgacgctagcaatctagaa

SEQ ID NO: 52858 - RNA, 30 nt, synthetic construct
  misc_feature 1..30: note = derived and/or modified sequence opt6 from anti-influenza_CDR
  source 1..30: mol_type = other RNA
gtgcagaggttaagttatgggatggatgta

SEQ ID NO: 52859 - RNA, 30 nt, synthetic construct
  misc_feature 1..30: note = derived and/or modified sequence opt6 from anti-influenza_CDR
  source 1..30: mol_type = other RNA
gtgcaaaagagttattacgggatggatgta

SEQ ID NO: 52860 - RNA, 30 nt, synthetic construct
  misc_feature 1..30: note = derived and/or modified sequence opt6 from anti-influenza_CDR
  source 1..30: mol_type = other RNA
tcttcatacacatcttcatccacacatgtc

SEQ ID NO: 52861 - RNA, 30 nt, synthetic construct
  misc_feature 1..30: note = derived and/or modified sequence opt6 from anti-influenza_CDR
  source 1..30: mol_type = other RNA
agttcatacacgagctcgagcacgctcgtg

SEQ ID NO: 52862 - RNA, 30 nt, synthetic construct
  misc_feature 1..30: note = derived and/or modified sequence opt6 from anti-influenza_CDR
  source 1..30: mol_type = other RNA
accaaacgatcacaacaaaccgtaatccca

SEQ ID NO: 52863 - RNA, 30 nt, synthetic construct
  misc_feature 1..30: note = derived and/or modified sequence opt6 from anti-influenza_CDR
  source 1..30: mol_type = other RNA
acctcacgatcacaacaaaccgtaatccca

SEQ ID NO: 52864 - RNA, 30 nt, synthetic construct
  misc_feature 1..30: note = derived and/or modified sequence opt6 from anti-influenza_CDR
  source 1..30: mol_type = other RNA
tcatctaactataaccgccgattcacacct

SEQ ID NO: 52865 - RNA, 30 nt, synthetic construct
  misc_feature 1..30: note = derived and/or modified sequence opt6 from anti-influenza_CDR
  source 1..30: mol_type = other RNA
agaccgaaagtaagagatcaagaaagcaga

SEQ ID NO: 52866 - RNA, 30 nt, synthetic construct
  misc_feature 1..30: note = derived and/or modified sequence opt6 from anti-influenza_CDR
  source 1..30: mol_type = other RNA
aggccgtgggtaagaggagtaagtagtaga

SEQ ID NO: 52867 - RNA, 30 nt, synthetic construct
  misc_feature 1..30: note = derived and/or modified sequence opt6 from anti-influenza_CDR
  source 1..30: mol_type = other RNA
aggccgtgggtaagaggattaagtagtaga

SEQ ID NO: 52868 - RNA, 30 nt, synthetic construct
  misc_feature 1..30: note = derived and/or modified sequence opt6 from anti-influenza_CDR
  source 1..30: mol_type = other RNA
agaccgaaagtaagaggacaagcaggaaga

SEQ ID NO: 52869 - RNA, 30 nt, synthetic construct
  misc_feature 1..30: note = derived and/or modified sequence opt6 from anti-influenza_CDR
  source 1..30: mol_type = other RNA
gcaccagcagtagcagcacaagcatcagca

SEQ ID NO: 52870 - RNA, 30 nt, synthetic construct
  misc_feature 1..30: note = derived and/or modified sequence opt6 from anti-influenza_CDR
  source 1..30: mol_type = other RNA
gtacaccatccaggaacagataacgatcaa

SEQ ID NO: 52871 - RNA, 30 nt, synthetic construct
  misc_feature 1..30: note = derived and/or modified sequence opt6 from anti-influenza_CDR
  source 1..30: mol_type = other RNA
ttcggacaagggacaaaagtagaaataaaa

SEQ ID NO: 52872 - RNA, 30 nt, synthetic construct
  misc_feature 1..30: note = derived and/or modified sequence opt6 from anti-influenza_CDR
  source 1..30: mol_type = other RNA
ggatttgcatttcataatagagctatgcat

SEQ ID NO: 52873 - RNA, 30 nt, synthetic construct
  misc_feature 1..30: note = derived and/or modified sequence opt6 from anti-influenza_CDR
  source 1..30: mol_type = other RNA
ggtcttactttttcttcttatgctgttcat

SEQ ID NO: 52874 - RNA, 30 nt, synthetic construct
  misc_feature 1..30: note = derived and/or modified sequence opt6 from anti-influenza_CDR
  source 1..30: mol_type = other RNA
ggtcctactttttcttcttatgctgttcat

SEQ ID NO: 52875 - RNA, 30 nt, synthetic construct
  misc_feature 1..30: note = derived and/or modified sequence opt6 from anti-influenza_CDR
  source 1..30: mol_type = other RNA
ggctctatattttcaaattacggcatatct

SEQ ID NO: 52876 - RNA, 30 nt, synthetic construct
  misc_feature 1..30: note = derived and/or modified sequence opt6 from anti-influenza_CDR
  source 1..30: mol_type = other RNA
ggatacagctttaacaattacggaataaat

SEQ ID NO: 52877 - RNA, 30 nt, synthetic construct
  misc_feature 1..30: note = derived and/or modified sequence opt6 from anti-influenza_CDR
  source 1..30: mol_type = other RNA
ggctatacatttaacgcttactatatacat

SEQ ID NO: 52878 - RNA, 30 nt, synthetic construct
  misc_feature 1..30: note = derived and/or modified sequence opt6 from anti-influenza_CDR
  source 1..30: mol_type = other RNA
ggctatacatttacatctttcattatgtat

SEQ ID NO: 52879 - RNA, 30 nt, synthetic construct
  misc_feature 1..30: note = derived and/or modified sequence opt6 from anti-influenza_CDR
  source 1..30: mol_type = other RNA
aggggtaattatgggaatgggtttgcgtat

SEQ ID NO: 52880 - RNA, 30 nt, synthetic construct
  misc_feature 1..30: note = derived and/or modified sequence opt6 from anti-influenza_CDR
  source 1..30: mol_type = other RNA
caacaatacggaagctcaccagcactaaca

SEQ ID NO: 52881 - RNA, 30 nt, synthetic construct
  misc_feature 1..30: note = derived and/or modified sequence opt6 from anti-influenza_CDR
  source 1..30: mol_type = other RNA
caagaatacaacaacgacagcccactaaca

SEQ ID NO: 52882 - RNA, 30 nt, synthetic construct
  misc_feature 1..30: note = derived and/or modified sequence opt6 from anti-influenza_CDR
  source 1..30: mol_type = other RNA
ataagatcaggattaaacagattcgagaca

SEQ ID NO: 52883 - RNA, 30 nt, synthetic construct
  misc_feature 1..30: note = derived and/or modified sequence opt6 from anti-influenza_CDR
  source 1..30: mol_type = other RNA
gtcttctattccggttcatctaactataat

SEQ ID NO: 52884 - RNA, 30 nt, synthetic construct
  misc_feature 1..30: note = derived and/or modified sequence opt6 from anti-influenza_CDR
  source 1..30: mol_type = other RNA
ggagcgagtataagtacgggcgggaattat

SEQ ID NO: 52885 - RNA, 30 nt, synthetic construct
  misc_feature 1..30: note = derived and/or modified sequence opt6 from anti-influenza_CDR
  source 1..30: mol_type = other RNA
atattctactccggcacaaccaaatacaac

SEQ ID NO: 52886 - RNA, 30 nt, synthetic construct
  misc_feature 1..30: note = derived and/or modified sequence opt6 from anti-influenza_CDR
  source 1..30: mol_type = other RNA
gcttcatatgccggtacatatatacatcta

SEQ ID NO: 52887 - RNA, 30 nt, synthetic construct
  misc_feature 1..30: note = derived and/or modified sequence opt6 from anti-influenza_CDR
  source 1..30: mol_type = other RNA
caacaactcaactcctacccccccatcacc

SEQ ID NO: 52888 - RNA, 30 nt, synthetic construct
  misc_feature 1..30: note = derived and/or modified sequence opt6 from anti-influenza_CDR
  source 1..30: mol_type = other RNA
caacaatttaacgactggccattcctaaca

SEQ ID NO: 52889 - RNA, 30 nt, synthetic construct
  misc_feature 1..30: note = derived and/or modified sequence opt6 from anti-influenza_CDR
  source 1..30: mol_type = other RNA
caacaactcaccacatacccccccataacc

SEQ ID NO: 52890 - RNA, 30 nt, synthetic construct
  misc_feature 1..30: note = derived and/or modified sequence opt6 from anti-influenza_CDR
  source 1..30: mol_type = other RNA
ggaggaagtataagtaatgggggatatcat

SEQ ID NO: 52891 - RNA, 30 nt, synthetic construct
  misc_feature 1..30: note = derived and/or modified sequence opt6 from anti-influenza_CDR
  source 1..30: mol_type = other RNA
ggcgattcagttatcaattcagcttactat

SEQ ID NO: 52892 - RNA, 30 nt, synthetic construct
  misc_feature 1..30: note = derived and/or modified sequence opt6 from anti-influenza_CDR
  source 1..30: mol_type = other RNA
caacaatacgacaactggctaccaataaca

SEQ ID NO: 52893 - RNA, 30 nt, synthetic construct
  misc_feature 1..30: note = derived and/or modified sequence opt6 from anti-influenza_CDR
  source 1..30: mol_type = other RNA
gctggagattatagtggaggtatatatgca

SEQ ID NO: 52894 - RNA, 30 nt, synthetic construct
  misc_feature 1..30: note = derived and/or modified sequence opt6 from anti-influenza_CDR
  source 1..30: mol_type = other RNA
gcaggagattatagtggaagtaattatgca

SEQ ID NO: 52895 - RNA, 30 nt, synthetic construct
  misc_feature 1..30: note = derived and/or modified sequence opt6 from anti-influenza_CDR
  source 1..30: mol_type = other RNA
gcaggagattattcaggagcaaattatgca

SEQ ID NO: 52896 - RNA, 30 nt, synthetic construct
  misc_feature 1..30: note = derived and/or modified sequence opt6 from anti-influenza_CDR
  source 1..30: mol_type = other RNA
ggcctaagtctatactcaaacgaaatcaat

SEQ ID NO: 52897 - RNA, 30 nt, synthetic construct
  misc_feature 1..30: note = derived and/or modified sequence opt6 from anti-influenza_CDR
  source 1..30: mol_type = other RNA
gcttcatatgcaggtaataatatatatgta

SEQ ID NO: 52898 - RNA, 30 nt, synthetic construct
  misc_feature 1..30: note = derived and/or modified sequence opt6 from anti-influenza_CDR
  source 1..30: mol_type = other RNA
gcatctcaatctgtatctacatttctagct

SEQ ID NO: 52899 - RNA, 30 nt, synthetic construct
  misc_feature 1..30: note = derived and/or modified sequence opt6 from anti-influenza_CDR
  source 1..30: mol_type = other RNA
ataaaaagcaatacagacggcggaacaaca

SEQ ID NO: 52900 - RNA, 30 nt, synthetic construct
  misc_feature 1..30: note = derived and/or modified sequence opt6 from anti-influenza_CDR
  source 1..30: mol_type = other RNA
gagtcggtggatatatacgggaatagtttt

SEQ ID NO: 52901 - RNA, 30 nt, synthetic construct
  misc_feature 1..30: note = derived and/or modified sequence opt6 from anti-influenza_CDR
  source 1..30: mol_type = other RNA
gagtctatagatatatacggaaattcattt

SEQ ID NO: 52902 - RNA, 30 nt, synthetic construct
  misc_feature 1..30: note = derived and/or modified sequence opt6 from anti-influenza_CDR
  source 1..30: mol_type = other RNA
gcaggagattatagtggagtaaattatgca

SEQ ID NO: 52903 - RNA, 33 nt, synthetic construct
  misc_feature 1..33: note = derived and/or modified sequence opt6 from anti-influenza_CDR
  source 1..33: mol_type = other RNA
gcagcatgggatgacagtttaaatggacaatta

SEQ ID NO: 52904 - RNA, 33 nt, synthetic construct
  misc_feature 1..33: note = derived and/or modified sequence opt6 from anti-influenza_CDR
  source 1..33: mol_type = other RNA
tgtagttatgcgggtagtagtagtagtagggtt

SEQ ID NO: 52905 - RNA, 33 nt, synthetic construct
  misc_feature 1..33: note = derived and/or modified sequence opt6 from anti-influenza_CDR
  source 1..33: mol_type = other RNA
ctagtactagcaacaggactaagaaactcacca

SEQ ID NO: 52906 - RNA, 33 nt, synthetic construct
  misc_feature 1..33: note = derived and/or modified sequence opt6 from anti-influenza_CDR
  source 1..33: mol_type = other RNA
caatcattactacattcagacggcaaaacctat

SEQ ID NO: 52907 - RNA, 33 nt, synthetic construct
  misc_feature 1..33: note = derived and/or modified sequence opt6 from anti-influenza_CDR
  source 1..33: mol_type = other RNA
cgcacatcccaatccctatcctcatacctacac

SEQ ID NO: 52908 - RNA, 33 nt, synthetic construct
  misc_feature 1..33: note = derived and/or modified sequence opt6 from anti-influenza_CDR
  source 1..33: mol_type = other RNA
cgcgcaagccaacgcctaaactcatacttacac

SEQ ID NO: 52909 - RNA, 33 nt, synthetic construct
  misc_feature 1..33: note = derived and/or modified sequence opt6 from anti-influenza_CDR
  source 1..33: mol_type = other RNA
cgcacatctcaatccctacgctcatacctacac

SEQ ID NO: 52910 - RNA, 33 nt, synthetic construct
  misc_feature 1..33: note = derived and/or modified sequence opt6 from anti-influenza_CDR
  source 1..33: mol_type = other RNA
cgcacatctcaatccctatcctcatacacacac

SEQ ID NO: 52911 - RNA, 33 nt, synthetic construct
  misc_feature 1..33: note = derived and/or modified sequence opt6 from anti-influenza_CDR
  source 1..33: mol_type = other RNA
cgcacatcccaatccctatcctcatacgaccac

SEQ ID NO: 52912 - RNA, 33 nt, synthetic construct
  misc_feature 1..33: note = derived and/or modified sequence opt6 from anti-influenza_CDR
  source 1..33: mol_type = other RNA
caagtgtgggatagctcgagcgatcactatgta

SEQ ID NO: 52913 - RNA, 33 nt, synthetic construct
  misc_feature 1..33: note = derived and/or modified sequence opt6 from anti-influenza_CDR
  source 1..33: mol_type = other RNA
caagtgtgggggagttcgagtgatcattatgta

SEQ ID NO: 52914 - RNA, 33 nt, synthetic construct
  misc_feature 1..33: note = derived and/or modified sequence opt6 from anti-influenza_CDR
  source 1..33: mol_type = other RNA
gggacgtgggatagtagtttaagtgtagggatg

SEQ ID NO: 52915 - RNA, 33 nt, synthetic construct
  misc_feature 1..33: note = derived and/or modified sequence opt6 from anti-influenza_CDR
  source 1..33: mol_type = other RNA
caatcattactacacggaaacggatataactat

SEQ ID NO: 52916 - RNA, 33 nt, synthetic construct
  misc_feature 1..33: note = derived and/or modified sequence opt6 from anti-influenza_CDR
  source 1..33: mol_type = other RNA
agagcaagtcagggaataagaaatgacttagga

SEQ ID NO: 52917 - RNA, 33 nt, synthetic construct
  misc_feature 1..33: note = derived and/or modified sequence opt6 from anti-influenza_CDR
  source 1..33: mol_type = other RNA
cgcgcaagccagaacatacgctcatacttaaac

SEQ ID NO: 52918 - RNA, 33 nt, synthetic construct
  misc_feature 1..33: note = derived and/or modified sequence opt6 from anti-influenza_CDR
  source 1..33: mol_type = other RNA
agagcaaatcaagacataggaatatacctaaac

SEQ ID NO: 52919 - RNA, 33 nt, synthetic construct
  misc_feature 1..33: note = derived and/or modified sequence opt6 from anti-influenza_CDR
  source 1..33: mol_type = other RNA
agagcaagccaaagcgtaagcaataacttagcc

SEQ ID NO: 52920 - RNA, 33 nt, synthetic construct
  misc_feature 1..33: note = derived and/or modified sequence opt6 from anti-influenza_CDR
  source 1..33: mol_type = other RNA
caacaataccacaactggccaccatcatactca

SEQ ID NO: 52921 - RNA, 33 nt, synthetic construct
  misc_feature 1..33: note = derived and/or modified sequence opt6 from anti-influenza_CDR
  source 1..33: mol_type = other RNA
agagcaagccaaggaatactaaattgcttagca

SEQ ID NO: 52922 - RNA, 33 nt, synthetic construct
  misc_feature 1..33: note = derived and/or modified sequence opt6 from anti-influenza_CDR
  source 1..33: mol_type = other RNA
agggcaagtcaatcaatagcaagttggttagca

SEQ ID NO: 52923 - RNA, 33 nt, synthetic construct
  misc_feature 1..33: note = derived and/or modified sequence opt6 from anti-influenza_CDR
  source 1..33: mol_type = other RNA
gccccacgcgtatacgaatactatttcgatcaa

SEQ ID NO: 52924 - RNA, 33 nt, synthetic construct
  misc_feature 1..33: note = derived and/or modified sequence opt6 from anti-influenza_CDR
  source 1..33: mol_type = other RNA
agagcaagccaaagcgtaagctcatacttagcc

SEQ ID NO: 52925 - RNA, 33 nt, synthetic construct
  misc_feature 1..33: note = derived and/or modified sequence opt6 from anti-influenza_CDR
  source 1..33: mol_type = other RNA
agcggagacgcactaccaaaacaaaatgcatac

SEQ ID NO: 52926 - RNA, 33 nt, synthetic construct
  misc_feature 1..33: note = derived and/or modified sequence opt6 from anti-influenza_CDR
  source 1..33: mol_type = other RNA
caaagtgcagatagtagtggaacaagttgggta

SEQ ID NO: 52927 - RNA, 33 nt, synthetic construct
  misc_feature 1..33: note = derived and/or modified sequence opt6 from anti-influenza_CDR
  source 1..33: mol_type = other RNA
ggagggagtaatatagggggaaagagtgtgcat

SEQ ID NO: 52928 - RNA, 33 nt, synthetic construct
  misc_feature 1..33: note = derived and/or modified sequence opt6 from anti-influenza_CDR
  source 1..33: mol_type = other RNA
caacactatggatcttcacctagatatgcattt

SEQ ID NO: 52929 - RNA, 33 nt, synthetic construct
  misc_feature 1..33: note = derived and/or modified sequence opt6 from anti-influenza_CDR
  source 1..33: mol_type = other RNA
cgcgcatcccaatccatatcctcatacctaaac

SEQ ID NO: 52930 - RNA, 33 nt, synthetic construct
  misc_feature 1..33: note = derived and/or modified sequence opt6 from anti-influenza_CDR
  source 1..33: mol_type = other RNA
ggagggaacgcgatagggagcaagaaagtgcat

SEQ ID NO: 52931 - RNA, 33 nt, synthetic construct
  misc_feature 1..33: note = derived and/or modified sequence opt6 from anti-influenza_CDR
  source 1..33: mol_type = other RNA
caagtgtgggatttcacgattgatcatgtggtc

SEQ ID NO: 52932 - RNA, 33 nt, synthetic construct
  misc_feature 1..33: note = derived and/or modified sequence opt6 from anti-influenza_CDR
  source 1..33: mol_type = other RNA
gcgacttgggatggaagtttaagtgcatgggta

SEQ ID NO: 52933 - RNA, 33 nt, synthetic construct
  misc_feature 1..33: note = derived and/or modified sequence opt6 from anti-influenza_CDR
  source 1..33: mol_type = other RNA
agagcaagtcaaagtgtaggcaattacttagcc

SEQ ID NO: 52934 - RNA, 33 nt, synthetic construct
  misc_feature 1..33: note = derived and/or modified sequence opt6 from anti-influenza_CDR
  source 1..33: mol_type = other RNA
caacaaagatctaaatggccacctatgtattca

SEQ ID NO: 52935 - RNA, 33 nt, synthetic construct
  misc_feature 1..33: note = derived and/or modified sequence opt6 from anti-influenza_CDR
  source 1..33: mol_type = other RNA
gatgtatctacaacttggtcttggtttgcacct

SEQ ID NO: 52936 - RNA, 33 nt, synthetic construct
  misc_feature 1..33: note = derived and/or modified sequence opt6 from anti-influenza_CDR
  source 1..33: mol_type = other RNA
agagcaagccaaaacataaaaagatacttcaac

SEQ ID NO: 52937 - RNA, 33 nt, synthetic construct
  misc_feature 1..33: note = derived and/or modified sequence opt6 from anti-influenza_CDR
  source 1..33: mol_type = other RNA
agagcaagccaaagcgtaggaaatagcttagca

SEQ ID NO: 52938 - RNA, 33 nt, synthetic construct
  misc_feature 1..33: note = derived and/or modified sequence opt6 from anti-influenza_CDR
  source 1..33: mol_type = other RNA
ggtgaatctacactttcatattacgctgtatct

SEQ ID NO: 52939 - RNA, 33 nt, synthetic construct
  misc_feature 1..33: note = derived and/or modified sequence opt6 from anti-influenza_CDR
  source 1..33: mol_type = other RNA
cgcgcaagccaaaacatatacaaatacctaaac

SEQ ID NO: 52940 - RNA, 33 nt, synthetic construct
  misc_feature 1..33: note = derived and/or modified sequence opt6 from anti-influenza_CDR
  source 1..33: mol_type = other RNA
gctagttgtagtggtggttattgtattttagat

SEQ ID NO: 52941 - RNA, 33 nt, synthetic construct
  misc_feature 1..33: note = derived and/or modified sequence opt6 from anti-influenza_CDR
  source 1..33: mol_type = other RNA
cgcacatcccaatccatatcctcatacctaaac

SEQ ID NO: 52942 - RNA, 33 nt, synthetic construct
  misc_feature 1..33: note = derived and/or modified sequence opt6 from anti-influenza_CDR
  source 1..33: mol_type = other RNA
cgcgcaagtcagagtataggcgcatacgtaaac

SEQ ID NO: 52943 - RNA, 33 nt, synthetic construct
  misc_feature 1..33: note = derived and/or modified sequence opt6 from anti-influenza_CDR
  source 1..33: mol_type = other RNA
cgcgcatcccaatccatatccacatacctaaac

SEQ ID NO: 52944 - RNA, 33 nt, synthetic construct
  misc_feature 1..33: note = derived and/or modified sequence opt6 from anti-influenza_CDR
  source 1..33: mol_type = other RNA
cgcgcatctcaatctatagacaaattcctaaat

SEQ ID NO: 52945 - RNA, 33 nt, synthetic construct
  misc_feature 1..33: note = derived and/or modified sequence opt6 from anti-influenza_CDR
  source 1..33: mol_type = other RNA
ggcgggcataatatagggagtaatagtgtgcat

SEQ ID NO: 52946 - RNA, 33 nt, synthetic construct
  misc_feature 1..33: note = derived and/or modified sequence opt6 from anti-influenza_CDR
  source 1..33: mol_type = other RNA
cgcgcatctcaatccatatccacatacctacac

SEQ ID NO: 52947 - RNA, 33 nt, synthetic construct
  misc_feature 1..33: note = derived and/or modified sequence opt6 from anti-influenza_CDR
  source 1..33: mol_type = other RNA
catgtgggcgggcatacgtatgggattgattat

SEQ ID NO: 52948 - RNA, 33 nt, synthetic construct
  misc_feature 1..33: note = derived and/or modified sequence opt6 from anti-influenza_CDR
  source 1..33: mol_type = other RNA
cgcgcaagccagagcataagcaattacttaaac

SEQ ID NO: 52949 - RNA, 33 nt, synthetic construct
  misc_feature 1..33: note = derived and/or modified sequence opt6 from anti-influenza_CDR
  source 1..33: mol_type = other RNA
cacgatgacgcaagtcatggatatagtataagc

SEQ ID NO: 52950 - RNA, 33 nt, synthetic construct
  misc_feature 1..33: note = derived and/or modified sequence opt6 from anti-influenza_CDR
  source 1..33: mol_type = other RNA
cgcgcatcccaaaccatatccacatacctaaac

SEQ ID NO: 52951 - RNA, 33 nt, synthetic construct
  misc_feature 1..33: note = derived and/or modified sequence opt6 from anti-influenza_CDR
  source 1..33: mol_type = other RNA
cgcgcatctcaatctatatccagatatctaaat

SEQ ID NO: 52952 - RNA, 33 nt, synthetic construct
  misc_feature 1..33: note = derived and/or modified sequence opt6 from anti-influenza_CDR
  source 1..33: mol_type = other RNA
gggacttgggatagtagtttaagtgcatatgta

SEQ ID NO: 52953 - RNA, 33 nt, synthetic construct
  misc_feature 1..33: note = derived and/or modified sequence opt6 from anti-influenza_CDR
  source 1..33: mol_type = other RNA
agctcgaactattacgatagcgtgtacgattac

SEQ ID NO: 52954 - RNA, 33 nt, synthetic construct
  misc_feature 1..33: note = derived and/or modified sequence opt6 from anti-influenza_CDR
  source 1..33: mol_type = other RNA
gcagcctgggacgatatattaaatgtaccagta

SEQ ID NO: 52955 - RNA, 33 nt, synthetic construct
  misc_feature 1..33: note = derived and/or modified sequence opt6 from anti-influenza_CDR
  source 1..33: mol_type = other RNA
gtggcttgggatgatagtgtagatggatatgta

SEQ ID NO: 52956 - RNA, 33 nt, synthetic construct
  misc_feature 1..33: note = derived and/or modified sequence opt6 from anti-influenza_CDR
  source 1..33: mol_type = other RNA
gggcctaaatattatagtgaatatatggacgta

SEQ ID NO: 52957 - RNA, 33 nt, synthetic construct
  misc_feature 1..33: note = derived and/or modified sequence opt6 from anti-influenza_CDR
  source 1..33: mol_type = other RNA
agagcaagtcaaggcataagttcatacttagcc

SEQ ID NO: 52958 - RNA, 33 nt, synthetic construct
  misc_feature 1..33: note = derived and/or modified sequence opt6 from anti-influenza_CDR
  source 1..33: mol_type = other RNA
tcaagcggttactatccagaatactttcaagat

SEQ ID NO: 52959 - RNA, 33 nt, synthetic construct
  misc_feature 1..33: note = derived and/or modified sequence opt6 from anti-influenza_CDR
  source 1..33: mol_type = other RNA
agcgggcataaattaggggataagtatgtgagt

SEQ ID NO: 52960 - RNA, 33 nt, synthetic construct
  misc_feature 1..33: note = derived and/or modified sequence opt6 from anti-influenza_CDR
  source 1..33: mol_type = other RNA
tcaaccggatattatcccgcctacctacaccac

SEQ ID NO: 52961 - RNA, 33 nt, synthetic construct
  misc_feature 1..33: note = derived and/or modified sequence opt6 from anti-influenza_CDR
  source 1..33: mol_type = other RNA
cgtgcatctcaacgtgtatcttcatatttagcc

SEQ ID NO: 52962 - RNA, 33 nt, synthetic construct; identical to SEQ ID NO: 51855
  misc_feature 1..33: note = derived and/or modified sequence opt6 from anti-influenza_CDR
  source 1..33: mol_type = other RNA

SEQ ID NO: 52963 - RNA, 33 nt, synthetic construct
  misc_feature 1..33: note = derived and/or modified sequence opt6 from anti-influenza_CDR
  source 1..33: mol_type = other RNA
caagtgtgggatagctcgagcgatcacgcggta

SEQ ID NO: 52964 - RNA, 33 nt, synthetic construct
  misc_feature 1..33: note = derived and/or modified sequence opt6 from anti-influenza_CDR
  source 1..33: mol_type = other RNA
gcaacatgggacgataatttaagtggaccagta

SEQ ID NO: 52965 - RNA, 33 nt, synthetic construct
  misc_feature 1..33: note = derived and/or modified sequence opt6 from anti-influenza_CDR
  source 1..33: mol_type = other RNA
tcatccggctattatcctgcctatttacctcat

SEQ ID NO: 52966 - RNA, 33 nt, synthetic construct
  misc_feature 1..33: note = derived and/or modified sequence opt6 from anti-influenza_CDR
  source 1..33: mol_type = other RNA
ggagggaataatatagggagtaagggagtgcat

SEQ ID NO: 52967 - RNA, 33 nt, synthetic construct
  misc_feature 1..33: note = derived and/or modified sequence opt6 from anti-influenza_CDR
  source 1..33: mol_type = other RNA
caagtgtgggatagctcgagcgatcacgtggta

SEQ ID NO: 52968 - RNA, 33 nt, synthetic construct
  misc_feature 1..33: note = derived and/or modified sequence opt6 from anti-influenza_CDR
  source 1..33: mol_type = other RNA
ggcaattactattacgagagctcgctcgattat

SEQ ID NO: 52969 - RNA, 33 nt, synthetic construct
  misc_feature 1..33: note = derived and/or modified sequence opt6 from anti-influenza_CDR
  source 1..33: mol_type = other RNA
ggacctcactattactcttcatatatggatgta

SEQ ID NO: 52970 - RNA, 33 nt, synthetic construct
  misc_feature 1..33: note = derived and/or modified sequence opt6 from anti-influenza_CDR
  source 1..33: mol_type = other RNA
agagcaagtcaaggcataagtacatacttagcc

SEQ ID NO: 52971 - RNA, 33 nt, synthetic construct
  misc_feature 1..33: note = derived and/or modified sequence opt6 from anti-influenza_CDR
  source 1..33: mol_type = other RNA
ggacctacatattactattcatatatggatgta

SEQ ID NO: 52972 - RNA, 33 nt, synthetic construct
  misc_feature 1..33: note = derived and/or modified sequence opt6 from anti-influenza_CDR
  source 1..33: mol_type = other RNA
ggagggaacaatatagggagaaatagcgtgcac

SEQ ID NO: 52973 - RNA, 33 nt, synthetic construct
  misc_feature 1..33: note = derived and/or modified sequence opt6 from anti-influenza_CDR
  source 1..33: mol_type = other RNA
caagtttggcattcatcttcagatcactatgtc

SEQ ID NO: 52974 - RNA, 33 nt, synthetic construct
  misc_feature 1..33: note = derived and/or modified sequence opt6 from anti-influenza_CDR
  source 1..33: mol_type = other RNA
tcatccggctactacccccaatactttcaagac

SEQ ID NO: 52975 - RNA, 33 nt, synthetic construct
  misc_feature 1..33: note = derived and/or modified sequence opt6 from anti-influenza_CDR
  source 1..33: mol_type = other RNA
cgtgcatctcaatctgtatctagatatttagct

SEQ ID NO: 52976 - RNA, 33 nt, synthetic construct
  misc_feature 1..33: note = derived and/or modified sequence opt6 from anti-influenza_CDR
  source 1..33: mol_type = other RNA
tggggacaagggacaacattaacagtaagtagt

SEQ ID NO: 52977 - RNA, 33 nt, synthetic construct
  misc_feature 1..33: note = derived and/or modified sequence opt6 from anti-influenza_CDR
  source 1..33: mol_type = other RNA
agagcaagccaatcagtagactcaaacttagca

SEQ ID NO: 52978 - RNA, 33 nt, synthetic construct
  misc_feature 1..33: note = derived and/or modified sequence opt6 from anti-influenza_CDR
  source 1..33: mol_type = other RNA
cgtgcatcccaatccgtatctcataatttagcc

SEQ ID NO: 52979 - RNA, 33 nt, synthetic construct
  misc_feature 1..33: note = derived and/or modified sequence opt6 from anti-influenza_CDR
  source 1..33: mol_type = other RNA
cgtgcatctcaatctgtatcttcaaatttagcc

SEQ ID NO: 52980 - RNA, 33 nt, synthetic construct
  misc_feature 1..33: note = derived and/or modified sequence opt6 from anti-influenza_CDR
  source 1..33: mol_type = other RNA
agagcaagccaatcagtagaccataacttagca

SEQ ID NO: 52981 - RNA, 33 nt, synthetic construct
  misc_feature 1..33: note = derived and/or modified sequence opt6 from anti-influenza_CDR
  source 1..33: mol_type = other RNA
caacactacacaaactggccaccaagactaaca

SEQ ID NO: 52982 - RNA, 33 nt, synthetic construct
  misc_feature 1..33: note = derived and/or modified sequence opt6 from anti-influenza_CDR
  source 1..33: mol_type = other RNA
caacactacacaaactaccccccccgcctaacc

SEQ ID NO: 52983 - RNA, 33 nt, synthetic construct
  misc_feature 1..33: note = derived and/or modified sequence opt6 from anti-influenza_CDR
  source 1..33: mol_type = other RNA
caacactacacaaacttccccccccgcctaacc

SEQ ID NO: 52984 - RNA, 33 nt, synthetic construct
  misc_feature 1..33: note = derived and/or modified sequence opt6 from anti-influenza_CDR
  source 1..33: mol_type = other RNA
cgtgcatctcaagtcatatctcacaatctagcc

SEQ ID NO: 52985 - RNA, 33 nt, synthetic construct
  misc_feature 1..33: note = derived and/or modified sequence opt6 from anti-influenza_CDR
  source 1..33: mol_type = other RNA
caacattactcaaactggccacccagactaaca

SEQ ID NO: 52986 - RNA, 33 nt, synthetic construct
  misc_feature 1..33: note = derived and/or modified sequence opt6 from anti-influenza_CDR
  source 1..33: mol_type = other RNA
caacactactcaaacttccccccccgcctaacc

SEQ ID NO: 52987 - RNA, 33 nt, synthetic construct
  misc_feature 1..33: note = derived and/or modified sequence opt6 from anti-influenza_CDR
  source 1..33: mol_type = other RNA
caacactactcaaactaccccccccgcctaacc

SEQ ID NO: 52988 - RNA, 33 nt, synthetic construct
  misc_feature 1..33: note = derived and/or modified sequence opt6 from anti-influenza_CDR
  source 1..33: mol_type = other RNA
cgtgcatctcaatctgtagctaataatttagcc

SEQ ID NO: 52989 - RNA, 33 nt, synthetic construct
  misc_feature 1..33: note = derived and/or modified sequence opt6 from anti-influenza_CDR
  source 1..33: mol_type = other RNA
caacaatacaacaactggccaccaatgtacaca

SEQ ID NO: 52990 - RNA, 33 nt, synthetic construct
  misc_feature 1..33: note = derived and/or modified sequence opt6 from anti-influenza_CDR
  source 1..33: mol_type = other RNA
agggcaagtcaaagtataggaaattggttagca

SEQ ID NO: 52991 - RNA, 33 nt, synthetic construct
  misc_feature 1..33: note = derived and/or modified sequence opt6 from anti-influenza_CDR
  source 1..33: mol_type = other RNA
caaagatacacatcaaactcacaaggcttcaca

SEQ ID NO: 52992 - RNA, 33 nt, synthetic construct
  misc_feature 1..33: note = derived and/or modified sequence opt6 from anti-influenza_CDR
  source 1..33: mol_type = other RNA
gcagcatgggatgatacattaaatggaccagta

SEQ ID NO: 52993 - RNA, 33 nt, synthetic construct
  misc_feature 1..33: note = derived and/or modified sequence opt6 from anti-influenza_CDR
  source 1..33: mol_type = other RNA
aaagcaagccaaaacgtaggatcaaacgtagca

SEQ ID NO: 52994 - RNA, 33 nt, synthetic construct
  misc_feature 1..33: note = derived and/or modified sequence opt6 from anti-influenza_CDR
  source 1..33: mol_type = other RNA
caggtgtgggatatgagtagtgatagaagggta

SEQ ID NO: 52995 - RNA, 33 nt, synthetic construct
  misc_feature 1..33: note = derived and/or modified sequence opt6 from anti-influenza_CDR
  source 1..33: mol_type = other RNA
caatcactcctacactcaaacggctataactat

SEQ ID NO: 52996 - RNA, 33 nt, synthetic construct
  misc_feature 1..33: note = derived and/or modified sequence opt6 from anti-influenza_CDR
  source 1..33: mol_type = other RNA
acatatttagtaggagcagtaggatttcaacac

SEQ ID NO: 52997 - RNA, 33 nt, synthetic construct; identical to SEQ ID NO: 51908
  misc_feature 1..33: note = derived and/or modified sequence opt6 from anti-influenza_CDR
  source 1..33: mol_type = other RNA

SEQ ID NO: 52998 - RNA, 33 nt, synthetic construct
  misc_feature 1..33: note = derived and/or modified sequence opt6 from anti-influenza_CDR
  source 1..33: mol_type = other RNA
caaagcctattagacagcaatggctataactat

SEQ ID NO: 52999 - RNA, 33 nt, synthetic construct
  misc_feature 1..33: note = derived and/or modified sequence opt6 from anti-influenza_CDR
  source 1..33: mol_type = other RNA
atgcaagcactccaaaccccacccatgtacaca

SEQ ID NO: 53000 - RNA, 33 nt, synthetic construct
  misc_feature 1..33: note = derived and/or modified sequence opt6 from anti-influenza_CDR
  source 1..33: mol_type = other RNA
caatcactactacactcaaacggctacaaccac

SEQ ID NO: 53001 - RNA, 33 nt, synthetic construct
  misc_feature 1..33: note = derived and/or modified sequence opt6 from anti-influenza_CDR
  source 1..33: mol_type = other RNA
caagtgtgggatataacgagcgatttagtggta

SEQ ID NO: 53002 - RNA, 33 nt, synthetic construct
  misc_feature 1..33: note = derived and/or modified sequence opt6 from anti-influenza_CDR
  source 1..33: mol_type = other RNA
agagcaagtcaagacataagtacatggttagca

SEQ ID NO: 53003 - RNA, 33 nt, synthetic construct
  misc_feature 1..33: note = derived and/or modified sequence opt6 from anti-influenza_CDR
  source 1..33: mol_type = other RNA
cgtgcatctagatctataactacatttctagct

SEQ ID NO: 53004 - RNA, 33 nt, synthetic construct
  misc_feature 1..33: note = derived and/or modified sequence opt6 from anti-influenza_CDR
  source 1..33: mol_type = other RNA
ggttggggtgcagttacaagtccgtttgatttt

SEQ ID NO: 53005 - RNA, 33 nt, synthetic construct
  misc_feature 1..33: note = derived and/or modified sequence opt6 from anti-influenza_CDR
  source 1..33: mol_type = other RNA
cgcgcttcccaatccgtttcctcttcctatctc

SEQ ID NO: 53006 - RNA, 36 nt, synthetic construct
  misc_feature 1..36: note = derived and/or modified sequence opt6 from anti-influenza_CDR
  source 1..36: mol_type = other RNA
caatccgtcctctactcctcaaacaacaaaaactac

SEQ ID NO: 53007 - RNA, 36 nt, synthetic construct
  misc_feature 1..36: note = derived and/or modified sequence opt6 from anti-influenza_CDR
  source 1..36: mol_type = other RNA
gcggcatgggatgatagtttaagtggaagttgggta

SEQ ID NO: 53008 - RNA, 36 nt, synthetic construct
  misc_feature 1..36: note = derived and/or modified sequence opt6 from anti-influenza_CDR
  source 1..36: mol_type = other RNA
gtattttactctgcagatagaacttcatatgcagat

SEQ ID NO: 53009 - RNA, 36 nt, synthetic construct
  misc_feature 1..36: note = derived and/or modified sequence opt6 from anti-influenza_CDR
  source 1..36: mol_type = other RNA
agagtaggacaaagcgtaagcggaagccatctagca

SEQ ID NO: 53010 - RNA, 36 nt, synthetic construct
  misc_feature 1..36: note = derived and/or modified sequence opt6 from anti-influenza_CDR
  source 1..36: mol_type = other RNA
acactatcatccgcctactcaaattacaaagtcgac

SEQ ID NO: 53011 - RNA, 36 nt, synthetic construct
  misc_feature 1..36: note = derived and/or modified sequence opt6 from anti-influenza_CDR
  source 1..36: mol_type = other RNA
gtggggacgggagggatagtgggaagtaaaggggat

SEQ ID NO: 53012 - RNA, 36 nt, synthetic construct
  misc_feature 1..36: note = derived and/or modified sequence opt6 from anti-influenza_CDR
  source 1..36: mol_type = other RNA
agatattcacgttcatctccaggtacatttgaatct

SEQ ID NO: 53013 - RNA, 36 nt, synthetic construct
  misc_feature 1..36: note = derived and/or modified sequence opt6 from anti-influenza_CDR
  source 1..36: mol_type = other RNA
caatcttatgattcttctctttctggttttcatgtt

SEQ ID NO: 53014 - RNA, 36 nt, synthetic construct
  misc_feature 1..36: note = derived and/or modified sequence opt6 from anti-influenza_CDR
  source 1..36: mol_type = other RNA
cgagcaagccaaagcgtaagctcaagccaactagca

SEQ ID NO: 53015 - RNA, 36 nt, synthetic construct
  misc_feature 1..36: note = derived and/or modified sequence opt6 from anti-influenza_CDR
  source 1..36: mol_type = other RNA
cgagcaagccaattcgtaagcacacgctcactagca

SEQ ID NO: 53016 - RNA, 36 nt, synthetic construct
  misc_feature 1..36: note = derived and/or modified sequence opt6 from anti-influenza_CDR
  source 1..36: mol_type = other RNA
gcgacatgggatgatagtttaaatggattttatgta

SEQ ID NO: 53017 - RNA, 36 nt, synthetic construct
  misc_feature 1..36: note = derived and/or modified sequence opt6 from anti-influenza_CDR
  source 1..36: mol_type = other RNA
cgagctagccatttcgttaactatcgctcactagct

SEQ ID NO: 53018 - RNA, 36 nt, synthetic construct
  misc_feature 1..36: note = derived and/or modified sequence opt6 from anti-influenza_CDR
  source 1..36: mol_type = other RNA
agagcaagccatttcgtaataggaagagcagtagca

SEQ ID NO: 53019 - RNA, 36 nt, synthetic construct
  misc_feature 1..36: note = derived and/or modified sequence opt6 from anti-influenza_CDR
  source 1..36: mol_type = other RNA
aggatatatcatgggggaaatagtggatttgatttt

SEQ ID NO: 53020 - RNA, 36 nt, synthetic construct
  misc_feature 1..36: note = derived and/or modified sequence opt6 from anti-influenza_CDR
  source 1..36: mol_type = other RNA
acactatcatccggatttgacaattatcaagtagcc

SEQ ID NO: 53021 - RNA, 36 nt, synthetic construct
  misc_feature 1..36: note = derived and/or modified sequence opt6 from anti-influenza_CDR
  source 1..36: mol_type = other RNA
gtagggaatgggggaaatgtggcgagtaagggagat

SEQ ID NO: 53022 - RNA, 36 nt, synthetic construct
  misc_feature 1..36: note = derived and/or modified sequence opt6 from anti-influenza_CDR
  source 1..36: mol_type = other RNA
gtaaggggagggagtacggtagcgtattttggagtg

SEQ ID NO: 53023 - RNA, 36 nt, synthetic construct
  misc_feature 1..36: note = derived and/or modified sequence opt6 from anti-influenza_CDR
  source 1..36: mol_type = other RNA
tgtttgagtaggatgagggggtatgggttggatgtg

SEQ ID NO: 53024 - RNA, 36 nt, synthetic construct
  misc_feature 1..36: note = derived and/or modified sequence opt6 from anti-influenza_CDR
  source 1..36: mol_type = other RNA
gtaggacagatggataaatattatgcaatggatgta

SEQ ID NO: 53025 - RNA, 36 nt, synthetic construct
  misc_feature 1..36: note = derived and/or modified sequence opt6 from anti-influenza_CDR
  source 1..36: mol_type = other RNA
ggagtaacaaacaaagtaaacagcataatagacaaa

SEQ ID NO: 53026 - RNA, 36 nt, synthetic construct
  misc_feature 1..36: note = derived and/or modified sequence opt6 from anti-influenza_CDR
  source 1..36: mol_type = other RNA
ggagtaacaaacaaagtaaacagaataatagacaaa

SEQ ID NO: 53027 - RNA, 36 nt, synthetic construct
  misc_feature 1..36: note = derived and/or modified sequence opt6 from anti-influenza_CDR
  source 1..36: mol_type = other RNA
ggagtaacaaacaaagaaaacagcataatagacaaa

SEQ ID NO: 53028 - RNA, 36 nt, synthetic construct
  misc_feature 1..36: note = derived and/or modified sequence opt6 from anti-influenza_CDR
  source 1..36: mol_type = other RNA
cctctaggtatacttcactattacgctatggatcta

SEQ ID NO: 53029 - RNA, 36 nt, synthetic construct
  misc_feature 1..36: note = derived and/or modified sequence opt6 from anti-influenza_CDR
  source 1..36: mol_type = other RNA
aaaataacaagcaaagtaaacaacatagtagacaaa

SEQ ID NO: 53030 - RNA, 36 nt, synthetic construct
  misc_feature 1..36: note = derived and/or modified sequence opt6 from anti-influenza_CDR
  source 1..36: mol_type = other RNA
ggaataacaaacaaagtaaacagcataatagacaaa

SEQ ID NO: 53031 - RNA, 36 nt, synthetic construct
  misc_feature 1..36: note = derived and/or modified sequence opt6 from anti-influenza_CDR
  source 1..36: mol_type = other RNA
aatgggagaagtagtacgagttggggaatagatgtg

SEQ ID NO: 53032 - RNA, 36 nt, synthetic construct
  misc_feature 1..36: note = derived and/or modified sequence opt6 from anti-influenza_CDR
  source 1..36: mol_type = other RNA
ggaataacaaacaaagaaaacagcgtaatagaaaaa

SEQ ID NO: 53033 - RNA, 36 nt, synthetic construct
  misc_feature 1..36: note = derived and/or modified sequence opt6 from anti-influenza_CDR
  source 1..36: mol_type = other RNA
cctttaggttcacgttattattatggtatggatgta

SEQ ID NO: 53034 - RNA, 36 nt, synthetic construct
  misc_feature 1..36: note = derived and/or modified sequence opt6 from anti-influenza_CDR
  source 1..36: mol_type = other RNA
gggataacgaacaaggtaaatagcgtgatagagaaa

SEQ ID NO: 53035 - RNA, 36 nt, synthetic construct
  misc_feature 1..36: note = derived and/or modified sequence opt6 from anti-influenza_CDR
  source 1..36: mol_type = other RNA
ggcgtaacaaacaaagtaaactcaataataaacaaa

SEQ ID NO: 53036 - RNA, 36 nt, synthetic construct
  misc_feature 1..36: note = derived and/or modified sequence opt6 from anti-influenza_CDR
  source 1..36: mol_type = other RNA
cacatgggctatcaagtaagagaaacaatggacgta

SEQ ID NO: 53037 - RNA, 36 nt, synthetic construct
  misc_feature 1..36: note = derived and/or modified sequence opt6 from anti-influenza_CDR
  source 1..36: mol_type = other RNA
gcaacatgggacagaagaccaacagcatatgtagta

SEQ ID NO: 53038 - RNA, 36 nt, synthetic construct
  misc_feature 1..36: note = derived and/or modified sequence opt6 from anti-influenza_CDR
  source 1..36: mol_type = other RNA
gaaggaaaatggggaccacaagcagcattcgatata

SEQ ID NO: 53039 - RNA, 36 nt, synthetic construct
  misc_feature 1..36: note = derived and/or modified sequence opt6 from anti-influenza_CDR
  source 1..36: mol_type = other RNA
ggagataaagggatatattactattatatggacgtg

SEQ ID NO: 53040 - RNA, 36 nt, synthetic construct
  misc_feature 1..36: note = derived and/or modified sequence opt6 from anti-influenza_CDR
  source 1..36: mol_type = other RNA
ggttccggttatcatatttctactccttttgataat

SEQ ID NO: 53041 - RNA, 36 nt, synthetic construct
  misc_feature 1..36: note = derived and/or modified sequence opt6 from anti-influenza_CDR
  source 1..36: mol_type = other RNA
cgagcaagccagagcgtaagctcaagctatctagca

SEQ ID NO: 53042 - RNA, 36 nt, synthetic construct
  misc_feature 1..36: note = derived and/or modified sequence opt6 from anti-influenza_CDR
  source 1..36: mol_type = other RNA
ggatctggatatacaactagaaattactttgactat

SEQ ID NO: 53043 - RNA, 36 nt, synthetic construct
  misc_feature 1..36: note = derived and/or modified sequence opt6 from anti-influenza_CDR
  source 1..36: mol_type = other RNA
agagcaagccagagcgtaagctcaaactatctagga

SEQ ID NO: 53044 - RNA, 36 nt, synthetic construct
  misc_feature 1..36: note = derived and/or modified sequence opt6 from anti-influenza_CDR
  source 1..36: mol_type = other RNA
ggatctacatatgacttttcatctggacttgattat

SEQ ID NO: 53045 - RNA, 36 nt, synthetic construct
  misc_feature 1..36: note = derived and/or modified sequence opt6 from anti-influenza_CDR
  source 1..36: mol_type = other RNA
ggagtacaccatccaggaacagataacgatcaaata

SEQ ID NO: 53046 - RNA, 36 nt, synthetic construct
  misc_feature 1..36: note = derived and/or modified sequence opt6 from anti-influenza_CDR
  source 1..36: mol_type = other RNA
ggcgtacaccatccatcaacagattcagatcaaaca

SEQ ID NO: 53047 - RNA, 36 nt, synthetic construct
  misc_feature 1..36: note = derived and/or modified sequence opt6 from anti-influenza_CDR
  source 1..36: mol_type = other RNA
ggagtacaccacccatcaaacgaaacagaacaaaga

SEQ ID NO: 53048 - RNA, 36 nt, synthetic construct
  misc_feature 1..36: note = derived and/or modified sequence opt6 from anti-influenza_CDR
  source 1..36: mol_type = other RNA
caatcaatcacattcgactacaaaaactacctcgcc

SEQ ID NO: 53049 - RNA, 36 nt, synthetic construct
  misc_feature 1..36: note = derived and/or modified sequence opt6 from anti-influenza_CDR
  source 1..36: mol_type = other RNA
ggagggttaatagggacgggaagttattattggggg

SEQ ID NO: 53050 - RNA, 36 nt, synthetic construct
  misc_feature 1..36: note = derived and/or modified sequence opt6 from anti-influenza_CDR
  source 1..36: mol_type = other RNA
gctagatataactggggaattagatatttcgatttc

SEQ ID NO: 53051 - RNA, 36 nt, synthetic construct
  misc_feature 1..36: note = derived and/or modified sequence opt6 from anti-influenza_CDR
  source 1..36: mol_type = other RNA
caatcagtcctctcaaactccaaaaacctaaactac

SEQ ID NO: 53052 - RNA, 36 nt, synthetic construct
  misc_feature 1..36: note = derived and/or modified sequence opt6 from anti-influenza_CDR
  source 1..36: mol_type = other RNA
tgtcaggtttgggagacaagtgaagatttatgggta

SEQ ID NO: 53053 - RNA, 39 nt, synthetic construct
  misc_feature 1..39: note = derived and/or modified sequence opt6 from anti-influenza_CDR
  source 1..39: mol_type = other RNA
gctagaggtggacgttattatgtagattattttgattat

SEQ ID NO: 53054 - RNA, 39 nt, synthetic construct
  misc_feature 1..39: note = derived and/or modified sequence opt6 from anti-influenza_CDR
  source 1..39: mol_type = other RNA
gctagatctggcgatggctataattattactttccattg

SEQ ID NO: 53055 - RNA, 39 nt, synthetic construct
  misc_feature 1..39: note = derived and/or modified sequence opt6 from anti-influenza_CDR
  source 1..39: mol_type = other RNA
gcgcgtgggtgtgggtataattgttattattttgatggg

SEQ ID NO: 53056 - RNA, 39 nt, synthetic construct
  misc_feature 1..39: note = derived and/or modified sequence opt6 from anti-influenza_CDR
  source 1..39: mol_type = other RNA
agcggaagctcaagcaatataggaagcaatacagtaaac

SEQ ID NO: 53057 - RNA, 39 nt, synthetic construct
  misc_feature 1..39: note = derived and/or modified sequence opt6 from anti-influenza_CDR
  source 1..39: mol_type = other RNA
gattctccttattcttcttcttggtctttttttgattat

SEQ ID NO: 53058 - RNA, 39 nt, synthetic construct
  misc_feature 1..39: note = derived and/or modified sequence opt6 from anti-influenza_CDR
  source 1..39: mol_type = other RNA
agcgggagtgatagtaatataggggactatttcgtgtgc

SEQ ID NO: 53059 - RNA, 39 nt, synthetic construct
  misc_feature 1..39: note = derived and/or modified sequence opt6 from anti-influenza_CDR
  source 1..39: mol_type = other RNA
gcgagaatggtagtggtaacgggagatggatttgatgtg

SEQ ID NO: 53060 - RNA, 39 nt, synthetic construct
  misc_feature 1..39: note = derived and/or modified sequence opt6 from anti-influenza_CDR
  source 1..39: mol_type = other RNA
tggctaagtataataaatgcgggagggggagatatagat

SEQ ID NO: 53061 - RNA, 39 nt, synthetic construct
  misc_feature 1..39: note = derived and/or modified sequence opt6 from anti-influenza_CDR
  source 1..39: mol_type = other RNA
gcagcctcatcattacaatcaggagtaccatcaagattt

SEQ ID NO: 53062 - RNA, 39 nt, synthetic construct
  misc_feature 1..39: note = derived and/or modified sequence opt6 from anti-influenza_CDR
  source 1..39: mol_type = other RNA
catgatgctaaattttctggttcttattatgttgcttct

SEQ ID NO: 53063 - RNA, 39 nt, synthetic construct
  misc_feature 1..39: note = derived and/or modified sequence opt6 from anti-influenza_CDR
  source 1..39: mol_type = other RNA
catgatgttaaattttctggttcttattatgttgcttct

SEQ ID NO: 53064 - RNA, 39 nt, synthetic construct
  misc_feature 1..39: note = derived and/or modified sequence opt6 from anti-influenza_CDR
  source 1..39: mol_type = other RNA
acaggaagtgaaagtacaacaggatacggaatggatgta

SEQ ID NO: 53065 - RNA, 39 nt, synthetic construct
  misc_feature 1..39: note = derived and/or modified sequence opt6 from anti-influenza_CDR
  source 1..39: mol_type = other RNA
gcagcaagtacaagtgtattaggatatggaatggatgta

SEQ ID NO: 53066 - RNA, 39 nt, synthetic construct
  misc_feature 1..39: note = derived and/or modified sequence opt6 from anti-influenza_CDR
  source 1..39: mol_type = other RNA
tcaggatcaacatttaatataggatcaaacgcagtagac

SEQ ID NO: 53067 - RNA, 39 nt, synthetic construct
  misc_feature 1..39: note = derived and/or modified sequence opt6 from anti-influenza_CDR
  source 1..39: mol_type = other RNA
tctggatctagatctaatgttggagataactctgtatat

SEQ ID NO: 53068 - RNA, 39 nt, synthetic construct
  misc_feature 1..39: note = derived and/or modified sequence opt6 from anti-influenza_CDR
  source 1..39: mol_type = other RNA
tccggatcttcatctaatatcggaaatgattatgtatct

SEQ ID NO: 53069 - RNA, 39 nt, synthetic construct
  misc_feature 1..39: note = derived and/or modified sequence opt6 from anti-influenza_CDR
  source 1..39: mol_type = other RNA
gggggagggagttatggggcgtatgagggatttgattat

SEQ ID NO: 53070 - RNA, 39 nt, synthetic construct
  misc_feature 1..39: note = derived and/or modified sequence opt6 from anti-influenza_CDR
  source 1..39: mol_type = other RNA
tccggatcttcatctaatattggatctaattatgtatat

SEQ ID NO: 53071 - RNA, 39 nt, synthetic construct
  misc_feature 1..39: note = derived and/or modified sequence opt6 from anti-influenza_CDR
  source 1..39: mol_type = other RNA
gccagaagacaacaactatacaaaggatactaccaccat

SEQ ID NO: 53072 - RNA, 39 nt, synthetic construct
  misc_feature 1..39: note = derived and/or modified sequence opt6 from anti-influenza_CDR
  source 1..39: mol_type = other RNA
tccggatctacatctaatattggatataaccctgtatct

SEQ ID NO: 53073 - RNA, 39 nt, synthetic construct
  misc_feature 1..39: note = derived and/or modified sequence opt6 from anti-influenza_CDR
  source 1..39: mol_type = other RNA
gctagaggtatgaattactatagtgattactttgactat

SEQ ID NO: 53074 - RNA, 39 nt, synthetic construct
  misc_feature 1..39: note = derived and/or modified sequence opt6 from anti-influenza_CDR
  source 1..39: mol_type = other RNA
gctagaggtcattctggttcttatcgtttatttgatttt

SEQ ID NO: 53075 - RNA, 39 nt, synthetic construct
  misc_feature 1..39: note = derived and/or modified sequence opt6 from anti-influenza_CDR
  source 1..39: mol_type = other RNA
gcaaaaccattaagaggtagctatagatatttcgatcta

SEQ ID NO: 53076 - RNA, 39 nt, synthetic construct
  misc_feature 1..39: note = derived and/or modified sequence opt6 from anti-influenza_CDR
  source 1..39: mol_type = other RNA
ccaatatgggtaaaaacaccactaaaactagcaaacgga

SEQ ID NO: 53077 - RNA, 39 nt, synthetic construct
  misc_feature 1..39: note = derived and/or modified sequence opt6 from anti-influenza_CDR
  source 1..39: mol_type = other RNA
caagcatcccaatcagtatacaacaaaaacaacctagcc

SEQ ID NO: 53078 - RNA, 39 nt, synthetic construct
  misc_feature 1..39: note = derived and/or modified sequence opt6 from anti-influenza_CDR
  source 1..39: mol_type = other RNA
caatcatccgaatcagtatacaaaaacaacaacctagcc

SEQ ID NO: 53079 - RNA, 39 nt, synthetic construct
  misc_feature 1..39: note = derived and/or modified sequence opt6 from anti-influenza_CDR
  source 1..39: mol_type = other RNA
caatcatcccaatcagtcgactcaaacaaccaactatca

SEQ ID NO: 53080 - RNA, 39 nt, synthetic construct
  misc_feature 1..39: note = derived and/or modified sequence opt6 from anti-influenza_CDR
  source 1..39: mol_type = other RNA
caaagctcacaatcagtcgacaacaataaagacctagca

SEQ ID NO: 53081 - RNA, 39 nt, synthetic construct
  misc_feature 1..39: note = derived and/or modified sequence opt6 from anti-influenza_CDR
  source 1..39: mol_type = other RNA
caatcatcccaatccgtatacaacaacaaccgcctatcc

SEQ ID NO: 53082 - RNA, 39 nt, synthetic construct
  misc_feature 1..39: note = derived and/or modified sequence opt6 from anti-influenza_CDR
  source 1..39: mol_type = other RNA
caatcatcccaatcagtctacaaaaacaacaacctagcc

SEQ ID NO: 53083 - RNA, 39 nt, synthetic construct
  misc_feature 1..39: note = derived and/or modified sequence opt6 from anti-influenza_CDR
  source 1..39: mol_type = other RNA
gggggagggtttgggtggagtcagacgtattttggatat

SEQ ID NO: 53084 - RNA, 42 nt, synthetic construct
  misc_feature 1..42: note = derived and/or modified sequence opt6 from anti-influenza_CDR
  source 1..42: mol_type = other RNA
tggctagggagaacgtattatagatcgaaatggtataatgac

SEQ ID NO: 53085 - RNA, 42 nt, synthetic construct
  misc_feature 1..42: note = derived and/or modified sequence opt6 from anti-influenza_CDR
  source 1..42: mol_type = other RNA
gggggtttggttgggggttatgatgagtatttttttgattat

SEQ ID NO: 53086 - RNA, 42 nt, synthetic construct
  misc_feature 1..42: note = derived and/or modified sequence opt6 from anti-influenza_CDR
  source 1..42: mol_type = other RNA
catcctaaatatttttatggttctggttcttatcctgatttt

SEQ ID NO: 53087 - RNA, 42 nt, synthetic construct
  misc_feature 1..42: note = derived and/or modified sequence opt6 from anti-influenza_CDR
  source 1..42: mol_type = other RNA
acgggttcgagttcggatgtgggtgcgagtaatagtgtgagt

SEQ ID NO: 53088 - RNA, 42 nt, synthetic construct
  misc_feature 1..42: note = derived and/or modified sequence opt6 from anti-influenza_CDR
  source 1..42: mol_type = other RNA
ggtgcatattacgattcatctggatatccagctttctatata

SEQ ID NO: 53089 - RNA, 42 nt, synthetic construct
  misc_feature 1..42: note = derived and/or modified sequence opt6 from anti-influenza_CDR
  source 1..42: mol_type = other RNA
acaggttcgagttcgaatataggttcggattatgatgtgcat

SEQ ID NO: 53090 - RNA, 42 nt, synthetic construct
  misc_feature 1..42: note = derived and/or modified sequence opt6 from anti-influenza_CDR
  source 1..42: mol_type = other RNA
gaatttgaaacctcaggctatttccatggctcatttgattat

SEQ ID NO: 53091 - RNA, 42 nt, synthetic construct
  misc_feature 1..42: note = derived and/or modified sequence opt6 from anti-influenza_CDR
  source 1..42: mol_type = other RNA
gcatcttcaaccggagccgtaacttcatcttactttccaaat

SEQ ID NO: 53092 - RNA, 42 nt, synthetic construct
  misc_feature 1..42: note = derived and/or modified sequence opt6 from anti-influenza_CDR
  source 1..42: mol_type = other RNA
acgggagggagttcggatataggagcgagtaatagtgtgagt

SEQ ID NO: 53093 - RNA, 42 nt, synthetic construct
  misc_feature 1..42: note = derived and/or modified sequence opt6 from anti-influenza_CDR
  source 1..42: mol_type = other RNA
acgggttcgagttcggatgtgggtgggtatgattatgtgagt

SEQ ID NO: 53094 - RNA, 42 nt, synthetic construct
  misc_feature 1..42: note = derived and/or modified sequence opt6 from anti-influenza_CDR
  source 1..42: mol_type = other RNA
ggatcaagtacaggagcagtaacaagaggacactatccatat

SEQ ID NO: 53095 - RNA, 42 nt, synthetic construct
  misc_feature 1..42: note = derived and/or modified sequence opt6 from anti-influenza_CDR
  source 1..42: mol_type = other RNA
ggatcatcaacaggaccagtaacatcaggacattacccatat

SEQ ID NO: 53096 - RNA, 42 nt, synthetic construct
  misc_feature 1..42: note = derived and/or modified sequence opt6 from anti-influenza_CDR
  source 1..42: mol_type = other RNA
cactatggagattcagaagcaataaatgacgcatttgacata

SEQ ID NO: 53097 - RNA, 42 nt, synthetic construct
  misc_feature 1..42: note = derived and/or modified sequence opt6 from anti-influenza_CDR
  source 1..42: mol_type = other RNA
acaggttcgagttcgaatataggtgcgggttatgatgtgcat

SEQ ID NO: 53098 - RNA, 42 nt, synthetic construct
  misc_feature 1..42: note = derived and/or modified sequence opt6 from anti-influenza_CDR
  source 1..42: mol_type = other RNA
attcctcattataattttggttctggttcttattttgattat

SEQ ID NO: 53099 - RNA, 42 nt, synthetic construct
  misc_feature 1..42: note = derived and/or modified sequence opt6 from anti-influenza_CDR
  source 1..42: mol_type = other RNA
acgggtacgagttcggatgtgggtgggtataattatgtgagt

SEQ ID NO: 53100 - RNA, 42 nt, synthetic construct
  misc_feature 1..42: note = derived and/or modified sequence opt6 from anti-influenza_CDR
  source 1..42: mol_type = other RNA
acgggtacgagttcggatgtgggtgcgtataattatgtgagt

SEQ ID NO: 53101 - RNA, 42 nt, synthetic construct
  misc_feature 1..42: note = derived and/or modified sequence opt6 from anti-influenza_CDR
  source 1..42: mol_type = other RNA
gcagaaagaccaaaagtaagaggacaagcaggaagaatgaat

SEQ ID NO: 53102 - RNA, 42 nt, synthetic construct
  misc_feature 1..42: note = derived and/or modified sequence opt6 from anti-influenza_CDR
  source 1..42: mol_type = other RNA
ggaagtaggccgtgggtaagaggagtaagtagtagaataagt

SEQ ID NO: 53103 - RNA, 42 nt, synthetic construct
  misc_feature 1..42: note = derived and/or modified sequence opt6 from anti-influenza_CDR
  source 1..42: mol_type = other RNA
atatggggagtagcagcaccaggaacagcagcagcacaaata

SEQ ID NO: 53104 - RNA, 42 nt, synthetic construct
  misc_feature 1..42: note = derived and/or modified sequence opt6 from anti-influenza_CDR
  source 1..42: mol_type = other RNA
tgggtaagacaaccaccaggaaaaggattagaatgggtagca

SEQ ID NO: 53105 - RNA, 42 nt, synthetic construct
  misc_feature 1..42: note = derived and/or modified sequence opt6 from anti-influenza_CDR
  source 1..42: mol_type = other RNA
gcaagagggccagaaggagtatggggaagatcaatagatagt

SEQ ID NO: 53106 - RNA, 42 nt, synthetic construct
  misc_feature 1..42: note = derived and/or modified sequence opt6 from anti-influenza_CDR
  source 1..42: mol_type = other RNA
gcacgagatccagatacaccattcgtacgagcattcgatagc

SEQ ID NO: 53107 - RNA, 42 nt, synthetic construct
  misc_feature 1..42: note = derived and/or modified sequence opt6 from anti-influenza_CDR
  source 1..42: mol_type = other RNA
acaggttcaacttcagatataggttcatataactatgtatct

SEQ ID NO: 53108 - RNA, 42 nt, synthetic construct
  misc_feature 1..42: note = derived and/or modified sequence opt6 from anti-influenza_CDR
  source 1..42: mol_type = other RNA
tgggattggaattttgatttatatttaggttggtttgatcct

SEQ ID NO: 53109 - RNA, 42 nt, synthetic construct
  misc_feature 1..42: note = derived and/or modified sequence opt6 from anti-influenza_CDR
  source 1..42: mol_type = other RNA
tgggcttggaattttgatttttttttaggttggtttgatcct

SEQ ID NO: 53110 - RNA, 42 nt, synthetic construct
  misc_feature 1..42: note = derived and/or modified sequence opt6 from anti-influenza_CDR
  source 1..42: mol_type = other RNA
ggtccaggttatagtggatatcattatggatggtttgataca

SEQ ID NO: 53111 - RNA, 42 nt, synthetic construct
  misc_feature 1..42: note = derived and/or modified sequence opt6 from anti-influenza_CDR
  source 1..42: mol_type = other RNA
gcgagatgggactatggagtgtatgagggatatatagattat

SEQ ID NO: 53112 - RNA, 45 nt, synthetic construct
  misc_feature 1..45: note = derived and/or modified sequence opt6 from anti-influenza_CDR
  source 1..45: mol_type = other RNA
gcaagagcaggaacaacattaacaagatttaactggtttgaccca

SEQ ID NO: 53113 - RNA, 45 nt, synthetic construct
  misc_feature 1..45: note = derived and/or modified sequence opt6 from anti-influenza_CDR
  source 1..45: mol_type = other RNA
gcaagagcaggaacaacagtaacaagatttaattggtttgaccca

SEQ ID NO: 53114 - RNA, 45 nt, synthetic construct
  misc_feature 1..45: note = derived and/or modified sequence opt6 from anti-influenza_CDR
  source 1..45: mol_type = other RNA
gcgagagggcaaaggtactattatgatagagatggaatggacgtg

SEQ ID NO: 53115 - RNA, 45 nt, synthetic construct
  misc_feature 1..45: note = derived and/or modified sequence opt6 from anti-influenza_CDR
  source 1..45: mol_type = other RNA
gcaagatcaggcggatatctaccacaaaataactggatagaccca

SEQ ID NO: 53116 - RNA, 45 nt, synthetic construct
  misc_feature 1..45: note = derived and/or modified sequence opt6 from anti-influenza_CDR
  source 1..45: mol_type = other RNA
atggaaaacgaaagaacactagacttccatgactcaaacgtaaaa

SEQ ID NO: 53117 - RNA, 45 nt, synthetic construct
  misc_feature 1..45: note = derived and/or modified sequence opt6 from anti-influenza_CDR
  source 1..45: mol_type = other RNA
ggagctgatcatggaagtggaagtaattttgtaagtccatatgta

SEQ ID NO: 53118 - RNA, 45 nt, synthetic construct
  misc_feature 1..45: note = derived and/or modified sequence opt6 from anti-influenza_CDR
  source 1..45: mol_type = other RNA
gatacaagaagctcactagataactatcaatatggaatggacgta

SEQ ID NO: 53119 - RNA, 45 nt, synthetic construct
  misc_feature 1..45: note = derived and/or modified sequence opt6 from anti-influenza_CDR
  source 1..45: mol_type = other RNA
gaagattatgatatattaacaggagcaggaccgggaatggaagta

SEQ ID NO: 53120 - RNA, 45 nt, synthetic construct
  misc_feature 1..45: note = derived and/or modified sequence opt6 from anti-influenza_CDR
  source 1..45: mol_type = other RNA
catccatatgatgttttaactggatctggagattggtttgatcct

SEQ ID NO: 53121 - RNA, 45 nt, synthetic construct
  misc_feature 1..45: note = derived and/or modified sequence opt6 from anti-influenza_CDR
  source 1..45: mol_type = other RNA
ggagctgatcatggaagtggaaataattttgtaagtccatatgta

SEQ ID NO: 53122 - RNA, 45 nt, synthetic construct
  misc_feature 1..45: note = derived and/or modified sequence opt6 from anti-influenza_CDR
  source 1..45: mol_type = other RNA
gtaatatatagcggaggatcgacatattatgcagactcagtaaaa

SEQ ID NO: 53123 - RNA, 45 nt, synthetic construct
  misc_feature 1..45: note = derived and/or modified sequence opt6 from anti-influenza_CDR
  source 1..45: mol_type = other RNA
tggtaccaacaaaaaccaggaaaagcaccaaaactactaatatac

SEQ ID NO: 53124 - RNA, 45 nt, synthetic construct
  misc_feature 1..45: note = derived and/or modified sequence opt6 from anti-influenza_CDR
  source 1..45: mol_type = other RNA
gatccatataacgacggaacaaaatataacgaaaaatttgaagga

SEQ ID NO: 53125 - RNA, 45 nt, synthetic construct
  misc_feature 1..45: note = derived and/or modified sequence opt6 from anti-influenza_CDR
  source 1..45: mol_type = other RNA
gcaagagcacatacagctctaactagatttagatggctagatcca

SEQ ID NO: 53126 - RNA, 45 nt, synthetic construct
  misc_feature 1..45: note = derived and/or modified sequence opt6 from anti-influenza_CDR
  source 1..45: mol_type = other RNA
gcatctctagattacgatttctcttactattaccatagagatgta

SEQ ID NO: 53127 - RNA, 45 nt, synthetic construct
  misc_feature 1..45: note = derived and/or modified sequence opt6 from anti-influenza_CDR
  source 1..45: mol_type = other RNA
gctagagttgcaactccatattattatgaatctggatttgactat

SEQ ID NO: 53128 - RNA, 45 nt, synthetic construct
  misc_feature 1..45: note = derived and/or modified sequence opt6 from anti-influenza_CDR
  source 1..45: mol_type = other RNA
gcgagaaggggagggggatggcaatattattatggaatggatgtg

SEQ ID NO: 53129 - RNA, 48 nt, synthetic construct
  misc_feature 1..48: note = derived and/or modified sequence opt6 from anti-influenza_CDR
  source 1..48: mol_type = other RNA
tctggacatataactgtatttggagttaatgttgacgcttttgatatg

SEQ ID NO: 53130 - RNA, 48 nt, synthetic construct
  misc_feature 1..48: note = derived and/or modified sequence opt6 from anti-influenza_CDR
  source 1..48: mol_type = other RNA
ggaggacatataacagtattcggactaaatatagacgcatatgatata

SEQ ID NO: 53131 - RNA, 48 nt, synthetic construct
  misc_feature 1..48: note = derived and/or modified sequence opt6 from anti-influenza_CDR
  source 1..48: mol_type = other RNA
ggaggacacataacagaattcggactaaatatagacgcatatgacata

SEQ ID NO: 53132 - RNA, 48 nt, synthetic construct
  misc_feature 1..48: note = derived and/or modified sequence opt6 from anti-influenza_CDR
  source 1..48: mol_type = other RNA
ggaggacatataacagtatttggagtaaatatagacgcatttgatata

SEQ ID NO: 53133 - RNA, 48 nt, synthetic construct
  misc_feature 1..48: note = derived and/or modified sequence opt6 from anti-influenza_CDR
  source 1..48: mol_type = other RNA
ggaggacatataacagtatttggagtaaatatagatgcatttgatgta

SEQ ID NO: 53134 - RNA, 48 nt, synthetic construct
  misc_feature 1..48: note = derived and/or modified sequence opt6 from anti-influenza_CDR
  source 1..48: mol_type = other RNA
gcaagagatggctggggacaacaattagtaccatattattttgattat

SEQ ID NO: 53135 - RNA, 48 nt, synthetic construct
  misc_feature 1..48: note = derived and/or modified sequence opt6 from anti-influenza_CDR
  source 1..48: mol_type = other RNA
gatttttgggtttcttattattatgattcttctgctcctcctgctatt

SEQ ID NO: 53136 - RNA, 48 nt, synthetic construct
  misc_feature 1..48: note = derived and/or modified sequence opt6 from anti-influenza_CDR
  source 1..48: mol_type = other RNA
gcaagagcaggagtaaaaatatttggattaatagtaggggcattagat

SEQ ID NO: 53137 - RNA, 48 nt, synthetic construct
  misc_feature 1..48: note = derived and/or modified sequence opt6 from anti-influenza_CDR
  source 1..48: mol_type = other RNA
gcacgtgatggtgcaggttcatattatcctttaaattggtttgatcct

SEQ ID NO: 53138 - RNA, 48 nt, synthetic construct
  misc_feature 1..48: note = derived and/or modified sequence opt6 from anti-influenza_CDR
  source 1..48: mol_type = other RNA
gttatatattcgcatgggcgtgcgtattatagtgcaagtgtgaatggg

SEQ ID NO: 53139 - RNA, 48 nt, synthetic construct
  misc_feature 1..48: note = derived and/or modified sequence opt6 from anti-influenza_CDR
  source 1..48: mol_type = other RNA
gacacactacacaacggatacacaaactacaatccatcactaagagga

SEQ ID NO: 53140 - RNA, 48 nt, synthetic construct
  misc_feature 1..48: note = derived and/or modified sequence opt6 from anti-influenza_CDR
  source 1..48: mol_type = other RNA
tacatatcctacaacggccgcccaaaatacaacccatccctaacctca

SEQ ID NO: 53141 - RNA, 48 nt, synthetic construct
  misc_feature 1..48: note = derived and/or modified sequence opt6 from anti-influenza_CDR
  source 1..48: mol_type = other RNA
gaaacaagatttggagaactattaagcccatatgatgcatttgaaata

SEQ ID NO: 53142 - RNA, 48 nt, synthetic construct
  misc_feature 1..48: note = derived and/or modified sequence opt6 from anti-influenza_CDR
  source 1..48: mol_type = other RNA
ctaatatactgggacgacgacaaaagatacagtccaagcctaaaaaga

SEQ ID NO: 53143 - RNA, 48 nt, synthetic construct
  misc_feature 1..48: note = derived and/or modified sequence opt6 from anti-influenza_CDR
  source 1..48: mol_type = other RNA
tacatatactacatcggcaacacagactacagaccatcactaaaatca

SEQ ID NO: 53144 - RNA, 48 nt, synthetic construct
  misc_feature 1..48: note = derived and/or modified sequence opt6 from anti-influenza_CDR
  source 1..48: mol_type = other RNA
gaaatatcacacggcggatcaacaaactacaacccatcactaaaatca

SEQ ID NO: 53145 - RNA, 48 nt, synthetic construct
  misc_feature 1..48: note = derived and/or modified sequence opt6 from anti-influenza_CDR
  source 1..48: mol_type = other RNA
gaaataaaccactcaggccgaacaaactacaacccatcactaaaatca

SEQ ID NO: 53146 - RNA, 48 nt, synthetic construct
  misc_feature 1..48: note = derived and/or modified sequence opt6 from anti-influenza_CDR
  source 1..48: mol_type = other RNA
ctaatatcatgggacgacgaaaaacactactcaccatcactacaatca

SEQ ID NO: 53147 - RNA, 48 nt, synthetic construct
  misc_feature 1..48: note = derived and/or modified sequence opt6 from anti-influenza_CDR
  source 1..48: mol_type = other RNA
gagggtgtgtattttgattcgggtacgtataggggttattttgattat

SEQ ID NO: 53148 - RNA, 48 nt, synthetic construct
  misc_feature 1..48: note = derived and/or modified sequence opt6 from anti-influenza_CDR
  source 1..48: mol_type = other RNA
tacatataccactccggctccacaaactacaacccatccctaaaatca

SEQ ID NO: 53149 - RNA, 48 nt, synthetic construct
  misc_feature 1..48: note = derived and/or modified sequence opt6 from anti-influenza_CDR
  source 1..48: mol_type = other RNA
tacatatactaccgcggctccacattctacaatccatccctaaaatca

SEQ ID NO: 53150 - RNA, 48 nt, synthetic construct
  misc_feature 1..48: note = derived and/or modified sequence opt6 from anti-influenza_CDR
  source 1..48: mol_type = other RNA
tacatatcctactccggatccacaaaatacaatccatccctccgctca

SEQ ID NO: 53151 - RNA, 48 nt, synthetic construct
  misc_feature 1..48: note = derived and/or modified sequence opt6 from anti-influenza_CDR
  source 1..48: mol_type = other RNA
gaaataaaacactcaggcagaacaaactacaacccatcactagaatca

SEQ ID NO: 53152 - RNA, 48 nt, synthetic construct
  misc_feature 1..48: note = derived and/or modified sequence opt6 from anti-influenza_CDR
  source 1..48: mol_type = other RNA
gaaataaaccactcaggcggaacaaactacaatccatcactaaaaaga

SEQ ID NO: 53153 - RNA, 48 nt, synthetic construct
  misc_feature 1..48: note = derived and/or modified sequence opt6 from anti-influenza_CDR
  source 1..48: mol_type = other RNA
ttcatgtactactccgcctccacatactacaacccatccctaaaatca

SEQ ID NO: 53154 - RNA, 48 nt, synthetic construct
  misc_feature 1..48: note = derived and/or modified sequence opt6 from anti-influenza_CDR
  source 1..48: mol_type = other RNA
tacgtatactactccggatccacaacctacaacccatccctaaaatca

SEQ ID NO: 53155 - RNA, 48 nt, synthetic construct; identical to SEQ ID NO: 22587
  misc_feature 1..48: note = derived and/or modified sequence opt6 from anti-influenza_CDR
  source 1..48: mol_type = other RNA

SEQ ID NO: 53156 - RNA, 48 nt, synthetic construct
  misc_feature 1..48: note = derived and/or modified sequence opt6 from anti-influenza_CDR
  source 1..48: mol_type = other RNA
ttcatatactacggcggcaacacaaaatacaacccatcactaaaatca

SEQ ID NO: 53157 - RNA, 48 nt, synthetic construct
  misc_feature 1..48: note = derived and/or modified sequence opt6 from anti-influenza_CDR
  source 1..48: mol_type = other RNA
ttcatgttccactccggatccccacgctacaacccaaccctaaaatca

SEQ ID NO: 53158 - RNA, 48 nt, synthetic construct
  misc_feature 1..48: note = derived and/or modified sequence opt6 from anti-influenza_CDR
  source 1..48: mol_type = other RNA
ttcttctacaacggcggctcaacaaaatacaacccatcactaaaatca

SEQ ID NO: 53159 - RNA, 48 nt, synthetic construct
  misc_feature 1..48: note = derived and/or modified sequence opt6 from anti-influenza_CDR
  source 1..48: mol_type = other RNA
cacatatacgactacggccgcacattctacaattcatcactacaatca

SEQ ID NO: 53160 - RNA, 48 nt, synthetic construct
  misc_feature 1..48: note = derived and/or modified sequence opt6 from anti-influenza_CDR
  source 1..48: mol_type = other RNA
gtattctattcagaaacaagaacatactacgcagactcagtaaaagga

SEQ ID NO: 53161 - RNA, 48 nt, synthetic construct
  misc_feature 1..48: note = derived and/or modified sequence opt6 from anti-influenza_CDR
  source 1..48: mol_type = other RNA
tacgtatacaaccgcggatccacaaaatactcaccatccctaaaatca

SEQ ID NO: 53162 - RNA, 48 nt, synthetic construct
  misc_feature 1..48: note = derived and/or modified sequence opt6 from anti-influenza_CDR
  source 1..48: mol_type = other RNA
tacatatacaaccgcggatccacaaaatacacaccatccctaaaatca

SEQ ID NO: 53163 - RNA, 48 nt, synthetic construct
  misc_feature 1..48: note = derived and/or modified sequence opt6 from anti-influenza_CDR
  source 1..48: mol_type = other RNA
tacctatactactccggctccacaaaatacaacccctccctcaaatca

SEQ ID NO: 53164 - RNA, 48 nt, synthetic construct
  misc_feature 1..48: note = derived and/or modified sequence opt6 from anti-influenza_CDR
  source 1..48: mol_type = other RNA
tacgtatacaactccggaaacacaaaatacaacccatccctaaaatca

SEQ ID NO: 53165 - RNA, 48 nt, synthetic construct
  misc_feature 1..48: note = derived and/or modified sequence opt6 from anti-influenza_CDR
  source 1..48: mol_type = other RNA
cacatattcgactccggatccacatactacaacccatcactaaaatca

SEQ ID NO: 53166 - RNA, 48 nt, synthetic construct
  misc_feature 1..48: note = derived and/or modified sequence opt6 from anti-influenza_CDR
  source 1..48: mol_type = other RNA
gtattttactctgcagatagaacttcatatgcagattcagttaaaggt

SEQ ID NO: 53167 - RNA, 48 nt, synthetic construct
  misc_feature 1..48: note = derived and/or modified sequence opt6 from anti-influenza_CDR
  source 1..48: mol_type = other RNA
tacatatactactccggcaacacatactacaacccctccctcaaatca

SEQ ID NO: 53168 - RNA, 48 nt, synthetic construct
  misc_feature 1..48: note = derived and/or modified sequence opt6 from anti-influenza_CDR
  source 1..48: mol_type = other RNA
cgatcttcccaatcattactccattcaaatggctataactatctcgat

SEQ ID NO: 53169 - RNA, 48 nt, synthetic construct
  misc_feature 1..48: note = derived and/or modified sequence opt6 from anti-influenza_CDR
  source 1..48: mol_type = other RNA
accatataccactccggctccacatactacaacccatccctaaaatca

SEQ ID NO: 53170 - RNA, 48 nt, synthetic construct
  misc_feature 1..48: note = derived and/or modified sequence opt6 from anti-influenza_CDR
  source 1..48: mol_type = other RNA
cgatcttcccaatcattactccattccaatggccatatctatttcgat

SEQ ID NO: 53171 - RNA, 48 nt, synthetic construct
  misc_feature 1..48: note = derived and/or modified sequence opt6 from anti-influenza_CDR
  source 1..48: mol_type = other RNA
atatggggagtagcagcaccaagcacagcaagcgcacaaacatcatta

SEQ ID NO: 53172 - RNA, 48 nt, synthetic construct
  misc_feature 1..48: note = derived and/or modified sequence opt6 from anti-influenza_CDR
  source 1..48: mol_type = other RNA
cgctcctctcaatcacttctatataccgatggctttacctatctctct

SEQ ID NO: 53173 - RNA, 48 nt, synthetic construct
  misc_feature 1..48: note = derived and/or modified sequence opt6 from anti-influenza_CDR
  source 1..48: mol_type = other RNA
gcaaaaccaagattagactatctagattactttcacgcagccgactca

SEQ ID NO: 53174 - RNA, 48 nt, synthetic construct
  misc_feature 1..48: note = derived and/or modified sequence opt6 from anti-influenza_CDR
  source 1..48: mol_type = other RNA
gctagatctccaggttactctggatatttatatggatggttcgatcca

SEQ ID NO: 53175 - RNA, 48 nt, synthetic construct
  misc_feature 1..48: note = derived and/or modified sequence opt6 from anti-influenza_CDR
  source 1..48: mol_type = other RNA
gcaatagcaggaagtggaagtgcagattatgcaagttgggcaaaagga

SEQ ID NO: 53176 - RNA, 48 nt, synthetic construct
  misc_feature 1..48: note = derived and/or modified sequence opt6 from anti-influenza_CDR
  source 1..48: mol_type = other RNA
gcaatagcaggatcaggatcagcagattatgcaagctgggcaaaaagt

SEQ ID NO: 53177 - RNA, 48 nt, synthetic construct
  misc_feature 1..48: note = derived and/or modified sequence opt6 from anti-influenza_CDR
  source 1..48: mol_type = other RNA
gcaataggaggaggaggaagtgcagattatgcaagttgggcaaaaagt

SEQ ID NO: 53178 - RNA, 48 nt, synthetic construct
  misc_feature 1..48: note = derived and/or modified sequence opt6 from anti-influenza_CDR
  source 1..48: mol_type = other RNA
agatcatcacaatcattactcagatcaaacggctataactacctagac

SEQ ID NO: 53179 - RNA, 48 nt, synthetic construct
  misc_feature 1..48: note = derived and/or modified sequence opt6 from anti-influenza_CDR
  source 1..48: mol_type = other RNA
caaggagatcacatagcatggctattaagaggaataaattttgattac

SEQ ID NO: 53180 - RNA, 51 nt, synthetic construct
  misc_feature 1..51: note = derived and/or modified sequence opt6 from anti-influenza_CDR
  source 1..51: mol_type = other RNA
gcaagattaggatcaggaagttatcataatggaccaaattggtttgatcca

SEQ ID NO: 53181 - RNA, 51 nt, synthetic construct
  misc_feature 1..51: note = derived and/or modified sequence opt6 from anti-influenza_CDR
  source 1..51: mol_type = other RNA
gcaagagcagaaaatttattaagtccatacttagcagaaggatttgaccca

SEQ ID NO: 53182 - RNA, 51 nt, synthetic construct
  misc_feature 1..51: note = derived and/or modified sequence opt6 from anti-influenza_CDR
  source 1..51: mol_type = other RNA
gtaatatcatacgatggatcaaacaaatactatgcagatagcgtaaaagga

SEQ ID NO: 53183 - RNA, 51 nt, synthetic construct
  misc_feature 1..51: note = derived and/or modified sequence opt6 from anti-influenza_CDR
  source 1..51: mol_type = other RNA
ggaacaataccactactaggaacaacaaactacgcacaaaaattccaagga

SEQ ID NO: 53184 - RNA, 51 nt, synthetic construct
  misc_feature 1..51: note = derived and/or modified sequence opt6 from anti-influenza_CDR
  source 1..51: mol_type = other RNA
ggaataatagcagtattcaacacagcaaactacgcacaaaaattccaagga

SEQ ID NO: 53185 - RNA, 51 nt, synthetic construct
  misc_feature 1..51: note = derived and/or modified sequence opt6 from anti-influenza_CDR
  source 1..51: mol_type = other RNA
aatatagaggacgatggaggggacaagtattatgtagatagtgtgaaaggg

SEQ ID NO: 53186 - RNA, 51 nt, synthetic construct
  misc_feature 1..51: note = derived and/or modified sequence opt6 from anti-influenza_CDR
  source 1..51: mol_type = other RNA
tggataaatccaaattcaggaacaacaggaagtgcacaaagatttcaagga

SEQ ID NO: 53187 - RNA, 51 nt, synthetic construct
  misc_feature 1..51: note = derived and/or modified sequence opt6 from anti-influenza_CDR
  source 1..51: mol_type = other RNA
ggaataaatccagtattcggaagaccacactatgcacaaaaatttcaagga

SEQ ID NO: 53188 - RNA, 51 nt, synthetic construct
  misc_feature 1..51: note = derived and/or modified sequence opt6 from anti-influenza_CDR
  source 1..51: mol_type = other RNA
ggaataataccactaataaacgcaccaaactacgcaccaaaattccaagga

SEQ ID NO: 53189 - RNA, 51 nt, synthetic construct
  misc_feature 1..51: note = derived and/or modified sequence opt6 from anti-influenza_CDR
  source 1..51: mol_type = other RNA
ggaataataccaatgatgggaacagtaaactatgcacaaaaactacaagga

SEQ ID NO: 53190 - RNA, 51 nt, synthetic construct
  misc_feature 1..51: note = derived and/or modified sequence opt6 from anti-influenza_CDR
  source 1..51: mol_type = other RNA
ggaataataccactattcggagcagcaaaatacgcacaaaaattccaagga

SEQ ID NO: 53191 - RNA, 51 nt, synthetic construct
  misc_feature 1..51: note = derived and/or modified sequence opt6 from anti-influenza_CDR
  source 1..51: mol_type = other RNA
aaatcatcccaacgcgtactctactcctcaaacaacaaaaactacctagcc

SEQ ID NO: 53192 - RNA, 51 nt, synthetic construct
  misc_feature 1..51: note = derived and/or modified sequence opt6 from anti-influenza_CDR
  source 1..51: mol_type = other RNA
ttaatatctgacgatggatctaacaaattctatgcagattcagttaaaggt

SEQ ID NO: 53193 - RNA, 51 nt, synthetic construct
  misc_feature 1..51: note = derived and/or modified sequence opt6 from anti-influenza_CDR
  source 1..51: mol_type = other RNA
ataatatcatacgacggaaatgaccaatactatacagacagcgtaaaagga

SEQ ID NO: 53194 - RNA, 51 nt, synthetic construct
  misc_feature 1..51: note = derived and/or modified sequence opt6 from anti-influenza_CDR
  source 1..51: mol_type = other RNA
tggatatcaacatacaacggcaacacaaacttcgcacaaaacttccaaggc

SEQ ID NO: 53195 - RNA, 51 nt, synthetic construct
  misc_feature 1..51: note = derived and/or modified sequence opt6 from anti-influenza_CDR
  source 1..51: mol_type = other RNA
gtagaaggaagctatagagatttctggaacaatcaaaatagatttgacccg

SEQ ID NO: 53196 - RNA, 51 nt, synthetic construct
  misc_feature 1..51: note = derived and/or modified sequence opt6 from anti-influenza_CDR
  source 1..51: mol_type = other RNA
tggataaacccaaactcaggagacacaaattacgcacaaaaattccaagga

SEQ ID NO: 53197 - RNA, 51 nt, synthetic construct
  misc_feature 1..51: note = derived and/or modified sequence opt6 from anti-influenza_CDR
  source 1..51: mol_type = other RNA
aaatcctcccaatcagtcctctactcctccaacaataaatcccacctcgcc

SEQ ID NO: 53198 - RNA, 51 nt, synthetic construct
  misc_feature 1..51: note = derived and/or modified sequence opt6 from anti-influenza_CDR
  source 1..51: mol_type = other RNA
ataatatacccaggagactcagacacaagatactcaccatcattccaagga

SEQ ID NO: 53199 - RNA, 51 nt, synthetic construct
  misc_feature 1..51: note = derived and/or modified sequence opt6 from anti-influenza_CDR
  source 1..51: mol_type = other RNA
ggtataattccagttttccctacacctaactatgcacaaatgtttcaaggt

SEQ ID NO: 53200 - RNA, 51 nt, synthetic construct
  misc_feature 1..51: note = derived and/or modified sequence opt6 from anti-influenza_CDR
  source 1..51: mol_type = other RNA
ggaatagtaccagtattcggaacagcaaactatgcacaaaaatttcaagga

SEQ ID NO: 53201 - RNA, 51 nt, synthetic construct
  misc_feature 1..51: note = derived and/or modified sequence opt6 from anti-influenza_CDR
  source 1..51: mol_type = other RNA
tggataaacccagaatcaggagacacaaaatacgcacaaaaattccaagga

SEQ ID NO: 53202 - RNA, 51 nt, synthetic construct
  misc_feature 1..51: note = derived and/or modified sequence opt6 from anti-influenza_CDR
  source 1..51: mol_type = other RNA
agatcatcacaatcaatattccacaactcaaacaacgaaaactacctcgcc

SEQ ID NO: 53203 - RNA, 51 nt, synthetic construct
  misc_feature 1..51: note = derived and/or modified sequence opt6 from anti-influenza_CDR
  source 1..51: mol_type = other RNA
tggataaatgcaaaaagaggaggaacaaattatgcacaaaaattccaagga

SEQ ID NO: 53204 - RNA, 51 nt, synthetic construct
  misc_feature 1..51: note = derived and/or modified sequence opt6 from anti-influenza_CDR
  source 1..51: mol_type = other RNA
tggataaatccagactcaggagcaacatcaagtgcacaaaatttccaagga

SEQ ID NO: 53205 - RNA, 51 nt, synthetic construct
  misc_feature 1..51: note = derived and/or modified sequence opt6 from anti-influenza_CDR
  source 1..51: mol_type = other RNA
tggataagtccagactcagacgcaacaaaatatgcacaaaaatttcaagga

SEQ ID NO: 53206 - RNA, 51 nt, synthetic construct
  misc_feature 1..51: note = derived and/or modified sequence opt6 from anti-influenza_CDR
  source 1..51: mol_type = other RNA
aatataaaacaagacggaagagaaaaatactacgtagacagcctaagagga

SEQ ID NO: 53207 - RNA, 51 nt, synthetic construct
  misc_feature 1..51: note = derived and/or modified sequence opt6 from anti-influenza_CDR
  source 1..51: mol_type = other RNA
ggaataatagcaatattcggaacaccaaaatacgcacaaaaattccaagga

SEQ ID NO: 53208 - RNA, 51 nt, synthetic construct
  misc_feature 1..51: note = derived and/or modified sequence opt6 from anti-influenza_CDR
  source 1..51: mol_type = other RNA
aaatcctcccaatccatcctcaactcctccaacaacaaaaactacctcgcc

SEQ ID NO: 53209 - RNA, 51 nt, synthetic construct
  misc_feature 1..51: note = derived and/or modified sequence opt6 from anti-influenza_CDR
  source 1..51: mol_type = other RNA
tggataagcgcatacaatggaaacacaaattacgcacaaaaattccaagga

SEQ ID NO: 53210 - RNA, 51 nt, synthetic construct
  misc_feature 1..51: note = derived and/or modified sequence opt6 from anti-influenza_CDR
  source 1..51: mol_type = other RNA
ggagtaataccaatatttagaacagcaaattacgcacaaaatttccaagga

SEQ ID NO: 53211 - RNA, 51 nt, synthetic construct
  misc_feature 1..51: note = derived and/or modified sequence opt6 from anti-influenza_CDR
  source 1..51: mol_type = other RNA
ggaataatagcaatattccacacaccaaaatacgcacaaaaattccaagga

SEQ ID NO: 53212 - RNA, 51 nt, synthetic construct
  misc_feature 1..51: note = derived and/or modified sequence opt6 from anti-influenza_CDR
  source 1..51: mol_type = other RNA
ggtatatctccaatgttcggtacaactacatatgcacaaaaatttcaaggt

SEQ ID NO: 53213 - RNA, 51 nt, synthetic construct
  misc_feature 1..51: note = derived and/or modified sequence opt6 from anti-influenza_CDR
  source 1..51: mol_type = other RNA
aaatcatcccaatccgtcctctactcctccaacaacaaaaactacctcgcc

SEQ ID NO: 53214 - RNA, 51 nt, synthetic construct
  misc_feature 1..51: note = derived and/or modified sequence opt6 from anti-influenza_CDR
  source 1..51: mol_type = other RNA
ggaataataccaatattcggaacaacaaaatacgcaccaaaattccaagga

SEQ ID NO: 53215 - RNA, 51 nt, synthetic construct
  misc_feature 1..51: note = derived and/or modified sequence opt6 from anti-influenza_CDR
  source 1..51: mol_type = other RNA
ggaataagcccactattcggaacaacaaactacgcacaaaaattccaagga

SEQ ID NO: 53216 - RNA, 51 nt, synthetic construct
  misc_feature 1..51: note = derived and/or modified sequence opt6 from anti-influenza_CDR
  source 1..51: mol_type = other RNA
ggaataatgggaatgttcggaacaacaaactatgcacaaaaatttcaagga

SEQ ID NO: 53217 - RNA, 51 nt, synthetic construct
  misc_feature 1..51: note = derived and/or modified sequence opt6 from anti-influenza_CDR
  source 1..51: mol_type = other RNA
ggaataataggaatgtttggaagtacaaattatgcacaaaattttcaagga

SEQ ID NO: 53218 - RNA, 51 nt, synthetic construct
  misc_feature 1..51: note = derived and/or modified sequence opt6 from anti-influenza_CDR
  source 1..51: mol_type = other RNA
tggataaatccaaattcaggcggaacaaattatgcacaaaaattccaagga

SEQ ID NO: 53219 - RNA, 51 nt, synthetic construct
  misc_feature 1..51: note = derived and/or modified sequence opt6 from anti-influenza_CDR
  source 1..51: mol_type = other RNA
gcaatatcaagctcaggagatagcacatactatgcagatagcgtaaaagga

SEQ ID NO: 53220 - RNA, 51 nt, synthetic construct
  misc_feature 1..51: note = derived and/or modified sequence opt6 from anti-influenza_CDR
  source 1..51: mol_type = other RNA
tcaatatcaagctcaagctcatacatatactatgtcgacagcgtaaaagga

SEQ ID NO: 53221 - RNA, 51 nt, synthetic construct
  misc_feature 1..51: note = derived and/or modified sequence opt6 from anti-influenza_CDR
  source 1..51: mol_type = other RNA
gacataataggaatgttcggatcaacaaactatgcacaaaatttccaagga

SEQ ID NO: 53222 - RNA, 51 nt, synthetic construct
  misc_feature 1..51: note = derived and/or modified sequence opt6 from anti-influenza_CDR
  source 1..51: mol_type = other RNA
ggaataataccaatgttcggaacaacaaactacgcacaaaaattccaagga

SEQ ID NO: 53223 - RNA, 51 nt, synthetic construct
  misc_feature 1..51: note = derived and/or modified sequence opt6 from anti-influenza_CDR
  source 1..51: mol_type = other RNA
ggaataatagcaatattcggaacagcaaactacgcacaaaaattccaagga

SEQ ID NO: 53224 - RNA, 51 nt, synthetic construct
  misc_feature 1..51: note = derived and/or modified sequence opt6 from anti-influenza_CDR
  source 1..51: mol_type = other RNA
ggaataataccaatattcggaacaacaaactacgcacaaaaattccaagga

SEQ ID NO: 53225 - RNA, 51 nt, synthetic construct
  misc_feature 1..51: note = derived and/or modified sequence opt6 from anti-influenza_CDR
  source 1..51: mol_type = other RNA
ggaatattcgcactatttggaacaacagactacgcacaaaaattccaagga

SEQ ID NO: 53226 - RNA, 51 nt, synthetic construct
  misc_feature 1..51: note = derived and/or modified sequence opt6 from anti-influenza_CDR
  source 1..51: mol_type = other RNA
ggaataataggaatgttcggaacagcaaactatgcacaaaaatttcaagga

SEQ ID NO: 53227 - RNA, 51 nt, synthetic construct
  misc_feature 1..51: note = derived and/or modified sequence opt6 from anti-influenza_CDR
  source 1..51: mol_type = other RNA
ggaataatagcagtattcggaacaacaaaatacgcacataaattccaagga

SEQ ID NO: 53228 - RNA, 51 nt, synthetic construct
  misc_feature 1..51: note = derived and/or modified sequence opt6 from anti-influenza_CDR
  source 1..51: mol_type = other RNA
ggtatattaggagttttcggttcaccttcatatgcacaaaaatttcaaggt

SEQ ID NO: 53229 - RNA, 51 nt, synthetic construct
  misc_feature 1..51: note = derived and/or modified sequence opt6 from anti-influenza_CDR
  source 1..51: mol_type = other RNA
ggaatatttggaatgttcggaacagcaaactatgcacaaaaatttcaagga

SEQ ID NO: 53230 - RNA, 51 nt, synthetic construct
  misc_feature 1..51: note = derived and/or modified sequence opt6 from anti-influenza_CDR
  source 1..51: mol_type = other RNA
tggataagcgcatacacaggagatacagattacgcacaaaaattccaagga

SEQ ID NO: 53231 - RNA, 51 nt, synthetic construct
  misc_feature 1..51: note = derived and/or modified sequence opt6 from anti-influenza_CDR
  source 1..51: mol_type = other RNA
agttttgacccagaagacggagaaacaatatacgcacaaaaatttcaagga

SEQ ID NO: 53232 - RNA, 51 nt, synthetic construct
  misc_feature 1..51: note = derived and/or modified sequence opt6 from anti-influenza_CDR
  source 1..51: mol_type = other RNA
ggaataagtggaagtggagaaagtacatattatgcagatagtgtaaaagga

SEQ ID NO: 53233 - RNA, 51 nt, synthetic construct
  misc_feature 1..51: note = derived and/or modified sequence opt6 from anti-influenza_CDR
  source 1..51: mol_type = other RNA
gtagtaagttatgatggaaattataaatattatgcagatagtgtacaggga

SEQ ID NO: 53234 - RNA, 51 nt, synthetic construct
  misc_feature 1..51: note = derived and/or modified sequence opt6 from anti-influenza_CDR
  source 1..51: mol_type = other RNA
ggctccatatcttactccggctctacatattaccatccatctctaaaatca

SEQ ID NO: 53235 - RNA, 51 nt, synthetic construct
  misc_feature 1..51: note = derived and/or modified sequence opt6 from anti-influenza_CDR
  source 1..51: mol_type = other RNA
acaagaggaagaccaataggaagaaattgggaaccaagagacaaagactat

SEQ ID NO: 53236 - RNA, 51 nt, synthetic construct
  misc_feature 1..51: note = derived and/or modified sequence opt6 from anti-influenza_CDR
  source 1..51: mol_type = other RNA
gcacgtgaagctggatatcattcttcattttcaggtgtatattttgattat

SEQ ID NO: 53237 - RNA, 51 nt, synthetic construct
  misc_feature 1..51: note = derived and/or modified sequence opt6 from anti-influenza_CDR
  source 1..51: mol_type = other RNA
agaatagacccaaacggaagcggaacaacatacgcacaaaaatttcaagga

SEQ ID NO: 53238 - RNA, 51 nt, synthetic construct
  misc_feature 1..51: note = derived and/or modified sequence opt6 from anti-influenza_CDR
  source 1..51: mol_type = other RNA
agaatagacccaaacggagcaggaacaacatatgcacaaaaatttcaagga

SEQ ID NO: 53239 - RNA, 51 nt, synthetic construct
  misc_feature 1..51: note = derived and/or modified sequence opt6 from anti-influenza_CDR
  source 1..51: mol_type = other RNA
tggatagatccaaataacgatggaactatatatgcacaaaaatttcaaggt

SEQ ID NO: 53240 - RNA, 51 nt, synthetic construct
  misc_feature 1..51: note = derived and/or modified sequence opt6 from anti-influenza_CDR
  source 1..51: mol_type = other RNA
atgatgtacccaggagactcagacacaatatactcaccatcattccaagga

SEQ ID NO: 53241 - RNA, 51 nt, synthetic construct
  misc_feature 1..51: note = derived and/or modified sequence opt6 from anti-influenza_CDR
  source 1..51: mol_type = other RNA
atgatgtatccaggagacgcagacgcaatatatagtccaagttttcaagga

SEQ ID NO: 53242 - RNA, 51 nt, synthetic construct
  misc_feature 1..51: note = derived and/or modified sequence opt6 from anti-influenza_CDR
  source 1..51: mol_type = other RNA
atgatgtatccaggtgaatctgaaactatatattcaccttcatttcaaggc

SEQ ID NO: 53243 - RNA, 51 nt, synthetic construct
  misc_feature 1..51: note = derived and/or modified sequence opt6 from anti-influenza_CDR
  source 1..51: mol_type = other RNA
atgatgtacccaggagacgcagacacaatatattcaccatcattccaagga

SEQ ID NO: 53244 - RNA, 51 nt, synthetic construct
  misc_feature 1..51: note = derived and/or modified sequence opt6 from anti-influenza_CDR
  source 1..51: mol_type = other RNA
atgatgtatccaggttcatctgacactatatattcaccttcatttcaaggt

SEQ ID NO: 53245 - RNA, 51 nt, synthetic construct
  misc_feature 1..51: note = derived and/or modified sequence opt6 from anti-influenza_CDR
  source 1..51: mol_type = other RNA
atgatgtacccaggagactcagacgcaatatactcaccatcatttcaagga

SEQ ID NO: 53246 - RNA, 51 nt, synthetic construct
  misc_feature 1..51: note = derived and/or modified sequence opt6 from anti-influenza_CDR
  source 1..51: mol_type = other RNA
atgatgtacccaggagacacagacacaatatactcaccatcattccaagga

SEQ ID NO: 53247 - RNA, 51 nt, synthetic construct
  misc_feature 1..51: note = derived and/or modified sequence opt6 from anti-influenza_CDR
  source 1..51: mol_type = other RNA
atgatgtatccaggtgaatctgacactatatattcaccttcatttcaaggc

SEQ ID NO: 53248 - RNA, 51 nt, synthetic construct
  misc_feature 1..51: note = derived and/or modified sequence opt6 from anti-influenza_CDR
  source 1..51: mol_type = other RNA
gtaataagttgggatagtggaaggatagggtatgcggatagtgtaaaggga

SEQ ID NO: 53249 - RNA, 51 nt, synthetic construct
  misc_feature 1..51: note = derived and/or modified sequence opt6 from anti-influenza_CDR
  source 1..51: mol_type = other RNA
gtccgttctggtgcttattattttaattatttagttccttattttgattat

SEQ ID NO: 53250 - RNA, 51 nt, synthetic construct
  misc_feature 1..51: note = derived and/or modified sequence opt6 from anti-influenza_CDR
  source 1..51: mol_type = other RNA
gtccgttctggtgcttattatgttaattatttagttccttattttgattat

SEQ ID NO: 53251 - RNA, 51 nt, synthetic construct
  misc_feature 1..51: note = derived and/or modified sequence opt6 from anti-influenza_CDR
  source 1..51: mol_type = other RNA
ataataagttgggatagtggaaggatagggtatgcggatagtgtaagggga

SEQ ID NO: 53252 - RNA, 51 nt, synthetic construct
  misc_feature 1..51: note = derived and/or modified sequence opt6 from anti-influenza_CDR
  source 1..51: mol_type = other RNA
catggaggtgtatattattatggaagtgcaagttcaggttggtttgatcct

SEQ ID NO: 53253 - RNA, 54 nt, synthetic construct
  misc_feature 1..54: note = derived and/or modified sequence opt6 from anti-influenza_CDR
  source 1..54: mol_type = other RNA
agaacatactacagatcaaaatggtacaatgactacgcagaaagcgtaaaatca

SEQ ID NO: 53254 - RNA, 54 nt, synthetic construct
  misc_feature 1..54: note = derived and/or modified sequence opt6 from anti-influenza_CDR
  source 1..54: mol_type = other RNA
agaacatactacagatcaaaatggtactatgactatgcagaaagcgtaaaatca

SEQ ID NO: 53255 - RNA, 54 nt, synthetic construct
  misc_feature 1..54: note = derived and/or modified sequence opt6 from anti-influenza_CDR
  source 1..54: mol_type = other RNA
agaacatactacagatcaaaatggtacaatgactacgcagtaagcgtaaaatca

SEQ ID NO: 53256 - RNA, 54 nt, synthetic construct
  misc_feature 1..54: note = derived and/or modified sequence opt6 from anti-influenza_CDR
  source 1..54: mol_type = other RNA
agaacatactacagatcaaaatggtacaacgactacgcagacttcctaaaaaga

SEQ ID NO: 53257 - RNA, 54 nt, synthetic construct
  misc_feature 1..54: note = derived and/or modified sequence opt6 from anti-influenza_CDR
  source 1..54: mol_type = other RNA
agaacatactatagatcaggatggtacaatgactatgcagaaagcgtaaaatca

SEQ ID NO: 53258 - RNA, 54 nt, synthetic construct
  misc_feature 1..54: note = derived and/or modified sequence opt6 from anti-influenza_CDR
  source 1..54: mol_type = other RNA
gcgagattgggcgggaataaggattatggagattacttgtggtattttgattta

SEQ ID NO: 53259 - RNA, 54 nt, synthetic construct
  misc_feature 1..54: note = derived and/or modified sequence opt6 from anti-influenza_CDR
  source 1..54: mol_type = other RNA
gcaaaagatacagcagaccatggagattatgtagacttaggattttttgatgca

SEQ ID NO: 53260 - RNA, 54 nt, synthetic construct
  misc_feature 1..54: note = derived and/or modified sequence opt6 from anti-influenza_CDR
  source 1..54: mol_type = other RNA
gcaagatcaggaatatttgattggtcagcaccactagtagaagcattcgatata

SEQ ID NO: 53261 - RNA, 54 nt, synthetic construct
  misc_feature 1..54: note = derived and/or modified sequence opt6 from anti-influenza_CDR
  source 1..54: mol_type = other RNA
gcaagacatgcaagttgtagtgcaagatcatgttattggggaccagtagattat

SEQ ID NO: 53262 - RNA, 54 nt, synthetic construct
  misc_feature 1..54: note = derived and/or modified sequence opt6 from anti-influenza_CDR
  source 1..54: mol_type = other RNA
gatgcacctccaaatgtagaagtagcttcaatgacaaattggtatttcgatcta

SEQ ID NO: 53263 - RNA, 54 nt, synthetic construct
  misc_feature 1..54: note = derived and/or modified sequence opt6 from anti-influenza_CDR
  source 1..54: mol_type = other RNA
ttaagaacagactatggagatccagatagtgtatattattacggaatggatgta

SEQ ID NO: 53264 - RNA, 54 nt, synthetic construct
  misc_feature 1..54: note = derived and/or modified sequence opt6 from anti-influenza_CDR
  source 1..54: mol_type = other RNA
ggtacatgtgcaggtgattgttcacttcattattattattatggtttagatgta

SEQ ID NO: 53265 - RNA, 54 nt, synthetic construct
  misc_feature 1..54: note = derived and/or modified sequence opt6 from anti-influenza_CDR
  source 1..54: mol_type = other RNA
cacgtaagcgtaagccatggcggaagaacaaaatcaaacccaagcgtaatgtca

SEQ ID NO: 53266 - RNA, 54 nt, synthetic construct
  misc_feature 1..54: note = derived and/or modified sequence opt6 from anti-influenza_CDR
  source 1..54: mol_type = other RNA
gcattaatatatttcgatggaagtaaacaatactatgcagattcagtaaaagga

SEQ ID NO: 53267 - RNA, 54 nt, synthetic construct
  misc_feature 1..54: note = derived and/or modified sequence opt6 from anti-influenza_CDR
  source 1..54: mol_type = other RNA
acattaatatcatacgatggagcaaaccaatactatgcagatagcgtaaaagga

SEQ ID NO: 53268 - RNA, 54 nt, synthetic construct
  misc_feature 1..54: note = derived and/or modified sequence opt6 from anti-influenza_CDR
  source 1..54: mol_type = other RNA
gctgtacctggacctgtatttggaatttttcctccatggtcatattttgataat

SEQ ID NO: 53269 - RNA, 54 nt, synthetic construct
  misc_feature 1..54: note = derived and/or modified sequence opt6 from anti-influenza_CDR
  source 1..54: mol_type = other RNA
ggaggaataataccaatattcggagcagcaaattacgcacaaaaattccaagga

SEQ ID NO: 53270 - RNA, 54 nt, synthetic construct
  misc_feature 1..54: note = derived and/or modified sequence opt6 from anti-influenza_CDR
  source 1..54: mol_type = other RNA
ggatggataagcgcatacacaggaaatacacattacgcaaaaaatttcgaagga

SEQ ID NO: 53271 - RNA, 54 nt, synthetic construct
  misc_feature 1..54: note = derived and/or modified sequence opt6 from anti-influenza_CDR
  source 1..54: mol_type = other RNA
ggatggataaacccaaattttggaggaacacattacgcaagaaaattccaagga

SEQ ID NO: 53272 - RNA, 54 nt, synthetic construct
  misc_feature 1..54: note = derived and/or modified sequence opt6 from anti-influenza_CDR
  source 1..54: mol_type = other RNA
gtaagatggagagcggcagcagtaataatggatcaattttataaaatggatgta

SEQ ID NO: 53273 - RNA, 54 nt, synthetic construct
  misc_feature 1..54: note = derived and/or modified sequence opt6 from anti-influenza_CDR
  source 1..54: mol_type = other RNA
gctgttcctggtcctatttttggtatttttcctccttggtcttattttgatcat

SEQ ID NO: 53274 - RNA, 54 nt, synthetic construct
  misc_feature 1..54: note = derived and/or modified sequence opt6 from anti-influenza_CDR
  source 1..54: mol_type = other RNA
gcagcatcaacagcaacatcaggaacatactatgcaatgagaccattcgatttc

SEQ ID NO: 53275 - RNA, 57 nt, synthetic construct
  misc_feature 1..57: note = derived and/or modified sequence opt6 from anti-influenza_CDR
  source 1..57: mol_type = other RNA
gcaagaggaaaaaggccaggatattgtagtggaggagtatgtagtagtgattattgg

SEQ ID NO: 53276 - RNA, 57 nt, synthetic construct
  misc_feature 1..57: note = derived and/or modified sequence opt6 from anti-influenza_CDR
  source 1..57: mol_type = other RNA
gcccgtcactatccatattacgatctacctacaggtttctattcacaattcgatttc

SEQ ID NO: 53277 - RNA, 57 nt, synthetic construct
  misc_feature 1..57: note = derived and/or modified sequence opt6 from anti-influenza_CDR
  source 1..57: mol_type = other RNA
ggaagtggagggtatgggggatttgattattttgggaaattgaggacgtgggatttt

SEQ ID NO: 53278 - RNA, 57 nt, synthetic construct
  misc_feature 1..57: note = derived and/or modified sequence opt6 from anti-influenza_CDR
  source 1..57: mol_type = other RNA
tttataagaacaagaccatggggaggaacagcagatacagcagcatcagtaaaagga

SEQ ID NO: 53279 - RNA, 57 nt, synthetic construct
  misc_feature 1..57: note = derived and/or modified sequence opt6 from anti-influenza_CDR
  source 1..57: mol_type = other RNA
ttaaattatcatgattcaggtacatattataatgcacctagaggttggtttgaccct

SEQ ID NO: 53280 - RNA, 57 nt, synthetic construct
  misc_feature 1..57: note = derived and/or modified sequence opt6 from anti-influenza_CDR
  source 1..57: mol_type = other RNA
gtaaaagatggttattgtacattaacaagttgtcctgtaggttggtattttgattta

SEQ ID NO: 53281 - RNA, 57 nt, synthetic construct
  misc_feature 1..57: note = derived and/or modified sequence opt6 from anti-influenza_CDR
  source 1..57: mol_type = other RNA
gctgttcctggtcctatttttggtatttttcctccttggtcttattttgatcattgg

SEQ ID NO: 53282 - RNA, 57 nt, synthetic construct
  misc_feature 1..57: note = derived and/or modified sequence opt6 from anti-influenza_CDR
  source 1..57: mol_type = other RNA
gcaagagcaatgatacaaggagtagtaacattatatttaagaccaggagattactgg

SEQ ID NO: 53283 - RNA, 57 nt, synthetic construct
  misc_feature 1..57: note = derived and/or modified sequence opt6 from anti-influenza_CDR
  source 1..57: mol_type = other RNA
gcaaaagtaggaccgtatacaggttatgatgattataattattatggaatggacgta

SEQ ID NO: 53284 - RNA, 57 nt, synthetic construct
  misc_feature 1..57: note = derived and/or modified sequence opt6 from anti-influenza_CDR
  source 1..57: mol_type = other RNA
gcaaaagtagaaagaagtttttatgacggaagtggatatggagatgcattagaaata

SEQ ID NO: 53285 - RNA, 57 nt, synthetic construct
  misc_feature 1..57: note = derived and/or modified sequence opt6 from anti-influenza_CDR
  source 1..57: mol_type = other RNA
tattgtgcaagaggaagagtaaatagtggatatgattggggaccgaattttgatagt

SEQ ID NO: 53286 - RNA, 57 nt, synthetic construct
  misc_feature 1..57: note = derived and/or modified sequence opt6 from anti-influenza_CDR
  source 1..57: mol_type = other RNA
ttttgtgcaagaggaagtccaaattcaggatatgactggggaccacattttgattat

SEQ ID NO: 53287 - RNA, 57 nt, synthetic construct
  misc_feature 1..57: note = derived and/or modified sequence opt6 from anti-influenza_CDR
  source 1..57: mol_type = other RNA
agaataaaatcaaatacagacggaggaacaacagactatgcagcaccagtaaaagga

SEQ ID NO: 53288 - RNA, 57 nt, synthetic construct
  misc_feature 1..57: note = derived and/or modified sequence opt6 from anti-influenza_CDR
  source 1..57: mol_type = other RNA
ctaagactacaaggagaagtagtagtaccaccatcacaatcaaactggttcgaccca

SEQ ID NO: 53289 - RNA, 60 nt, synthetic construct
  misc_feature 1..60: note = derived and/or modified sequence opt6 from anti-influenza_CDR
  source 1..60: mol_type = other RNA
gcgaaagagggagggaatacgatatttggattggtaacgatggcgtattattttgatagt

SEQ ID NO: 53290 - RNA, 60 nt, synthetic construct
  misc_feature 1..60: note = derived and/or modified sequence opt6 from anti-influenza_CDR
  source 1..60: mol_type = other RNA
gcaagagcaggaggagattcaagtggatattatggagcattaggaagattttttcagcat

SEQ ID NO: 53291 - RNA, 60 nt, synthetic construct
  misc_feature 1..60: note = derived and/or modified sequence opt6 from anti-influenza_CDR
  source 1..60: mol_type = other RNA
gcgaaagatagcaggggatattgctcgagcataatatgtttcgagggagggctagataat

SEQ ID NO: 53292 - RNA, 60 nt, synthetic construct
  misc_feature 1..60: note = derived and/or modified sequence opt6 from anti-influenza_CDR
  source 1..60: mol_type = other RNA
ggttcaggttcatctgaccgttcagattacgatccacattactattactatttagatgta

SEQ ID NO: 53293 - RNA, 60 nt, synthetic construct
  misc_feature 1..60: note = derived and/or modified sequence opt6 from anti-influenza_CDR
  source 1..60: mol_type = other RNA
ggaacagatccagatacagaagtatattgcagagtaggaaattgtgcagcatttgattat

SEQ ID NO: 53294 - RNA, 60 nt, synthetic construct
  misc_feature 1..60: note = derived and/or modified sequence opt6 from anti-influenza_CDR
  source 1..60: mol_type = other RNA
ggaacttcacatgtatctagatatttcgattggcttccacctacaaattggtttgaccct

SEQ ID NO: 53295 - RNA, 60 nt, synthetic construct
  misc_feature 1..60: note = derived and/or modified sequence opt6 from anti-influenza_CDR
  source 1..60: mol_type = other RNA
ggaacagatccagatacagaaggatattgcagaagcggaagctgtagcgcattcgatttc

SEQ ID NO: 53296 - RNA, 60 nt, synthetic construct
  misc_feature 1..60: note = derived and/or modified sequence opt6 from anti-influenza_CDR
  source 1..60: mol_type = other RNA
ggaacagatccagatacagaagtatattgcagagcaggaaattgtgcagcatttgatttt

SEQ ID NO: 53297 - RNA, 60 nt, synthetic construct
  misc_feature 1..60: note = derived and/or modified sequence opt6 from anti-influenza_CDR
  source 1..60: mol_type = other RNA
agaggaggacatagttttggatatggaagtggaggagatacacatagtgaatttgatagt

SEQ ID NO: 53298 - RNA, 60 nt, synthetic construct
  misc_feature 1..60: note = derived and/or modified sequence opt6 from anti-influenza_CDR
  source 1..60: mol_type = other RNA
catatgagtatgcaacaagtagtaagtgcaggatgggaaagagcagatttagtaggagat

SEQ ID NO: 53299 - RNA, 60 nt, synthetic construct
  misc_feature 1..60: note = derived and/or modified sequence opt6 from anti-influenza_CDR
  source 1..60: mol_type = other RNA
gattcccgtcttcgttctcttctttattttgaatggctttctcaaggttattttaatcct

SEQ ID NO: 53300 - RNA, 60 nt, synthetic construct
  misc_feature 1..60: note = derived and/or modified sequence opt6 from anti-influenza_CDR
  source 1..60: mol_type = other RNA
gcaagacatctaggacaacaactagtaagcaatacatattactattacggaatggatgta

SEQ ID NO: 53301 - RNA, 63 nt, synthetic construct
  misc_feature 1..63: note = derived and/or modified sequence opt6 from anti-influenza_CDR
  source 1..63: mol_type = other RNA
acaacaggaggaacaacaacatgtacagcagcaggatgtggaggaggatgttgtacatgttgt

SEQ ID NO: 53302 - RNA, 63 nt, synthetic construct
  misc_feature 1..63: note = derived and/or modified sequence opt6 from anti-influenza_CDR
  source 1..63: mol_type = other RNA
gcaagagcagcagacgaatcagtagaaagcctaacaataaaagcattcagaacaaattaccat

SEQ ID NO: 53303 - RNA, 63 nt, synthetic construct
  misc_feature 1..63: note = derived and/or modified sequence opt6 from anti-influenza_CDR
  source 1..63: mol_type = other RNA
gctagaatgccattagcaaattacgatctattaacaggtctatatataggtgcatttgactta

SEQ ID NO: 53304 - RNA, 63 nt, synthetic construct
  misc_feature 1..63: note = derived and/or modified sequence opt6 from anti-influenza_CDR
  source 1..63: mol_type = other RNA
gacatgctagcgtactatagcgataactcgggaaagaaatataacgtgtacgggatggatgta

SEQ ID NO: 53305 - RNA, 63 nt, synthetic construct
  misc_feature 1..63: note = derived and/or modified sequence opt6 from anti-influenza_CDR
  source 1..63: mol_type = other RNA
gatatgttagcgtattattatgatggatcgggaataagatataatttgtacgggatggatgta

SEQ ID NO: 53306 - RNA, 66 nt, synthetic construct
  misc_feature 1..66: note = derived and/or modified sequence opt6 from anti-influenza_CDR
  source 1..66: mol_type = other RNA
gctaaagatccccgtctccgtcaccttctctatttccctttcacttccatgatctattttgattat

SEQ ID NO: 53307 - RNA, 66 nt, synthetic construct
  misc_feature 1..66: note = derived and/or modified sequence opt6 from anti-influenza_CDR
  source 1..66: mol_type = other RNA
gcaaaagatagccaactaagaagcctattatatttcgaatggttaagccaaggatatttcgatcca

SEQ ID NO: 53308 - RNA, 66 nt, synthetic construct
  misc_feature 1..66: note = derived and/or modified sequence opt6 from anti-influenza_CDR
  source 1..66: mol_type = other RNA
gcaaaagatagccaactaagaagcctattatatttcgaatggttaagccaaggatatttcgattac

SEQ ID NO: 53309 - RNA, 66 nt, synthetic construct
  misc_feature 1..66: note = derived and/or modified sequence opt6 from anti-influenza_CDR
  source 1..66: mol_type = other RNA
gcaaaagatagccaactaagaagcctattatatttcgaatggttaagccaaggatatttcgaacca

SEQ ID NO: 53310 - RNA, 66 nt, synthetic construct
  misc_feature 1..66: note = derived and/or modified sequence opt6 from anti-influenza_CDR
  source 1..66: mol_type = other RNA
gcaaaagaaagaccgctaagactattaagatatttcgattggttaagcggaggagcaaacgattac

SEQ ID NO: 53311 - RNA, 66 nt, synthetic construct
  misc_feature 1..66: note = derived and/or modified sequence opt6 from anti-influenza_CDR
  source 1..66: mol_type = other RNA
gctagagatgtacataattatgactttctaactggatatccattacacttatacggtatggatgta

SEQ ID NO: 53312 - RNA, 66 nt, synthetic construct
  misc_feature 1..66: note = derived and/or modified sequence opt6 from anti-influenza_CDR
  source 1..66: mol_type = other RNA
gcgagagatggaagggaagggtatttttatgggagtgggagtttttataatttaaagggattgaat

SEQ ID NO: 53313 - RNA, 66 nt, synthetic construct
  misc_feature 1..66: note = derived and/or modified sequence opt6 from anti-influenza_CDR
  source 1..66: mol_type = other RNA
agtacagatagaggacatgtattaagatattttggatggatgttaccaggagatgcatttgatgta

SEQ ID NO: 53314 - RNA, 66 nt, synthetic construct
  misc_feature 1..66: note = derived and/or modified sequence opt6 from anti-influenza_CDR
  source 1..66: mol_type = other RNA
ttaaactattacgatagatcaggatatcactcaccagatggaccaagcaataactggttcgatcca

SEQ ID NO: 53315 - RNA, 66 nt, synthetic construct
  misc_feature 1..66: note = derived and/or modified sequence opt6 from anti-influenza_CDR
  source 1..66: mol_type = other RNA
gcaagagtaccaagagacagactactaacactatattacgaatcatcaacatacggatttgactat

SEQ ID NO: 53316 - RNA, 66 nt, synthetic construct
  misc_feature 1..66: note = derived and/or modified sequence opt6 from anti-influenza_CDR
  source 1..66: mol_type = other RNA
gcaagaaaatggggaagaatgacagtattcggagtagcaacagatcaattatactatttcgattac

SEQ ID NO: 53317 - RNA, 66 nt, synthetic construct
  misc_feature 1..66: note = derived and/or modified sequence opt6 from anti-influenza_CDR
  source 1..66: mol_type = other RNA
gcaacagatatagtagtagaaagagatgcaagtttaggaggatttaatagttatggaatggatgta

SEQ ID NO: 53318 - RNA, 69 nt, synthetic construct
  misc_feature 1..69: note = derived and/or modified sequence opt6 from anti-influenza_CDR
  source 1..69: mol_type = other RNA
gcaagaaacttaccagatatagcagtagtaacagcagtacaagacgcaacaccagtatggttcgatcca

SEQ ID NO: 53319 - RNA, 69 nt, synthetic construct
  misc_feature 1..69: note = derived and/or modified sequence opt6 from anti-influenza_CDR
  source 1..69: mol_type = other RNA
gacggtccatattcagatgactttagatctggatatgcagctagatatagatatttcggtatggatgta

SEQ ID NO: 53320 - RNA, 72 nt, synthetic construct
  misc_feature 1..72: note = derived and/or modified sequence opt6 from anti-influenza_CDR
  source 1..72: mol_type = other RNA
ggaagagaactattaagattacaacatttcttaacagatagccaaagcgaaagaagagactgtttcgatcca

SEQ ID NO: 53321 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaacaagaaatgaatggggatgtagatgtaatgacagtagtgac

SEQ ID NO: 53322 - RNA, 72 nt, synthetic construct
  misc_feature 1..72: note = derived and/or modified sequence opt6 from anti-influenza_CDR
  source 1..72: mol_type = other RNA
atgtcactattaacagaagtagaaacaccaacaaaaaacgaatgggaatgcagatgcaatgactcaagcgac

SEQ ID NO: 53323 - RNA, 72 nt, synthetic construct
  misc_feature 1..72: note = derived and/or modified sequence opt6 from anti-influenza_CDR
  source 1..72: mol_type = other RNA
atgagtctattaacagaagtagaaacaccaataagaaatgaatgggaatgcagatgtaatgacagtagtgac

SEQ ID NO: 53324 - RNA, 72 nt, synthetic construct
  misc_feature 1..72: note = derived and/or modified sequence opt6 from anti-influenza_CDR
  source 1..72: mol_type = other RNA
atgagtctattaacagaagtagaaacaccaataagaaacggatgggaatgtaaatgtaatgacagtagtgac

SEQ ID NO: 53325 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaataagaagtgaatggggatgtagatgtaatgatagtagtgat

SEQ ID NO: 53326 - RNA, 72 nt, synthetic construct
  misc_feature 1..72: note = derived and/or modified sequence opt6 from anti-influenza_CDR
  source 1..72: mol_type = other RNA
atgagttttttaccagaagtagaaacaccaataagaaatgaatggggatgtagatgtaatgatagtagtgac

SEQ ID NO: 53327 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaataagaaatgaatggggatgtagatgtaatgacagcagtaac

SEQ ID NO: 53328 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaataagaaaagaatggggatgtagatgtaatgacagtagtgac

SEQ ID NO: 53329 - RNA, 72 nt, synthetic construct
  misc_feature 1..72: note = derived and/or modified sequence opt6 from anti-influenza_CDR
  source 1..72: mol_type = other RNA
atgagttttttaacagaagtagaaacaccaataagaaatgaatggggatgtagatgtaatgacagtagtgac

SEQ ID NO: 53330 - RNA, 72 nt, synthetic construct
  misc_feature 1..72: note = derived and/or modified sequence opt6 from anti-influenza_CDR
  source 1..72: mol_type = other RNA
atgagtttaccaacagaagtagaaacaccaataagaagtgaatggggatgtagatgtaatgacagtagtgat

SEQ ID NO: 53331 - RNA, 72 nt, synthetic construct
  misc_feature 1..72: note = derived and/or modified sequence opt6 from anti-influenza_CDR
  source 1..72: mol_type = other RNA
atgagtttattaccagaagtagaaacaccaataagaaatgaatggggatgtagatgtaatgacagtagtgac

SEQ ID NO: 53332 - RNA, 72 nt, synthetic construct
  misc_feature 1..72: note = derived and/or modified sequence opt6 from anti-influenza_CDR
  source 1..72: mol_type = other RNA
atgagtttattaccagaagtagaaacaccaataagaaatggatggggatgtagatgtaatgatagtagtgac

SEQ ID NO: 53333 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaacaagaaatggatgggaatgtagatgtagtggaagtagtgat

SEQ ID NO: 53334 - RNA, 72 nt, synthetic construct
  misc_feature 1..72: note = derived and/or modified sequence opt6 from anti-influenza_CDR
  source 1..72: mol_type = other RNA
atgagtctattaacagaagtagaaacaccaataagaaatgaatgggaatacagatgtaatgacagcagtgac

SEQ ID NO: 53335 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaataagaaatgaatgggaatatagatgtagtgacagcagtgac

SEQ ID NO: 53336 - RNA, 72 nt, synthetic construct
  misc_feature 1..72: note = derived and/or modified sequence opt6 from anti-influenza_CDR
  source 1..72: mol_type = other RNA
atgagcttactaacagaagtagaaacgccaacaagaaatggatgggaatgtagatatagcgatagctcagac

SEQ ID NO: 53337 - RNA, 72 nt, synthetic construct
  misc_feature 1..72: note = derived and/or modified sequence opt6 from anti-influenza_CDR
  source 1..72: mol_type = other RNA
atgagttttttaacggaagtggaaacgttaacgagaaatggatgggaatgtagatgtagtgatagtagtgac

SEQ ID NO: 53338 - RNA, 72 nt, synthetic construct
  misc_feature 1..72: note = derived and/or modified sequence opt6 from anti-influenza_CDR
  source 1..72: mol_type = other RNA
atgagtttgttaacggaagtggaaacgttaacgagaaatggatgggaatgtaaatgtagagatagtagtgac

SEQ ID NO: 53339 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaataagaaatgaatggggatgtagatgtaatgacagtagtgac

SEQ ID NO: 53340 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaataagaagtgaatggggatgtagatgtaatgatagtggagat

SEQ ID NO: 53341 - RNA, 72 nt, synthetic construct
  misc_feature 1..72: note = derived and/or modified sequence opt6 from anti-influenza_CDR
  source 1..72: mol_type = other RNA
atgtcactattaacagaagtagaaacaccaataagaaacgaatgggaatgcagatgcaatggatcaagcgat

SEQ ID NO: 53342 - RNA, 72 nt, synthetic construct
  misc_feature 1..72: note = derived and/or modified sequence opt6 from anti-influenza_CDR
  source 1..72: mol_type = other RNA
atgagtttaccaacagaagtagaaacaccaataagaaatgaatggggatgtagatgtaatgacagtagtgac

SEQ ID NO: 53343 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaataagaaatgaatggggatgtagatgtaatggaagtagtgat

SEQ ID NO: 53344 - RNA, 72 nt, synthetic construct
  misc_feature 1..72: note = derived and/or modified sequence opt6 from anti-influenza_CDR
  source 1..72: mol_type = other RNA
atgagtttgttaacggaagtggatacgttaacgagaaatggatggggatgtagatgtagtgatagtagtgac

SEQ ID NO: 53345 - RNA, 72 nt, synthetic construct
  misc_feature 1..72: note = derived and/or modified sequence opt6 from anti-influenza_CDR
  source 1..72: mol_type = other RNA
atgagtttgttaacggaagtggaaacgttaacgaaaaatggatggggatgtagatgtagtgatagtagtgac

SEQ ID NO: 53346 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacaccaacaagaaatggatgggaatgtaaatgtagtgacagtagtgac

SEQ ID NO: 53347 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacacatacaagaaacggatgggaatgtaaatgtagtgacagtagtgac

SEQ ID NO: 53348 - RNA, 72 nt, synthetic construct
  misc_feature 1..72: note = derived and/or modified sequence opt6 from anti-influenza_CDR
  source 1..72: mol_type = other RNA
atgtcactactaacagaagtaaaaacaccaacaagaaacggatgggaatgcaaatgctcagactcatcagac

SEQ ID NO: 53349 - RNA, 72 nt, synthetic construct
  misc_feature 1..72: note = derived and/or modified sequence opt6 from anti-influenza_CDR
  source 1..72: mol_type = other RNA
atgagtttgttaacggaagtggaaacgttaacgagaaatggatggggatgtagatgtagtgatagtagtgac

SEQ ID NO: 53350 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaacaagagatggatgggaatgtaaatgtagtgatagtagtgac

SEQ ID NO: 53351 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaacaagaaatggatggggatgtagatgtagtgatagtagtgac

SEQ ID NO: 53352 - RNA, 72 nt, synthetic construct
  misc_feature 1..72: note = derived and/or modified sequence opt6 from anti-influenza_CDR
  source 1..72: mol_type = other RNA
atgagtctattaacagaagtagaaacaccaacaagaaacggatgggaatgtaaatgtaatgacagtagtgac

SEQ ID NO: 53353 - RNA, 72 nt, synthetic construct
  misc_feature 1..72: note = derived and/or modified sequence opt6 from anti-influenza_CDR
  source 1..72: mol_type = other RNA
atgagtttgttaacggaagtggaaacgttaacgagaaatggatgggaatgtaaatgtagtgatagtagtgac

SEQ ID NO: 53354 - RNA, 72 nt, synthetic construct
  misc_feature 1..72: note = derived and/or modified sequence opt6 from anti-influenza_CDR
  source 1..72: mol_type = other RNA
atgtcactattaacagaagtagaaacaccaataagaaacgaatggggatgcaaatgcaatgactcaagcgac

SEQ ID NO: 53355 - RNA, 72 nt, synthetic construct
  misc_feature 1..72: note = derived and/or modified sequence opt6 from anti-influenza_CDR
  source 1..72: mol_type = other RNA
atgagttttttaacagaagtagaaacgccaataagaaatgaatggggatgtagatgtaatggaagtagtgat

SEQ ID NO: 53356 - RNA, 72 nt, synthetic construct
  misc_feature 1..72: note = derived and/or modified sequence opt6 from anti-influenza_CDR
  source 1..72: mol_type = other RNA
atgagtttattaacagaagtagaaacgccaacaagaaatggatgggaatgtagatgtaatgatagtagtgac

SEQ ID NO: 53357 - RNA, 72 nt, synthetic construct
  misc_feature 1..72: note = derived and/or modified sequence opt6 from anti-influenza_CDR
  source 1..72: mol_type = other RNA
atgtcactattaacagaagtagaaacaccaataagaaaaggatgggaatgcaattgctcagactcaagcgac

SEQ ID NO: 53358 - RNA, 72 nt, synthetic construct
  misc_feature 1..72: note = derived and/or modified sequence opt6 from anti-influenza_CDR
  source 1..72: mol_type = other RNA
atgtcactattaacagaagtagaaacaccaacaagaaacgaatgggaatgcagatgctcagactcaagcgac

SEQ ID NO: 53359 - RNA, 72 nt, synthetic construct
  misc_feature 1..72: note = derived and/or modified sequence opt6 from anti-influenza_CDR
  source 1..72: mol_type = other RNA
atgagtttgttaacgggagtggaaacgcatacgagaaatggatggggatgtaaatgtagtgatagtagtgac

SEQ ID NO: 53360 - RNA, 72 nt, synthetic construct
  misc_feature 1..72: note = derived and/or modified sequence opt6 from anti-influenza_CDR
  source 1..72: mol_type = other RNA
atgagtttattaccggaagtagaaacacatacaagaaatggatggggatgtagatgtagtgatagtagtgac

SEQ ID NO: 53361 - RNA, 72 nt, synthetic construct
  misc_feature 1..72: note = derived and/or modified sequence opt6 from anti-influenza_CDR
  source 1..72: mol_type = other RNA
actgacggtccatattcagatgactttagatctggatatgcagctagatatagatatttcggtatggatgta

SEQ ID NO: 53362 - RNA, 75 nt, synthetic construct
  misc_feature 1..75: note = derived and/or modified sequence opt6 from anti-influenza_CDR
  source 1..75: mol_type = other RNA
gcaaaacatatgagtttacaacaagtagtaagtgcaggatgggaaagagcagatttagtaggagatgcatttgat

SEQ ID NO: 53363 - RNA, 75 nt, synthetic construct
  misc_feature 1..75: note = derived and/or modified sequence opt6 from anti-influenza_CDR
  source 1..75: mol_type = other RNA
gcaaaacatttaagtatgcaacaagtagtaagtgcaggatgggaaagagcagatttagtaggagatgcatttgat

SEQ ID NO: 53364 - RNA, 75 nt, synthetic construct
  misc_feature 1..75: note = derived and/or modified sequence opt6 from anti-influenza_CDR
  source 1..75: mol_type = other RNA
gcaaaacatgcaagtttacaacaagtagtaagtgcaggatgggaaagagcagatttagtaggagatgcatttgat

SEQ ID NO: 53365 - RNA, 75 nt, synthetic construct
  misc_feature 1..75: note = derived and/or modified sequence opt6 from anti-influenza_CDR
  source 1..75: mol_type = other RNA
gcaaaacatagtagtttacaacaagtagtaagtgcaggatgggaaagagcagatttagtaggagatgcatttgat

SEQ ID NO: 53366 - RNA, 75 nt, synthetic construct
  misc_feature 1..75: note = derived and/or modified sequence opt6 from anti-influenza_CDR
  source 1..75: mol_type = other RNA
gcaaaacatttaagtttacaacaagtagtaagtgcaggatgggaaagagcagatttagtaggagatgcatttgat

SEQ ID NO: 53367 - RNA, 75 nt, synthetic construct
  misc_feature 1..75: note = derived and/or modified sequence opt6 from anti-influenza_CDR
  source 1..75: mol_type = other RNA
gcaaaacatatgagtatgcaacaagtagtaagtgcaggatgggaaagagcagatttagtaggagatgcatttgat

SEQ ID NO: 53368 - RNA, 75 nt, synthetic construct
  misc_feature 1..75: note = derived and/or modified sequence opt6 from anti-influenza_CDR
  source 1..75: mol_type = other RNA
gcaagaggaccagaaacatactactacgacaaaacaaactggctaaactcacacccagacgaatacttccaacac

SEQ ID NO: 53369 - RNA, 75 nt, synthetic construct
  misc_feature 1..75: note = derived and/or modified sequence opt6 from anti-influenza_CDR
  source 1..75: mol_type = other RNA
acaactgacggtccatatagcgatgactttagatctggatatgcagctagatatagatatttcggtatggatgta

SEQ ID NO: 53370 - RNA, 75 nt, synthetic construct
  misc_feature 1..75: note = derived and/or modified sequence opt6 from anti-influenza_CDR
  source 1..75: mol_type = other RNA
actgacggtccatatagtgatgactttagatctggatatgcagctagatatagatatttcggtatggatgtatgg

SEQ ID NO: 53371 - RNA, 78 nt, synthetic construct
  misc_feature 1..78: note = derived and/or modified sequence opt6 from anti-influenza_CDR
  source 1..78: mol_type = other RNA
gatatacaaatgacacaatcaccaagctcattaagcgcaagcgtaggagatagagtaacaataacatgtagatcaagc

SEQ ID NO: 53372 - RNA, 78 nt, synthetic construct
  misc_feature 1..78: note = derived and/or modified sequence opt6 from anti-influenza_CDR
  source 1..78: mol_type = other RNA
gcaacaggaagagcagcaacaggatcagcatcatgtacaggaggaggaacatattggacatattgtacatgtacaaca

SEQ ID NO: 53373 - RNA, 81 nt, synthetic construct
  misc_feature 1..81: note = derived and/or modified sequence opt6 from anti-influenza_CDR
  source 1..81: mol_type = other RNA
ggatacataccagaagcaccaagagatggacaagcatatgtaagaaaagatggagaatgggtactattaagcacattctta

SEQ ID NO: 53374 - RNA, 90 nt, synthetic construct
  misc_feature 1..90: note = derived and/or modified sequence opt6 from anti-influenza_CDR
  source 1..90: mol_type = other RNA
caagtacaattactagaaacaggaggaggattagtaaaaccaggacaaagcctaaaattaagctgtgcagcaagcggattcacattcaca

SEQ ID NO: 53375 - RNA, 96 nt, synthetic construct
  misc_feature 1..96: note = derived and/or modified sequence opt6 from anti-influenza_CDR
  source 1..96: mol_type = other RNA
agattcacaatatcaagagacaactcaaaaaacacactatacctacaaatgaactcactaagagcagaagacacagcagtatactactgcgcaaaa

SEQ ID NO: 53376 - RNA, 96 nt, synthetic construct
  misc_feature 1..96: note = derived and/or modified sequence opt6 from anti-influenza_CDR
  source 1..96: mol_type = other RNA
ggagtaccatcaagatttagcggaagcggaagcggaacagatttcacactaacaataagctcattacaaccagaagatttcgcaacatattactgt

SEQ ID NO: 53377 - RNA, 15 nt, synthetic construct
  misc_feature 1..15: note = derived and/or modified sequence opt6 from anti-OX40_HeavyChain_CDR1
  source 1..15: mol_type = other RNA
agctatagcatgaac

SEQ ID NO: 53378 - RNA, 15 nt, synthetic construct
  misc_feature 1..15: note = derived and/or modified sequence opt6 from anti-OX40_HeavyChain_CDR1
  source 1..15: mol_type = other RNA
gattacgctatgcat

SEQ ID NO: 53379 - RNA, 15 nt, synthetic construct
  misc_feature 1..15: note = derived and/or modified sequence opt6 from anti-OX40_HeavyChain_CDR1
  source 1..15: mol_type = other RNA
gactcatatatgtct

SEQ ID NO: 53380 - RNA, 15 nt, synthetic construct
  misc_feature 1..15: note = derived and/or modified sequence opt6 from anti-OX40_HeavyChain_CDR1
  source 1..15: mol_type = other RNA
gacgcgtatatgagt

SEQ ID NO: 53381 - RNA, 15 nt, synthetic construct
  misc_feature 1..15: note = derived and/or modified sequence opt6 from anti-OX40_HeavyChain_CDR1
  source 1..15: mol_type = other RNA
gagtcatatatgtca

SEQ ID NO: 53382 - RNA, 15 nt, synthetic construct
  misc_feature 1..15: note = derived and/or modified sequence opt6 from anti-OX40_HeavyChain_CDR1
  source 1..15: mol_type = other RNA
agtgggtattggaat

SEQ ID NO: 53383 - RNA, 21 nt, synthetic construct
  misc_feature 1..21: note = derived and/or modified sequence opt6 from anti-OX40_LightChain_CDR2
  source 1..21: mol_type = other RNA
tatacctcccgccttcactct

SEQ ID NO: 53384 - RNA, 21 nt, synthetic construct
  misc_feature 1..21: note = derived and/or modified sequence opt6 from anti-OX40_LightChain_CDR2
  source 1..21: mol_type = other RNA
gccgcctcttcacttcaatct

SEQ ID NO: 53385 - RNA, 21 nt, synthetic construct
  misc_feature 1..21: note = derived and/or modified sequence opt6 from anti-OX40_LightChain_CDR2
  source 1..21: mol_type = other RNA
gacgcaagcaatagagcgaca

SEQ ID NO: 53386 - RNA, 21 nt, synthetic construct
  misc_feature 1..21: note = derived and/or modified sequence opt6 from anti-OX40_LightChain_CDR2
  source 1..21: mol_type = other RNA
tatacctctcgacttcgctct

SEQ ID NO: 53387 - RNA, 24 nt, synthetic construct
  misc_feature 1..24: note = derived and/or modified sequence opt6 from anti-OX40_LightChain_CDR3
  source 1..24: mol_type = other RNA
caacaaagatcaaactggccaaca

SEQ ID NO: 53388 - RNA, 24 nt, synthetic construct
  misc_feature 1..24: note = derived and/or modified sequence opt6 from anti-OX40_HeavyChain_CDR3
  source 1..24: mol_type = other RNA
gctcctcgttggtatttttctgtt

SEQ ID NO: 53389 - RNA, 24 nt, synthetic construct
  misc_feature 1..24: note = derived and/or modified sequence opt6 from anti-OX40_HeavyChain_CDR3
  source 1..24: mol_type = other RNA
gctcctcgttggtatttttctgct

SEQ ID NO: 53390 - RNA, 24 nt, synthetic construct
  misc_feature 1..24: note = derived and/or modified sequence opt6 from anti-OX40_HeavyChain_CDR3
  source 1..24: mol_type = other RNA
gcgccaagatggtattttgcagta

SEQ ID NO: 53391 - RNA, 27 nt, synthetic construct
  misc_feature 1..27: note = derived and/or modified sequence opt6 from anti-OX40_LightChain_CDR3
  source 1..27: mol_type = other RNA
caacaaggaaatacattaccatggaca

SEQ ID NO: 53392 - RNA, 27 nt, synthetic construct
  misc_feature 1..27: note = derived and/or modified sequence opt6 from anti-OX40_HeavyChain_CDR3
  source 1..27: mol_type = other RNA
gagtcgggttggtatttgtttgattat

SEQ ID NO: 53393 - RNA, 27 nt, synthetic construct
  misc_feature 1..27: note = derived and/or modified sequence opt6 from anti-OX40_LightChain_CDR3
  source 1..27: mol_type = other RNA
caacaatacaactcctacccccccacc

SEQ ID NO: 53394 - RNA, 27 nt, synthetic construct
  misc_feature 1..27: note = derived and/or modified sequence opt6 from anti-OX40_LightChain_CDR3
  source 1..27: mol_type = other RNA
caacaaggccacacactaccaccaaca

SEQ ID NO: 53395 - RNA, 27 nt, synthetic construct
  misc_feature 1..27: note = derived and/or modified sequence opt6 from anti-OX40_LightChain_CDR3
  source 1..27: mol_type = other RNA
caacaaggccatacattaccagcaaca

SEQ ID NO: 53396 - RNA, 27 nt, synthetic construct
  misc_feature 1..27: note = derived and/or modified sequence opt6 from anti-OX40_LightChain_CDR3
  source 1..27: mol_type = other RNA
caacaaggccatacagcaccaccaaca

SEQ ID NO: 53397 - RNA, 27 nt, synthetic construct
  misc_feature 1..27: note = derived and/or modified sequence opt6 from anti-OX40_LightChain_CDR3
  source 1..27: mol_type = other RNA
caacaaggcgcaacactaccaccaaca

SEQ ID NO: 53398 - RNA, 27 nt, synthetic construct
  misc_feature 1..27: note = derived and/or modified sequence opt6 from anti-OX40_LightChain_CDR3
  source 1..27: mol_type = other RNA
caacaaggacacgcactaccaccaaca

SEQ ID NO: 53399 - RNA, 27 nt, synthetic construct
  misc_feature 1..27: note = derived and/or modified sequence opt6 from anti-OX40_LightChain_CDR3
  source 1..27: mol_type = other RNA
caacaagcccacacactcccacccaca

SEQ ID NO: 53400 - RNA, 27 nt, synthetic construct
  misc_feature 1..27: note = derived and/or modified sequence opt6 from anti-OX40_LightChain_CDR3
  source 1..27: mol_type = other RNA
caacaaggacacacactagcaccaaca

SEQ ID NO: 53401 - RNA, 27 nt, synthetic construct
  misc_feature 1..27: note = derived and/or modified sequence opt6 from anti-OX40_LightChain_CDR3
  source 1..27: mol_type = other RNA
caagccggccatacattaccaccaaca

SEQ ID NO: 53402 - RNA, 30 nt, synthetic construct
  misc_feature 1..30: note = derived and/or modified sequence opt6 from anti-OX40_HeavyChain_CDR1
  source 1..30: mol_type = other RNA
ggatatacatttacatcttacgttatgcat

SEQ ID NO: 53403 - RNA, 30 nt, synthetic construct
  misc_feature 1..30: note = derived and/or modified sequence opt6 from anti-OX40_HeavyChain_CDR3
  source 1..30: mol_type = other RNA
tattacggctcatctttatctatggattat

SEQ ID NO: 53404 - RNA, 33 nt, synthetic construct
  misc_feature 1..33: note = derived and/or modified sequence opt6 from anti-OX40_LightChain_CDR1
  source 1..33: mol_type = other RNA
cgcgcatctcaagacatatctaactacctaaat

SEQ ID NO: 53405 - RNA, 33 nt, synthetic construct
  misc_feature 1..33: note = derived and/or modified sequence opt6 from anti-OX40_LightChain_CDR1
  source 1..33: mol_type = other RNA
agggcaagtcaaggaataagtagttggttagca

SEQ ID NO: 53406 - RNA, 33 nt, synthetic construct
  misc_feature 1..33: note = derived and/or modified sequence opt6 from anti-OX40_LightChain_CDR1
  source 1..33: mol_type = other RNA
cgtgcatctcaatctgtatcttcatatttagcc

SEQ ID NO: 53407 - RNA, 39 nt, synthetic construct
  misc_feature 1..39: note = derived and/or modified sequence opt6 from anti-OX40_HeavyChain_CDR3
  source 1..39: mol_type = other RNA
tataggtatgattatgatggtgggcatgcgatggattat

SEQ ID NO: 53408 - RNA, 39 nt, synthetic construct
  misc_feature 1..39: note = derived and/or modified sequence opt6 from anti-OX40_HeavyChain_CDR3
  source 1..39: mol_type = other RNA
tataaatatgattatgatgccggacatgcaatggactat

SEQ ID NO: 53409 - RNA, 39 nt, synthetic construct
  misc_feature 1..39: note = derived and/or modified sequence opt6 from anti-OX40_HeavyChain_CDR3
  source 1..39: mol_type = other RNA
tataagtatgattatgatggcgggcatgcgatggattat

SEQ ID NO: 53410 - RNA, 45 nt, synthetic construct
  misc_feature 1..45: note = derived and/or modified sequence opt6 from anti-OX40_HeavyChain_CDR3
  source 1..45: mol_type = other RNA
gatcaatcgactgcagattattatttttattatggcatggacgta

SEQ ID NO: 53411 - RNA, 48 nt, synthetic construct
  misc_feature 1..48: note = derived and/or modified sequence opt6 from anti-OX40_HeavyChain_CDR2
  source 1..48: mol_type = other RNA
tacatatcctacaacggcatcacataccacaacccatccctcaaatca

SEQ ID NO: 53412 - RNA, 48 nt, synthetic construct
  misc_feature 1..48: note = derived and/or modified sequence opt6 from anti-OX40_HeavyChain_CDR2
  source 1..48: mol_type = other RNA
tacatatcctacaacgccatcacataccacaacccatccctcaaatca

SEQ ID NO: 53413 - RNA, 48 nt, synthetic construct
  misc_feature 1..48: note = derived and/or modified sequence opt6 from anti-OX40_HeavyChain_CDR2
  source 1..48: mol_type = other RNA
tacatatcctactccggcatcacataccacaacccctccctcaaatca

SEQ ID NO: 53414 - RNA, 51 nt, synthetic construct
  misc_feature 1..51: note = derived and/or modified sequence opt6 from anti-OX40_HeavyChain_CDR2
  source 1..51: mol_type = other RNA
tatataaatccatataacgacggaacaaaatataacgaaaaattcaaaggc

SEQ ID NO: 53415 - RNA, 51 nt, synthetic construct
  misc_feature 1..51: note = derived and/or modified sequence opt6 from anti-OX40_HeavyChain_CDR2
  source 1..51: mol_type = other RNA
tatatatcttcatcttcatctacaattgactatgcagattcagttaaaggt

SEQ ID NO: 53416 - RNA, 51 nt, synthetic construct
  misc_feature 1..51: note = derived and/or modified sequence opt6 from anti-OX40_HeavyChain_CDR2
  source 1..51: mol_type = other RNA
ggaataagttggaatagtggaagtatagggtatgcggatagtgtaaaggga

SEQ ID NO: 53417 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagataacggtgactcaagctataaccaaaaatttagagaa

SEQ ID NO: 53418 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagataacgctgactcaagctataaccaaaaatttagagaa

SEQ ID NO: 53419 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagataacgcagacgcaagctataaccaaaaatttagagaa

SEQ ID NO: 53420 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagataacggagacgcaagctataaccaaaaatttagagaa

SEQ ID NO: 53421 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagatagcggtgactcaagctataaccaaaaatttagagaa

SEQ ID NO: 53422 - RNA, 51 nt, synthetic construct
  misc_feature 1..51: note = derived and/or modified sequence opt6 from anti-OX40_HeavyChain_CDR2
  source 1..51: mol_type = other RNA
gatatgtatccagataacggtagctcaagctataaccaaaaatttagagaa

SEQ ID NO: 53423 - RNA, 309 nt, synthetic construct
  misc_feature 1..309: note = derived and/or modified sequence opt6 from Ig_LightChain_kappa_constant_domain
  source 1..309: mol_type = other RNA
acagtagcagcaccatcagtattcatattcccaccatcagacgaacaactaaaatcaggaacagcatcagtagtatgcctactaaacaacttctacccaagagaagcaaaagtacaatggaaagtagacaacgcactacaatcaggaaactcacaagaatcagtaacagaacaagactcaaaagactcaacatactcactatcatcaacactaacactatcaaaagcagactacgaaaaacacaaagtatacgcatgcgaagtaacacaccaaggactatcctcaccagtaacaaaatcattcaacaga

SEQ ID NO: 53424 - RNA, 309 nt, synthetic construct
  misc_feature 1..309: note = derived and/or modified sequence opt6 from Ig_LightChain_kappa_constant_domain
  source 1..309: mol_type = other RNA
acagtagcagcaccatcagtattcatattcccaccatcagacgaacaactaaaatcaggaacagcatcagtagtatgcctactaaacaacttctacccaagagaagcaaaagtacaatggaaagtagacaacgcactacaatcaggaaactcacaagaatcagtaacagaacaagactcaaaagactcaacatactcactatcaaacacactaacactatcaaaagcagactacgaaaaacacaaagtatacgcatgcgaagtaacacaccaaggactatcatcaccagtaacaaaatcattcaacaga

SEQ ID NO: 53425 - RNA, 312 nt, synthetic construct
  misc_feature 1..312: note = derived and/or modified sequence opt6 from Ig_LightChain_lambda_constant_domain
  source 1..312: mol_type = other RNA
ccaaaagcagcaccatcagtaacactattcccaccatcatcagaagaactacaagcaaacaaagcaacattagtatgcctaatatcagacttctacccaggagccgtaacagtagcatggaaagcagactcatcaccagtaaaagcaggagtagaaacaacaacaccatcaaaacaatcaaacaacaaatacgcagcatcatcatacttatcactaacaccagaacaatggaaatcacacagatcatactcatgccaagtaacacacgaaggatcaacagtagaaaaaacagtagcaccaacagaatgctca

SEQ ID NO: 53426 - RNA, 312 nt, synthetic construct
  misc_feature 1..312: note = derived and/or modified sequence opt6 from Ig_LightChain_lambda_constant_domain
  source 1..312: mol_type = other RNA
ccaaaagcagcaccatcagtaacactattcccaccatcatcagaagaactacaagcaaacaaagcaacactagtatgcctaatatcagacttctacccaggagcagtaacagtagcatggaaagcagactcatcaccagtaaaagcaggagtagaaacaacaacaccatcaaaacaatcaaacaacaaatacgcagcatcatcatacctatcactaacaccagaacaatggaaatcacacagatcatactcatgccaagtaacacacgaaggatcaacagtagaaaaaacagtagcaccagcagaatgctca

SEQ ID NO: 53427 - RNA, 312 nt, synthetic construct
  misc_feature 1..312: note = derived and/or modified sequence opt6 from Ig_LightChain_lambda_constant_domain
  source 1..312: mol_type = other RNA
ccaaaagcagcaccatcagtaacactattcccaccatcatcagaagaactacaagcaaacaaagcaacactagtatgcctaatatcagacttctacccaggagcagtaacagtagcatggaaagcagactcatcaccagtaaaagcaggagtagaaacaacaacaccatcaaaacaatcaaacaacaaatacgcagcatcatcatacctatcactaacaccagaacaatggaaatcacacaaatcatacagctgccaagtaacacacgaaggatcaacagtagaaaaaacagtagcaccaacagaatgctca

SEQ ID NO: 53428 - RNA, 312 nt, synthetic construct
  misc_feature 1..312: note = derived and/or modified sequence opt6 from Ig_LightChain_lambda_constant_domain
  source 1..312: mol_type = other RNA
ccaaaagcagcaccatcagtaacactattcccaccatcatcagaagaactacaagcaaacaaagcaacactagtatgcctaatatcagacttctacccaggcgcagtaacagtagcatggaaagcagactcatcaccagtaaaagcaggagtagaaacaacaacaccatcaaaacaatcaaacaacaaatacgcagcatcatcatacctatcactaacaccagaacaatggaaatcacacaaatcatactcatgccaagtaacacacgaaggatcaacagtagaaaaaacagtagcaccagcagaatgctca

SEQ ID NO: 53429 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagta

SEQ ID NO: 53430 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagta

SEQ ID NO: 53431 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagca

SEQ ID NO: 53432 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagta

SEQ ID NO: 53433 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagca

SEQ ID NO: 53434 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtactaccactagcaccatcatcaaaatcaacatcaggaggaacagcagcactaggatgcttagtaaaagactacttcccagaaccagtaacagtatcatggaactcaggagtccacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagta

SEQ ID NO: 53435 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtactaccactagcaccatcatcaaaatcaacatcaggaggaacagcagcactaggatgcctagtaaaagactacttcccagaaccagtaacagtatcatggaactcaggagtacacacattcccagcagtattacaatcatcaggactatactcactatcatcagtagtaacagtaccatcctcatcactaggaacacaaacatacatatgcaacgtaaaccacaaaccatcaaacacaaaagtagacaaaaaagca

SEQ ID NO: 53436 - RNA, 270 nt, synthetic construct
  misc_feature 1..270: note = derived and/or modified sequence opt6 from IgG1_HeavyChain_CH1_constant_domain
  source 1..270: mol_type = other RNA
tcaggaccatcagtactaccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagta

SEQ ID NO: 53437 - RNA, 270 nt, synthetic construct
  misc_feature 1..270: note = derived and/or modified sequence opt6 from IgG1_HeavyChain_CH1_constant_domain
  source 1..270: mol_type = other RNA
tctggaccttcagttctacctctagctccatcttcaaaatcaacttcaggtggaactgcagctctaggttgccttgtaaaagactatttccctgaacctgtaactgtatcttggaactcaggtgtacatacatttccagctgtacttcaatcttcaggtctatattcactttcatctgtagttacagttccatcttcatctctaggtacacaaacatatatatgtaatgttaaccataaaccttcaaatacaaaagtagataaacgtgca

SEQ ID NO: 53438 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagca

SEQ ID NO: 53439 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagta

SEQ ID NO: 53440 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtattcccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagca

SEQ ID NO: 53441 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtactaccattagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaaaagta

SEQ ID NO: 53442 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtactaccactagcaccatcatcaaaatcaacatcaggaggaacagcagcactaggatgcctagtaaaagactacttcccagaaccagtaacagtatcatggaactcaggagtacacacattcccagccgtactacaatcatcaggactatactcactatcatcagtagtaacagtaccatcatcatcactaggaacacaaacatacatatgcaacgtaaaccacaaaccatcaaacacaaaagtagacaaaaaagca

SEQ ID NO: 53443 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtactaccactagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagta

SEQ ID NO: 53444 - RNA, 282 nt, synthetic construct
  misc_feature 1..282: note = derived and/or modified sequence opt6 from IgG1_HeavyChain_CH1_constant_domain
  source 1..282: mol_type = other RNA
tcagcatcaacaaaaggaccatcagtactaccattagcaccatcatcaaaatcaacatcaggaggaacagcagcactaggatgcctagtaaaagactacttcccagaaccagtaacagtatcatggaactcaggagtacacacattcccagcagtactacaatcatcaggactatactcactatcatcagtagtaacagtaccatcatcatcactaggaacacaaacatacatatgcaacgtaaaccacaaaccatcaaacacaaaagtagacaaaagagca

SEQ ID NO: 53445 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaattactaggaggaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaataagcaaagcaaaa

SEQ ID NO: 53446 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggaggaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtattacaccaagactggctaaacggaaaagaatacaaatgcaaagtatcaaacaaagcactaccagcaccaatagaaaaaacaatatcaaaagcaaaa

SEQ ID NO: 53447 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggaggaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53448 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggaggaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53449 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53450 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53451 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53452 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactactaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53453 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggaggaccatcagtattcctattcccaccaaaaccaaaagacacactaatgataagcagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53454 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggaggaccatcagtattcctattcccaccaaaaccaaaagacacattaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggttaaacggaaaagaatacaaatgcaaagtatcaaacaaagcactaccagcaccaatagaaaaaacaatatcaaaagcaaaa

SEQ ID NO: 53455 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggaggaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtcctacaccaagactggctaaacggaaaagaatacaaatgcaaagtatcaaacaaagcactaccagcaccaatagaaaaaacaatatcaaaagcaaaa

SEQ ID NO: 53456 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggaggaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53457 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggagcaccatcagtattcctattcccaccaaaacccaaagacacactaatgatatcaagaacaccagaagtaacatgcgtagtagtagacgtatcacacgaagacccagaagtaaaattcaacgtatacgtagacggagtagaagtacacaacgcaaaaacaaaaccacgagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53458 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53459 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53460 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaactagcaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53461 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggaggaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53462 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggaggaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaataagcaaagcaaaa

SEQ ID NO: 53463 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggaggaccatcagtattcctattcccaccaaaaccaaaagacacactaatgataagcagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcattaccagcaccaatagaaaaaacaatatcaaaagcaaaa

SEQ ID NO: 53464 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggaggaccatcagtattcttattcccaccaaaaccaaaagacacattaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53465 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53466 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggagcaccatcagtattcttattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53467 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggagcaccatcagtattcctattcccaccaaaaccaaaagacacactaatgatatcaagaacaccagaagtaacatgcgtagtcgtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53468 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcactaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53469 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggaggaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53470 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggaggaccaagcgtattcctattcccaccaaaaccaaaagacacactaatgatatcaagaacaccagaagtaacatgcgtagtagtagacgtatcacatgaagacccagaagtaaaattcaacgtatacgtagacggagtagaagtacacaacgcaaaaacaaaaccaagagaagaacaatacgcatcaacatacagagtagtaagcgtactaacagtactacaccaagactggctaaacggaaaagaatacaaatgcaaagtatcaaacaaagcactaccagcaccaatagaaaaaacaatatcaaaagcaaaa

SEQ ID NO: 53471 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagccggaggaccatcagtattcctattcccaccaaaaccaaaagacacactaatgatatcaagaacaccagaagtaacatgcgtagtagtagacgtaagccacgaagacccagaagtaaaattcaactggtacgtagacggagtagaagtacacaacgcaaaaacaaaaccaagagaagaacaatacaactcaacatacagagtagtatcagtactaacagtactacaccaagactggttaaacggaaaagaatacaaatgcaaagtatcaaacaaagcactaccagcaccaatagaaaaaacaatatcaaaagcaaaa

SEQ ID NO: 53472 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggaggaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53473 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacaactcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53474 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggagcaccatcagtattcctattcccaccaaaaccaaaagacacactaatgatatcaagaacaccagaagtaacatgcgtagtagtagacgtatcacacgaagacccagaagtaaaattcaacgtatacgtagacggagtagaagtacacaacgcaaaaacaaaaccaagagaagaacaatacgcatcaacatacagagtagtatcagtactaacagtactacaccaagactggctaaacggaaaagaatacaaatgcaaagtatcaaacaaagcactaccagcaccaatagaaaaaacaatatcaaaagcaaaa

SEQ ID NO: 53475 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggagcaccatcagtattcctattcccaccaaaaccaaaagacacactaatgatatcaagaacaccagaagtaacatgcgtagtagtagacgtatcacacgaagacccagaagtaaaattcaactggtacgtagacggagtagaagtacacaacgcaaaaacaaaaccaagagaagaacaatacaactcaacatacagagtagtatcagtactaacagtactacaccaagactggttaaacggaaaagaatacaaatgcaaagtatcaaacaaagcactaccagcaccaatagaaaaaacaatatcaaaagcaaaa

SEQ ID NO: 53476 - RNA, 330 nt, synthetic construct
  misc_feature 1..330: note = derived and/or modified sequence opt6 from IgG1_HeavyChain_CH2_constant_domain
  source 1..330: mol_type = other RNA
gcaccagaagcagcaggagcaccatcagtattcctattcccaccaaaaccaaaagacacattaatgataagcagaacaccagaagtaacatgcgtagtagtagacgtatcacacgaagacccagaagtaaaattcaactggtacgtagacggagtagaagtacacaacgcaaaaacaaaaccaagagaagaacaatacgcatcaacatacagagtagtaagcgtactaacagtactacaccaagactggttaaacggaaaagaatacaaatgcaaagtatcaaacaaagcactaccagcaccaatagaaaaaacaatatcaaaagcaaaa

SEQ ID NO: 53477 - RNA, 318 nt, synthetic construct
  misc_feature 1..318: note = derived and/or modified sequence opt6 from IgG1_HeavyChain_CH3_constant_domain
  source 1..318: mol_type = other RNA
ggacaaccaagagaaccacaagtatacacactaccaccatcaagagaagaaatgacaaaaaaccaagtatcactaacatgcctagtaaaaggattctacccatcagacatagcagtagaatgggaatcaaacggacaaccagaaaacaactacaaaacaacaccaccagtactagactcagacggatcattcttcctatactcaaaactaacagtagacaaatcaagatggcaacaaggaaacgtattctcatgctcagtaatgcacgaagcactacacaaccactacacacaaaaatcactatcactatcaccagga

SEQ ID NO: 53478 - RNA, 318 nt, synthetic construct
  misc_feature 1..318: note = derived and/or modified sequence opt6 from IgG1_HeavyChain_CH3_constant_domain
  source 1..318: mol_type = other RNA
ggacaaccaagagaaccacaagtatacacactaccaccatcaagagaagaactaacaaaaaaccaagtatcactaacatgcctagtaaaaggattctacccatcagacatagcagtagaatgggaatcaaacggacaaccagaaaacaactacaaaacaacaccaccagtactagactcagacggatcattcttcctatactcaaaactaacagtagacaaatcaagatggcaacaaggaaacgtattctcatgctcagtaatgcacgaagcactacacaaccactacacacaaaaatcactatcactatcaccagga

SEQ ID NO: 53479 - RNA, 318 nt, synthetic construct
  misc_feature 1..318: note = derived and/or modified sequence opt6 from IgG1_HeavyChain_CH3_constant_domain
  source 1..318: mol_type = other RNA
ggacaaccaagagaaccacaagtatacacactaccaccatcaagagatgaaatgacaaaaaaccaagtatcactaacatgcctagtaaaaggattctacccatcagacatagcagtagaatgggaatcaaacggacaaccagaaaacaactacaaaacaacaccaccagtactagactcagacggatcattcttcctatactcaaaactaacagtagacaaatcaagatggcaacaaggaaacgtattctcatgctcagtaatgcacgaagcactacacaaccactacacacaaaaatcactatcactatcaccagga

SEQ ID NO: 53480 - RNA, 318 nt, synthetic construct
  misc_feature 1..318: note = derived and/or modified sequence opt6 from IgG1_HeavyChain_CH3_constant_domain
  source 1..318: mol_type = other RNA
ggacaaccaagagaaccacaagtatacacactaccaccatcaagagacgaactaacaaaaaaccaagtatcactaacatgcctagtaaaaggattctacccatcagacatagcagtagaatgggaatcaaacggacaaccagaaaacaactacaaaacaacaccaccagtactagactcagacggatcattcttcctatactcaaaactaacagtagacaaatcaagatggcaacaaggaaacgtattctcatgctcagtaatgcacgaagcactacacaaccactacacacaaaaatcactatcactatcaccagga

SEQ ID NO: 53481 - RNA, 297 nt, synthetic construct
  misc_feature 1..297: note = derived and/or modified sequence opt6 from IgG2_HeavyChain_CH1_constant_domain
  source 1..297: mol_type = other RNA
tcagcatcaacaaaaggaccatcagtattcccactagcaccatgctcaagatcaacatcagaatcaacagcagcactaggatgcctagtaaaagactacttcccagaaccagtaacagtatcatggaactcaggagcactaacatcaggagtacacacattcccagcagtactacaatcatcaggattatactcactatcatcagtagtaacagtaccatcatcaaacttcggaacacaaacatacacatgcaacgtagaccacaaaccatcaaacacaaaagtagacaaaacagta

SEQ ID NO: 53482 - RNA, 297 nt, synthetic construct
  misc_feature 1..297: note = derived and/or modified sequence opt6 from IgG2_HeavyChain_CH1_constant_domain
  source 1..297: mol_type = other RNA
tcagcatcaacaaaaggaccatcagtattcccactagcaccatgctcaagatcaacatcagaatcaacagcagcactaggatgcctagtaaaagactacttcccagaaccagtaacagtatcatggaactcaggagcactaacatcaggagtacacacattcccagcagtactacaatcatcaggactatactcactatcatcagtagtaacagtaacatcatcaaacttcggaacacaaacatacacatgcaacgtagaccacaaaccatcaaacacaaaagtagacaaaacagta

SEQ ID NO: 53483 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggagtagaagtacacaacgcaaaaacaaaaccaagagaagaacaattcaactcaacattcagagtagtatcagtactaacagtagtacaccaagactggctaaacggaaaagaatacaaatgcaaagtatcaaacaaaggattaccagcaccaatagaaaaaacaatatcaaaaacaaaa

SEQ ID NO: 53484 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggagtagaagtacacaacgcaaaaacaaaaccaagagaagaacaattcaactcaacattcagagtagtatcagtactaacagtagtacaccaagactggctaaacggaaaagaatacaaatgcaaagtatcaaacaaaggactaccagcatcaatagaaaaaacaatatcaaaaacaaaa

SEQ ID NO: 53485 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggagtagaagtacacaacgcaaaaacaaaaccaagagaagaacaattcaactcaacattcagagtagtatcagtactaacagtagtacaccaagactggctaaacggaaaagaatacaaatgcaaagtatcaaacaaaggactaccatcaccaatagaaaaaacaatatcaaaaacaaaa

SEQ ID NO: 53486 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtaagccacgaagacccagaagtacaattcaactggtacgtagacggagtagaagtacacaacgcaaaaacaaaaccaagagaagaacaattcaactcaacattcagagtagtatcagtactaacagtagtacaccaagactggctaaacggaaaagaatacaaatgcaaagtatcaaacaaaggactaccatcatcaatagaaaaaacaatatcaaaaacaaaa

SEQ ID NO: 53487 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggaatggaagtacacaacgcaaaaacaaaaccaagagaagaacaattcaactcaacattccgagtagtatcagtactaacagtagtacaccaagactggctaaacggaaaagaatacaaatgcaaagtatcaaacaaaggactaccagcaccaatagaaaaaacaatatcaaaaacaaaa

SEQ ID NO: 53488 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggaatggaagtacacaacgcaaaaacaaaaccaagagaagaacaattcaactcaacattcagagtagtatcagtactaacagtagtacaccaagactggctaaacggaaaagaatacaaatgcaaagtatcaaacaaaggactaccagcatcaatagaaaaaaccatatcaaaaacaaaa

SEQ ID NO: 53489 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcctattcccaccaaaaccaaaagacacactaatgatatcaagaacaccagaagtaacatgcgtagtagtagacgtatcacacgaagacccagaagtacaattcaactggtacgtagacggaatggaagtacacaacgcaaaaacaaaaccaagagaagaacaattcaactcaacattcagagtagtatcagtactaacagtagtacaccaagactggctaaacggaaaagaatacaaatgcaaagtatcaaacaaaggactaccatcaccaatagaaaaaacaatatcaaaaacaaaa

SEQ ID NO: 53490 - RNA, 327 nt, synthetic construct
  misc_feature 1..327: note = derived and/or modified sequence opt6 from IgG2_HeavyChain_CH2_constant_domain
  source 1..327: mol_type = other RNA
gcaccaccagtagcaggaccatcagtattcttattcccaccaaaaccaaaagacacactaatgatatcaagaacaccagaagtaacatgcgtagtagtagacgtatcacacgaagacccagaagtacaattcaactggtacgtagacggaatggaagtacacaacgcaaaaacaaaaccaagagaagaacaattcaactcaacattcagagtagtatcagtattaacagtagtacaccaagactggctaaacggaaaagaatacaaatgcaaagtatcaaacaaaggactaccatcatcaatagaaaaaacaatatcaaaaacaaaa

SEQ ID NO: 53491 - RNA, 318 nt, synthetic construct
  misc_feature 1..318: note = derived and/or modified sequence opt6 from IgG2_HeavyChain_CH3_constant_domain
  source 1..318: mol_type = other RNA
ggacaaccaagagaaccacaagtatacacactaccaccatcaagagaagaaatgacaaaaaaccaagtatcactaacatgcctagtaaaaggattctacccatcagacatagcagtagaatgggaatcaaacggacaaccagaaaacaactacaaaacaacaccaccaatgctagactcagacggatcattcttcctatactcaaaactaacagtagacaaatcaagatggcaacaaggaaacgtattctcatgctcagtaatgcacgaagcactacacaaccactacacacaaaaatcactatcactatcaccagga

SEQ ID NO: 53492 - RNA, 297 nt, synthetic construct
  misc_feature 1..297: note = derived and/or modified sequence opt6 from IgG4_HeavyChain_CH1_constant_domain
  source 1..297: mol_type = other RNA
tcagcatcaacaaaaggaccatcagtattcccactagcaccatgctcaagatcaacatcagaatcaacagcagcattaggatgcctagtaaaagactacttcccagaaccagtaacagtatcatggaactcaggagcactaacatcaggagtacacacattcccagcagtattacaatcatcaggactatactcactatcatcagtagtaacagtaccatcatcatcactaggaacaaaaacatacacatgcaacgtagaccacaaaccatcaaacacaaaagtagacaaaagagta

SEQ ID NO: 53493 - RNA, 330 nt, synthetic construct
  misc_feature 1..330: note = derived and/or modified sequence opt6 from IgG4_HeavyChain_CH2_constant_domain
  source 1..330: mol_type = other RNA
gcaccagaattcctaggaggaccatcagtattcctattcccaccaaaaccaaaagacacactaatgatatcaagaacaccagaagtaacatgcgtagtagtagacgtatcacaagaagacccagaagtacaattcaactggtacgtagacggagtagaagtacacaacgcaaaaacaaaaccaagagaagaacaattcaactcaacataccgagtagtatcagtactaacagtactacaccaagactggctaaacggaaaagaatacaaatgcaaagtatcaaacaaaggactaccatcatcaatagaaaaaacaatatcaaaagcaaaa

SEQ ID NO: 53494 - RNA, 318 nt, synthetic construct
  misc_feature 1..318: note = derived and/or modified sequence opt6 from IgG4_HeavyChain_CH3_constant_domain
  source 1..318: mol_type = other RNA
ggacaaccaagagaaccacaagtatacacactaccaccatcacaagaagaaatgacaaaaaaccaagtatcactaacatgcctagtaaaaggattctacccatcagacatagcagtagaatgggaatcaaacggacaaccagaaaacaactacaaaacaacaccaccagtactagactcagacggatcattcttcctatactcaagactaacagtagacaaatcaagatggcaagaaggaaacgtattctcatgctccgtaatgcacgaagcactacacaaccactacacacaaaaatcactatcactatcactagga

SEQ ID NO: 53495 - RNA, 1347 nt, synthetic construct
  misc_feature 1..1347: note = derived and/or modified sequence opt11 from AAB-003_gamma1-Chain
  source 1..1347: mol_type = other RNA
gaagtccaactcctcgaatccggcggaggcctcgtccaacccggcggatccctacgcctatcctgcgccgccagcggcttcacattttcaaactacggcatgtcctgggtccgccaagcacccggcaaaggactcgaatgggtcgccagcatacgatccggcggaggacgcacctactactccgacaatgtaaaaggacgatttacaatctctcgcgacaactccaaaaacacactctacctacaaatgaactccctaagagcagaagacacagccgtctactactgcgtcagatacgaccattactcaggctcctccgactactggggccaaggcaccctcgtgaccgtatcctccgcatctaccaaaggaccctccgttttccccctagcaccctcctccaaatctacctccggaggaaccgccgccctaggctgccttgtaaaagattacttccccgaacccgtcaccgtctcctggaactccggcgcactcacctcaggagtccacaccttccctgccgtcctccaaagctccgggctctattccctctcctccgtagtgaccgtcccatcctcaagcctaggcacccaaacctacatctgcaacgttaaccacaaaccatccaacaccaaagtagacaagaaagtcgaaccaaaatcctgcgacaaaacccacacctgtccaccctgcccagcccctgaagccgccggcgcccctagcgtcttccttttcccacccaaacccaaagacaccctaatgatatcccgaacccccgaggtaacctgcgtcgtcgtcgacgtctcacacgaagaccccgaagtcaaattcaactggtacgtcgacggagtcgaagtccacaacgccaaaaccaagccccgagaagaacaatacaattccacctacagagttgtctccgtcctaaccgtcctccaccaagactggctcaacggcaaagaatacaaatgcaaagttagcaacaaggccctccccgcacccatcgagaaaaccatctcaaaagcaaaaggccaaccacgcgaaccacaagtctacaccctacccccatcacgcgaggaaatgactaaaaaccaagtatccctgacatgcctagtcaaaggattctacccctcagacatcgccgtcgaatgggaatcaaacggacaacccgaaaataactacaaaaccacaccgcccgtcctcgattcagacggctccttcttcctctactcaaaactcaccgtcgacaaatcacgctggcaacaaggcaacgtattctcctgctccgtcatgcacgaagctctccacaatcactacacccaaaaatcactctccctatcacccggcaaa

SEQ ID NO: 53496 - RNA, 1329 nt, synthetic construct
  misc_feature 1..1329: note = derived and/or modified sequence opt11 from Abagovomab_HeavyChain
  source 1..1329: mol_type = other RNA
caagtcaaactccaagaaagcggcgccgaacttgcacgccccggagcctcagtaaaactctcatgcaaagcctccggctacaccttcaccaactactggatgcaatgggtaaaacaaagacctggccagggactcgactggataggcgccatctacccaggcgacggaaatacccgatacacccacaaattcaaaggaaaagccacactaaccgccgacaaatcatcctcaactgcatacatgcaactctcctccctagccagcgaagactccggcgtctactactgcgcccgcggcgaaggcaactacgcatggttcgcctactggggccaaggcactacagtcacagtctcctccgccaaaacaacacccccatctgtataccccctcgcaccaggatccgccgcccaaacaaactccatggtcactctcggctgcctcgtaaaaggctacttcccagagccagtcaccgtaacctggaactccggctccctttcatcaggcgtccacaccttcccagccgtactccaatcagacctctacaccctatcgtcgtccgttaccgtcccctcttccacatggccctccgaaactgttacctgcaacgtcgcccaccccgcctcctccacaaaagtcgacaagaaaatcgtaccccgcgactgcggctgcaaaccctgcatctgcacagtacccgaagtttcatcagtcttcatcttccctcccaaacccaaagacgtactaaccatcaccctcacccccaaagtaacttgcgtcgtcgtagacatctccaaagacgaccccgaagtccaattctcgtggttcgtcgacgacgtagaagtccacaccgcacaaacccaaccccgcgaagaacaattcaactccaccttccgctccgtctccgaactcccaatcatgcaccaagactggctcaacggaaaagaatttaaatgcagagtcaactcagccgccttccctgcacccatagagaaaaccatctccaagaccaaaggccgtcccaaagcaccccaagtctataccatcccacccccaaaagaacaaatggccaaagacaaagtatccctcacatgcatgatcaccgacttcttccccgaagacatcaccgtcgaatggcaatggaacggccaacccgccgaaaactataaaaacacacaacccataatggacaccgatggctcctacttcgtctactccaaacttaacgtccaaaaatcaaactgggaagccggtaacaccttcacatgctccgtcctccacgaaggactccacaatcaccacaccgaaaaatccctctcccactcacccggcaaa

SEQ ID NO: 53497 - RNA, 642 nt, synthetic construct
  misc_feature 1..642: note = derived and/or modified sequence opt11 from Abagovomab_LightChain
  source 1..642: mol_type = other RNA
gacatcgaactcacacaatcccccgcctcactatccgccagcgtcggcgaaaccgtcacaatcacctgccaagcctccgaaaacatctactcctacctcgcctggcaccaacaaaaacaaggcaaatccccccaactcctcgtctacaacgccaaaaccctcgccggcggcgtctcctcccgcttctccggctccggctcaggcacacacttctccctaaaaatcaaatccctccaacccgaagacttcggcatctactactgccaacaccactacggcatcctccccaccttcggcggcggcaccaaactcgaaatcaaacgcgccgacgccgcccccaccgtctccatcttccccccctcctccgaacaactcacctcaggcggcgcctcagtcgtctgcttcctcaacaacttctaccccaaagacatcaacgtcaaatggaaaatcgacggctccgaacgccaaaacggcgtcctcaactcatggaccgaccaagactccaaagactcaacctactccatgtcctcaaccctcaccctaaccaaagacgaatacgaacgccacaactcctacacctgcgaagccacccacaaaacctccacctcccccatcgtcaaatccttcaaccgaaacgaatgc

SEQ ID NO: 53498 - RNA, 1350 nt, synthetic construct
  misc_feature 1..1350: note = derived and/or modified sequence opt11 from Abciximab_HeavyChain
  source 1..1350: mol_type = other RNA
gaagtccaactacaacaaagcggcgcagaactcgttaaacccggcgcatccgttaaactaagctgcaccgcctccggcttcaacatcaaggacacctacgtccactgggtaaaacaacgccccgaacaaggactcgaatggatcggccgaatcgatcccgccaacggatacacaaaatacgaccccaaattccaaggaaaagccactatcaccgcggacacaagctccaacactgcatacctccaactctcatcactcacatccgaagacaccgccgtctactactgcgtccgcccactctacgactactacgcaatggactactggggccaaggcacctcagtcacagtctcgtccgccaaaaccacagctccatcagtctaccccctcgcccccgtctgcggcgatacaaccggctccagcgtcacactaggctgcctcgtaaaaggatacttcccagaacccgtaacccttacctggaactccggttcactaagctcaggcgtccacaccttccccgcagtcctacaatcagacctctacaccctatcctcctcagtcaccgtcaccagctccacctggccctcccaatccattacctgcaacgtcgcccaccccgcctcctcaaccaaagtagacaagaaaatcgaaccccgacccaaatcctgcgacaaaacccacacttgcccaccctgcccagcccccgaactcctcggcggcccctccgtcttcctcttcccacccaaacccaaagacaccctcatgatctcccgcacacccgaagtaacatgcgttgtcgtagacgtctcccacgaagaccccgaagtcaaattcaactggtacgtcgacggagtcgaagtccacaacgccaaaaccaaaccccgcgaagaacaatacaactccacataccgtgtagtctccgtcctaaccgtactccaccaagactggctaaacggcaaagaatacaaatgcaaagtctccaacaaagccctacccgcacccatcgagaaaaccatctccaaagccaaaggccaaccccgcgaaccacaagtctacacccttccaccctcacgcgacgaactaaccaaaaaccaggtctccctaacatgcctcgtaaaaggcttctacccctcagacatcgctgtcgaatgggaatctaacggccaaccagaaaacaattacaaaaccacaccccctgtactcgactcagacggctctttctttctctacagcaaacttacagtcgacaaatcccgctggcaacaaggcaacgtcttctcttgcagcgtcatgcacgaagccctacacaaccactacacccaaaaatctctctccctctctcccggcaag

SEQ ID NO: 53499 - RNA, 642 nt, synthetic construct
  misc_feature 1..642: note = derived and/or modified sequence opt11 from Abciximab_LightChain
  source 1..642: mol_type = other RNA
gacatcctcatgacccaatcaccatcctccatgtccgtctccctaggcgacaccgtctccatcacctgccacgcctcacaaggcatctcctcaaacatcggctggctacaacaaaaaccaggaaaatccttcatgggcctaatctactacggcaccaacctcgtcgacggcgtcccctcccgattctctggctccggctcaggcgccgactactccctcaccatctcctccctcgactcagaagacttcgccgactactactgcgtccaatacgcccaactcccctacacattcggcggcggaaccaaactcgaaatcaaacgcgccgacgccgcccccaccgtatccatcttccccccctcctccgaacaactaacctccggcggcgcctccgtcgtctgcttcctcaacaacttctacccaaaagacatcaacgtcaaatggaaaatcgacggctcagaacgccaaaacggcgtcctcaactcatggaccgaccaagactccaaagactccacctactccatgtcctccaccctcaccctcaccaaagacgaatacgaacgccacaactcctacacctgcgaagccacccacaaaacctcaacctcccccatcgtcaaatcattcaaccgcaacgaatgc

SEQ ID NO: 53500 - RNA, 1341 nt, synthetic construct
  misc_feature 1..1341: note = derived and/or modified sequence opt11 from Abituzumab_HeavyChain1
  source 1..1341: mol_type = other RNA
caagtccaactccaacaaagcggcggagaactcgccaaacccggagcttccgtcaaagtctcctgcaaagcgtctggctacaccttcagctcattctggatgcactgggttcgacaagcgccaggccaaggacttgaatggataggctacatcaacccccgatcaggatacaccgaatacaacgagatattccgcgacaaagcaacaatgaccaccgacacctccacttccaccgcctatatggaactctcatctctccgctcagaagacaccgccgtctactactgcgcatccttcctcggacgcggcgcaatggactactggggtcaaggcaccaccgtcaccgtctcctccgcatcaaccaaaggcccaagcgtattccccctcgccccctgttcccgcagcacatccgaatccactgccgccctcggctgcctagtcaaagactacttccccgaacccgtcaccgtatcatggaactccggagcactcacctcaggtgtccacaccttccccgccgtcctccaaagctcaggcctatactcactctcctccgtcgtcacagtcccatcttccaacttcggcacccaaacctacacatgcaacgtagaccacaaaccctccaacacaaaagtagacaaaaccgttgaacctaaatcatctgacaaaacccacacatgcccgccctgccccgcacccccagtcgccggcccctccgtcttcttgttcccacccaaacccaaggacaccctcatgatatcacgcaccccagaagtcacatgcgtcgtcgtcgacgtcagtcacgaagaccccgaagtacaattcaactggtacgtagacggcgtagaagtccacaacgccaaaaccaaacccagagaagaacaagcccagtcgaccttccgagtagtctcagttctcaccgtcgtccaccaagactggctaaacggcaaagaatataaatgcaaagtctcaaacaaaggactacccgcccccatagagaaaactataagcaaaaccaaaggccaaccccgcgaaccacaagtatacaccctcccgccctcccgagaagaaatgaccaaaaaccaagtctcactcacatgcctagtcaaaggcttttacccctctgacatagccgtagaatgggaatccaacggccaacccgaaaacaactacaaaaccacccctcccatgctcgactccgacggatccttcttcctatactccaaactcaccgtcgacaaatccagatggcaacaaggcaacgtcttttcctgctccgtcatgcacgaagccctacacaaccactacacccaaaaatcactctccttatcacccggcaaa

SEQ ID NO: 53501 - RNA, 642 nt, synthetic construct
  misc_feature 1..642: note = derived and/or modified sequence opt11 from Abituzumab_LightChain1
  source 1..642: mol_type = other RNA
gacatccaaatgacacaatccccctcctcactatccgcctccgtcggcgaccgcgtaaccatcacatgccgcgccagccaggacatctccaactacctcgcctggtaccaacaaaaacccggcaaagccccaaaactcctcatctactacacaagcaaaatccactccggcgtcccctcccgcttctcaggctccggctccggcaccgactacaccttcaccatctcctccctccaacccgaagacatcgccacctactactgccaacaaggcaacaccttcccctacaccttcggacaaggcaccaaagtcgaaatcaaacgcaccgtcgccgccccctccgtcttcatcttcccaccctcagacgaacaactcaaatccggcacagcctccgtagtctgcctcctcaacaacttctaccctcgcgaagccaaagtccaatggaaggtcgacaacgccctccaatccggcaactcccaagaatcagtaaccgaacaagactccaaagactcaacctactccctatcctccacactaaccctatcaaaagccgactacgaaaaacacaaagtctacgcctgcgaagtcacccaccaaggcctctcctcccccgtcaccaaatccttcaaccgcggcgaatgc

SEQ ID NO: 53502 - RNA, 1332 nt, synthetic construct
  misc_feature 1..1332: note = derived and/or modified sequence opt11 from Abrilumab_HeavyChain1
  source 1..1332: mol_type = other RNA
caagtccaactcgtccaatcaggcgccgaagtcaaaaagcccggggcctcggttaaggtcagctgcaaagtctctggctacaccctctccgacctctccatccactgggtacgccaggcaccaggcaagggattagaatggatgggaggattcgacccccaagacggcgaaacaatctacgcccagaaattccaaggccgagtcaccatgaccgaagacacctccactgacaccgcctacatggaactttcctccctaaaatccgaagacaccgcagtctactactgcgccaccggatcatcatcctcatggttcgacccctggggccaaggaacactcgtcacagtctcatccgcttccacaaaaggcccctcagtattcccactcgccccctgctctcgctcaacctccgaatccaccgccgccctcggctgcctcgtcaaagactacttccccgaacccgtcacagtctcctggaactcaggcgcactcacctccggtgtacacaccttccccgccgtccttcagtcctccggcctctactccctctcctccgtcgttaccgtaccctcatcgaacttcggaacccagacctatacctgcaacgtggatcacaaaccgtccaacaccaaagtcgacaaaacagtcgaacgaaaatgctgcgtagaatgcccaccatgccccgcacccccagtagccggcccctccgtcttcctattcccacccaaacccaaggacacactaatgatctccagaacccccgaggtaacctgcgtcgttgtcgacgtatcccacgaagacccagaggtccagttcaactggtacgtagacggagtcgaagttcacaacgccaaaaccaagccaagggaagaacaatttaactcaaccttccgcgtagtctccgtcctcactgtcgtccaccaagactggcttaacggcaaagaatacaaatgcaaagtctccaacaaaggcctacccgcccccatagagaaaacaatctctaaaaccaaaggccaaccacgcgaaccccaagtctacacccttccacccagccgcgaagaaatgaccaaaaaccaagtcagcctaacctgcctcgtcaaaggcttttacccctccgacatcgccgtcgaatgggaatccaacggccaacccgaaaacaactacaaaaccacacccccaatgctcgactctgacgggtcattcttcctctactcaaaacttaccgtcgacaaatccagatggcaacaaggcaacgtcttctcctgctccgtcatgcacgaagccctccacaaccactacacccaaaaatccctctcactctcacccggcaaa

SEQ ID NO: 53503 - RNA, 642 nt, synthetic construct
  misc_feature 1..642: note = derived and/or modified sequence opt11 from Abrilumab_LightChain1
  source 1..642: mol_type = other RNA
gacatccaaatgacacaatcgccctcaagcgtaagcgccagcgtaggcgaccgcgtcaccataacctgccgcgcatcccaaggcataagctcatggctcgcctggtaccaacaaaaacccggaaaagcacccaaactcctaatctacggcgcaagcaacctcgaaagcggagtccccagcagattctcaggctcaggctcaggcacagactttaccctcaccatatcctccctacaaccagaagacttcgccaactactactgccaacaagcaaactcattcccatggacattcggacaaggcaccaaagtcgagatcaaacgcaccgtcgcagccccgtccgtattcatcttcccaccctcagacgaacaactgaaatcaggcacagcctcagtcgtctgcctactcaacaacttctacccccgagaagccaaagtccaatggaaagtcgacaacgcgctccaatccggaaactcgcaagaaagcgtcaccgaacaagacagcaaagactcaacctacagcctaagctcaaccctaaccctcagcaaagcagactacgaaaaacacaaagtatacgcatgcgaagtcacacaccaaggcctaagctcacccgtcaccaagagcttcaacagaggcgaatgc

SEQ ID NO: 53504 - RNA, 639 nt, synthetic construct
  misc_feature 1..639: note = derived and/or modified sequence opt11 from Abrilumab_LightChain1_variant2
  source 1..639: mol_type = other RNA
caaatcgtcctaacacaatcccccgctatcatgtccgcctcccccggcgaaaaagtcacaataacctgctccgcctcctcctccgtctcctacatgaactggttccaacaaaaacccggcacctcccccaaactctggatctactcaacctccaacctcgcatccggcgtccccgcccgcttctccggctcaggatccggaacctcatactcactcaccatctcccgcatggaagcagaagacgccgccacctactactgccaacaacgatcctcctaccccaacaccttcggcggcggcaccaaactagaaatcaaacgcgccgacgcagcccccaccgtctccatcttcccaccctcatccgaacaactcacctcaggcggcgcatcagtcgtctgcttcctaaacaacttctaccccaaagacatcaacgtcaaatggaaaatcgacggatcagaacgccaaaacggagtcctaaactcctggaccgaccaagactccaaagactccacatactccatgtcctcaaccctcaccctaaccaaagacgaatacgaacgccacaactcctacacatgcgaagccacccacaaaacctccacctcccccatcgtcaaatccttcaaccgcaacgaatgc

SEQ ID NO: 53505 - RNA, 1347 nt, synthetic construct
  misc_feature 1..1347: note = derived and/or modified sequence opt11 from Actoxumab_HeavyChain1
  source 1..1347: mol_type = other RNA
gaagtacaactcgtccaatccggcgccgaagttaagaaatccggagaatcactcaaaatatcctgcaaaggctccggatattccttcacatcatactggataggctgggtccgccaaatgcctggaaaaggcctcgaatggatgggcatcttctaccccggcgactcctccacacgctactccccctccttccaaggccaagtaaccatatccgcagacaaaagcgtcaacaccgcctacctccaatggtcctcactcaaagcctccgacaccgctatgtactactgtgccagacgccgcaactggggcaacgcattcgacatatggggacagggcaccatggtcaccgtatcctccgcctccacaaaaggcccctcagtattccccctcgcaccatcctccaaaagcacctccggcggcaccgccgcactcggatgcctcgtaaaagactacttccccgaacccgtcacggtctcctggaactcaggcgcactcaccagcggagtacacacattccccgccgtcctccagtccagcggcctctactccctatccagcgtagttaccgtcccctcctcctccctcggaacccaaacctacatctgcaatgtcaatcacaaacccagcaacaccaaagtcgacaagcgcgtcgaacccaagtcctgcgacaaaacacacacttgccctccctgccccgcccccgaactactcggaggcccatccgtattcctattcccacccaaacccaaagacaccctcatgatctcccgcacccccgaagtaacctgcgtagtcgtcgacgtcagccacgaagaccccgaagtaaaattcaactggtacgtcgatggtgtcgaggtccacaacgctaaaaccaagccccgcgaggaacaatacaactccacctaccgagtagtatccgtcctaaccgtactccaccaagactggctcaatggcaaagaatacaaatgcaaagtatccaacaaagccctccccgcccccatcgagaaaaccatctcgaaagcaaaaggtcaaccccgcgaaccccaagtatacaccctcccgccctcccgagaagaaatgaccaagaaccaagtctcactaacctgcctcgtcaaaggcttctacccctcggacatcgccgtagaatgggaatccaacggacaacccgaaaacaactacaaaaccacacctcccgtcctagacagcgacggctcattcttcctctactcaaaactcaccgtcgacaaatcacgctggcaacagggcaacgtattttcctgctccgtcatgcacgaagcacttcacaaccactacacccaaaaatccctcagcctctcccccggcaaa

SEQ ID NO: 53506 - RNA, 645 nt, synthetic construct
  misc_feature 1..645: note = derived and/or modified sequence opt11 from Actoxumab_LightChain1
  source 1..645: mol_type = other RNA
gaaatcgtcctcacccaatcccccggcaccctctcactctcccccggcgaacgcgccacactctcctgccgagcctcccaatccgtctcatcctcctacctcgcctggtaccaacaaaaacccggccaagctccccgactactaatctacggcgcctcctcccgcgccaccggcatcccagaccgattctccggctccggctccggcaccgacttcaccctcacaatctcccgtctagaacccgaagacttcgccgtctactactgccaacaatacggctcctcaacctggaccttcggccaaggcaccaaagtcgaaatcaaacgcaccgtcgccgccccctccgtcttcatcttcccaccctccgacgaacaactcaaatccggaaccgcctccgtcgtctgcctcctcaacaacttctacccccgcgaagccaaagtccagtggaaagtcgacaacgccctccaatccggcaactcccaagaatccgtcaccgaacaagactccaaagactcaacctactcattatcctccaccctcaccctctccaaagccgactacgaaaaacacaaagtctacgcatgcgaagtcacccaccaaggcctctcctcccccgtaaccaaatccttcaacagaggcgaatgc

SEQ ID NO: 53507 - RNA, 672 nt, synthetic construct
  misc_feature 1..672: note = derived and/or modified sequence opt11 from Adalimumab_HeavyChain
  source 1..672: mol_type = other RNA
gaggtccagctcgtggaatcgggcggaggcctggtccagcccggacgctccctccgactctcgtgcgcggcctcgggcttcaccttcgacgactacgcaatgcactgggtacgccaggccccgggcaagggcctagaatgggtctcggccataacctggaactcgggccacatcgactacgcggactcggtagagggcagattcacgatctcgcgcgacaacgcgaaaaacagcctgtacctacaaatgaactcactcagggccgaggacacagcagtgtactactgcgcaaaagtgagctacctctccaccgcgagctcgctcgactactggggccagggcacgctcgtgaccgtgagctcagcatcgaccaagggaccgagcgtattcccactagccccctcgagcaaaagcacgagcgggggcacggccgcactcggatgcctagtcaaagactacttcccggaacccgtaaccgtctcatggaacagcggagcattaacatccggagtgcacacgttcccggccgtgctccagagctcgggactgtactcactctcgagcgtagtcacggtcccaagcagctcattaggcacgcaaacatacatatgcaacgtcaaccacaagccctcgaacacaaaagtggacaagaaagtggaaccgaaatcgtgc

SEQ ID NO: 53508 - RNA, 642 nt, synthetic construct
  misc_feature 1..642: note = derived and/or modified sequence opt11 from Adalimumab_LightChain
  source 1..642: mol_type = other RNA
gacatccaaatgacccaatcaccctcaagcctatccgcatccgtcggcgaccgcgtcaccatcacatgccgcgcctcccaaggcatccgcaactacctcgcctggtaccaacaaaaacccggcaaagcacccaaactcctcatctacgccgcctccaccctccaaagcggcgtcccctcacgcttctcaggctccggctcaggcaccgacttcaccctcacaatctcctccctccaacccgaagacgtcgccacctactactgccaacgatacaaccgcgccccctacaccttcggccaaggcaccaaagtcgaaatcaaacgcaccgtcgccgccccctcagtcttcatcttcccaccctccgacgaacaactaaaatccggcacagcctcagtcgtctgcctcctcaacaacttctacccccgcgaagccaaagtccaatggaaagtcgacaacgccctccaatccggcaactcccaagaaagcgtcaccgaacaagactcaaaagactccacctactccctctcctcaacactcacactctccaaagccgactacgaaaaacacaaagtctacgcctgcgaagtcacccaccaaggcctctcctcacccgtcaccaaatccttcaaccgcggcgaatgc

SEQ ID NO: 53509 - RNA, 1359 nt, synthetic construct
  misc_feature 1..1359: note = derived and/or modified sequence opt11 from Aducanumab_HeavyChain1
  source 1..1359: mol_type = other RNA
caagtccaactcgtcgaatccggaggcggcgtcgtccaacccggccgatctctccgactctcatgcgccgcctccggattcgcattctcatcctacggcatgcactgggtccgacaagcccccggcaaaggcctcgaatgggtagcagtaatctggttcgatggcacaaagaaatactacaccgactccgtcaaaggcagattcaccatcagccgggacaattccaaaaacaccctctacctccaaatgaacaccctccgcgccgaggacaccgcagtctactattgcgcacgagatcggggaatcggcgcccgccgcggaccctactacatggacgtctggggcaaaggcaccaccgtcacagtctcatccgcctccaccaaaggcccctccgtcttcccactagcaccttcctccaaatccacctccggcggaaccgccgccctcggctgtctcgtcaaagactacttcccagaacccgtcaccgtctcctggaactccggcgcccttacctccggcgtccacaccttcccagctgtactccaatcatcgggcctctactccctctcatcagtcgtcacagtaccctcttcatctctcggcacacaaacctacatatgcaacgtaaaccacaaacccagcaacaccaaagtcgacaaaagagtagaacccaaatcatgcgataaaacccacacatgcccaccctgcccagcccccgaactcctcggcggaccctcagtgttcctcttccctcccaaacctaaagacacactcatgatctctcgtacccccgaagtcacttgcgtcgtcgtcgatgtctcacacgaagacccagaagtcaaattcaactggtacgtagacggtgtcgaagtccacaatgccaaaaccaaaccccgagaagaacaatacaactcgacctaccgcgtcgtatccgtcctcaccgtcctccaccaagactggctcaatggcaaagaatataaatgcaaagtctcaaacaaagcactccccgcccccatcgagaaaacaatatccaaagcaaaaggccaaccacgcgaaccccaagtctacacactcccaccctcccgcgaagaaatgaccaaaaaccaagtatcccttacctgcctcgtcaaaggcttctacccctccgacatcgcagtcgaatgggaaagcaacggccaacccgaaaacaactacaagaccacaccacccgtcctcgactccgacggctccttcttcctgtactccaaactcaccgtcgacaaatccagatggcaacaaggaaacgtcttctcctgctccgtaatgcacgaagccctgcacaaccactacacccaaaaatccctatctctatcccccggc

SEQ ID NO: 53510 - RNA, 642 nt, synthetic construct
  misc_feature 1..642: note = derived and/or modified sequence opt11 from Aducanumab_LightChain1
  source 1..642: mol_type = other RNA
gacatccaaatgacccaatccccctcctcactctccgcctccgtcggcgaccgcgtaaccataacctgccgcgcctcacaatcaatctcttcatacctaaactggtaccaacaaaaacccggtaaagcccccaaactactcatctacgccgcctcctccctccaatccggcgtcccctcccgcttctcaggctccggctccggcaccgacttcaccctcaccatcagctcgctccaacccgaagacttcgccacctactactgccaacaatcctactcaactcccctcaccttcggaggcggcaccaaagtcgaaataaagcgcaccgtcgcagcccccagcgtcttcatcttcccaccctcagacgaacaactcaaatccggcaccgcctccgtcgtctgcctcctcaacaacttctacccccgcgaagccaaggtccaatggaaagtcgacaacgccctccaatccggcaactcccaagaatccgtcaccgaacaagactccaaagactcaacctactccctatcctccaccctcaccctatcaaaagccgactacgaaaaacacaaagtctacgcatgcgaagtcacccaccaaggcctatcctcccccgtcaccaaatccttcaaccgcggcgaatgc

SEQ ID NO: 53511 - RNA, 1359 nt, synthetic construct
  misc_feature 1..1359: note = derived and/or modified sequence opt11 from Afasevikumab_HeavyChain1
  source 1..1359: mol_type = other RNA
gaagtccaactcgtcgaatccggcggcgggctcgtccaacccggacgatcactcaggctttcctgcgccgcctccgggttcacattcgacgactacgccatgcactgggtccgccaagcccccggcaaaggcctcgaatgggtctccggcatcaactggagctcaggcggaatcggctacgccgactccgtaaaaggtcgcttcaccatctcacgcgacaacgccaaaaactccctctacctccaaatgaactccctccgcgcagaagacaccgcactctactactgcgcccgagacatcggcggattcggcgagttctactggaacttcggtctctggggacgcggaaccctggtcactgtctcctccgcatccaccaaaggcccctcagtcttccccctcgccccatcctcgaaatccacctccggcggcaccgccgccctaggatgcctagtcaaagattacttccccgaacccgtaaccgtcagctggaactccggagccctaacctcaggtgtccacaccttcccagccgtcctccaatcctccggcctttactccctatcatccgtcgtcaccgtcccctcctcaagtctcggtacacaaacatacatctgcaacgtaaatcacaaaccatccaacaccaaagtcgacaaacgagtagaacccaaaagctgcgacaaaacacatacctgcccaccctgccccgcacccgaactactaggagggccatccgtcttcctattcccacccaaacccaaagacaccctaatgatctcccgaacccccgaagttacctgcgtcgtcgtggacgtctcacacgaagaccccgaagtaaaattcaactggtacgtagacggagtcgaagtccacaacgccaagaccaaacccagagaagaacaatacaactccacctacagagtcgtctccgtcctcacagtactccaccaagactggctcaacggcaaagaatacaaatgcaaagtctcaaacaaagccctccccgctcccatcgaaaagacaatctctaaagctaaaggacaaccccgagaaccccaagtatacaccctcccaccctcccgagaagaaatgaccaaaaaccaagtctccctcacatgcctcgttaaaggattttacccctccgacatcgccgtcgaatgggaaagcaatggccaacccgaaaacaattacaaaaccaccccacccgtcctcgactcagacggatccttcttcctctactcaaaactcactgtcgacaaatccagatggcaacaaggcaacgtattctcatgctcagtcatgcacgaagccctccacaatcactacacccagaaatcactaagcctgtcccccggcaaa

SEQ ID NO: 53512 - RNA, 645 nt, synthetic construct
  misc_feature 1..645: note = derived and/or modified sequence opt11 from Afasevikumab_LightChain1
  source 1..645: mol_type = other RNA
gaaatcgtcctcacccaatcccccgccaccctgtcactctcccccggcgaacgcgccaccctctcctgccgcgcctcccaatccgtccgctcttacctcgcctggtaccaacaaaaacccggccaagccccccgactcctcatctacgacgcctcaaaccgcgccaccggcatccccgcccgcttctccggctccggatccggcaccgacttcacactcaccatctcatccctcgaaccagaagacttcgccgtatactactgccaacaacgctccaactggccccccgccaccttcggcggcggcaccaaagtcgaaatcaaacgcacagtcgctgccccctccgtcttcatcttccccccctccgacgaacaactaaaatccggaaccgcctccgtcgtctgcctactcaacaacttctacccccgcgaagcaaaagtccaatggaaagtagacaacgcactccaatccggcaactcccaagaatccgtcaccgaacaagactccaaagactcaacctactctctatcctccaccctcaccctctccaaagccgactacgaaaaacacaaagtctacgcctgcgaagtcacccaccaaggactctcctcccccgtcaccaaatccttcaaccgcggcgaatgc

SEQ ID NO: 53513 - RNA, 1293 nt, synthetic construct
  misc_feature 1..1293: note = derived and/or modified sequence opt11 from Aflibercept_Fusion_protein1
  source 1..1293: mol_type = other RNA
tccgacacaggccgcccattcgttgaaatgtactcagaaataccagaaataatccacatgaccgaaggccgcgaactcgtcataccctgccgagtcacatctcccaatatcaccgtcaccctcaagaaattccccctcgacaccttaatacccgacggcaaacgtatcatatgggactcacgcaaaggcttcatcatctccaacgcaacttacaaagagatcggcctcttaacctgcgaagccaccgtaaacggtcacctctacaaaaccaactacctcacccacagacaaaccaacacaatcatagacgtcgtactctccccatcccacggcatcgaactatccgtcggcgaaaaactcgtccttaactgcactgcccgaaccgaactcaacgtcggcatcgacttcaactgggaatacccctccagcaaacaccaacacaagaaactcgtaaaccgcgacctgaaaacccaaagcggctcagagatgaagaaattcctatccacactaaccatcgacggcgtaacccgatccgaccaaggcctatacacatgcgccgcctcctccggtctcatgaccaagaaaaactccacattcgtaagagtccacgaaaaagacaaaacccacacatgcccaccctgccccgcccccgaactactcggcggcccctccgtcttcctcttcccacccaaacccaaagacaccctcatgatcagcagaaccccagaagtaacctgcgtcgtcgtcgacgtctcccacgaagaccccgaagtcaaattcaactggtacgtcgacggagtagaagtacacaacgcgaaaacaaaaccccgcgaagaacaatacaactcaacataccgcgtagtcagtgtactcaccgtcctccaccaagactggctcaacggcaaagaatacaaatgcaaagtatccaacaaagcactccccgcccccatcgagaaaaccatatcaaaagccaaaggccaaccccgcgaaccccaagtctacacactacctccctcccgagacgaactaaccaaaaaccaagtatccctcacctgtctcgtcaaaggcttctacccctccgacatcgcagtcgaatgggaatcaaacggacaacccgaaaacaactacaaaaccacacctcccgtcctcgactctgacggctcattcttcctctactcaaaactcacagtcgacaaatcacgctggcaacaaggcaacgtcttctcctgcagcgtcatgcacgaagccctacacaaccactatacccaaaaatccctctcgctatcccccggc

SEQ ID NO: 53514 - RNA, 1332 nt, synthetic construct
  misc_feature 1..1332: note = derived and/or modified sequence opt11 from Afutuzuab_HeavyChain1
  source 1..1332: mol_type = other RNA
caagtccaattagtacaatccggcgctgaagtcaagaaacccggctcaagtgtcaaagtctcctgcaaagcctcaggctacgccttctcatactcttggatcaactgggtacgccaagcacccggacaaggcctcgaatggggccgcatattccctggcgacggcgacacagactacaacggaaaattcaaaggccgtgtcacaatcaccgccgacaaaagcacatccacagcctacgaactctcctcactccgctcagaagacacagccgtctactactgtgcccgaaacgtcttcgacggatactggctcgtctactggggccaaggcaccctcgttacggtctcatccgcctccaccaaaggcccctccgtattccccctcgccccctcatccaaatccacctcaggcggcacagccgccctcggctgccttgtaaaagactacttcccagagccagtcaccgtatcatggaactccggcgcactcacaagcggagtccacacattccccgccgtactccaatcctcaggcctatatagcctcagctctgtcgtcaccgtcccatcctcgtccctaggcacacaaacatacatctgcaatgtcaaccacaaaccctccaataccaaagtagataagaaagttgaacccaaatcatgcgacaaaacccacacctgtccaccctgccccgcccccgagctcctcggcggcccctccgtcttcctattcccacccaaacccaaagacaccctcatttcccgaacccccgaagttacctgcgtcgtcgtcgacgtcagccacgaagaccccgaagtaaaattcaactggtacgtcgacggcgtcgaagtccacaacgccaaaacaaaaccccgcgaagaacaatacaactcaacctaccgcgtcgtcagcgttctcaccgtcctccaccaagactggctaaacggaaaagaatataaatgcaaagtctcaaacaaagccctacccgcccctatcgagaaaacaatctcaaaagccaaaggacaaccccgcgaaccccaagtctatacactccctccctcccgggacgaacttaccaaaaaccaagtcagcctaacctgcctcgtcaaaggtttctacccctcagacatcgccgttgaatgggaatccaacggccaacccgaaaacaactacaaaaccacacctcccgtactcgactccgacggctcattcttcctctactcaaaactcactgtggacaaatctcgatggcaacaaggaaacgtcttctcctgctccgtccacgaagcccttcacaaccactacacccaaaaatccctttccctctcacccgga

SEQ ID NO: 53515 - RNA, 651 nt, synthetic construct
  misc_feature 1..651: note = derived and/or modified sequence opt11 from Afutuzuab_LightChain1
  source 1..651: mol_type = other RNA
gacatcgtcacccaaacacccctctccctacccgtcacccccggcgaacccgcctccatctcctgccgctcctccaaatccctactccactccaacggcatcacctacctctactggtacctccaaaaacccggccaaagcccccaactcctcatctaccaatcaaacctagtctctggcgtccccgaccgcttctccggctctggatccggcaccgacttcaccctcaaaatctcccgcgtcgaagccgaagacgtaggcgtctactactgcgcccaaaacctagaactcccctacaccttcggcggcggcaccaaagtcgaaatcaaacgcaccgtcgccgccccctccgtcttcatcttcccaccctccgacgaacaactaaaatccggcaccgcatccgtcgtctgcctcctcaacaacttctacccccgcgaagccaaagtccaatggaaagtcgacaacgccctccaatccggcaactcccaagaatccgtcaccgaacaagactccaaagactcaacctattctctctcctcaaccctcaccctctccaaagccgactacgaaaaacacaaagtctacgcctgcgaagtaacccaccaaggcctatcctcccccgtcaccaaatccttcaaccgcggcgaatgc

SEQ ID NO: 53516 - RNA, 1347 nt, synthetic construct
  misc_feature 1..1347: note = derived and/or modified sequence opt11 from Afutuzumab_HeavyChain1
  source 1..1347: mol_type = other RNA
caagtccaactcgtacaatccggcgccgaagtcaagaaacccggctcctccgtcaaagtatcctgcaaagcctccggatacgccttctcctacagctggatcaactgggtccgccaggccccaggacaagggctcgaatggatgggaagaatcttccccggcgacggagacaccgactacaacggcaaattcaaaggacgagttaccatcacagccgacaaatccacctccacagcctacatggaactctcctccctccgctcagaagacaccgccgtatattactgcgcccgtaacgtcttcgacggctactggctagtctactggggccaaggcaccctcgtcacagtcagctccgcctcaaccaaaggcccgtcagtattccccctcgccccctcctcaaaaagcacatctggcggaaccgccgccctcggctgcctcgtcaaagactacttccccgaacccgtaaccgtatcctggaactccggcgcgctaacatccggcgtacacaccttccccgcggtcctccagtcatccggactctactccctatcaagcgtagtcaccgtgccctcctcctccctaggcacacaaacctacatatgcaacgtcaatcacaaaccgtccaacaccaaagtagacaagaaagtcgaacccaaatcctgcgacaaaacacacacatgcccaccctgccccgcccccgaactcctcggcggcccgtccgtattcctcttccctcccaaacccaaagacaccctcatgatatccagaacgcccgaagtcacatgcgtcgtagtcgacgtcagccacgaagacccggaagtcaaattcaattggtacgtagacggcgtcgaagtacacaacgccaaaactaaaccccgcgaagaacagtataactccacctaccgcgtagtctccgtcctaaccgtcctacaccaagactggctcaacggaaaagaatacaaatgcaaagtctccaacaaagcactacccgcacccatagagaaaaccatatcgaaagccaaaggacagccccgcgaaccccaagtctacaccctcccaccatccagagacgaactcaccaaaaaccaagtatccctaacctgcctagttaaaggattctacccctcagacatcgcagtagaatgggaatccaacggacaacccgaaaacaactacaaaaccaccccacccgtactcgactccgacggatcattcttcctatacagcaaactcaccgtcgacaaaagccgatggcaacaaggcaacgtattctcatgctccgtcatgcacgaagcactccacaaccactatacacaaaaatccctctcactctcccccggaaaa

SEQ ID NO: 53517 - RNA, 657 nt, synthetic construct
  misc_feature 1..657: note = derived and/or modified sequence opt11 from Afutuzumab_LightChain1
  source 1..657: mol_type = other RNA
gacatcgtcatgacccagacacccctctccctacccgtcacccccggagaacccgcctcaatctcctgccgctcctccaaatcactcctccactccaacggaatcacctacctatactggtacctccaaaaacccggccaatctccccaactcctgatctaccaaatgtccaacctcgtctccggcgtccccgaccgcttctccggctccggctccggcaccgacttcaccctcaaaatctcccgagtcgaagccgaagacgtaggagtctactactgcgctcaaaacctcgaactcccctacaccttcggcggcggcaccaaagtcgaaatcaaacgcacagtcgccgccccatccgtcttcatcttcccaccctcagacgaacaactcaaatccggcaccgcctccgtcgtatgcctcctcaacaacttctacccccgagaagccaaagtccaatggaaagtcgacaacgccctccaaagcggcaactcacaagaatccgtcaccgaacaagacagcaaagactccacctactccctctcctccacactcaccctatccaaagccgactacgaaaaacacaaagtatacgcctgcgaagtcacccaccaaggcctatcctcccccgtcaccaaatccttcaaccgcggcgaatgc

SEQ ID NO: 53518 - RNA, 684 nt, synthetic construct
  misc_feature 1..684: note = derived and/or modified sequence opt11 from Alacizumab_pegol_HeavyChain1
  source 1..684: mol_type = other RNA
gaagtccaacttgtagaatccggcggtggtctcgtccaacccggcggctccctccgcctctcctgcgcagcatcaggcttcaccttctcctcctacggcatgtcctgggtccgacaggcccccggcaaaggcctcgaatgggtagccaccatcacctccggaggctcctacacctactacgtcgactccgtaaaaggccgcttcaccatctcacgcgacaacgccaaaaacaccctctacctacaaatgaactccctccgcgccgaagacaccgccgtatactactgcgtacgcatcggcgaagacgcactcgactattggggccaaggcacccttgtcaccgtctcctcagcctctaccaaaggcccctctgtattccccctcgccccctcatccaaatccacctcaggcggaaccgccgccctcggctgcctcgtcaaagactacttccccgaacccgtcaccgtctcatggaactcaggcgcccttacctccggcgtccacaccttccccgccgtcctccaatcctcaggcctctactctctctcctccgtcgtcaccgtcccctcctcctccctcggcacccaaacctacatctgcaacgtcaaccacaaaccctccaacaccaaagtcgacaagaaagtcgaacccaaatcttgcgacaaaacccacacatgcgccgcc

SEQ ID NO: 53519 - RNA, 642 nt, synthetic construct
  misc_feature 1..642: note = derived and/or modified sequence opt11 from Alacizumab_pegol_LightChain1
  source 1..642: mol_type = other RNA
gacatccaaatgacccaatctccctcatccctctccgcctccgtaggcgaccgagtcacaatcacctgccgcgcctcccaagacatcgccggctccctcaactggctccaacaaaaacccggcaaagccatcaaacgcctcatctacgccacctcctccctcgactcaggcgtccccaaacgcttctccggctctcgctccggatctgactacaccctcaccatctcctcccttcaacccgaagacttcgccacctactactgcctccaatacggctcattcccccccaccttcggccaaggaaccaaagtcgaaatcaaacgcaccgtcgccgccccctccgtcttcatcttccccccctccgacgaacaactcaaatccggcaccgcatccgtagtctgcctcctcaacaacttctacccccgcgaagccaaagtccaatggaaagtcgacaacgccctccaatctggcaactcccaagaaagcgttaccgaacaagactccaaagactccacctactccctatcctccacactcaccctctccaaagcagactacgaaaaacacaaagtctacgcctgcgaagtcacacaccaaggcctctcctcccccgtcaccaaatccttcaaccgcggcgaatgc

SEQ ID NO: 53520 - RNA, 1353 nt, synthetic construct
  misc_feature 1..1353: note = derived and/or modified sequence opt11 from Alemtuzumab_HeavyChain
  source 1..1353: mol_type = other RNA
caagtccaactacaggaatccggacccggcctcgtccgaccctcacaaacactcagcctgacctgtaccgtctccggcttcaccttcacagacttctacatgaactgggtacgacaaccacccggccgcggactagaatggatcggcttcatacgcgacaaagcaaaaggctacacaacagaatataacccctccgtcaaaggccgcgtcacaatgctcgtcgacacctccaaaaaccaattctcccttcgcctatcatctgtaaccgccgccgacacagcagtctactactgcgcccgagaaggacacaccgccgcacccttcgactactggggccaaggaagcctagtcacagtctcatcagcaagcactaaaggcccctccgtcttccccctcgccccctccagcaaatcaacctcaggcggcaccgccgccctaggctgcctcgtcaaagattacttccccgaacctgtcaccgtctcctggaactccggagccctcacatccggcgtccacaccttccccgccgtcctacagtcctcaggcctatactccctctcctccgtagtaaccgtcccctcctcctccctaggaacacaaacctacatctgcaatgtaaaccacaaaccctccaacacaaaagtcgacaagaaagtcgaacccaaatcttgcgacaaaacccacacatgcccgccctgccccgcgcccgaattacttggcggcccctctgtcttcctcttccctcccaaacccaaagacacactcatgataagccgaacacccgaagtcacatgcgtcgtcgtagacgtctcccacgaagaccccgaagttaagttcaattggtacgtagacggcgtcgaagtccacaacgccaaaacaaagcctcgcgaagaacaatacaactcaacctaccgagtagtctccgtcctcaccgtactccaccaagactggctaaatggcaaagaatacaaatgcaaggtctccaacaaggccctcccagccccaatcgaaaagaccatctcaaaagccaaaggccaacccagagaaccccaagtctacacccttccaccatcacgcgacgaattaaccaaaaaccaagtatcactaacctgcctcgtcaaaggtttttacccctccgacatcgcagtcgaatgggaatccaatggccaacccgaaaacaactacaaaacaacccctcccgttctcgacagtgatggcagcttcttcctctactccaaactcaccgtagacaaatcccgctggcaacaaggaaacgtattctcctgctccgtcatgcacgaagcactccacaaccattacactcagaaatccctctccctctcccccggaaaa

SEQ ID NO: 53521 - RNA, 657 nt, synthetic construct
  misc_feature 1..657: note = derived and/or modified sequence opt11 from Alemtuzumab_HeavyChain_variant_1bey_H
  source 1..657: mol_type = other RNA
caagtccaactccaagaatccggccccggacttgtacgcccctcccaaaccctctccctcacctgcaccgtctccggcttcaccttcaccgacttctacatgaactgggtccgccaaccacccggccgtggtctcgaatggatcggcttcatccgagacaaagccaaaggctacaccaccgagtacaacccctcagtcaaaggccgagtcaccatgctagtcgacacctccaaaaaccaattctccctacgcctctcctccgtaaccgccgccgacaccgccgtctactactgcgcccgcgaaggccacaccgccgcccccttcgactattggggacaaggctcactagtcacagtatcctccgcctccaccaaaggaccctcagtcttccccctcgccccctcctccaaatcaacctcaggcggcaccgccgccctaggctgcctagtcaaagactacttcccagaacccgtcaccgtctcatggaactcaggagccctcacctccggcgttcacacattccccgccgtcctccaatcctccggcctctactccctctcatccgtcgtcaccgtcccctcctcctccctcggcacccaaacctacatctgcaacgtcaaccacaaaccctccaacaccaaagtcgacaaaaaagta

SEQ ID NO: 53522 - RNA, 660 nt, synthetic construct
  misc_feature 1..660: note = derived and/or modified sequence opt11 from Alemtuzumab_HeavyChain_variant_1ce1_H
  source 1..660: mol_type = other RNA
caagtccaactacaagaatccggccccggactcgtcagaccctcccaaaccctctccctgacctgcaccgtctccggcttcaccttcaccgacttctacatgaactgggtccgccaaccccccggccgcggcctcgaatggatcggcttcatacgcgacaaagccaaaggctacacaaccgaatacaacccctccgtcaaaggccgagtaaccatgctcgtcgacacctccaaaaaccaattctccctccgtctctcctccgtcacagccgccgacaccgccgtctactactgcgcccgagaaggtcacaccgccgcccccttcgactactggggccaaggcagcctcgtcaccgtctcctccgcatccaccaaaggcccctccgtattccccctcgccccctcatccaaatcaacctctggcggcaccgccgcccttggctgcctcgtcaaagactacttcccagaacccgtcaccgtctcatggaactccggcgccctcacctccggcgtccacaccttccccgccgtactccaatcctccggcctctactccctctcctctgtcgtcaccgtcccctcatcatccctcggcacccaaacctacatctgcaacgtcaaccacaaaccatcaaacacaaaagtcgacaaaaaagtcgaa

SEQ ID NO: 53523 - RNA, 1311 nt, synthetic construct
  misc_feature 1..1311: note = derived and/or modified sequence opt11 from Alemtuzumab_HeavyChain_variant_8005_H
  source 1..1311: mol_type = other RNA
caagtccaactccaagaatcaggcccaggcctcgtccgaccctcccaaaccctctccctaacctgtactgtctccggattcacattcaccgacttctacatgaattgggtccgacaaccacccggccgcggcctcgaatggatcggattcatcagggacaaagccaaaggatacacaaccgaatacaacccctccgtaaaaggacgagtaaccatgctcgtcgacactagcaaaaaccaattctccctccgcctctccagcgtcaccgccgccgacaccgcagtatactactgcgctcgcgaaggccacaccgccgcacccttcgactactggggccaaggatccctcgtcaccgtctcatccgcctccactaagggaccatcagtgttcccactcgcccccagctccaaatctacctccggcggcaccgccgccctcggctgcctcgtaaaagactacttccccgaacccgtaacagtctcctggaactcaggagccctcacaagcggcgtccacactttcccagcagtcttacagtcctccggcctctatagcctcagctccgtcgtcaccgtcccctcatcctccctcggcactcaaacttacatctgcaatgtaaaccacaaacccagcaacactaaagtcgacaagaaagtcgaagcccccgaactactcggaggccccagcgtcttcctctttcccccaaaacccaaagacaccctcatgatctcccgcacccccgaagttacctgcgtcgtcgttgacgtctcacacgaagaccccgaagtaaaattcaactggtacgtcgacggcgtcgaagtccacaacgcaaaaaccaaaccccgagaagaacaatacaactccacctaccgcgtcgtctcagtcctcaccgtactacaccaagactggctcaacggcaaagaatacaaatgcaaagtatccaacaaagccctcccagcaccaatcgaaaagaccatctcgaaagccaaaggacaaccacgtgaaccacaagtatacaccctcccaccctcacgtgacgaactcaccaaaaaccaagtatccctaacatgcctagtcaaaggcttctacccctcagacatcgccgtagaatgggaatccaacggccaacccgaaaacaactacaaaaccaccccacccgttctcgactccgacggctccttcttcctctactctaaactcaccgtcgacaagtcaagatggcaacaaggaaacgtcttctcctgcagcgtcatgcacgaagcactccacaaccactacacccagaaatcactctcactctcacccggaaaa

SEQ ID NO: 53524 - RNA, 633 nt, synthetic construct
  misc_feature 1..633: note = derived and/or modified sequence opt11 from Alemtuzumab_LightChain
  source 1..633: mol_type = other RNA
gacatccaaatgacccaatcaccctcatcactctcagcctccgtcggcgaccgcgtcaccataacctgcaaagcctcccaaaacatcgacaaatacctcaactggtaccaacaaaaacccggcaaagcccccaaactcctaatctacaacaccaacaacctccaaaccggcgtcccctcccgcttctccggatccggctcaggcaccgacttcaccttcaccatctcctccctccagcccgaagacatcgccacctactactgcctacaacacatctcccgcccccgcaccttcggccaaggcaccaaagtcgagatcaaacggaccgtcgcagccccctccgtcttcatcttcccaccctccgacgaacaactcaaatcaggcacagcatccgtcgtctgcctcctcaacaacttctacccccgggaagccaaagtccaatggaaagtcgacaacgccctccaatcaggcaactcccaagaatccgtcacagaacaagactccaaagactccacctactccctctcctccaccctcaccctctccaaagccgactacgaaaaacacaaagtctacgcctgcgaagtcacacaccaaggcctctcctcccccgtcaccaaatccttcaaccgc

SEQ ID NO: 53525 - RNA, 642 nt, synthetic construct
  misc_feature 1..642: note = derived and/or modified sequence opt11 from Alemtuzumab_LightChain_variant_8005_L
  source 1..642: mol_type = other RNA
gacatccaaatgacccaatccccctcatccctctccgcctccgtcggcgaccgcgtcaccattacctgcaaagcctcacaaaacatcgacaaatacctcaactggtaccaacaaaaacccggcaaagcccccaaactcctcatctacaacaccaacaacctccaaaccggcgtcccctcccgcttctccggctcaggctcaggcaccgacttcaccttcaccatctcctccctccaacccgaagacatcgccacctactactgtctccaacacatctcccgcccccgaaccttcggccaaggcaccaaagtcgaaatcaaacgcaccgtcgccgccccctccgtcttcatcttccctccctccgacgaacaactcaaatcaggcaccgcctcagtcgtatgcctactaaacaacttctacccccgcgaagccaaagtccaatggaaagtcgacaacgccctccaatccggaaactcccaagaaagcgtcaccgaacaagactccaaagactccacctactccctttcctcaaccctcaccctctccaaagccgactacgaaaaacacaaagtctacgcctgcgaagtcacccaccaaggcctctcctcccccgtcaccaaatccttcaaccgcggcgaatgc

SEQ ID NO: 53526 - RNA, 1341 nt, synthetic construct
  misc_feature 1..1341: note = derived and/or modified sequence opt11 from Alirocumab_HeavyChain1
  source 1..1341: mol_type = other RNA
gaagtccaactcgtcgaatccggcgggggactcgtccaacccggcggatccctccgcctctcctgcgccgcatcaggcttcactttcaacaactacgccatgaactgggtacgccaagcacccggcaaaggactagactgggtctccaccatctccggatccggcggtacaaccaactacgccgactccgtaaaaggccgcttcatcatttcccgcgactcctccaaacacaccctctacctccaaatgaactcactacgcgccgaagacacagccgtatactactgcgccaaagactccaactggggcaacttcgacctatggggccgcggcaccctcgttaccgtctcctctgcatccacaaaaggaccctccgtctttccactcgccccaagctccaaatccacctcaggcggcaccgccgctctcggatgcctcgtcaaagactatttcccggaacccgtaaccgtctcatggaactcaggcgccctaacatcaggcgtccacaccttcccagccgtcctccagtcatcaggcctatactccctatcatccgtagtcaccgtcccctcctccagcctaggcacccaaacctacatatgcaacgtcaatcacaaaccctccaacaccaaagtcgataagaaagtcgaacccaaatcctgcgacaaaacccatacctgccctccctgcccagcccccgaactcctaggcggcccatccgtcttcctcttcccacccaaacccaaagacacactcatgatctcccgcacccccgaagttacctgcgtcgtcgtcgacgtctcgcacgaagaccccgaagtaaaattcaactggtacgtcgatggcgtcgaagtccacaacgcgaaaaccaaaccgcgagaagaacaatacaacagcacctaccgagtagtatccgtcttaacagtcctacaccaagactggctcaacggcaaagaatacaaatgcaaagtctctaacaaagctctacccgccccaatcgagaaaaccatttccaaagcgaaaggccaaccccgcgaaccccaggtctacaccctaccgccctcccgtgacgaactaaccaaaaaccaagtatccctaacctgcctcgtaaaaggattctaccccagcgatatcgccgtagaatgggaatccaacggacaacccgaaaacaattacaaaaccaccccacccgtactcgactccgacggctcattcttcctctacagcaaactcaccgtcgacaaatcccgatggcagcaaggcaacgtcttctcctgctcagtcatgcacgaagccctccacaaccactacactcaaaagtccctaagcctatcccccgga

SEQ ID NO: 53527 - RNA, 660 nt, synthetic construct
  misc_feature 1..660: note = derived and/or modified sequence opt11 from Alirocumab_LightChain1
  source 1..660: mol_type = other RNA
gacatcgtcatgacccaatcccccgacagcctcgccgtctccctcggcgaacgcgccaccatcaactgcaaatcctcccaatccgtcctctaccgctcaaacaaccgcaacttcctcggctggtaccaacaaaaacccggccaaccacccaacctcctaatctactgggcatccacccgcgaatccggcgtccccgaccgcttctccggctccggctccggcaccgacttcaccctaaccatctcctccctacaagccgaagacgtcgccgtatactactgccaacaatactacaccaccccctacaccttcggtcaaggcaccaaactcgaaatcaaacgcaccgtcgccgccccctccgtattcatcttccccccctccgacgaacaactcaaatccggaaccgcctccgtcgtctgcctcctcaacaacttctacccccgcgaagccaaagtccaatggaaagtcgacaacgccctccaatccggcaactcccaagaatccgtcaccgaacaagactccaaagactccacctactccctctcctcaaccctaaccctatccaaagcagactacgaaaaacacaaagtctacgcctgcgaagtcacccaccaaggcctatcctcacccgtcaccaaatccttcaaccgcggcgaatgc

SEQ ID NO: 53528 - RNA, 735 nt, synthetic construct
  misc_feature 1..735: note = derived and/or modified sequence opt11 from ALX-0061_HeavyChain1
  source 1..735: mol_type = other RNA
gaggtacagctggtggaaagcgggggagggctggtacagccgggagggagcctgaggctgagctgcgcggcgagcgggagtgtattcaagataaacgtgatggcatggtaccggcaagcaccaggaaaagggagagagttggtggcagggataataagcggagggagcacgagctacgcagacagcgtgaaggggaggttcacaataagcagggacaatgcgaagaacacgctgtacctacagatgaacagcctgaggccggaggacacagcggtgtactactgcgcgttcataacgacggagagcgactacgatctggggagaaggtactgggggcaggggacgctggtgacggtgagcagtgggggaggagggagcgggggagggagcgaggtgcagctggtggagagtgggggagggctggtacagccggggaatagcctgaggctgagctgcgcagcaagtgggttcacattcagcagcttcgggatgtcgtgggtgagacaagcgccggggaaggggttagaatgggtgagcagcataagtgggagcgggagcgacacgctgtacgcggacagcgtgaaggggcggttcacgataagcagggacaacgcaaagacaacgctgtacctgcagatgaacagcctgaggccggaggacacggcagtgtactactgcacgataggagggagtctgagcaggagcagccaagggacactggtaacagtgagcagc

SEQ ID NO: 53529 - RNA, 1347 nt, synthetic construct
  misc_feature 1..1347: note = derived and/or modified sequence opt11 from Amatuximab_HeavyChain1
  source 1..1347: mol_type = other RNA
caagtccaactacaacaatctggacccgaactcgagaaacccggcgcctcagtcaaaatctcctgcaaagcctccggatactccttcacaggatatactatgaactgggtcaaacaatcccacggcaaaagcctggaatggatcggcctaatcaccccctacaacggcgcctcatcatacaaccagaaattccgcggcaaagcaaccctcaccgtcgacaaatcctcctccaccgcctacatggaccttctcagccttacctcagaagactccgccgtctacttctgcgcccggggcggctacgacggccgtggcttcgactactggggctcaggcacccccgtaactgtctcaagcgcctcaaccaaaggaccctccgtcttcccacttgcaccctcctctaaatccacttcaggcggcaccgcagcccttggctgcctcgtcaaggactacttcccagaacccgtaaccgtatcttggaactccggtgccctcacatctggagtacataccttccccgcagtactccaatcctccggcctatactcactctcgtccgtagtcaccgtaccctcctcctcactcggaacccagacatacatctgcaacgtcaaccacaaaccctccaacaccaaagtcgacaaaaaggtcgaacccaaatcctgcgacaaaactcacacatgtccaccatgcccagcccccgaactactcggcggtccctccgtcttcctcttcccacccaaacccaaagacacactcatgatctcccgtacaccagaagtaacctgcgtcgtcgtagacgtatcccacgaagaccctgaagtaaagttcaactggtacgtcgacggcgtcgaagtccacaacgccaaaaccaaaccccgcgaagaacaatacaactcaacctatcgcgtcgtctctgtcctcaccgtcctccaccaagactggctcaacggcaaggaatacaaatgcaaagtctcgaacaaagccctccccgcacccatagagaaaaccatctccaaagccaaaggtcaaccccgcgaaccccaagtctacacactccctccctcacgcgacgaactcaccaaaaaccaagtctcccttacctgcttagttaagggcttttacccctccgacattgccgtcgaatgggaatccaacggccaacccgaaaacaattacaaaacaacaccacccgtcctagactccgacggatccttcttcctatactccaaactaacagtcgacaaatcaagatggcaacaaggcaacgtattctcctgctccgtcatgcacgaagccctacacaaccactacacccagaaatccctctccctcagccccggcaaa

SEQ ID NO: 53530 - RNA, 639 nt, synthetic construct
  misc_feature 1..639: note = derived and/or modified sequence opt11 from Amatuximab_LightChain1
  source 1..639: mol_type = other RNA
gacatcgaactcacccaaagcccagccatcatgtccgcctcccccggagaaaaagtcaccatgacctgctcagcctccagctccgtctcctacatgcactggtaccagcaaaaatctggcacctcccccaaacgctggatctacgacacctcaaaactcgcctccggcgtccccggccgcttctccggctcaggctcaggcaactcatactccctcaccatctcctccgtcgaagccgaagacgacgccacctactactgccaacaatggtccaaacaccccctcaccttcggcagcggcaccaaagtcgaaatcaaacgaaccgtcgccgccccctccgtattcatcttcccaccctccgacgaacaactaaaatccggcaccgcctcagtcgtctgcttactcaacaacttctacccccgcgaagccaaagtccaatggaaagtcgacaacgccctccaatccggcaactcccaagaatccgtcaccgaacaagactccaaggactccacctactcactctcctccaccctcaccctctccaaagccgactacgaaaaacacaaagtctacgcatgcgaagtcacacaccaaggcctctcctcccccgtcaccaaatccttcaaccgaggcgaatgc

SEQ ID NO: 53531 - RNA, 1350 nt, synthetic construct
  misc_feature 1..1350: note = derived and/or modified sequence opt11 from Anetumab_ravtansine_HeavyChain1
  source 1..1350: mol_type = other RNA
caagtcgaactcgtacaatccggagccgaagtaaagaaacccggcgaatccctcaaaatctcctgcaaaggctcaggatactccttcacctcttactggatcgggtgggtacgccaagcacccggcaaaggtctagaatggatgggcataatagaccccggagactcacgaacacgctactcaccatccttccaagggcaagtcaccatcagtgcagacaaaagcatctcaacagcctacctacaatggtcatcactaaaagcatccgacaccgcgatgtactactgcgcccgaggccaactgtacggcggcacctacatggacggatggggacaaggcaccctcgttaccgtctcatccgcatccaccaaaggaccttccgtcttcccacttgccccctccagcaaatcaaccagcggcggcaccgccgcactaggatgcctcgtcaaagactacttcccggaacccgtaaccgtctcatggaactccggagccctcacatccggagtccacaccttcccagcagtcctccaatcctcaggcctatactcactctcctcagtcgtcaccgttccctcctcctcccttggcacccaaacctacatctgcaacgtcaaccacaaaccctccaacaccaaagtcgacaagaaagtcgaacccaaatcttgcgacaaaactcacacatgcccaccctgccccgcacccgaactcctcggtggcccatccgtctttctctttccacccaaacccaaagacactctaatgatatcccgcacccccgaagtcacatgcgtcgtagtcgacgtctcccacgaagaccccgaagtcaaattcaactggtatgtcgacggcgtagaagtccacaacgccaaaacaaaaccccgcgaagaacaatacaactccacctaccgcgtagtaagcgtgctaaccgtcctccaccaagactggctcaacggcaaagagtacaaatgcaaagtatccaataaagccctacccgccccaatcgagaaaacgatatccaaagcaaaaggccaaccacgagaaccccaagtctacaccctaccaccctcccgcgacgaactcaccaaaaaccaagtatccctaacctgcctagtcaaaggattctaccccagcgacatcgccgtagaatgggaatccaacggccaacccgaaaacaactacaaaaccaccccacccgtactagacagcgacggatcattcttcctctactccaaactgacagtcgacaaatcccgctggcaacaaggcaacgtattctcatgttccgtcatgcacgaagccctacacaaccactacacacaaaaatccctctccctatcacccggaaaa

SEQ ID NO: 53532 - RNA, 651 nt, synthetic construct
  misc_feature 1..651: note = derived and/or modified sequence opt11 from Anetumab_ravtansine_LightChain1
  source 1..651: mol_type = other RNA
gacatcgccctcacacaacccgcttccgtctccggctctcccggccaatccatcacaatctcctgcaccggcacctcctccgacatcggcggctacaactccgtctcctggtaccaacaacacccaggcaaagcccccaaactcatgatctacggcgtcaacaaccgaccctccggcgtctccaaccgcttctccggctccaaatccggaaacaccgcctccctcaccatctccggcctccaagccgaagacgaagccgactactactgctcctcctacgacatcgaatccgcaacccccgtcttcggcggcggcacaaaactaaccgtcctaggccaacccaaagccgccccatccgtcacactattccccccctcctccgaagaactccaagccaacaaagccaccctcgtctgcctcatctcagacttctaccccggcgcagtcaccgtcgcctggaaaggcgactcctcacccgtcaaagccggcgtcgaaaccaccaccccctccaaacaatccaacaacaaatacgccgcctcatcctacctctccctaacccccgaacaatggaaatcccaccgatcctactcctgccaagtcacccacgaaggctccaccgtcgaaaaaaccgtcgcccccaccgaatgctcc

SEQ ID NO: 53533 - RNA, 1341 nt, synthetic construct
  misc_feature 1..1341: note = derived and/or modified sequence opt11 from Anifrolumab_HeavyChain1
  source 1..1341: mol_type = other RNA
gaagtacaactcgtccaatccggcgccgaagtcaaaaagcccggcgaatctctcaaaatatcatgcaagggctccggctacatcttcaccaattactggatagcatgggtccgccaaatgccaggcaaaggactcgaatcgatgggcatcatctacccaggcgatagcgacatccgctactcaccctcattccaaggacaagtaaccatatctgcagacaaatcaatcaccactgcatacctccaatggtccagtctcaaagcatccgacaccgccatgtactactgcgcccgccacgacatcgaaggcttcgactactggggaaggggcaccctcgtcaccgtctcctcagcctcaaccaaaggtccatccgttttcccactggcgccatcctccaaatccacctcaggcggcacggccgccctcgggtgcctagtcaaagactacttccccgaacccgtcaccgtctcttggaactccggcgccctcacctccggcgtccacaccttcccagccgtcctccaaagctccggactctactccctctcctccgtagtcacggtcccaagctcatctctcggcacccagacctacatctgcaacgtcaaccacaaaccctccaacaccaaagtcgacaaacgcgtagaacccaaatcttgcgacaaaacccacacctgtccaccctgccccgcccccgaatttgaaggcggtccctccgtattcctcttcccacccaaacccaaagacaccctcatgatctcccgcacccccgaagtaacctgcgtcgtcgtcgacgtctcacatgaagaccccgaagtaaaattcaactggtacgtagacggagtagaagtccacaacgcaaagaccaaaccacgcgaagaacaatacaactccacctaccgcgtcgtctccgtcctcactgtcctacaccaagactggctaaacggcaaagaatacaaatgcaaagtcagcaacaaggccctccccgcctccatagagaaaacaatctcaaaagccaaaggccaaccacgtgaaccccaagtatacaccctacccccaagccgagaagaaatgaccaaaaaccaagtgtccctaacctgccttgtaaaaggcttctaccccagcgacatcgccgttgaatgggaatcgaacggccaacccgaaaacaactacaaaaccaccccacccgtcctcgactcagacggctccttcttcttatactccaaactaaccgtcgataaatcccgctggcaacaaggcaacgtcttctcatgctctgtcatgcacgaagccctccacaaccattacactcaaaaatccctatccctctcacccggcaaa

SEQ ID NO: 53534 - RNA, 645 nt, synthetic construct
  misc_feature 1..645: note = derived and/or modified sequence opt11 from Anifrolumab_LightChain1
  source 1..645: mol_type = other RNA
gaaatcgtcctcacacaatcccccggcaccctctccctctcccccggcgaacgcgccaccttatcctgccgcgcctcccaatccgtatcatcctccttcttcgcatggtaccaacaaaaacccggccaagctccccgtctcctcatctacggcgcctcatcccgcgccaccggcatccccgaccgcctctccggctctggctcaggcaccgacttcaccctcaccatcacccgcctcgaacccgaagacttcgccgtctactactgccaacaatacgactcctccgccatcaccttcggccaaggcacccgcctcgaaatcaaacgcaccgtcgccgccccctccgtattcatcttcccaccctccgacgaacaactaaaatccggcaccgcctcagtcgtctgcctcctcaacaacttctacccccgcgaagccaaagtccaatggaaagtcgacaacgccctccaatccggcaactcacaagaatccgtcaccgaacaagactccaaagactccacctactccctctcctcaaccctcaccctctccaaagccgactacgaaaaacacaaagtctacgcctgcgaagtaacccaccaaggcctctcctcccccgtcaccaaatccttcaaccgcggcgaatgc

SEQ ID NO: 53535 - RNA, 1344 nt, synthetic construct
  misc_feature 1..1344: note = derived and/or modified sequence opt11 from Anrukinzumab_HeavyChain1
  source 1..1344: mol_type = other RNA
gaagtccagctagtcgaatccggcggaggcctcgtccaacccggcggctccctccgcctatcctgcgccgccagcggcttcaccttcatatcatacgcaatgtcctgggttcgccaagccccaggcaagggccttgaatgggtcgccagcatctcctcaggcggaaacacctactacccagactcagtcaaaggccgcttcacaatcagccgcgacaacgccaaaaacagcctatacctccaaatgaactccctacgcgccgaagacaccgccgtctattactgcgcacgcctcgacggctactacttcggcttcgcatactggggccaaggcaccctcgtcaccgtatcttccgcgtccaccaaaggcccatccgtcttccccctagccccctcatcaaaaagtacctcaggaggaaccgcagccctcggatgcctcgtaaaagactacttccctgaacccgtcaccgtctcctggaactctggcgccttaacaagcggcgtccatacattccccgccgtccttcaatcatctggcctctactcactctcatccgtcgtcacagtcccatccagctcactcggcacccaaacatacatctgcaacgtaaaccacaaaccatcgaacaccaaggtagacaagaaagtcgaacccaaatcatgcgacaaaacccacacatgtcccccatgccccgcaccagaagccctcggcgccccaagcgtcttcctattcccacccaaacctaaagacaccctcatgatctcaaggacccccgaagtcacgtgcgtagtcgtagacgtctcacacgaagaccccgaagtcaaattcaactggtacgtagacggagtcgaagtccacaacgcaaaaacaaaacccagagaagaacaatacaactccacctaccgagtagtatccgtcctcaccgtactccaccaagactggctcaacggcaaagaatacaaatgcaaagtatccaacaaagccctccccgcacccatcgagaaaaccatctccaaagcaaaaggccaaccccgcgaaccccaagtctacaccctaccaccctcacgtgaagaaatgaccaaaaaccaagtctcacttacttgcctcgtaaaaggcttctacccatcagacatcgcagtagaatgggaatccaacggccaaccagaaaacaactacaaaacaaccccacccgtactagactcagacggctccttcttcctctactccaaacttaccgtagacaagtcacgatggcaacaaggcaacgttttcagctgctccgtcatgcacgaagcactacacaaccactacacccaaaaatccctctccctatcacccggaaaa

SEQ ID NO: 53536 - RNA, 654 nt, synthetic construct
  misc_feature 1..654: note = derived and/or modified sequence opt11 from Anrukinzumab_LightChain1
  source 1..654: mol_type = other RNA
gacatccaaatgacccaaagcccctcctccctctccgcctccgtaggcgaccgcgtcaccataacctgcaaagcctccgaatccgtagacaactacggcaaatccctcatgcactggtaccaacaaaaacccggcaaagcccccaaactcctaatctaccgcgcatccaacctagaatccggcgtcccatcccggttctcgggctccggctcaggcaccgacttcaccctaaccatctcctccctccaacccgaagacttcgccacctactactgccagcaatcaaacgaagacccctggaccttcggaggcggcaccaaagtcgaaataaaacgcaccgtcgccgcccccagcgtcttcatcttcccaccctccgacgaacaactaaaatccggcaccgcctccgtcgtctgcctactcaacaacttctacccccgcgaagccaaagtccaatggaaagtcgacaacgcgctccaatccggcaactcacaagaatccgtcaccgaacaagacagcaaagactccacctactccctaagctccaccctgaccctaagcaaagccgactacgaaaaacacaaagtatacgcctgcgaagtcacccaccaaggcctctcctcacccgtcaccaaatccttcaacagaggcgaatgc

SEQ ID NO: 53537 - RNA, 1338 nt, synthetic construct
  misc_feature 1..1338: note = derived and/or modified sequence opt11 from Apolizumab_HeavyChain1
  source 1..1338: mol_type = other RNA
caagtacaactacaagaatccggccccggcctcgtcaaaccctccgaaaccctctcactaacctgcacagtatcaggcttcagcctcaccaactatggcgtacactgggtccgacaatcaccgggcaaaggactcgagtggatcggtgtcaaatggtccggaggctccaccgaatataacgccgccttcatcagcagactaaccatctccaaggacacgtccaaaaaccaagtctccctcaaactcaactccctaacagccgcagacaccgccgtatactactgcgcacgcaacgaccgctacgccatggactactggggccaaggcaccctagtaactgtctcatccgcctccactaaaggcccttccgtcttcccactagcgccctccagcaaatccacctccggcggcacagccgcactcggctgcctagtaaaagactacttccccgagcccgtcacagtctcctggaactctggcgcgctcacatctggcgtccacacctttccagccgtcctacaatcctcaggcctatacagcctttcctcagtcgtaacagtaccctcctcatcactcggcacccaaacctacatctgtaacgtaaaccacaaaccctccaacacaaaagtagacaagaaagtagaacccaaatcctgcgacaaaacacacacatgcccaccctgccccgcaccagaactcctaggcggcccgtcagtcttcctcttcccacccaaacccaaagacaccctaatgatctcccgcaccccagaagtcacttgcgttgtcgtcgacgtctcccacgaagaccccgaagtgaaattcaactggtacgtcgacggagttgaggtccacaacgccaaaacaaaaccacgcgaagaacaatacaactcaacctaccgagtcgtctccgtgctcactgtcctccaccaagactggctaaacggcaaagaatacaaatgcaaagtctccaacaaagccctcccagcccccatcgagaaaacaatcagcaaagccaaaggacaaccccgcgaaccacaagtatacaccctcccaccatcccgcgacgaactcaccaaaaaccaagtctccctaacatgcctcgtcaaaggcttttacccctcagacatagcagtcgaatgggaatccaacggacaacccgaaaacaactacaaaaccaccccacccgtcctcgactccgatggctccttcttcctctactccaaactcaccgtcgacaaatcccgatggcaacaaggcaacgtcttcagctgctcagtcatgcacgaggccctccacaaccactacacccagaaaagcctctccctatcccccggcaaa

SEQ ID NO: 53538 - RNA, 642 nt, synthetic construct
  misc_feature 1..642: note = derived and/or modified sequence opt11 from Apolizumab_LightChain1
  source 1..642: mol_type = other RNA
gacatccaaatgacccaatccccctcctccctaagcgcctccgtaggcgaccgcgtcaccatcacttgccgcgcctccgaaaacatctactcctacctagcctggtaccaacaaaaacccggcaaagcccccaaactcctagtctccaacgccaaaaccctcgcagaaggcgtcccctccagattctccggatcaggctcaggcaaacaattcaccctcaccatcagctccctccaacccgaagacttcgccacttactactgccaacaccactacggcaactcataccccttcggccaaggcaccaaactcgaaatcaaacgcaccgtcgccgccccctccgtcttcatcttcccaccctccgacgaacaactaaaatccggcaccgcctccgtcgtctgcctactcaacaacttctacccccgagaagccaaagtccaatggaaagtcgacaacgccctccaatccggcaactcccaagaatctgtaaccgaacaagactccaaagactccacctactccctctcctccaccctcaccctctcaaaagccgactacgaaaaacacaaagtctacgcctgcgaagtcacccaccaaggcctctcctcccccgtaacaaaatccttcaaccgaggcgaatgc

SEQ ID NO: 53539 - RNA, 378 nt, synthetic construct
  misc_feature 1..378: note = derived and/or modified sequence opt11 from Apomab_HeavyChain
  source 1..378: mol_type = other RNA
gaggtgcagttggtgcagagtggggggggggtggagaggccgggggggagtctgaggttgagttgtgcggcgagtgggtttacgtttgatgattatgcgatgtgggtgaggcaggcgccgggaaaggggttggagtgggtgagtgggataaattggcagggggggagtacggggtatgcggatagtgtgaaggggagggtgacgataagtagggataatgcgaagaatagtttgtatttgcagatgaatagtttgagggcggaggatacggcggtgtattattgtgcgaagatattgggggcggggagggggtggtattttgattactgggggaaggggacgacggtgacggtgagcagtgcgagtacgaaggggccg

SEQ ID NO: 53540 - RNA, 324 nt, synthetic construct
  misc_feature 1..324: note = derived and/or modified sequence opt11 from Apomab_LightChain
  source 1..324: mol_type = other RNA
tccgaactcacccaagaccccgccgtctccgtcgccctcggccaaaccgtccgcatcacctgctccggcgactccctccgctcctactacgcctcctggtaccaacaaaaacccggccaagcccccgtcctcgtcatctacggcgccaacaaccgcccctccggcatccccgaccgattctccggctcctcctccggcaacaccgcctccctcaccatcaccggcgcccaagccgaagacgaagccgactactactgcaactccgccgactcctccggcaaccacgtcgtcttcggcggcggcaccaaactcaccgtcctaggc

SEQ ID NO: 53541 - RNA, 645 nt, synthetic construct
  misc_feature 1..645: note = derived and/or modified sequence opt11 from Aquaporumab_LightChain
  source 1..645: mol_type = other RNA
gaaatcgtcctcacccaatcccccggaacactctccctctccccaggagaacgcgccaccctctcctgccgcgcatcccaaaccgtacgcaccaactaccttgcatggttccaacaaaaacccggccaagcaccccgcctcctcatcttcggcgcctcctcacgagccaccggcatccccgaccgcttctccggctcaggctcaggcaccgacttcaccctcaccatctcccgcctcgaacccgaagacttcgccgtctactactgccaacaatacggctcatccccctggaccttcggccaaggcaccaaagtcgaaatcaaacgcacagtagccgccccctccgtcttcatcttcccaccctcagacgaacaactcaaatccggcaccgcctccgtcgtctgcctcctcaacaacttctacccccgcgaagccaaagtccaatggaaagtcgacaacgccctccaatccggcaactcccaagaatccgtcaccgaacaagactccaaagactccacctactcactctcctccaccctcaccctctccaaagccgactacgaaaaacacaaagtctacgcatgcgaagttacacaccaaggcctctccagccccgtcaccaaatccttcaaccgcggcgaatgc

SEQ ID NO: 53542 - RNA, 1326 nt, synthetic construct
  misc_feature 1..1326: note = derived and/or modified sequence opt11 from Arcitumomab_99tc_HeavyChain
  source 1..1326: mol_type = other RNA
gaagtaaaactcgtcgaatccggcggaggcctcgtccaacctggaggctcactccgactctcctgcgccacctccggcttcaccttcaccgactactacatgaactgggtcagacaacctcccggcaaagccctcgaatggctcggattcatcggcaacaaagcaaacggatacaccaccgaatactccgcttccgtcaaaggacgattcaccatctcacgcgacaaatcccaatccatcctatacctccaaatgaacaccctccgcgctgaggactccgccacctactactgcacccgagaccgcggcctccgcttctacttcgattattggggccaaggcaccaccctcacagtatcatcagcaaaaaccacccctccctccgtttaccccctcgcccccggctccgccgcccaaacaaactccatggtcaccctcggatgcctcgtcaaaggatacttccccgaacccgtcacagtcacttggaactccggaagcctatcctccggtgtccacacattccccgccgtcctccagtccgatctctacaccctatcatcctcagtaaccgtcccctcgagcccccgcccatccgaaaccgtaacctgcaatgtagcccaccccgcctcctccaccaaagtagacaagaaaatcgtccccagagactgcccaccctgcaaatgccccgcccccaacctcctcggcggcccctccgtcttcatcttcccaccaaaaatcaaagacgtcctcatgatctcactctcacccatcgtcacatgcgtagtcgtcgacgtctccgaagacgaccccgacgtccaaatctcatggttcgtcaacaacgttgaggtacacacggcccagacccagacacaccgtgaagactacaactccaccctccgcgtagtatccgccctccctattcaacaccaagactggatgtccggcaaagagttcaaatgcaaagtcaacaacaaagaccttcccgcacccatcgaacgcaccatctccaaacccaaaggctcggtccgcgcaccccaagtctacgtactcccaccacccgaagaagaaatgacaaagaaacaagtcaccctcacatgcatggtcaccgacttcatgcccgaagacatatacgtcgagtggaccaacaacggcaaaacagagctcaactacaaaaacacagaacccgtccttgactccgacgggtcatacttcatgtactccaaactccgcgtagaaaagaaaaactgggtcgaacggaacagctactcctgcagcgtcgtccacgaaggcctccacaaccaccacaccaccaaatcattctcacga

SEQ ID NO: 53543 - RNA, 639 nt, synthetic construct
  misc_feature 1..639: note = derived and/or modified sequence opt11 from Arcitumomab_99tc_LightChain
  source 1..639: mol_type = other RNA
caaaccgtcctctcccaatcccccgcaatcctctccgcctcccccggcgaaaaagtcaccatgacctgccgcgcctcctcctccgtaacctacatccactggtaccaacaaaaacccggctcatcccccaaatcctggatctacgccacctccaacctcgcctccggcgtccccgcccgcttctccggctccggctccggcacctcatactccctaaccatctcccgagtcgaagccgaagacgccgccacctactactgccaacactggtcctccaaaccacccaccttcggcggcggaacaaaactcgaaatcaaaagagctgacgccgcccccaccgtctccatcttcccaccctcctccgaacaactcacctccggcggcgcctccgtcgtttgcttcctcaacaacttctaccccaaagacatcaacgtcaaatggaaaatcgacggctcagaacgacaaaacggcgtcctcaactcctggaccgaccaagactccaaagactccacctactccatgtcctccaccctcacactcacaaaagacgaatacgaacgccacaactcatacacatgcgaagccacccacaaaacctccacctcccccatcgtcaaatccttcaaccgcaacgaatgc

SEQ ID NO: 53544 - RNA, 1329 nt, synthetic construct
  misc_feature 1..1329: note = derived and/or modified sequence opt11 from Ascrinvacumab_HeavyChain1
  source 1..1329: mol_type = other RNA
caagtccagctacaagaatccggccccggcctcgtcaaaccctcccaaaccctatccctaacctgcaccgtatctggaggatcaatctcctccggcgaatactactggaactggatccgccaacacccaggcaaaggcctcgaatggatcggctacatctactacagcggctccacctactacaacccctccctcaaatcccgcgtcaccatatccgtcgacacatccaaaaaccagttctcactaaaactaagctccgtaaccgccgctgacacagcagtctactactgcgcccgagaatccgtcgcaggattcgactactggggacaaggtaccctcgtcaccgtatctagcgcctccaccaaaggcccatccgtcttccccctcgcaccctgctcacgctctacctcagaatcaaccgctgccctaggctgccttgtcaaagactacttccccgaacccgtcaccgtctcctggaactcaggcgccctaacctccggcgtccacacatttcccgccgtcctccagtcatccggcctctactccctttcatctgtcgtcacagtcccatctagcaacttcggcacccaaacatacacatgcaacgtcgaccacaaacccagtaacaccaaagtcgacaaaaccgtcgagcgtaaatgctgcgtcgaatgcccaccctgccccgcaccccctgtcgccggcccctcagtcttcctattcccacccaaacccaaagacaccctaatgatcagccgaaccccagaagtaacctgcgtcgtggtagacgtctctcacgaagacccagaagtccaattcaactggtacgtagacggagtagaagtacacaacgcaaaaacaaaaccccgcgaagaacaattcaactcaaccttccgcgtagtctccgtcctcaccgtagtccaccaagactggctaaacggcaaagaatacaaatgcaaagtctcaaacaaaggactcccagcgcccatagagaaaaccatctccaagacgaaaggccaaccccgcgaaccacaagtctacacactaccaccctcaagagaagaaatgaccaaaaaccaagtctccctaacctgcctcgtaaaaggattctacccctccgacatagcagtcgaatgggaatccaatggacaacccgaaaacaactacaaaaccaccccgcccatgctcgactctgacggatccttcttcctatactcaaaactcaccgtcgacaaatcccgctggcaacaaggtaacgtattctcctgctcagtaatgcacgaagcactccacaaccactacacccaaaaatcactatcactctcccccggt

SEQ ID NO: 53545 - RNA, 645 nt, synthetic construct
  misc_feature 1..645: note = derived and/or modified sequence opt11 from Ascrinvacumab_LightChain1
  source 1..645: mol_type = other RNA
gaaatcgtcctcacacaatcccccggcaccctatccctctcccccggcgaacgcgccaccctctcatgccgcgcctcacaatccgtctcctcatcatacctcgcatggtaccaacaaaaacccggccaagccccacgcctcctcatctacggaacatcctcacgcgccaccgggatccccgaccgcttctcaggctcaggctccggcaccgacttcaccctcaccatctcacgcctcgaacccgaagacttcgccgtctactactgccaacaatacggatcctcccccatcaccttcggccaaggcacccgcctcgaaatcaaacgcaccgtcgccgcaccctccgtcttcatcttcccaccctccgacgaacaactcaaatccggcaccgcctccgtcgtctgcctcctcaacaacttttacccccgagaagcaaaggtccaatggaaagtcgacaacgccctccaatccggcaactcccaggaatccgtcaccgaacaagactccaaagactccacctactccctatcatccaccctaacactctccaaagccgactacgaaaaacacaaagtctacgcatgcgaagttacccaccaaggcctctcctcccccgtaaccaaatccttcaaccgcggcgaatgc

SEQ ID NO: 53546 - RNA, 1314 nt, synthetic construct
  misc_feature 1..1314: note = derived and/or modified sequence opt11 from Aselizuab_HeavyChain1
  source 1..1314: mol_type = other RNA
gaagtacaactcgtcgagtccggcggaggactcgtacaacccggcggctctctccgactatcctgcgccgcctccggctttaccttctcaacctacgcatcttgggtacgtcaggcccccggcaaaggactcgaatgggtagcctccatatctaccggaggctccacctactaccccgactccgttaaaggccggtttaccatatccagagacaacgccaaaaacacactatacctccaaaactcactccgagccgaagacaccgccgtctattactgcgcacgggactatgacggctacttcgactactggggacaaggcaccctagtcacagtatcatctgcatccaccaaaggcccctccgtcttccccctagccccctgctcccgctccacctccgaatccacagccgccctaggctgcctagtcaaagactacttccccgaaccagtcaccgtctcctggaactccggcgcactaacatccggcgttcacaccttccccgccgtactccaatcgtcaggcctctattccctctcatccgtcgtcacagtcccatcttcctccctcggcaccaaaacctatacctgcaacgtcgaccacaagccctcaaacacaaaagtcgacaaacgcgttgaatccaaatacggcccaccatgcccttcctgcccagcacccgagttcctcggaggccccagcgtcttcctctttcccccaaaacccaaagacaccctcataagccgcaccccagaagtaacctgcgtcgtcgtcgacgtcagccaagaagacccagaagtccaattcaactggtacgtcgacggcgtcgaagtccacaacgccaaaacaaaaccaagagaagaacaattcaactccacctaccgagtagtatcagtcctaaccgtcctacaccaagactggctgaacggcaaagaatacaaatgcaaagtctccaacaaaggcctcccctcatccatcgagaaaaccatctcaaaagccaaaggccaaccgcgagaaccccaagtctacacactacctccctcccaagaagaaaccaaaaaccaagtaagcctaacctgcctagtcaaaggcttctaccccagcgacatagccgtcgaatgggaatccaacggacaacccgaaaacaactacaaaactactccacccgtcctcgactccgacggatccttcttcctgtactcccgtctcaccgtcgacaaatcccgctggcaagaaggcaacgtgttctcctgctccgtccacgaagctctccacaaccactacacccaaaaatcactctcactctcactaggcaaa

SEQ ID NO: 53547 - RNA, 1311 nt, synthetic construct
  misc_feature 1..1311: note = derived and/or modified sequence opt11 from Aselizuab_HeavyChain2
  source 1..1311: mol_type = other RNA
gaagtccaactagtcgaatctggcggcggcctagtccaaccaggcggctcactacgcctatcatgcgccgcatccggattcaccttctccacctacgcctcctgggtaagacaggcccccggaaaaggactcgaatgggtcgcctctatatccaccggcggctccacctactaccccgactccgtcaaaggccgcttcaccatctcccgcgacaatgcaaaaaacaccttatacctccaaaactctcttcgtgctgaagacaccgccgtctactactgcgcccgcgactacgacggctacttcgactactggggccaaggcaccctcgtcaccgttagctctgcctccaccaaaggcccatccgtcttccccctcgcaccctgctcacgcagcacctccgaaagcaccgccgcactcggatgccttgtcaaagactatttccccgaacctgtcacggtatcctggaactccggcgccctcacctccggcgtacacacattcccagccgtcctccaatcctccggcctgtattctttatctagcgttgtaacagtcccaagctcctcgcttggtaccaaaacctacacctgcaacgtcgaccacaaaccctccaacaccaaagtcgacaaacgcgtagaatccaaatatggccccccctgcccctcctgccccgccccagaattcctcggcggcccctccgtcttcctcttccccccaaaacccaaagacaccatctcacgtacaccagaagtcacctgcgtcgtagtagacgtctcacaagaagaccccgaagtccaattcaactggtacgtcgacggcgtagaagtacacaacgccaaaaccaaaccccgagaagaacaattcaactccacctaccgcgtcgtatccgtcctcaccgtactacatcaagactggctcaacggcaaagaatacaaatgcaaagtctccaataaaggcctcccttcatccatcgaaaagacaatttccaaagcaaaaggccaaccccgagaaccccaagtatacacactacccccctcacaagaagaaaccaaaaaccaagtgagccttacctgcctcgtcaaaggcttctacccatccgacatcgccgtcgaatgggaatcaaacggccaacccgaaaacaactataaaactaccccacccgtcctcgactccgacggttctttcttcctctactcccgactcacagtcgataaaagccgatggcaagaaggcaacgtcttctcttgttctgtccacgaagccctccacaaccactacacacagaaatctctctcactatccctcggcaaa

SEQ ID NO: 53548 - RNA, 648 nt, synthetic construct
  misc_feature 1..648: note = derived and/or modified sequence opt11 from Aselizuab_LightChain1
  source 1..648: mol_type = other RNA
gacatccaaacccaatccccctcctcactctccgcctccgtcggcgatcgcgtcaccatcacctgcaaagcctcccaatccgtcgactacgacggcgactcatacaactggtaccaacaaaaacccggcaaagcacccaaactactaatctacgccgcctcaaacctcgaatctggcatcccctcccgattctccggctcaggatccggcaccgacttcaccctcaccatatcctcactccaacccgaagacttcgccacctactactgccaacaatccaacgaagacccctggacattcggccaaggcaccaaagtcgaaatcaaacgcaccgtcgccgccccctccgtattcatcttccccccctccgacgaacaactcaaatccggcaccgcctccgtcgtctgcctcctcaacaacttctacccccgcgaagccaaagtccaatggaaagtcgacaacgccctccaatccggcaactcccaggaatcagtaaccgaacaagactccaaggactccacctactccctctcctcaaccctcaccctctccaaagccgactacgaaaaacacaaagtatacgcctgcgaagtcacccaccaaggcctatcctcacccgtaaccaaatccttcaaccgcggcgaatgc

SEQ ID NO: 53549 - RNA, 1344 nt, synthetic construct
  misc_feature 1..1344: note = derived and/or modified sequence opt11 from Atezolizumab_HeavyChain1
  source 1..1344: mol_type = other RNA
gaagtccagctagtcgaaagcggcggcggactcgtccaaccgggcggctccctgcgcctctcatgcgccgcctccggctttactttctcagactcctggatccactgggtccgccaagcccctggcaaaggcctcgaatgggtcgcctggatatctccctacggcggctccacctactacgccgactccgtcaaaggacgctttaccatctccgcagacacatccaaaaacacagcatacctccaaatgaactccctccgcgccgaagacaccgccgtatactactgcgccagacgacactggcccggcggtttcgactactggggacaaggcactctagtcaccgtaagctcagcctcaacaaaaggcccctccgtcttcccactcgccccctcctcaaaaagcacctcaggaggaaccgccgccctcggatgtctagttaaagactacttccccgaacccgtcacagtctcatggaactcaggagcactcacctcaggcgtccacaccttccccgcagtactacaatcctcaggcctctactccctcagttcagtagtcacagtaccctcgtcctccttgggcacacaaacctacatctgcaacgtcaaccacaaaccatccaacaccaaagttgacaagaaagtcgaaccaaaaagctgcgacaaaacccacacatgcccaccctgccccgcaccagaactcctaggcggaccatcagtcttcctcttcccacccaagcccaaagacacactcatgattagccgaacacccgaagtaacatgcgtagtcgtcgacgtatcccacgaggaccccgaagtcaaattcaactggtacgtcgacggcgttgaagtccacaacgcaaaaaccaaaccacgcgaagaacagtatgcctcaacatatcgagtcgtcagtgtcctcaccgtcttacaccaagactggctaaatggtaaagaatacaaatgcaaagtctcaaacaaagccctccccgcacccatcgagaaaaccataagcaaagcaaaaggccaacccagagaaccacaagtctacaccctcccaccctcacgagaagaaatgaccaaaaaccaagtctccctcacctgtctcgtcaaaggcttctacccctccgacatagccgtagaatgggaatcgaacggccaacccgaaaacaactacaaaaccacccctcccgtcctcgacagcgacggctccttcttcctgtacagcaaactcaccgtcgacaaatcacgttggcaacaaggcaacgtcttcagctgcagcgtcatgcacgaagcactccacaaccactacacacaaaagtccctatccctcagccccggaaag

SEQ ID NO: 53550 - RNA, 642 nt, synthetic construct
  misc_feature 1..642: note = derived and/or modified sequence opt11 from Atezolizumab_LightChain1
  source 1..642: mol_type = other RNA
gacatccaaatgacccaatcaccctcttccctatccgcctcagtcggcgaccgcgtaaccatcacctgccgcgcctcccaagacgtctccaccgccgtagcctggtaccaacaaaaacccggcaaagcccccaaactcctcatctactccgcctccttcctctactccggcgtcccctcccgattctccggctcaggctccggcaccgacttcaccctcaccatctcctccctccaacccgaagacttcgccacatactactgccaacaatacctctaccaccccgccaccttcggccaaggcaccaaagtcgaaatcaaacgcaccgtcgccgccccctctgtcttcatcttccccccctctgacgaacaactcaaatctggcaccgcctccgtcgtctgcctcctcaacaacttctacccccgcgaagccaaagtccaatggaaagtcgacaacgccctccaatccggaaactcccaagaatccgtcaccgaacaagactccaaagactccacatacagcctctcctccaccctcaccctctccaaagccgactacgaaaaacacaaagtctacgcctgcgaagtaacacaccaaggcctctcctcccccgtcaccaaatccttcaaccgcggagaatgc

SEQ ID NO: 53551 - RNA, 1323 nt, synthetic construct
  misc_feature 1..1323: note = derived and/or modified sequence opt11 from Atinumab_HeavyChain1
  source 1..1323: mol_type = other RNA
gaagtccaactcgtagaatcaggcggcggcctagtacaacccggcggctcattacgcctctcctgcgccgcctccggcttcaccttctcaaactactggatgagctgggtacggcaggcccccggaaaaggactcgaatgggtagccaccatcaaacaagacggctcccagaaaaactacgtcgactccgtaaaaggccgattcacaatctcccgcgacaacgccaaaaactccctctacctacgcctcaacagtctccgagccgaagacaccgccgtctactactgcgccaccgaactctttgacctatggggccgaggctccctagtcaccgtctcctccgcctccactaagggcccctccgtattcccactcgccccctgcagcagatctacttccgaatcaacagcagccctcggctgcctagtaaaagactactttcctgaaccagtcaccgtctcctggaactccggcgccctaacatccggagtccacactttccccgccgtactacaatcatcgggtctatactctctatcatccgtcgtcacagtcccatcctcctccctcggaacaaaaacctatacctgcaacgtcgaccacaaaccctcaaacacaaaagtcgacaaacgcgtcgaatccaaatacggccctccctgcccctcctgcccagcccccgagttcctcggcggccccagtgtattcctcttcccacccaaacccaaagacaccctcatgatctcccgaacccccgaagtaacctgcgtcgtagtcgacgtgtctcaagaagaccccgaagtacaattcaactggtacgtcgacggagtagaagtccacaacgccaaaacaaaacccagagaagaacaattcaactccacctaccgcgtcgtcagcgtcctcacagtcctccaccaagactggttgaacggcaaggaatacaaatgcaaggtatctaacaaaggcctaccctcctccatagagaaaaccataagcaaagcaaaaggccaaccccgcgaaccccaagtctacacccttcccccatcccaagaagaaatgaccaaaaaccaagtctccctaacctgcctcgtcaagggcttctacccctccgacatagcagtcgaatgggaaagcaacggacaacccgaaaacaactacaaaaccacaccacccgtcctcgactcagacgggtcattcttcctctactcacgcctcaccgtcgacaaaagccgctggcaagaaggaaacgtgttctcatgcagcgtcatgcatgaagctctccacaaccactacacccaaaaatccctctcactctccctcggcaaa

SEQ ID NO: 53552 - RNA, 642 nt, synthetic construct
  misc_feature 1..642: note = derived and/or modified sequence opt11 from Atinumab_LightChain1
  source 1..642: mol_type = other RNA
gaaatcgtcctcacacaatcgcccgccaccctatccctatcccccggcgaacgcgccaccctgagctgccgcgccagccaaagcgtatcctcctacctcgcctggtaccaacaaaaacccggacaagcacccagactcctaatctacgacgcctccaaccgcgccaccggcatccccgcccgcttctcaggctcaggctcaggcacagacttcaccctcaccatctcctccctcgagcccgaagacttcgccgtctactactgccaacaaaggtccaactggccaatcactttcggccaaggcaccaaactcgaaatcaaacgcacagtcgccgccccctccgtcttcatcttcccaccctccgacgaacaactcaaatccggcaccgcctcagtcgtctgcctactcaacaacttctacccccgcgaagccaaagtccaatggaaagtcgacaacgccctccaaagcggcaactcccaagaatccgtcaccgaacaagactccaaagactcaacctactccctatcctcaaccctcaccctatccaaagccgactacgaaaaacacaaagtctacgcatgcgaagtcacacaccaaggcctgagctcacccgtaaccaaatccttcaacagaggcgaatgc

SEQ ID NO: 53553 - RNA, 1329 nt, synthetic construct
  misc_feature 1..1329: note = derived and/or modified sequence opt11 from Atlizuab_HeavyChain1
  source 1..1329: mol_type = other RNA
gtacaactccaggaatccggccccggactcgtccgaccctcacaaacactctcactaacctgcaccgtatccggctattccatcacctccgaccacgcctggtcatgggttcgccaaccacccggacgcggcctcgaatggatcggctacatatcatactcgggaataaccacctacaacccctccctcaaatcacgcgttaccctccgagacacaagcaaaaaccaattttcactccgactatcatccgtcaccgccgccgacacagccgtctactactgcgcccgatccctcgctcgaaccaccgccgactactggggacaaggctcactcgttacagtctcctcagcatccaccaaaggaccctccgtcttccccctcgcaccctcctccaaatccacttctggcggcaccgcagcactcggctgcctcgtcaaagactactttcccgaacccgtcaccgtctcctggaactccggcgcccttacctcaggagtccacaccttccccgccgtcctccagtcttcaggcctttactccctctcctcagtcgtaaccgtcccctcctccagcctcggcacccaaacatacatctgcaacgtcaaccacaaaccctccaacaccaaagtagacaagaaagtcgaaccaaaatcctgcgacaaaacccatacatgtccaccctgccccgcacccgaactcctcggaggcccctccgttttcctctttcccccaaaacccaaagacaccctcatctcccgcacacccgaagtaacctgcgtcgttgtagacgtatcacacgaagacccagaagtcaaattcaactggtacgtcgacggagtcgaagtccacaacgccaaaaccaagcctagagaagaacaatacaactcaacctaccgagtcgtctccgtcctcaccgtcctccaccaagactggctaaacggcaaagaatacaaatgcaaagtatcaaacaaagccctccccgctcccatcgaaaagaccatctccaaagccaaaggccaaccccgcgaaccacaagtctacaccctaccaccatcccgtgacgaactaaccaaaaaccaagtctctctcacctgtctcgtcaaaggcttctacccctccgacattgccgtcgaatgggaatctaacggtcaacccgaaaacaactacaaaaccaccccgcccgtcctcgactcagacggctcattcttcctttactccaaactcaccgtcgacaaatcgcgatggcaacaaggcaacgttttctcctgctccgtccacgaagccctccacaaccactatacccaaaaatccctctctctctctcccggc

SEQ ID NO: 53554 - RNA, 639 nt, synthetic construct
  misc_feature 1..639: note = derived and/or modified sequence opt11 from Atlizuab_LightChain1
  source 1..639: mol_type = other RNA
gacatccaaacccaatccccctcctctctctccgcatccgtaggagatcgcgtcaccataacctgccgcgcctcccaagacatctcctcctacctcaactggtaccaacaaaaacccggcaaagcccccaaactactcatctactacacctcccgcctccactccggagtcccctcccgcttctccggctccggctcgggcaccgacttcaccttcaccatctcctcactccaacccgaagacatcgccacctactactgccaacaaggcaacacactaccctacacattcggccaaggcaccaaagtcgaaatcaaacgcaccgtcgccgccccctccgtcttcatattcccaccctccgacgaacaactcaaatccggcaccgcctccgtcgtctgcctcctcaacaacttctacccccgcgaagccaaagtccaatggaaagtcgacaacgccctccaatccggaaactcccaagaatccgtcaccgaacaagactccaaagactccacctactccctctcctccaccctcaccctgagcaaagccgactacgaaaaacataaagtctacgcctgcgaagtcacccaccaaggactctcctctcccgtcacaaagtccttcaaccgaggcgaatgc

SEQ ID NO: 53555 - RNA, 792 nt, synthetic construct
  misc_feature 1..792: note = derived and/or modified sequence opt11 from Aurograb_SingleChain
  source 1..792: mol_type = other RNA
atggccaaagtacaactactccaaagcgcaaccgaagtcaaaaaacccggcgccagcgtaaaagtaagctgcaaagcatacggatacacattcaccgactacggcataacctgggtccgacaagcccccggacaaggactcgaatggatgggttggatctcagcctacaacggctacacaaactacgcccaaaaattccaagaccgaataacaatgaccacagacgccagcacaagcacagcctacatggaactacgcagcctccgcccagacgacaccgccgtcctatactgcgcaagagaccgcgaagacgcctccctcctccgcgacggccactggggccaagggaccctagtcacagtctcaagcggaggaggcggctcaggaggaggcggaagcggcggaggaggctccggcggaggcggaagcgaaaccacgctcacacaatcccccggcaccctaagcctaagcccaggcgaacgcgcaaccctaagctgcagagcctcccaaatcgtatcctcaagctacctcgcctggtaccaacaaaaacctggccaagccccacgcctcctaatatacggagcctcaagcagagccacaggcataccagaccgattcagcggaagcggctccggaaccgacttcactctcacaatctcaaaactcgaaccagaagacttcgcagtctactactgccaacactacggaagctcaagcccatggacaagccgaccccgagaccaaagcgacatcaaacgtgcagccgcactagaacaccaccaccaccaccac

SEQ ID NO: 53556 - RNA, 1350 nt, synthetic construct
  misc_feature 1..1350: note = derived and/or modified sequence opt11 from Avelumab_HeavyChain1
  source 1..1350: mol_type = other RNA
gaagtacaattactcgaatcaggaggaggcctcgtccaacccggcggctctctacgactctcatgcgccgccagcggcttcaccttttcctcctacatcatgatgtgggtacgccaagcaccaggcaaaggcctcgaatgggtctcctccatctacccctcaggcggaatcaccttctacgccgacaccgtcaaaggacgcttcaccatctccagagacaactccaaaaacacactatatctccaaatgaactccctccgagccgaagacaccgcagtatactactgcgcacgcatcaaactaggcacagtaaccaccgtcgactactggggtcaaggcacactcgtcaccgtctcctcagcgtccaccaaaggcccctccgtctttcccctagccccctcctccaaatccacatcaggcggaacagccgcactcggctgcctcgtaaaagactacttccccgaacccgtcaccgtatcatggaactccggagccctcacatccggcgtccacaccttccccgccgtcctccaatcaagcggtctctactctctctcctccgtcgttacagtcccctcaagttcattaggcacccaaacgtacatatgcaacgtcaaccacaaacccagcaacaccaaagtagacaagaaagttgaaccaaaatcctgcgataaaacccatacctgcccaccctgccccgccccagaactccttggcggcccctcagtattcctcttcccacccaaacccaaagacacccttatgatctcccgtacccccgaagtaacctgcgtcgtcgtcgacgtatcccacgaagaccccgaagtcaaattcaactggtacgtcgacggcgtcgaagtccacaacgccaaaaccaaaccccgagaagaacaatacaactccacataccgcgtcgtatcggtacttaccgtcctccaccaagactggctcaatggcaaagaatataaatgcaaagtctccaacaaggcacttcccgcccccatcgaaaagacaatttccaaagcaaaaggccaaccccgagaaccccaagtctacaccctcccaccctcccgagacgaactcaccaaaaaccaggtctccctgacctgcctcgtaaaaggcttctacccctccgacatcgcagtcgaatgggaatccaacggccaacctgaaaacaactacaaaaccacacccccagtcctagactccgacggatcatttttcctatactccaaactgactgtagacaaatcccgatggcaacaaggcaacgtcttctcctgctccgtcatgcacgaagcactccacaaccactacacacaaaaatccctctcactatccccaggaaaa

SEQ ID NO: 53557 - RNA, 648 nt, synthetic construct
  misc_feature 1..648: note = derived and/or modified sequence opt11 from Avelumab_LightChain1
  source 1..648: mol_type = other RNA
caatccgccctcacacaacccgcctccgtttccggctcccccggccaatcaatcaccatctcctgcacaggaacatcctccgacgtcggcggctacaactacgtctcctggtatcaacaacaccccgggaaagcccccaaacttatgatctacgacgtctccaaccgcccctccggcgtatcaaaccgcttctccggctccaaatccggcaacaccgcctcactcaccatctccggcctacaagccgaagacgaagcagactactactgctcatcctacacctcctcctccacccgagtcttcggcaccggcaccaaagtcacagtcctcggacaacccaaagccaaccccaccgtcaccctcttccccccctcatccgaagaactccaagcaaacaaagccaccctcgtatgcctcatctccgacttctaccccggcgccgtcaccgtcgcatggaaagccgacggctcaccagtcaaagccggcgtcgaaaccaccaaaccatctaaacaatccaacaacaaatacgccgcatcatcctacctctccctcaccccagaacaatggaaatcccaccgctcctactcttgccaagtaacccacgaaggctccaccgtcgaaaaaaccgtcgcccccaccgaatgctcc

SEQ ID NO: 53558 - RNA, 1344 nt, synthetic construct
  misc_feature 1..1344: note = derived and/or modified sequence opt11 from Bapineuzumab_HeavyChain1
  source 1..1344: mol_type = other RNA
gaagtccaactactcgaatccggcggcggcctcgtccaacccggcggctccctccgcctctcctgcgccgcctccgggttcaccttctcaaactacggcatgagctgggtccgccaagcccctggaaaaggtctcgaatgggtcgcctccatccgttccggcggcggccgaacttactactccgacaacgtgaaaggccgcttcaccatcagccgagacaactccaaaaacacactctacctacaaatgaactcactccgcgccgaagacaccgccgtctactactgcgtccgctacgaccactactcaggatcaagcgactactggggccaaggaaccttagtcaccgtctcaagcgcctccaccaaaggcccctcagtcttccccctcgccccctcctccaaatccacctcaggcggcacagccgcactcggctgcctagtaaaagattacttccccgaacccgtaaccgtctcttggaactcaggcgccctcacctccggcgttcacaccttccccgccgtcctccaatcctccggcctctactccctatcctctgtagtaaccgtcccctcgtcctccctcggaacccaaacatacatatgcaacgtcaaccataaaccatccaacactaaagtcgacaagaaagttgaacccaaatcctgcgacaaaacccacacctgtccaccctgccccgcccccgaactgctcggcggcccttccgtctttctattcccaccaaaaccaaaagataccctaatgatatcccgaacaccagaagtcacttgcgtcgtcgtcgacgtctcccacgaagaccccgaagtcaaattcaactggtacgtcgacggcgtcgaagtacacaacgccaaaaccaaaccccgcgaagaacaatacaactccacataccgcgtcgtatccgtactaacagtcctccaccaagactggctaaacggaaaagaatacaaatgcaaagtttctaacaaagctctacctgcccccatcgagaaaaccatcagcaaagccaaaggacaacccagagaaccccaagtatacacactcccaccatcccgcgaagaaatgaccaaaaaccaggtatccctaacctgtctcgtaaaaggcttctacccgtcagacatcgcagtcgaatgggaaagcaacggccaacccgaaaacaactacaagaccacaccaccagtactcgactcagacggatccttcttcctatacagcaaattaaccgttgacaagagccgatggcaacaaggaaacgtcttctcctgctcagtcatgcacgaggccctccacaaccactatacccagaagtctctctcactctcccccggt

SEQ ID NO: 53559 - RNA, 657 nt, synthetic construct
  misc_feature 1..657: note = derived and/or modified sequence opt11 from Bapineuzumab_LightChain1
  source 1..657: mol_type = other RNA
gacgtcgtcatgacccaatcacccctctccctccccgtcacccccggcgaacccgcctccatctcctgcaaatcctcccaatccctactcgactccgacggtaaaacctacctcaactggctcctccaaaaacccggccaatctccccaacgcctaatctacctcgtctccaaactcgactccggcgtacccgaccgcttctcgggctccggctccggcaccgacttcaccctcaaaatctcccgagtcgaagccgaagacgtaggagtctactactgctggcaaggcacccacttcccccgcaccttcggccaaggcaccaaagtcgaaatcaaacgcacagtcgccgccccctcagtattcatcttcccaccctccgacgaacaactcaaatccggcacagcctccgtcgtctgcctcctcaacaacttctacccccgcgaagccaaagtccaatggaaagtcgacaacgccctacaatccggaaactcccaagaatccgtcaccgaacaagactcaaaagactccacctactccctctcatccaccctcaccctctcaaaagccgactacgaaaaacacaaagtctacgcctgcgaagtcacccaccaaggcctctcctcccccgtcaccaaatccttcaaccgcggcgaatgc

SEQ ID NO: 53560 - RNA, 1338 nt, synthetic construct
  misc_feature 1..1338: note = derived and/or modified sequence opt11 from Basiliximab_HeavyChain
  source 1..1338: mol_type = other RNA
caactacaacaatccggtaccgttctcgcccgacccggagcgtcagtcaaaatgtcctgcaaagcctccggctactccttcacccgctactggatgcactggatcaaacaacgccccggccaaggcctcgaatggattggagccatttaccccggcaactccgacacctcatataaccaaaaattcgaaggcaaagccaaactcaccgccgtcacctctgcatccaccgcatacatggaactttcatccctgacccacgaagactccgcagtatactactgcagccgcgactacggctactactttgacttctggggacaaggcaccacactcaccgtctcatccgccagcactaaaggcccctccgtattccccttagcgccctcctccaaatcaacttccggtggaactgccgccctcggctgcctcgtcaaagattacttccccgaacccgtaacagtatcctggaactcaggcgccctaacctcaggcgtccacaccttccccgccgtcctacaatcatccggcctctactcgctctcatccgtcgtcactgtaccctcctcctccctcggcacccaaacctacatatgcaacgtcaaccacaaaccctccaacacaaaagtagacaaacgcgtcgaaccacccaagtcctgcgacaaaacccatacctgcccaccctgccccgctcccgaactcctgggcggcccctcggtcttcttattcccacccaaacccaaagacaccctcatgatcagccgtacacccgaagtaacctgcgtcgtcgtcgacgtcagccacgaagaccccgaagtcaaattcaactggtacgtcgacggcgtcgaagtccacaacgccaaaaccaaaccccgtgaagaacaatacaactccacctaccgcgtagtatcagtcctaacagtcctccaccaagactggctcaacggaaaagaatacaagtgcaaagtctcaaacaaagccctccccgcacccattgagaaaaccatctcaaaagccaaaggccaaccccgcgaaccccaggtctacaccctcccaccctcacgagacgaactcaccaaaaaccaagtctcgctaacctgcctcgtaaaaggtttttacccctctgacatcgccgtcgaatgggaatctaatggccaacccgaaaacaactacaaaaccacaccacccgtccttgattccgacggatcattcttcctatactccaagctcaccgttgacaaatcccgctggcaacaaggcaacgtattctcctgctccgtcatgcacgaagcactccacaaccactacacccaaaaatccctaagcctctcacccggcaaa

SEQ ID NO: 53561 - RNA, 630 nt, synthetic construct
  misc_feature 1..630: note = derived and/or modified sequence opt11 from Basiliximab_LightChain
  source 1..630: mol_type = other RNA
caaatcgtcagcacccaaagccccgccatcatgtcagcctcacccggcgaaaaagtcaccatgacatgctccgcatcctcctcccgctcctacatgcaatggtaccaacaaaaaccaggcacctcccccaaacgctggatctacgacacctccaaactcgcttccggtgtccccgcccgcttctcaggctccggctcaggcacctcttactccctaaccatctcctcaatggaagccgaagacgcagccacctactactgccaccaacgctcctcctacaccttcggcggcggcaccaaactagaaatcaaacgaaccgtcgccgcaccttcagtcttcatcttcccaccctccgacgaacaactcaaatccggcaccgcctctgtcgtctgcctcctcaacaacttctacccccgcgaagccaaagtccaatggaaagtcgacaacgccctccaatctggcaactcccaagaatcagtcaccgaacaagactccaaagactccacctactccctctcctccaccctcaccctttccaaagccgactacgaaaaacacaaagtctacgcctgcgaagtcacccaccaaggcctctcctcccccgtaaccaaatccttcaaccgcggcgaa

SEQ ID NO: 53562 - RNA, 1350 nt, synthetic construct
  misc_feature 1..1350: note = derived and/or modified sequence opt11 from Bavituximab_HeavyChain
  source 1..1350: mol_type = other RNA
gaagtacaactccaacaatccggcccagaactcgaaaaacccggagcctcagtaaagctctcctgcaaagcctctggctacagcttcaccggatacaacatgaactgggtaaaacaatcccacggcaaatccctcgaatggatcggccacatagatccctactacggcgacacctcctacaaccaaaaattccgcggaaaagccacccttaccgtcgataaaagcagctccaccgcctacatgcaactaaaatccctcacctccgaggacagcgccgtatactactgcgtcaaaggcggatactacggccactggtacttcgacgtctggggcgccgggaccaccgtcaccgtctcttccgccagcacaaaaggcccctcagtcttccccctcgccccctcctccaaatcaacctcaggcggaactgccgccctaggctgcctcgtcaaagattacttcccagagcccgtcacagtttcatggaactcaggagccctcacctcaggcgtccacaccttccccgcagtcctccaaagctccggcctctactccctctcatccgtcgtcacagtcccgtcatcctcactcggcacacaaacctacatctgcaacgtcaaccacaaacccagcaacaccaaagtagacaagaaagtcgaaccaaaatcctgcgacaaaacacacacatgcccaccctgcccagcccccgaactcctcggcggcccgagcgtattcctatttcccccaaaacccaaagacaccctcatgatcagccgcacccccgaagtaacctgcgtcgtcgtcgacgtctcacacgaagaccccgaagtcaaattcaattggtacgtcgacggcgtcgaggtccacaacgctaaaaccaaaccccgcgaagaacaatacaactcaacctaccgcgtcgtatcagtcctaacagtcctacaccaagactggctaaacggcaaagaatacaaatgcaaagtatccaataaagcactgcccgcacccatagagaaaaccatatccaaagccaaaggccagccacgcgagccacaagtctacacgcttccaccctcccgagacgaactgacgaaaaaccaagtcagcctaacctgcctggtcaaaggcttctacccctccgacatagccgtcgagtgggaatctaacggccaaccagaaaacaactacaaaacaacaccccctgtcctcgactctgacggctccttcttcctctactccaaactcaccgtagacaaatcacggtggcagcaaggcaacgtattcagctgctccgtcatgcacgaagccctccacaatcactacacgcaaaaatccctatccctcagccccggcaaa

SEQ ID NO: 53563 - RNA, 642 nt, synthetic construct
  misc_feature 1..642: note = derived and/or modified sequence opt11 from Bavituximab_LightChain
  source 1..642: mol_type = other RNA
gacatccaaatgacccaatccccctcctccctctccgcctccctcggcgaacgcgtctccctaacctgccgagcctcccaagacatcggctcctccctaaactggctccaacaaggccccgacggcaccatcaaacgcctcatctatgccacctcctcactagactccggcgtccccaaacgcttctccggctcccgctccggctccgactactccctcaccatctcctccctcgaatccgaagacttcgtcgactactactgccttcaatacgtctcctccccccccaccttcggagccggcaccaaactcgaactcaaacgcgctgacgcagccccctccgtcttcatcttccccccctctgacgaacaactcaaatccggcaccgcctccgtcgtctgcctcctcaacaacttctacccacgcgaagccaaagtccaatggaaagtcgacaacgccctccaatccggcaactcccaagaatccgtaacagaacaagactcaaaagactcaacttatagcctctcctccaccctcaccctctccaaagcagactacgaaaaacacaaagtctacgcatgcgaagtcacccaccaaggcctctcctcccccgtcaccaaatcattcaaccgcggcgaatgc

SEQ ID NO: 53564 - RNA, 624 nt, synthetic construct
  misc_feature 1..624: note = derived and/or modified sequence opt11 from Bavituximab_LightChain_variant_8734_L
  source 1..624: mol_type = other RNA
gacatccagatgacccaatcaccctcctccctctccgcatccctcggcgaacgcgtcagcctcacctgccgcgccagccaggacatcggctccagcctcaactggctccaacaaggccccgacggcacaatcaaacgcctcatatacgccacctcatccctcgactccggcgtccccaaacgattctccggctcccgctccggctccgactactccctcaccatctcctccctcgaatccgaagacttcgtcgactactactgcctccaatatgtctcctccccccccacattcggcgccggaaccaaactcgaactcaaacgcgccgacgccgccccctccgtcttcatcttccccccctccgacgaacaactcaaatccggcacagcctcagtcgtctgcctcctcaacaacttctacccccgcgaagccaaagtccaatggaaagtcgacaacgccctccaatcaggcaactcccaagaatcagtaaccgaacaagactccaaagactccacctacagcctctccaaagccgactacgaaaaacacaaagtctacgcctgcgaagtcacccaccaaggcctctcctcacccgtaaccaaatccttcaaccgcggcgaatgc

SEQ ID NO: 53565 - RNA, 1368 nt, synthetic construct
  misc_feature 1..1368: note = derived and/or modified sequence opt11 from Begelomab_HeavyChain1
  source 1..1368: mol_type = other RNA
caggtccaactccaacaatccggagcagaactagtaaaacccggcgcatccgtaaaactctcatgcaaagcctccggctacaccttccgctcctacgacattaactgggtccgccaacgccccgaacaaggcctagaatggatcggctggatcttccccggagatggatctaccaaatacaacgaaaaattcaaaggcaaagccaccctcaccaccgacaaatctagctcaactgcctacatgcaactatcacgactcacctctgaggactccgctgtctacttctgcgcgcgttggacagtcgtcggacccggctactttgacgtctggggcgcaggcacaaccgtcaccgtctcctccgccaaaacaacacccccctccgtttacccactcgcacccggatgcggcgacactacaggctcctccgtcaccctcggctgcctagtcaaaggctacttccccgaatccgtaactgttacgtggaactccggctcactctcctcctccgtccacactttcccagccctcctccaatccggcctatacaccatgtccagcagcgtcaccgtcccatcctccacatggccatcacagaccgtaacctgctccgttgcacaccccgcctcaagcaccaccgtcgacaaaaaactcgaaccatccggccccatcagcaccataaacccctgccccccctgcaaagaatgccacaaatgccccgcccccaaccttgaaggaggaccatccgtcttcatattcccacccaacatcaaagacgtactcatgatctccctaacccccaaagtcacttgcgtcgtcgtcgacgtatcggaagacgaccctgatgtccaaatatcctggttcgtcaacaacgtcgaagtacacaccgcccaaacacaaacccaccgcgaagactataactccacaatccgcgtcgtctccacactacccatacaacaccaagattggatgtccggcaaggaatttaaatgcaaagtcaacaacaaagacctcccctcccccatcgaacgcacaatctccaaaatcaaaggcctcgtacgcgctccccaagtctacatactacccccccccgccgaacaactctcccgcaaagacgtgtctctcacttgcctcgttgtcggcttcaaccccggagacatctccgtcgaatggacgtcaaacggacacacagaagaaaactataaagacaccgccccagtcctcgacagcgacggctcctacttcatctactccaaactcaacatgaaaacaagcaaatgggaaaaaacagactcattctcttgcaacgtccgccacgagggactcaaaaactactacctcaaaaaaaccatctcccgctcccccggcaaa

SEQ ID NO: 53566 - RNA, 639 nt, synthetic construct
  misc_feature 1..639: note = derived and/or modified sequence opt11 from Begelomab_LightChain1
  source 1..639: mol_type = other RNA
caaatcgtcctaacccaatccccagccatcatgtccgcatcccccggcgaaaaagtaaccatcacatgctccgcctcctcatccgtctcctacatgaactggttccaacaaaaacccggcacctcacccaaactatggatctactcaacctccaacctcgcctccggcgtacccgcccgattctccggctccggctccggcacctcctactccctcaccatctcccgcatggaagccgaagacgccgcaacctactactgccaacaacgctcctcctaccccaacaccttcggcggcggcaccaaactagaaatcaaacgcgccgacgccgcccccaccgtctccatcttcccaccctcctccgaacaactcacctccggcggcgcatcagtcgtctgcttcctcaacaacttctaccccaaagacatcaacgtcaaatggaaaatcgacggctccgaacgccaaaacggcgtcctcaactcatggaccgaccaagactccaaagactccacctactccatgtcctccaccctcaccctcaccaaagacgaatacgaacgacacaacagctacacatgcgaagccacccacaaaacctccacctcccccatcgtcaaatcattcaaccgcaacgaatgc

SEQ ID NO: 53567 - RNA, 1353 nt, synthetic construct
  misc_feature 1..1353: note = derived and/or modified sequence opt11 from Benralizumab_HeavyChain1
  source 1..1353: mol_type = other RNA
gaagttcagctagtccaatccggcgccgaagtaaagaaaccaggcgcctcagtcaaagtctcctgcaaagccagcggctacaccttcacatcatacgtcatacattgggtacgacaacgcccaggccaaggcctcgcatggatgggttacatcaacccctacaacgacggaacaaaatacaacgaacgattcaaaggcaaagtcacaatcacatcagaccgctccacatccaccgtctatatggaattaagctcactccgcagcgaagacacagccgtctacctctgcggccgcgaaggcatccgatattacggcctccttggcgactactggggccaaggtaccctagtcactgtctcgtcagcctcaactaaaggcccctccgtctttcccctcgcgcccagctccaaatccacctccggaggcactgccgcactaggatgcctcgtcaaagactacttccccgaacccgtcactgtctcctggaactcaggcgcactcacctccggagttcacactttccccgccgtcctccaatcctccggcctctattccctatccagcgtcgtcaccgtccccagctcctcactcggcacccaaacctacatatgcaacgtcaaccacaaacccagcaacaccaaagtcgacaaaaaggttgaacctaaatcctgcgacaaaactcacacatgcccaccctgccccgcccccgaactcctcggcggcccctccgtattcctctttccccctaaacctaaagacaccctgatgatctcccgaaccccagaagtcacatgcgtcgtagtcgacgtatcacacgaagaccccgaagtcaaattcaactggtacgtagacggcgtagaagtccacaacgccaaaaccaagccccgcgaagaacaatacaactccacctaccgcgtcgtctccgtcctcaccgtactacaccaagattggctcaacggaaaggaatacaaatgcaaagtcagcaacaaagcactgccagcccccatcgagaaaaccatatccaaagccaaaggccaaccacgcgaaccccaagtatacacactcccaccctcacgcgacgaactaaccaagaaccaagtctcactgacatgcctagtaaaaggcttctatccgtcagacatcgccgttgaatgggaatccaacggccaacccgaaaacaactacaaaacaacacccccagtcctcgactcagatggctctttcttcctctacagcaaactgactgtcgacaaatcccgctggcaacaaggcaacgtattcagctgctccgtaatgcatgaagcactccacaaccactacactcaaaaatccctctccctctcacccggcaaa

SEQ ID NO: 53568 - RNA, 642 nt, synthetic construct
  misc_feature 1..642: note = derived and/or modified sequence opt11 from Benralizumab_LightChain1
  source 1..642: mol_type = other RNA
gacatccaaatgacccaatccccctcctccctctccgcctcagtcggcgaccgcgtcaccatcacctgcggcacctcagaagacatcatcaactacctcaactggtaccaacaaaaacccggcaaagcacccaaactcctcatctaccacacctcccgactccaatccggcgtcccctcccgtttctcaggatccggctccggcaccgacttcaccctcaccatctcctccctccaacccgaagacttcgccacctactactgccaacaaggctacaccctcccctacaccttcggccaaggcacaaaagtagaaatcaaacgaaccgtcgccgccccctccgtcttcatcttccccccctccgacgaacaactcaaatccggcaccgcctcagtcgtctgcctcctcaacaacttctacccccgagaagccaaagtccaatggaaagtagacaacgccctccaatccggaaactcccaagaatccgtcaccgaacaagactccaaagactcaacctactccctctcctccaccctcaccctcagcaaagccgactacgaaaaacacaaagtctacgcctgcgaagtcacccaccaaggcctatcctcccccgtcaccaaatccttcaaccgcggcgaatgc

SEQ ID NO: 53569 - RNA, 1329 nt, synthetic construct
  misc_feature 1..1329: note = derived and/or modified sequence opt11 from Betalutin_HeavyChain1
  source 1..1329: mol_type = other RNA
gaaatccaattacaacaatccggccccgaactcgtcaaaccaggcgcatccgtcaaagtatcatgcaaagcctcaggctactccttcaccgactacaacatgtactgggtcaaacaatcccacggcaaatccctggaatggatcggttacatcgacccctacaacggcgacacaacatacaatcaaaaattcaaaggcaaagccaccctcaccgtagacaaatcttcctccaccgccttcatacatctcaactcactcacctcagaagactctgccgtctactactgcgcacgatccccctacggccactacgcgatggactactggggacaaggcacgtccgtaaccgtatcctccgccaaaacaacacccccatcagtctaccccctcgcccccggctccgccgcccaaaccaactccatggtcaccctcggctgccttgtcaaaggctacttccccgaaccagtcaccgtcacgtggaactcaggatccctctcctcaggcgtccataccttcccagccgtcctccaatctgatctatacactctctcctcgtccgtcacagttccatcctctacctggccctccgaaaccgttacctgcaacgtcgcccaccccgcctcctccaccaaggtcgacaaaaagatagtcccgcgagactgcggctgcaagccctgtatctgcaccgtacccgaagtctcctccgtattcatcttccctcccaaacccaaggacgtcctcaccatcactctaacacccaaagtcacatgcgtcgtagtcgacatctccaaagatgaccccgaagtccaattctcctggttcgttgacgacgtcgaagtacacaccgcccaaactcaaccccgcgaagaacaattcaactcaacgttccgctccgtttccgaacttccaatcatgcaccaagactggctcaatggcaaagagttcaaatgccgcgtaaactccgccgccttccccgcccccatcgagaaaaccatctccaaaaccaaaggccgtccaaaagcaccccaagtatacaccatccctccacccaaagaacaaatggccaaagacaaagtctcccttacctgcatgattacagacttcttccccgaagacataaccgtcgaatggcaatggaacggccaacccgccgaaaactacaaaaacacccagcccatcatggacaccgacggctcttacttcgtctactcaaaactaaacgtccaaaaatccaactgggaagccggcaacacatttacctgctccgttctacacgaaggactacacaaccaccacaccgaaaaatccctatctcactcccccggcaaa

SEQ ID NO: 53570 - RNA, 642 nt, synthetic construct
  misc_feature 1..642: note = derived and/or modified sequence opt11 from Betalutin_LightChain1
  source 1..642: mol_type = other RNA
gacatcgtcatgacccaatcccacaaactcctctccacctccgtcggcgaccgcgtctccataacctgcaaagcctcccaagacgtctccaccgccgtagactggtaccaacaaaaacccggccaatcaccaaaactcctcatcaactgggcctcaacccgccacaccggagtccccgaccgcttcactggctcaggctccggcaccgactacaccctaacaatctcctcaatgcaagccgaagacctcgccctctactactgcagacaacactactccacccccttcaccttcggctccggcaccaaactcgaaatcaaacgcgccgacgcagcccccaccgtatccatcttcccaccctcctccgaacaactcacctctggcggcgcctccgtcgtatgcttcctaaacaacttctaccccaaagacatcaacgtcaaatggaaaatcgacggctccgaacgccaaaacggcgtactcaactcctggaccgaccaagactccaaagactccacctactccatgtcctccaccctcaccctaaccaaagacgaatacgaacgccacaactcatacacatgcgaagccacccacaaaacctcaacctctcccatcgtcaaatccttcaaccgcaacgaatgc

SEQ ID NO: 53571 - RNA, 1344 nt, synthetic construct
  misc_feature 1..1344: note = derived and/or modified sequence opt11 from Bevacituzuab_HeavyChain1
  source 1..1344: mol_type = other RNA
gaagtacaactcgtcgaatccggcggaggcctagtccaacccggcggctccctccgcctctcctgcgccgcctcaggctacaccttcaccaactacggcaactgggtccgacaagcacccggcaaaggcttagaatgggtcggatggatcaacacctacaccggcgaacccacatacgcagccgacttcaaacgccgcttcaccttctccctagacacctccaaatcaaccgcatacctccaaaactcgctccgcgctgaagacacagcagtctactactgcgccaaatacccccactactacgggtcatcacactggtacttcgacgtctggggccaaggaacactggtcaccgtatccagcgcatccaccaaaggcccctccgtcttccccctagcccccagctccaaatcaacctccggaggaacagcagccctcggttgcctagtcaaagattacttccctgaacccgtcaccgtaagctggaactccggcgccctgaccagtggagtacacaccttcccagccgtcctccaatcctcaggcctctactcactttcctccgtcgtcaccgtcccatcatcatcactcggaacacaaacctatatctgcaacgtcaaccacaaacccagcaacaccaaggtcgacaagaaagttgaacccaaatcctgcgacaaaacacacacctgtccaccatgcccggccccggaactcctaggtggcccttccgtcttcctattcccgcccaaacccaaagacaccctcatcagccgcacccccgaagtaacttgcgtcgtcgttgacgtctcccacgaggaccctgaagtaaaattcaactggtacgtcgacggcgtcgaagtacacaacgccaaaacaaaaccccgagaagaacaatacaactccacctaccgtgtcgtctccgtcctaaccgtcctacaccaagactggctcaacggaaaagaatacaaatgcaaagtctcaaacaaagccctacccgcccccattgagaaaaccatctcaaaagccaaaggccaaccccgagaaccccaagtctacacactcccaccctccagagaagaaaccaaaaaccaagtctccctaacctgcctagtcaaaggattctacccctccgacatcgccgttgaatgggaatccaacggtcaaccagaaaacaactacaaaaccaccccacccgtcctagactcagacggctccttcttcctttactcaaaacttaccgtcgacaaatcacgctggcaacaaggtaacgtattctcttgctccgtccacgaagcactccacaaccactacacccaaaaatcactctccctcagccccggaaaa

SEQ ID NO: 53572 - RNA, 639 nt, synthetic construct
  misc_feature 1..639: note = derived and/or modified sequence opt11 from Bevacituzuab_LightChain1
  source 1..639: mol_type = other RNA
gacatccaaacccaatcaccctcctccctctccgcctccgtaggcgaccgcgtcaccataacctgctccgcctcacaagacatctcaaactacctcaactggtaccaacaaaaacccggcaaagcccccaaagtccttatctacttcacctcctcactccactccggcgtcccctcacgcttctccggctccggctcaggcaccgacttcaccctcaccatatcctccctccaacccgaagacttcgccacctactactgccaacaatactctaccgtcccatggaccttcggccaaggcaccaaagtcgaaatcaaacgcaccgtcgccgccccctccgtattcatattccctccctccgacgaacaactcaaatccggcaccgcatcagtcgtctgcctcctcaacaacttctacccccgcgaagccaaagtccaatggaaagtcgacaacgccctccaatccggaaactcacaagaatcagtcaccgaacaagactccaaagactccacctactccctctcctcaacccttaccctctcaaaagccgactacgaaaaacacaaagtatacgcctgcgaagtcacccaccaaggcctatcatcccccgtcaccaaatccttcaaccgcggcgaatgc

SEQ ID NO: 53573 - RNA, 639 nt, synthetic construct
  misc_feature 1..639: note = derived and/or modified sequence opt11 from Bevacizumab_154-aspartic_acid_LightChain
  source 1..639: mol_type = other RNA
gacatccaaatgacacaatccccctcatccctctccgcctccgtcggcgaccgagtcaccataacctgctccgcatcccaagacatctccaactacctaaactggtaccaacaaaaacccggcaaagcccccaaagtcctcatctacttcacatcctccctccactccggcgtcccctcccgcttctccggatccggctcaggcaccgacttcacccttaccatctcctccctacaacccgaagacttcgccacctactactgccaacaatactccacagtcccctggaccttcggccaaggcaccaaagtcgaaatcaaacgcaccgtcgccgccccctccgtcttcatcttcccaccctccgacgaacaactcaaatccggcaccgcctccgtcgtctgcctcctcaacaacttctacccccgcgaagccaaagtacaatggaaagtcgacaacgccgaccaatccggcaactcccaagaatcagtcaccgaacaagactccaaagactcaacctactccctctcctccaccctcaccctctccaaagcagactacgaaaaacacaaagtctacgcctgcgaagtcacccaccaaggcctctcctcccccgtcaccaaatccttcaaccgaggcgaa

SEQ ID NO: 53574 - RNA, 639 nt, synthetic construct
  misc_feature 1..639: note = derived and/or modified sequence opt11 from Bevacizumab_154-substitution_deriv_LightChain
  source 1..639: mol_type = other RNA
gacatccaaatgacccaatccccctcatctctctctgcctcagtcggcgaccgagtcaccataacctgctccgcctcccaagacatctcaaactacctcaactggtaccaacaaaaacccggcaaagcccccaaagtcctcatctacttcacctcctccctccactccggagtcccctcccgcttctcaggctcaggctccggcaccgacttcaccctcaccatctcctccctccaaccagaagacttcgctacctactactgccaacaatactccacagtcccctggaccttcggccaaggcacaaaagtcgaaatcaaacgcaccgtcgccgccccatccgtcttcatattcccaccctccgacgaacaactcaaatcaggcaccgcctccgtcgtatgcctcctcaacaacttctacccccgcgaagccaaagtccaatggaaagtcgacaacgccgaccaatccggaaactcccaagaatccgtcaccgaacaagactccaaagactccacctactcactctcctccaccctcaccctctccaaagccgactacgaaaaacacaaagtctacgcatgcgaagtcacccaccaaggcctctcctcccccgtaaccaaatccttcaaccgaggcgaa

SEQ ID NO: 53575 - RNA, 672 nt, synthetic construct
  misc_feature 1..672: note = derived and/or modified sequence opt11 from Bevacizumab_180-serine_HeavyChain
  source 1..672: mol_type = other RNA
gaagtccaactcgtcgaatccggcggcggcctcgtccaacccggcggctcactccgcctctcctgcgccgcctccggctacaccttcaccaactacggcatgaactgggtccgccaagcccccggaaaaggcctagaatgggtcggctggatcaacacctacaccggagaacccacttacgccgccgacttcaaacgccgcttcaccttctccctcgacacctccaaatctactgcctacctacaaatgaactccctccgcgccgaagacaccgccgtctactactgcgccaaatacccccattactacggctcctcacactggtacttcgacgtttggggccaaggcaccctcgtcaccgtctcctcagcctccacaaaaggcccctccgtcttccccctcgcaccctcatccaaatccacctccggcggcaccgccgccctaggatgcctcgtcaaagactacttccccgaacccgtcaccgtctcctggaactccggcgccctcacctccggcgtccacaccttccctgccgtctctcaatcatccggcctctactccctctcctcagtcgtcaccgtcccctcctccagcctaggcacccaaacatacatctgcaacgtcaaccataaaccctctaacaccaaagtcgacaaaaaagtcgaacccaaa

SEQ ID NO: 53576 - RNA, 672 nt, synthetic construct
  misc_feature 1..672: note = derived and/or modified sequence opt11 from Bevacizumab_180-substitution_deriv_HeavyCahin
  source 1..672: mol_type = other RNA
gaagtccaactcgtcgaatccggcggaggcctcgtccaacccggcggctccctccgcctatcctgcgcagcctcaggctacaccttcaccaactacggcatgaactgggtccgccaagcccccggcaaaggactcgaatgggtcggctggatcaacacctacaccggcgaacccacctacgccgccgacttcaaacgccgcttcaccttctccctagacacctccaaatccaccgcctacctccaaatgaactccctacgtgccgaagacacagccgtctactactgcgccaaatatccccactactacggctcatcacactggtacttcgacgtctggggccaaggcaccctcgtcaccgtctcctccgcctccacaaaaggcccctccgtcttcccactcgcaccctcctccaaatccacctccggcggcaccgccgccctcggttgcctcgtcaaagactacttccccgaacccgtcaccgtctcctggaattcaggcgccctaacctccggcgtccacaccttccccgccgtctctcaatcctccggactctactccctatcatccgtcgtcaccgtcccctcctcctccctaggcacccaaacctacatctgcaacgtaaaccacaaaccctcaaacaccaaagtcgacaaaaaagtcgaacccaaa

SEQ ID NO: 53577 - RNA, 1359 nt, synthetic construct
  misc_feature 1..1359: note = derived and/or modified sequence opt11 from Bevacizumab_beta_HeavyChain1
  source 1..1359: mol_type = other RNA
gaagtacaactcgtcgaatccgggggtggcctcgtccaacccggcggctcactaagactctcatgcgccgcctccggatacaccttcaccaactacggaatgaactgggtacgccaagcccccggcaaaggtctcgaatgggtcggctggataaacacctacaccggagagcccacctacgccgccgacttcaaacgacgcttcaccttctccctcgacacctccaaaagcaccgcatacctccagatgaactcactacgcgccgaagacaccgcagtctactactgcgcgaaatacccccactattacggttcctcccactggtacttcgacgtctggggccaaggcaccctagtcacagtctcctccgcctccaccaagggaccctcagtcttccccctcgccccttcctcaaaatccacctccggcggaaccgccgcacttggatgcctcgtcaaagactacttcccagaaccagtaaccgtctcctggaactccggtgccctaacatcaggagtccacacattccccgccgtactccaatcctccggtctttactccctatcatcagtcgtaaccgtaccctccagcagcctcggaacacaaacctacatatgcaacgtcaaccacaaaccctccaacaccaaagtcgacaagaaagtcgaacccaaatcctgcgacaaaacacacacatgcccaccctgccccgcccccgagctactcggcggcccctcagtcttcctcttccctccaaaaccaaaagacaccctcatgatctcacgaacacctgaagtaacctgcgtagtcgtcgacgtctcccacgaagaccccgaagtcaaatttaattggtacgtagacggggttgaagtccacaacgcaaaaaccaaacctcgagaagaacaatacaacagtacctaccgggttgtatccgttctcaccgtcctccaccaagactggctaaacggaaaggaatacaaatgcaaggtatccaacaaagccctccccgcccccatcgagaaaaccatctccaaggccaaaggccaaccaagagaaccacaagtctacacactcccaccctcccgcgaagaaatgaccaaaaaccaagtcagcctaacatgcctcgtcaaaggcttctacccctccgacatcgcagtagaatgggaatccaacggacaacccgaaaacaattacaaaaccactccacccgtcctcgactccgacggctccttcttcctctactctaaactcaccgtcgacaaatcccgatggcaacaaggaaacgtgttctcctgcagcgtcatgcacgaagccctccacaatcactacactcaaaaatccctctccctatcccccggcaaa

SEQ ID NO: 53578 - RNA, 642 nt, synthetic construct
  misc_feature 1..642: note = derived and/or modified sequence opt11 from Bevacizumab_beta_LightChain1
  source 1..642: mol_type = other RNA
gacatccaaatgacccaatccccctcctccctctccgcatccgtcggcgaccgcgtcaccatcacatgctccgcctcccaagacatctccaactacctaaactggtaccaacaaaaacccggcaaagccccaaaagtactcatctacttcacctcctccctccactccggcgtaccctcccgcttctccggctcaggctcaggcacagacttcaccctaaccatctcctcactccaacccgaagacttcgccacctactactgccaacaatactcaaccgttccctggaccttcggacaaggcaccaaagtcgaaatcaaacgcaccgtcgcagccccctccgtcttcatcttcccaccatcagacgaacaactaaaatccggcaccgcatcagtcgtctgccttctcaacaacttctacccacgcgaagccaaagtccaatggaaagtcgacaacgccctccaatccggcaactcccaagaatccgtcaccgaacaagactccaaagactccacctactccctctcctccaccctcaccctctcaaaagccgactacgaaaaacacaaagtctacgcctgcgaagtcacccaccaaggcctctcatcccccgtcaccaaatccttcaaccgcggcgaatgc

SEQ ID NO: 53579 - RNA, 687 nt, synthetic construct
  misc_feature 1..687: note = derived and/or modified sequence opt11 from Bevacizumab_FcDomain
  source 1..687: mol_type = other RNA
tcctgcgacaaaacccacacctgccccccctgcccagcccccgaactccttggcggcccctccgtcttcttattccccccaaaacctaaagacaccctcatgatctcccgcacccccgaagtcacctgcgtcgtcgtcgacgtctcccacgaagaccccgaagtcaaattcaactggtacgtagacggcgtcgaagtacacaacgccaaaaccaaaccccgcgaagaacaatacaactccacctaccgagtcgtctccgtactcaccgtcctccaccaagactggctaaacggcaaagaatacaaatgcaaagtctccaacaaagccctccccgcccccatcgaaaaaaccatctccaaagccaaaggccaaccccgcgaaccccaagtctacaccctcccaccctcccgcgacgaactcaccaaaaaccaagtctccctcacctgcctagtcaaaggattctacccctcagacatcgccgtcgaatgggaatccaacggtcaacccgaaaacaactacaaaaccacccccccagtcctcgactcagacggctcattcttcctctactccaaactcaccgtcgacaaatcccgctggcaacaaggcaacgtcttctcctgctcagtcatgcacgaagcactccacaaccactacacccaaaaatccctctcactctccccaggaaaa

SEQ ID NO: 53580 - RNA, 672 nt, synthetic construct
  misc_feature 1..672: note = derived and/or modified sequence opt11 from Bevacizumab_HeavyChain
  source 1..672: mol_type = other RNA
gaagtccaactcgtcgaatccggcggcggactcgtccaacccggcggatccctccgcctctcctgcgccgcctccggctacaccttcaccaactacggcatgaactgggtccgccaagcccccgggaaaggcctcgaatgggtcggctggataaacacatacaccggtgaacccacctacgccgccgacttcaaacgccgcttcaccttctcactcgacacctccaaatccaccgcctacctacaaatgaactccctacgagccgaagacacagccgtctactactgcgccaaatacccccactactacggctcctcccactggtacttcgacgtatggggccaaggcaccctagtcaccgtatcctcagcctccaccaaaggcccctccgtcttccccctagccccctcttcaaaatccacctccggcggcaccgccgccctcggctgcctcgtcaaagactacttccccgaacccgtcaccgtctcctggaactccggcgccctcacatccggcgtccacaccttccccgccgtcctccaatcctccggactctactccctctcctccgtcgtcaccgtcccctcatcatcactcggcacccaaacctacatctgcaacgtaaaccacaaaccctcaaacaccaaagtcgacaaaaaagtcgaacccaaa

SEQ ID NO: 53581 - RNA, 1428 nt, synthetic construct
  misc_feature 1..1428: note = derived and/or modified sequence opt11 from Bevacizumab_HeavyChain_variant1
  source 1..1428: mol_type = other RNA
gcatcagccacgatgggctggtcctgcatcatcctcttcctagtcgccaccgcaaccggagtacactcagaagtacagctcgtagaatccggcggcggactcgtacaacccggcggctccctacgcttatcatgcgccgcatccggttacacattcaccaactacggcatgaactgggttcgccaggcccccggcaagggcctcgaatgggtcggctggatcaacacctacaccggtgaacccacctacgccgcagatttcaaacgccgattcaccttctctctcgacacctccaaatcaaccgcctacctccaaatgaactcacttcgagcagaagacaccgccgtctactactgcgcaaaatacccccactactacggatcaagccactggtacttcgacgtctggggccaaggcaccttagtcaccgtctcatccgcgagcacaaaaggccccagcgtcttccccctcgcaccctcaagcaaatcaacctccggcggcaccgcagccctaggatgcctcgtcaaagactacttccccgaacccgtcaccgtcagctggaacagcggagccctcacctctggagtccacaccttccccgcggtcctacaatcatccgggctatactccctctcctccgtcgtgaccgtcccttcatcatccctcggaacccagacatacatctgcaacgtcaatcacaaaccaagcaacacaaaagtcgataagaaagtcgaaccgaaatcatgcgacaaaacccacacatgcccaccctgccccgcgcccgaactcctcggaggtccctctgtcttcctctttcccccaaaaccaaaagataccctaatgatatcacgaacccccgaagtgacctgcgtcgtcgtagacgtatcgcacgaagaccccgaagtcaaattcaactggtacgttgacggcgtcgaagtccacaacgccaaaaccaaacccagagaagaacaatataactcaacctaccgcgtcgtctccgtccttaccgtcctccaccaagactggctaaacggcaaagaatacaaatgcaaagtatcaaacaaagccctccccgcccccatcgagaaaacaatctccaaagcaaaaggccaaccccgcgaaccacaagtatacaccctcccaccctcccgagaagaaatgaccaaaaaccaagtcagcctcacatgcctcgtcaaaggcttctacccctccgacatagccgtcgaatgggaatccaacggccaacccgaaaacaactacaaaaccaccccacccgttctcgactctgacggctcattcttcctatactccaaactcaccgttgacaaatcacgctggcaacaaggcaacgtcttctcatgctcagtaatgcacgaagccctccacaaccactacacacaaaaatcgctctcactaagccccggaaaa

SEQ ID NO: 53582 - RNA, 369 nt, synthetic construct
  misc_feature 1..369: note = derived and/or modified sequence opt11 from Bevacizumab_HeavyChain_V-Region
  source 1..369: mol_type = other RNA
gaagtgcaattggtcgagagcgggggcgggctcgtgcaaccgggcgggagcttgcgcttgagctgtgccgcgagcgggtacacgttcacgaactatggcatgaactgggtcaggcaagcgcccgggaaagggctcgagtgggtgggctggatcaatacctataccggggaaccgacctatgccgcggactttaaaaggcgctttacatttagcttggacacgagcaagagcacggcctatctccagatgaatagcctgcgcgcggaagataccgcggtctattactgtgccaagtacccgcactattacgggagctcgcactggtactttgacgtgtgggggcaagggaccttggtcacggtctcgagc

SEQ ID NO: 53583 - RNA, 717 nt, synthetic construct
  misc_feature 1..717: note = derived and/or modified sequence opt11 from Bevacizumab_LightChain1
  source 1..717: mol_type = other RNA
gcctccaaactcgcaaccatgggctggtcatgcatcatccttttcctcgtcgccaccgccaccggcgtccactccgacatacaaatgacccaatccccctcatcactatccgcctccgtcggcgaccgtgtcaccataacctgccgcgcctcacaagacatatcctcctaccttaactggtaccaacaaaaacccggcaaagcccccaaactcctaatctactacacctcccgactccactcaggcgtcccatcccgattctccggctccggctcaggcacagacttcaccttcaccatctcctcactccaaccagaagacatcgccacatactactgccaacaaggcaacaccctcccctacaccttcggccaaggcaccaaagtcgaaatcaaacgcaccgtcgccgccccctccgtcttcatcttcccaccctctgacgaacaactcaaatccggcaccgcctcagtcgtctgcctactcaacaacttctacccccgcgaagccaaagtacaatggaaagtcgacaacgccctccaatctggcaactcccaagaatccgttaccgaacaagactccaaagactcaacctactccctatcctccaccctcaccctatcaaaagccgactacgaaaaacacaaagtctacgcctgcgaagtaacacaccaaggcctctcatctcccgtcacaaaatccttcaaccgcggcgaatgc

SEQ ID NO: 53584 - RNA, 711 nt, synthetic construct
  misc_feature 1..711: note = derived and/or modified sequence opt11 from Bevacizumab_LightChain2
  source 1..711: mol_type = other RNA
gcctccgcaaccatgggctggtcctgcatcatcctcttcctcgtcgccaccgccaccggcgtacactcagacatccaaatgacacaatcaccctcctccctatccgcctccgtaggcgaccgcgtcaccatcacatgctcagcctcccaagacatctccaactacctcaactggtaccaacaaaaacccggcaaagccccaaaagtcctaatctacttcacctcctcactacactccggcgtcccctcccgcttctcaggctcaggctccggcaccgacttcaccctcaccatctcctcactccaacccgaagacttcgccacctactactgccaacaatactccaccgtcccctggaccttcggccaaggaaccaaagtcgaaatcaaacgcaccgtcgccgccccctccgtcttcatcttcccaccctccgacgaacaactaaaatcaggcaccgcctcagtcgtctgccttctaaacaacttctacccccgcgaagccaaagtccaatggaaagtcgacaacgccctccaatccggcaactcccaagaatccgtcaccgaacaagactccaaagactccacctactccctatcctccaccctaaccctctcaaaagccgactacgaaaaacacaaagtctacgcctgcgaagtcacccaccaaggcctctcttccccagtcaccaaatccttcaaccgaggcgaatgc

SEQ ID NO: 53585 - RNA, 642 nt, synthetic construct
  misc_feature 1..642: note = derived and/or modified sequence opt11 from Bevacizumab_LightChain
  source 1..642: mol_type = other RNA
gacatccagatgacccaatccccctcctccctatcagcctccgtcggagaccgcgtcaccatcacatgctccgccagccaagacatctccaactacctcaactggtaccaacaaaaacccggcaaagcccccaaagtcctcatctacttcacctcctccctccactccggcgtcccctcccgcttctccggctcaggctccggcaccgacttcaccctaaccatctcttcactccaacccgaagacttcgccacctactactgccaacaatactccaccgtcccctggaccttcggccaaggaaccaaagtcgaaatcaaacgaaccgtcgcagccccctccgtattcatcttcccaccctccgacgaacaactcaaatccggcaccgcctccgtcgtatgcctcctcaacaacttctacccccgcgaagccaaagtccaatggaaagtcgacaacgccctccaatccggcaactcacaagaatccgtcaccgaacaagactccaaagactccacctactcactctcatccaccctaaccctctccaaagccgactacgaaaaacacaaagtatatgcctgcgaagtcacccaccaaggcctctcctcccccgtcaccaaatccttcaaccgaggcgaatgc

SEQ ID NO: 53586 - RNA, 324 nt, synthetic construct
  misc_feature 1..324: note = derived and/or modified sequence opt11 from Bevacizumab_LightChain_VJ-Region
  source 1..324: mol_type = other RNA
gacatccaaatgacccaatccccctcctccctctccgcctccgtcggcgaccgcgtcaccataacctgctccgcctcccaagacatctccaactacctcaactggtaccaacaaaaacccggcaaagcccccaaagtcctcatctacttcacctcctccctccactccggcgtcccctcccgcttctccggctccggctccggcaccgacttcaccctcaccatctcctccctccaacccgaagacttcgccacctactactgccaacaatactccaccgtcccctggaccttcggccaaggcaccaaagtcgaaatcaaacgc

SEQ ID NO: 53587 - RNA, 321 nt, synthetic construct
  misc_feature 1..321: note = derived and/or modified sequence opt11 from Bevacizumab_LightChain_V-Region
  source 1..321: mol_type = other RNA
gacatccaaatgacacaatccccctcctccctctccgcctccgtcggcgaccgcgtcaccataacctgctccgcatcccaagacatctccaactacctcaactggtaccaacaaaaacccggcaaagcccccaaagtcctaatctacttcacctcctccctccactccggcgtcccctcccgcttctccggctccggctccggcaccgacttcaccctcaccatctcctccctccaacccgaagacttcgccacctactactgccaacaatactccaccgtcccctggaccttcggccaaggcaccaaagtcgaaatcaaa

SEQ ID NO: 53588 - RNA, 369 nt, synthetic construct
  misc_feature 1..369: note = derived and/or modified sequence opt11 from Bevacizumab-rhuMAb-VEGF_HeavyChain_gamma1-Chain_VDJ-Region
  source 1..369: mol_type = other RNA
gaagtacaactcgtcgaatccggcggcggcctcgtccaacccggcggctccctccgcctatcctgcgccgcctccggctacaccttcaccaactacggcatgaactgggtccgccaagcccccggcaaaggcctcgaatgggtcggctggatcaacacctacaccggcgaacccacctacgccgccgacttcaaacgccgcttcaccttctccctcgacacctccaaatccaccgcctacctccaaatgaactccctacgcgccgaagacaccgccgtctactactgcgccaaatacccccactactacggctcctcccactggtacttcgacgtctggggccaaggcaccctcgtaaccgtctcctcc

SEQ ID NO: 53589 - RNA, 321 nt, synthetic construct
  misc_feature 1..321: note = derived and/or modified sequence opt11 from Bevacizumab-rhuMAb-VEGF_LightChain_VJ-Region
  source 1..321: mol_type = other RNA
gacatccaaatgacccaatccccctcctccctctccgcctccgtcggcgaccgcgtcaccatcacctgctccgcctcccaagacatctccaactacctcaactggtaccaacaaaaacccggcaaagcccccaaagtcctcatctacttcacctcctccctccactccggcgtcccctcccgcttctccggctccggctccggcaccgacttcaccctcaccatctcctccctccaacccgaagacttcgccacctactactgccaacaatactccaccgtcccctggaccttcggccaaggcaccaaagtcgaaatcaaa

SEQ ID NO: 53590 - RNA, 1341 nt, synthetic construct
  misc_feature 1..1341: note = derived and/or modified sequence opt11 from Bevacizumab_gamma1-Chain
  source 1..1341: mol_type = other RNA
gaggtccaactcgtcgagagcggcggcggcctcgtccaacccggcggctcccttcgcctaagctgcgccgcctccggctacaccttcaccaactacggcatgaactgggtccgccaagcaccaggaaaaggactcgaatgggtcggctggattaacacctacaccggcgaaccaacatacgctgcagacttcaaacgacgtttcaccttctcactagacacctccaaaagcactgcatacctccaaatgaactccctccgagccgaagacaccgcagtatactactgcgcaaaatacccacactactatggctcatcccactggtacttcgacgtctggggccaaggaacactcgtcaccgtcagctcagcctccaccaagggccccagcgtattccctctcgccccatcatcaaaatccacctcaggtggcaccgcagccctcggctgcctagtcaaggactacttccccgaacccgtaaccgtctcatggaactccggcgcactaacatccggtgtccatactttccccgcagttcttcaaagctctggatccctatcaagcgttgtcaccgtcccatcctcctccctcggcacccaaacgtacatctgcaacgtcaaccacaaaccaagcaacaccaaagtagacaagaaagtcgaaccaaaatcgtgcgacaaaacccacacatgcccaccctgccccgcccccgaacttctcggaggaccctccgtcttcctcttcccacccaaacccaaagacacactaatgatcagtcgcacccccgaggtcacatgcgtcgtcgtcgacgtctctcacgaggacccagaagtaaagttcaactggtacgtcgacggcgtcgaagtccacaacgccaaaaccaaaccacgcgaagaacaatacaactcgtatgtcgtctccgtcctcaccgtcctccaccaagactggctcaacggtaaagaatacaaatgcaaagtatcaaacaaagccctccccgccccaatagagaaaaccatttcaaaagctaaaggccaaccccgcgaaccccaagtatacaccctaccacccagccgcgacgaactaaccaaaaatcaagtaagcctcacgtgcctcgtcaaaggattctacccctcagacatcgccgtcgaatgggaatccaacggccaacccgaaaacaactacaaaaccacaccacccgtcctagactccgacggctcattcttcaaaaagctcacagtcgacaaaagccgctggcaacaaggcaacgtcttctcctgctccgtcatgcacgaagccctacacaaccactacacccaaaaatccctctcactttcccccggcaaa

SEQ ID NO: 53591 - RNA, 1359 nt, synthetic construct
  misc_feature 1..1359: note = derived and/or modified sequence opt11 from Bevacizumab_gamma1-Chain_CH3-Region_mutein
  source 1..1359: mol_type = other RNA
gaagtccagctcgtcgaatcaggcggcggcctcgtacaaccaggcggatccctcagactctcctgcgccgcctccggctacaccttcacaaactatggaatgaactgggtccgccaagcaccaggcaaaggcctagaatgggtaggctggatcaacacgtacaccggagaacccacctacgcagccgacttcaaacgcaggttcaccttctccctagacacctccaaatcaaccgcgtacctccaaatgaacagcctccgcgccgaagatacagccgtctactactgcgcaaaatacccacactactacggctcctcccactggtacttcgacgtctggggccaaggaacactcgtaaccgtctcctccgcatccactaaaggtccgtccgtcttcccgctcgccccctcctccaaatcaacatctggcggcacagcagccctaggttgcctcgtcaaagactactttcccgaaccagtaaccgtctcctggaacagcggcgccctcacaagcggcgtccacacattcccagccgtcctacaatcatcaggactatacagcctctcctcagtagtcaccgtcccctcctcctccctaggaacccagacatacatctgcaacgtcaaccacaaaccctccaacaccaaagtcgacaagaaagtcgaacccaaatcatgtgacaaaacccacacatgccctccctgccccgcccccgaactcctaggcggcccatcagtcttcctcttcccacccaaacccaaagacaccctaatgatctccaggacccccgaagtaacctgcgtcgtagtagacgtctcacacgaagacccagaagtaaaattcaactggtacgtcgacggcgtagaagtccacaacgcaaaaacaaaaccgcgcgaagaacaatacaacagcacctaccgcgtcgtaagcgtgctaaccgtcctacaccaagactggctcaacggcaaagaatacaaatgcaaagtaagcaacaaagccctaccagccccaatcgaaaagaccatttccaaagccaaaggacaaccccgcgaaccacaagtatgcaccctcccgccctcacgcgacgaactcaccaaaaaccaagtctccctcagctgcgccgttaaagggttctacccctccgatatcgcggttgaatgggaatccaacggccaacccgaaaacaactacaaaaccaccccacccgtcctagactccgacggctcattcttcctcgtgtccaaactcaccgtcgacaaatcacgctggcaacaaggcaacgtcttctcatgctccgtcatgcacgaagccctacacaaccactacacccaaaaatcactctccctctcacccggtaaa

SEQ ID NO: 53592 - RNA, 1347 nt, synthetic construct
  misc_feature 1..1347: note = derived and/or modified sequence opt11 from Bezlotoxumab_HeavyChain1
  source 1..1347: mol_type = other RNA
gaagtccaactcgtccaatcgggagccgaagtcaagaaatccggagaatccctaaaaatatcctgcaaaggctccggttactccttcaccagctattggataggctgggtacgccaaatgccaggcaaaggactcgaatggatgggcatcttctaccccggcgactcttccacccgctactccccctccttccaaggccaagtcacaatatccgcagataaatccgtgaacaccgcctacctacaatggtcctctcttaaagcatcagacacagcaatgtactactgcgcccgccgccgcaactggggcaacgccttcgacatctggggccaaggcaccatggtaacagtctcctccgcctccacaaaaggaccctctgtctttcccctcgctccctcctccaagtccacctcgggcggaaccgccgccctcggctgcctcgtaaaagactacttccccgaacccgtcaccgtctcatggaactccggcgccctcacctcaggtgtacacaccttccccgccgtcctacagtcctccggactatactccctctcgtccgtagtcacagtcccctccagcagcttaggaacccaaacatacatatgcaacgtcaaccacaaaccctccaacaccaaagtcgacaaaagagtagaacccaaatcttgcgacaagacacacacctgtccaccctgccccgcccccgaactactcggcggcccctccgtctttctcttccctcccaaacccaaagacacactcatgatatctagaacccccgaagtcacatgcgtcgtcgtagacgtctcacacgaagaccccgaagtaaaattcaactggtacgtcgacggcgtagaagtccacaacgcaaaaaccaaaccccgcgaagaacaatacaactccacctaccgcgtcgtctccgtcttaaccgtactccaccaagattggctcaatggcaaagaatataaatgcaaagtctcgaacaaagccctccccgcccccatcgaaaagaccatcagcaaagctaagggccaaccccgcgaaccccaagtctacaccctcccacccagcagagaagaaatgaccaaaaaccaagtctccctaacctgcctcgtcaaaggattctacccctctgacatcgccgtcgaatgggaaagcaacggccaacccgaaaacaactacaaaaccaccccacccgtcctcgacagcgacggctctttcttcctctactccaaactcaccgtcgacaaatcgcgatggcaacaaggtaacgtcttctcctgcagcgtcatgcacgaagcgctccacaaccactacacccaaaaatccctctccctcagccccggcaaa

SEQ ID NO: 53593 - RNA, 645 nt, synthetic construct
  misc_feature 1..645: note = derived and/or modified sequence opt11 from Bezlotoxumab_LightChain1
  source 1..645: mol_type = other RNA
gaaatcgtactcacccagagccccggcaccctctccctatcacccggcgaaagagccaccctatcctgccgcgcctcacaatccgtctcctcctcatacctcgcctggtaccaacaaaaacccggccaagcaccccgcctccttatctacggagcctcctcccgcgccacaggcatcccagaccgcttctcaggctccggctccggaaccgacttcaccctcaccatctcccgacttgaacccgaagacttcgccgtctactactgccaacaatacggctcctcaacctggaccttcggacaaggcaccaaagtcgaaataaaacgcaccgtcgcagccccctccgtcttcatcttcccaccctccgacgaacaactaaaatccggcaccgcctcagtcgtatgcctcctcaacaacttctacccccgcgaagccaaagtccaatggaaagtcgacaacgccctccaatccggaaactcccaagaatccgtcaccgaacaagactccaaagactcaacctactccctctcatccaccctcaccctctccaaagcagactacgaaaaacacaaagtctacgcctgcgaagtcacccaccaaggcctctcctcccccgtcaccaaatccttcaaccgaggcgagtgc

SEQ ID NO: 53594 - RNA, 1335 nt, synthetic construct
  misc_feature 1..1335: note = derived and/or modified sequence opt11 from Bimagrumab_HeavyChain1
  source 1..1335: mol_type = other RNA
caagtccaactcgtccaatccggcgccgaagtaaaaaaaccaggagcatcagttaaagtcagttgcaaagcctccggatacaccttcacatcctcatacatcaactgggtccgacaagcaccaggccaaggactcgaatggatgggtaccatcaaccccgtatccggctccacctcctacgcccaaaaattccaaggccgagtcaccatgaccagagacacctccataagcacggcctacatggagctctcccgcctacgatcagacgacaccgccgtatactactgcgcccgtggcggatggtttgactactggggtcaaggaaccctcgtcaccgtatcctccgccagcaccaaaggcccctccgtcttccccctcgccccctcctccaaatccacctcaggaggaaccgccgcactcggctgcctagtcaaagactacttcccagaaccagtcaccgtatcctggaactccggcgccctcacctcaggcgtacataccttccccgccgtcctacaatcttccggcctctactcactatccagcgtcgtcaccgtcccctcctcatcactcggcacccaaacctacatctgcaacgtcaaccacaaaccctccaacaccaaagtcgacaaacgcgtcgaaccaaaatcatgcgacaaaacccacacatgcccaccatgtccagcccccgaagccgccggcggcccatcagtcttcctcttcccaccaaaacccaaagacaccctcatgatcagtcgcacccccgaagtaacatgcgtcgtcgtcgatgtatcacacgaagaccccgaagttaaattcaactggtacgttgacggcgtagaagtacacaacgccaaaaccaaaccccgagaagaacaatacaactccacctaccgagtcgtcagcgtcctcacagtcctccaccaagactggttaaacggaaaagaatacaaatgcaaagtctccaataaagctctacccgcccccatcgaaaaaaccatctccaaagctaaaggccagccccgagaaccacaagtatataccctccccccatcccgagaagaaatgaccaaaaaccaagtatcccttacctgcttagtcaaaggcttctatccctccgacatcgccgtcgaatgggaatcaaacggccaacccgaaaacaactacaaaacaacaccacccgtcctggactccgacggctcattcttcctatactccaaacttaccgtagacaaatcccgctggcaacagggcaacgtcttctcgtgctccgtcatgcacgaagcactccacaaccactacacccaaaaatccctctccctctcccccggcaaa

SEQ ID NO: 53595 - RNA, 1332 nt, synthetic construct
  misc_feature 1..1332: note = derived and/or modified sequence opt11 from Bimagrumab_HeavyChain
  source 1..1332: mol_type = other RNA
caagtacagctagtacaatcaggcgcagaagtcaagaaacccggagcatcagtcaaagtatcctgcaaggcttccggctacaccttcacttcctcatacataaactgggtccgacaagcccccggccaaggtctcgaatggatgggcaccataaaccccgtaagcggctccacttcatatgcacaaaaattccaaggccgcgtaacaatgacccgcgacacctccatctccactgcatacatggaactctcccgactccgctccgacgacaccgccgtatactactgcgcacgaggcggctggttcgactactggggccaaggcacccttgtaacagtctcctccgcctctacgaaaggtccctccgtcttccccctcgccccgagctccaaatccacatcaggcggcaccgcagccctaggctgcctcgtcaaagactacttccccgaaccagtcaccgtctcctggaacagcggcgcactcacatccggcgtccacaccttccccgctgtcctccaatcatccggcctctactccctttccagcgtcgtcacagtcccctcctcatccctcggcacgcaaacatacatctgcaacgtcaatcacaaaccatcaaacacaaaagtagacaaacgcgtagaacccaaatcctgcgacaaaacccacacctgtcccccatgcccagcacccgaagccgccggagggccctcagtattcctgttcccacccaaacccaaagacacactaatgatctcgcgtacccctgaagtaacctgcgtcgtagtcgacgtttcccacgaagaccccgaagtcaaattcaactggtacgtcgacggcgtcgaagtacacaacgccaaaaccaaaccccgcgaagaacagtacaactccacataccgcgtcgtctccgtactcaccgtactacaccaagactggctcaacggaaaagaatacaaatgcaaagtttccaacaaagccctccccgcccccatagagaaaaccatctccaaagccaaaggccaaccacgcgaaccacaagtctacacccttccaccctcacgcgaagaaatgaccaaaaaccaagtcagcctcacatgcctcgtcaagggcttctacccctcagacatcgcagtcgaatgggaatccaacggacaacccgaaaacaactacaaaacaacaccacccgtcctcgactcagacggcagcttcttcctatactccaaactcacagtagacaaaagccgttggcagcaaggaaacgtcttctcatgctcagtcatgcacgaagcactacacaaccattacacccaaaaatccctatccctctcccccggc

SEQ ID NO: 53596 - RNA, 651 nt, synthetic construct
  misc_feature 1..651: note = derived and/or modified sequence opt11 from Bimagrumab_LightChain1
  source 1..651: mol_type = other RNA
caatccgccctcacccaaccagcctccgtctccggatcaccaggccaatccatcaccatctcctgcaccggcacctcctccgacgtcggctcctacaactacgtcaactggtaccaacaacaccccggaaaagcacccaaactaatgatctacggagtctccaaacgcccctcaggagtctccaaccgattctccggctcaaaatccggcaacaccgccagcctcaccatctccggactccaagccgaagacgaagccgactactactgcggcaccttcgccggcggctcctactacggcgtcttcggcggcggcaccaaactaaccgtcctcggacaaccaaaagccgccccctccgtcaccctcttcccaccctcctccgaagaactccaagccaacaaagccacactcgtctgcctcatctccgacttctacccaggcgccgtcaccgtcgcctggaaagccgactcctcccccgtcaaagccggcgtcgaaaccaccaccccctccaaacaatccaacaacaaatacgccgcctcctcatacctctccctcaccccagaacaatggaaatcccaccgatcctactcctgccaagtcacccacgaaggctccaccgtcgaaaaaaccgtcgcccccacagaatgttcc

SEQ ID NO: 53597 - RNA, 1365 nt, synthetic construct
  misc_feature 1..1365: note = derived and/or modified sequence opt11 from Bimekizumab_HeavyChain1
  source 1..1365: mol_type = other RNA
gaagtacagctagtagaaagcggcggtggcctagtccaacccggtggatccctccgactcagctgcgccgcctccggctttaccttctccgactacaacatggcctgggtccgccaagcacccggcaaaggactcgaatgggtcgcaaccatcacctacgaaggacgcaacacctactatcgggactccgtcaaaggccgcttcaccatctccagagacaacgccaaaaactccctctacctccaaatgaactctctccgcgcagaagacaccgcagtctactactgcgcctcgccaccccaatactacgaaggctccatataccgcctctggttcgcccactggggacaaggaaccctagtcaccgtctctagcgcctcaaccaaaggcccttccgtcttccccctcgccccctcatctaaatccacttcaggcggcacagccgccctcggctgcctcgtaaaagactacttccccgaacccgtcacagtcagctggaactctggcgctctcacttcaggcgtacacaccttccctgcagtcctccaatcttcaggactctactccctatcatccgtcgtaaccgtcccctcctcatccctcggcacacaaacctatatctgcaacgtcaaccacaaaccatccaacaccaaagtcgacaagaaagtcgaacccaaatcctgcgacaaaacccacacatgccctccctgccccgcccccgaactactcggaggcccctccgtcttcctattcccaccaaaacccaaagacaccctcatgatatcccgaacccctgaagttacctgcgtcgtcgtcgacgtctcccacgaagaccccgaagtcaaattcaactggtacgtcgacggcgtagaggtccacaatgccaaaaccaaaccccgagaagaacaatacaactctacataccgcgtcgtatccgtcctcaccgtcctacaccaagactggctcaacgggaaagaatacaaatgcaaagtctccaacaaagcactgccagcacccatcgagaaaacaatatccaaagccaaaggccaaccccgagaaccccaagtctacacactacccccttcccgcgacgaactcaccaaaaatcaagtatcactaacctgcctagtcaaaggcttctacccatccgacatagccgtcgaatgggaatccaacggccaaccagaaaacaactacaaaaccacacccccagtcctagactccgacggctccttcttcctatactcaaaactcaccgtcgataaatcccgatggcaacaaggcaacgtcttttcctgctccgtcatgcacgaagccctacacaaccactacacccaaaaatccctctctctatcacccggcaaa

SEQ ID NO: 53598 - RNA, 642 nt, synthetic construct
  misc_feature 1..642: note = derived and/or modified sequence opt11 from Bimekizumab_LightChain1
  source 1..642: mol_type = other RNA
gctatccagctcacgcaatcaccctcgagcttgagcgcgagcgtcggcgatcgcgtgaccataacctgccgcgcggacgagagcgtacgcacactcatgcactggtaccagcaaaagcccggaaaagcacccaagctcttaatctatctcgtgagcaacagcgaaatcggggtcccggacaggttctccggctcaggctcgggaacggacttccgcctgaccatatcctcgctacagcccgaggacttcgccacgtactactgccagcaaacgtggtcggacccgtggacgttcgggcaagggaccaaggtcgagatcaagcgcacagtcgcggccccaagcgtgttcatattcccgccctcggacgaacaattgaaatcgggcacggcctcagtcgtatgcctactcaataacttctacccgcgcgaggccaaggtccagtggaaggtcgacaacgcactccagagcgggaactcacaagagagcgtgaccgagcaagatagcaaggactcgacctacagcctaagctcgaccctgaccttgagtaaggccgactacgagaaacataaagtgtacgcatgcgaggtcacgcaccagggcctaagctcgccagtgaccaagagctttaacagaggcgagtgc

SEQ ID NO: 53599 - RNA, 1344 nt, synthetic construct
  misc_feature 1..1344: note = derived and/or modified sequence opt11 from Bleselumab_HeavyChain1
  source 1..1344: mol_type = other RNA
caactccaactccaagaatcaggcccaggcctcctcaaaccctctgagaccctcagcctcacctgtaccgtctccggaggctcaatcagctcccccggctactacggaggatggatccgccaaccacccggaaaaggcctcgaatggatcggctccatctacaaatccggctccacctaccacaacccctccctcaaatcccgtgtcactatatccgtcgacacgagcaaaaaccaattctccctcaaactctcttccgtcaccgccgcagacaccgccgtctactactgtacacgccccgtggtccgctacttcggatggttcgatccctggggccaaggaaccctagtaaccgtctcatcagcatccaccaaaggtccctccgtcttcccactcgccccttgctcccgatccacctcagaaagcaccgccgcactcgggtgcctcgtcaaggattacttcccagaacccgtcaccgtctcatggaactccggagccctaacctcaggcgttcacaccttcccagccgtcctccaaagctccggactctactcactatcatccgtagtaacagtcccatcttcctccttaggaacaaaaacatacacatgcaacgtcgaccataaaccctcaaacaccaaagtcgacaaacgcgtcgaatccaaatacggaccaccctgcccaccctgcccagcccccgaatttgaaggcggtccctccgtcttcctgttcccacccaaacccaaagataccctcatgataagccgcacccccgaagtaacctgcgtcgtcgtagacgtctcccaagaagatcccgaagtccaattcaactggtacgtagacggcgtcgaagtccacaacgctaaaaccaaaccccgcgaagaacaattcaactcaacctaccgcgtagtctccgtactcaccgtcctccaccaagactggctaaacggcaaggaatacaaatgcaaagtctcaaacaagggcctaccatcctccatcgaaaagacaatatctaaagccaaaggacaaccacgtgaaccccaagtatacacccttcccccatcgcaagaagaaatgaccaaaaaccaagtatccctaacctgcctcgtcaaaggattctacccctccgacatcgcagtagaatgggaatccaacggacaacccgaaaacaactacaaaactacacccccagtactcgactccgacggttctttcttcctctactcccgactaactgtcgacaaatcccgatggcaagaaggtaacgtattctcctgctccgtcatgcacgaagccctacacaaccattacactcaaaaatcactttcactttcactcggcaaa

SEQ ID NO: 53600 - RNA, 639 nt, synthetic construct
  misc_feature 1..639: note = derived and/or modified sequence opt11 from Bleselumab_LightChain1
  source 1..639: mol_type = other RNA
gccatccaactcacccaatccccctcctccctatccgcctccgtcggcgaccgcgtcaccatcacctgccgcgcctcccaaggcatctcatccgccctagcctggtaccaacaaaaacccggcaaagcccccaaactactaatctacgacgcctccaacctcgaatccggcgtcccctcccgcttctccggctccggctccggcaccgacttcacactcaccatctcctccctccaacccgaagacttcgcaacctactactgccaacaattcaactcataccccacattcggccaaggcaccaaagtcgaaatcaaacgcaccgtcgcagccccctccgtcttcatcttccccccctccgacgaacaactaaaatccggcaccgcctccgtcgtatgcctcctaaacaacttctacccccgcgaagccaaagtccaatggaaagtcgacaacgccctacaatccggaaactcccaagaatccgtcaccgaacaagactcaaaagactcaacctactccctatccagcaccctaacactctccaaagccgactacgaaaagcacaaagtctacgcatgcgaagtcacccaccaaggcctctcctcacccgtcaccaaatccttcaacagaggcgaatgc

SEQ ID NO: 53601 - RNA, 1512 nt, synthetic construct
  misc_feature 1..1512: note = derived and/or modified sequence opt11 from Blinatumomab_HeavyChain1
  source 1..1512: mol_type = other RNA
gacatccaactcacacaatcacccgcaagcctagccgtaagcctaggccaacgcgcaaccatcagctgcaaagccagccagagcgtcgactacgacggagactcctacctcaactggtaccaacaaatacccggacaacccccaaaactcctaatatacgacgcctccaacctcgtcagcggcataccaccacgattctcaggctcgggatccggaacagacttcaccttgaacatacaccccgtcgaaaaagtcgacgccgcgacataccactgccagcaatcaacagaagacccatggaccttcggcggcggaaccaaactcgaaatcaagggaggcggaggaagtggcggtggcggcagcggaggcggaggaagccaggtccaactccagcaatcaggcgcagagctagtccggcccggaagctccgtcaagatctcctgcaaggcttccggatacgccttcagctcatactggatgaactgggtaaaacagagaccaggacaaggactcgaatggatcggacaaatatggcccggagacggagacacgaactacaacggcaaattcaaaggcaaagccactctcacagccgacgaatcgagctcgaccgcgtacatgcaactaagctcactagcgtccgaagactcagcagtatacttctgcgctcgccgagaaaccaccacagtaggaagatactactacgccatggactactggggccagggaacaacggtcacggtctcgagcggcggcggcggctcggacatcaaactacaacaatccggggcagaactcgccagaccaggcgcctcagtaaaaatgagttgtaaaacgagcggatacaccttcacacgctacaccatgcactgggtcaaacaaagacccggccaaggcctcgagtggataggatacattaaccccagccgaggatacacaaactataaccaaaaattcaaagacaaagcgaccctcacaacagacaaaagctcaagcacagcctacatgcaactaagcagcctaacatcagaagacagcgcagtatactactgcgcccgctactacgacgaccactactgcctcgactactggggacaagggaccaccctaacggtttctagcgtggaaggaggctcaggcggcagcggcggctcaggagggagcggcggcgtcgacgacattcaactaacccaatcacccgccataatgagcgcaagccccggagaaaaagtcaccatgacctgccgagcaagttcaagcgtaagctacatgaattggtaccagcaaaaatccggcacatccccaaaaagatggatctacgacacctcaaaagtagcgtcaggcgtcccctaccgattcagcgggtccggaagtggaacctcctactccctcaccatctccagcatggaagcagaagacgccgccacttactactgccaacaatggtcatccaacccactaacattcggagcaggcacgaagctagaattaaaacatcaccaccaccaccac

SEQ ID NO: 53602 - RNA, 1512 nt, synthetic construct
  misc_feature 1..1512: note = derived and/or modified sequence opt11 from Blinatumomab_SingleChain
  source 1..1512: mol_type = other RNA
gacatccaactcacccaatcacccgcgtccctagccgttagcctaggccaacgcgccaccataagctgcaaagccagccaaagcgtcgactacgacggcgactcatacttaaactggtaccaacaaatacccggacaaccacccaaactcctgatctacgacgcatcaaatctcgtaagcggaatcccgccccggttctccggatcaggctccggcacggacttcacactaaacatacacccagtcgaaaaggtcgacgccgcgacctaccactgccaacaatccactgaagacccatggacgttcgggggaggaacgaagctcgaaatcaaaggaggaggcggaagcggaggaggcggcagcggaggaggcggaagccaagtacaactccagcaatcgggagcagagctagtccgaccaggcagctcagtcaaaatatcatgcaaagcatcaggctacgcattctcctcatactggatgaactgggtcaaacaaagaccaggccaaggactcgaatggatcggacaaatctggcccggcgacggcgacacaaactacaacggcaagttcaagggcaaagcaaccctcacagcagacgaaagcagctccaccgcatacatgcaactaagctcactagcaagcgaagattcagcagtatacttctgtgcacggcgagaaacgaccaccgtaggccgatactactacgccatggactactggggccaaggcacaacagttacggtaagctcaggaggcggaggcagcgacatcaaactacaacaatcaggagcagaactcgctcgccccggcgcctccgtcaaaatgagctgtaaaaccagcggatacacattcacccgatacaccatgcactgggtaaaacaaaggcccggacaagggctcgaatggataggctacatcaaccccagccgcggatacacaaactacaaccaaaaattcaaagacaaagccacactaacaacggacaaaagctcctcaacagcctacatgcaactcagcagcctaacatcagaagactcagcagtatactactgcgcccgatactacgacgaccactactgcctcgactactgggggcaaggaacaacactcacagtatccagcgtggaaggcggatcaggcggatccggaggctcaggagggagcggaggcgtggatgacatccaactcacccaatcccctgccatcatgagcgccagccccggagaaaaagtaaccatgacctgccgcgcaagctcaagcgtaagctatatgaactggtaccagcagaagtcaggcacaagcccaaaaagatggatatacgacaccagcaaagtagccagcggcgtaccctaccgattcagcggaagcgggagcggaacctcctactccctcacgatatcaagtatggaagccgaagacgccgccacctactactgccaacaatggtcaagcaaccccctaaccttcggcgccggcacgaaactcgaactcaaacaccaccaccaccaccac

SEQ ID NO: 53603 - RNA, 1512 nt, synthetic construct
  misc_feature 1..1512: note = derived and/or modified sequence opt11 from Blinatumumab_SingleChain_variable_fragment_fusion_protein_( bite)
  source 1..1512: mol_type = other RNA
gacatccagctaacccaatcaccagcaagcctggccgtgagcctgggacagcgagcaaccataagctgcaaagcaagccagagcgtggactatgacggcgactcatacttgaactggtaccaacagatccccggacaaccgcccaagctcctaatatatgacgcaagtaacctcgtaagtgggatcccacccagattctctggctccggctcgggcacggacttcaccctaaacatacaccccgtcgaaaaagtagacgccgcaacataccactgccaacaatcaaccgaggacccatggacattcggaggcgggaccaagctcgaaatcaaaggcgggggcgggtctgggggcggcggatcgggagggggaggctcccaagttcagctccaacaatcaggcgccgaactggtccgacccgggagctcagtcaaaatatcctgcaaagcatcaggctacgcctttagctcatactggatgaactgggtaaaacaacgcccaggccaaggcctcgaatggataggacaaatatggccaggcgacggcgacacaaactacaacggcaaattcaaaggcaaggcaacactcacggccgacgaatcgtcctcaaccgcttacatgcaactaagctccctcgcatcagaagactcggccgtatacttctgcgcgcgaagagaaacaaccacagtaggacgatactactatgccatggactattggggccaaggaaccacagtcaccgtatcaagcgggggcgggggctcggacatcaaactacaacaaagcggggccgaactcgcccgcccgggagcgagcgtcaaaatgagttgtaaaacaagcggatacacattcacgcgctacaccatgcactgggtaaaacaaaggccagggcaagggctagagtggatcggctatataaatccctcacgcggatacacaaactacaaccaaaaatttaaagataaagcaaccctcaccacggacaagagttcaagcacagcctacatgcaactgtcgagcctaacctcggaagacagcgcggtctattactgcgccaggtactacgacgaccactactgtctagactactgggggcaagggaccacgctaacagtctccagcgtagaaggaggttcgggagggagcgggggctctggcgggagcgggggtgtagacgacatccaactcacacaatcgcccgcaatcatgagcgctagcccaggcgaaaaagtcaccatgacctgccgagcgagcagcagcgtatcctacatgaactggtaccaacaaaaatccggcacgagtccgaaacgatggatatacgacacctcgaaagtggcctcaggcgtaccctacagatttagcggaagcgggagtggaacctcatactccctcacgatctcaagcatggaagccgaagacgccgcaacctactactgccaacaatggtcaagcaaccccctcacttttggtgcaggaacgaaactagagctgaaacaccaccaccaccaccac

SEQ ID NO: 53604 - RNA, 1344 nt, synthetic construct
  misc_feature 1..1344: note = derived and/or modified sequence opt11 from Blontuvetmab_HeavyChain
  source 1..1344: mol_type = other RNA
caagtccaactccagcaatcccgcgccgaactcgtcagacccggcgcctccgtcaccctctcatgcaaaccatccggctacaccttcaccgactacgaagtacactgggtcaaacaaacccccgtacacggcctcgaatggatcggcgctatagaccccgaaactggcgggaccgccgataaccaaaaattcaaaggaaaagccatactcaccgccgacaaatctagcagcacagcctacatggaactgcgatcactcacctccgaagactccgccgtctactattgcactaacttcgtagacgtatggggtaccggcaccaccgtcaccgtgtcatctgcctccaccaccgccccctccgtcttccccctcgcaccatcttgcggatcccaatcaggctcaaccgtcgcgctcgcctgcctcgtatccggctacttccctgaacccgtaaccgtctcatggaactccggctcactcacctccggagtccacaccttcccttcagtactacaatcatccggcctctactccctctcttctatggtcaccgtccccagctcacgctggccatccgaaaccttcacatgcaacgtagcccacccagcatcaaaaaccaaagtcgacaaacctgtccccaaaagagaaaacggtcgcgtcccccgacccccagactgccccaaatgccccgcaccagaaatgctcggaggaccttccgtcttcatattccctcctaaaccaaaagacaccctactcatagcacgcactcccgaagttacctgcgtcgtcgtcgacctcgatcccgaagacccagaagtccaaatctcatggttcgtcgacggcaaacaaatgcaaaccgccaaaacccaaccccgcgaagaacaattcaacggcacttaccgagtcgtctctgtcctccccataggccaccaagactggttaaaaggcaaacaattcacctgtaaggtcaataacaaagcactaccctcgcccatcgaacgcactatatcaaaagcccgcggccaagcccaccaaccatctgtctacgtactaccaccctcccgagaagaactatccaaaaacaccgtctcactaacctgcctcatcaaagacttcttcccacccgatatcgacgtcgaatggcaatcaaatggccaacaagaacccgagtccaaatacagaaccacaccccctcaactcgacgaagacggttcatacttcctctactcaaaactctccgtcgacaagtcccgatggcaacgcggagacaccttcatatgcgctgtcatgcacgaagccctccacaaccactacacccaaaaatcactctcacactcccccggaaaa

SEQ ID NO: 53605 - RNA, 657 nt, synthetic construct
  misc_feature 1..657: note = derived and/or modified sequence opt11 from Blontuvetmab_LightChain
  source 1..657: mol_type = other RNA
gacgtcgtcatgtcacaatccccctcctcactcgccgtctccgtcggcgaaaaagtcaccatgtcctgcaaatcctcccaatccctcctatactctggcaaccaaaaaaactacctcgcctggtaccaacaaaaacccggccaatctccccgactcctcatttactgggcctccacccgcgaatccggcgtcccagaccgcttcaccggctccggatcaggcaccgacttcaccctcaccatctcatctgtcaaagccgaagacctagccgtcttctactgccaacaatactacaactacccactcaccttcggaggcggcacccacctaacagtcctcggccaacccaaggcctcaccctccgtcaccctcttccccccctcctccgaagaactcggcgcaaacaaagcaacccttgtttgcctcatctccgacttctacccctcaggcgtcaccgtcgcctggaaagccgacggctcccccatcacccaaggagtcgaaacaaccaaaccctcaaaacaatctaacaacaaatacgccgcctcttcctacctatccctaacccccgacaaatggaaatcccactcctccttctcctgcctagtcacccacgaaggctccaccgtcgaaaaaaaagtcgccccagccgaatgctcc

SEQ ID NO: 53606 - RNA, 1332 nt, synthetic construct
  misc_feature 1..1332: note = derived and/or modified sequence opt11 from Blosozumab_HeavyChain1
  source 1..1332: mol_type = other RNA
caagtacaactcgtccaatccggggccgaagtcaagaaacccggcgcatccgtaaaagtcagctgcaaagtcagcggcttccccatcaaagacacattccaacattgggtccgacaagcccccggcaaaggcctcgaatggatgggctggtcagaccccgaaatcggagacaccgaatacgcatccaaattccaaggccgagtcaccatgaccgaagacacctccaccgacaccgcctacatggaactatcaagcctgcgttccgaagacacagccgtctactactgcgccaccggcgacaccacttacaaattcgacttctggggccaaggcacaaccgtaactgtctcctccgcatcaaccaaaggcccctccgttttccccctcgccccatgctcccgctccacctccgaatcaacagccgcactcggatgcctggttaaagactactttccagaacccgtcaccgtatcctggaactccggcgcccttacctctggcgtacacacattccccgccgtcctacaatcctccggcctctactctctctcatccgtcgtcacagtaccctcctcttcactaggcacaaaaacatacacatgcaacgtcgaccacaagccctccaacactaaagtcgacaaacgcgtcgaatccaaatacggcccaccctgcccaccatgcccagccccggagttcctcggcggcccatcggtcttcctcttccctcccaagcccaaagacacactcatgatctcacgcacccccgaagtcacatgcgtagtcgtcgacgtatcccaggaagatcctgaagtccaattcaactggtacgtcgacggcgtcgaagtacacaacgcaaaaaccaaaccacgagaagaacaattcaactcaacctatcgagtcgtctccgtcctaaccgtcctccaccaagactggctcaacggcaaagaatacaagtgtaaagtcagtaacaagggactaccctcctccatcgaaaagaccatatccaaagccaagggccaaccccgcgaaccccaagtctacaccctacccccatcacaagaagaaatgaccaaaaaccaagtctcactcacatgcctcgtcaaaggcttctacccctccgacatcgccgtagaatgggaaagcaatggacaacccgaaaacaactacaaaaccactcccccagtactcgactccgacggcagcttcttcctctactcaagactcaccgtcgacaaatcccgctggcaggaaggcaacgtcttcagctgctccgtcatgcacgaagccttacacaaccactacacccaaaaatccctttccctatcactagga

SEQ ID NO: 53607 - RNA, 642 nt, synthetic construct
  misc_feature 1..642: note = derived and/or modified sequence opt11 from Blosozumab_LightChain1
  source 1..642: mol_type = other RNA
gacatccagatgactcaaagcccatcctccctctccgcctccgtcggcgaccgcgtaaccatcacttgcaaagctagccaagacgtccacaccgccgtcgcctggtaccaacaaaaacccggaaaagcacccaaactcctcatctactgggcctcaacccgctggaccggcgtaccatcccgcttctccggctccggctcaggcaccgacttcaccctcaccatctcctccctacaacccgaagacttcgccacctactactgccaacaatactccgactacccctggaccttcggcggaggaaccaaagtcgaaatcaaacgcaccgtcgccgccccctcagtcttcatcttcccaccctccgacgaacaactcaaatccggaacagcctccgtcgtctgcctactcaacaacttctacccccgcgaagccaaagtccaatggaaagtcgacaacgccctccaatccggcaactcacaagaatccgtcaccgaacaagactccaaagactccacctactccctctcatccaccctcaccctatccaaagccgactacgaaaaacacaaagtctacgcctgcgaagtcacccaccaaggcctctcctcccccgtcaccaaatccttcaaccgcggcgaatgc

SEQ ID NO: 53608 - RNA, 1332 nt, synthetic construct
  misc_feature 1..1332: note = derived and/or modified sequence opt11 from Bococizumab_HeavyChain1
  source 1..1332: mol_type = other RNA
caagtccaactcgtccaatcaggagccgaagtcaagaaacccggcgcctccgtcaaagtctcctgcaaagcatccggctacaccttcacctcctactacatgcattgggtcagacaagcccccggccaaggcctcgaatggatgggcgaaatctccccattcggcggtcgcaccaactacaacgaaaaattcaaatcccgcgtgaccatgacccgagacacaagcacctccactgtatacatggaactctcctcactccgctcagaagacaccgccgtctactactgcgcccgagaacgcccactctacgcatccgatctctggggccaaggcaccacagttaccgtctcctccgcatccacaaaaggccctagcgtcttccccctcgcaccctgctcacgttccacatcagaaagcaccgccgcgctaggctgcctcgtcaaagactacttccccgaaccagttacagtctcatggaactcaggcgccctcacatcgggcgtacacaccttcccagccgtcctacaatcatccggcctctacagcctatccagcgtcgtaaccgtcccctcctccaacttcggcacccaaacctacacgtgcaacgtcgaccacaaaccctccaacacaaaagtcgacaaaacagtcgaacgaaaatgttgcgtcgaatgcccaccctgccccgcaccacccgtcgccggaccctctgtattcctcttcccacccaaacccaaagacaccctcatgatctcccgaacccccgaagtaacctgtgtcgtagtcgacgtctcccacgaagaccccgaagtacaattcaactggtacgtggacggcgttgaagtccacaacgccaaaacaaaaccccgcgaagaacaattcaactcaaccttcagagtcgtctcagtcctcaccgtcgtacaccaagactggctcaacggcaaagaatacaaatgcaaagtatccaacaaaggcctcccctcatccatcgagaaaaccatatccaaaaccaaaggccaaccccgagaaccccaagtctacacactcccacccagtcgcgaagaaatgaccaaaaaccaagtatcactgacatgcctcgtcaaaggcttctacccctccgacatagctgtagaatgggaatccaacggccaacccgaaaacaactacaaaaccaccccacccatgctcgactccgacggctcattcttcctatacagcaaactaaccgtagacaaatcccgttggcaacaaggtaacgtattctcgtgctcagtcatgcacgaagcactccacaatcactacacacaaaaatcactttcactctcacccggaaaa

SEQ ID NO: 53609 - RNA, 642 nt, synthetic construct
  misc_feature 1..642: note = derived and/or modified sequence opt11 from Bococizumab_LightChain1
  source 1..642: mol_type = other RNA
gacatccaaatgactcaatccccctcctccctatccgcttccgtcggcgaccgcgtcaccatcacatgccgcgcttcccaaggcatctcatcggccctcgcctggtaccaacaaaaacccggcaaagcccccaaactcctcatctactccgcctcctaccgctacaccggagtcccctcccgattctccggctccggctcaggcaccgacttcaccttcaccatctcttcactccaacccgaagacatcgccacctactactgccaacaaagatactccctctggcgaaccttcggacaaggaaccaaactcgaaatcaaacgcacagtcgccgccccctccgtcttcatcttcccaccctccgacgaacaactcaaatccggcaccgcctccgtcgtctgcctcctcaacaacttctacccccgagaagccaaagtccaatggaaagtcgacaacgccctccaatccggcaactcccaagaatccgtcaccgaacaagactccaaagactccacctactccctctcctcaaccctcaccctctccaaagccgactacgaaaaacacaaagtctacgcctgcgaagtcacacaccaaggcctatcctcccccgtaaccaaatcattcaaccgaggcgaatgc

SEQ ID NO: 53610 - RNA, 1338 nt, synthetic construct
  misc_feature 1..1338: note = derived and/or modified sequence opt11 from Brentuximab_vedotin_HeavyChain1
  source 1..1338: mol_type = other RNA
caaattcaactccagcaatcaggcccagaagtggtcaagcccggagccagcgtcaaaatctcctgcaaagccagcggctacaccttcaccgattactacatcacatgggtcaaacaaaaacccggccaaggcctcgaatggatcggctggatctaccccggctccggcaacactaaatacaacgaaaaattcaaaggcaaagcaaccctaaccgtagacacctcctcatccacagcattcatgcaactgtcatccctcacctcagaagataccgctgtctacttctgcgcaaactacggcaactactggttcgcatactggggccagggcacacaagtcacagtatcagcagcatcaacaaaaggcccctccgtattcccactagccccctcgagcaaatccacgtctggcggaacagcagccctcggctgcctcgtcaaagactacttcccagaacctgtcaccgtctcgtggaactccggagcgctcacctcaggcgtacacacattccccgctgtcctccaatcctccggcctgtactcactctcatccgtcgttaccgtacccagctcctcactcggaacccaaacctacatctgcaacgtcaaccacaaaccctccaacacaaaagtcgacaagaaagtcgaacccaaatcctgcgacaaaacacacacatgccctccctgccccgcccccgaacttctaggcggtccctcagtattcctctttccccctaaacccaaagacacactcatgattagccgaaccccagaagtaacctgcgtcgtcgtagacgtctcgcacgaggaccccgaagtaaaattcaactggtacgtcgacggagtcgaagtccacaacgcaaaaaccaaaccacgagaagaacaatacaactccacctacagagtcgtcagcgtcctcacagtcctacaccaagactggcttaacggaaaagaatacaaatgtaaagtctcaaacaaagccctccctgccccaatcgagaaaaccatctccaaagcaaaaggccaaccgcgagaaccccaggtctacacactcccaccctcccgtgacgaactaaccaaaaaccaagtctcactaacctgcctcgtcaaaggcttctacccctccgacatagcagtagaatgggaatccaacggtcaacccgaaaacaactacaaaaccacaccacccgtcctcgactccgacggatccttcttcctctactccaaactcaccgtcgacaaatcacgctggcaacaaggcaacgtattttcctgctcggtcatgcacgaagccctccacaaccactacacccaaaaatccctctccctctcccccggc

SEQ ID NO: 53611 - RNA, 654 nt, synthetic construct
  misc_feature 1..654: note = derived and/or modified sequence opt11 from Brentuximab_vedotin_LightChain1
  source 1..654: mol_type = other RNA
gacatcgtcctcactcaatcccccgcttccctcgccgtatccctcggccaacgagcgaccatctcctgcaaagcctcccaatccgtcgacttcgacggcgactcctacatgaactggtaccaacaaaaacccggccaaccccccaaagtcctaatctacgccgcctccaacctcgaatccggaatccccgcccgattctccggctccggctccggcacagacttcaccctcaacatccaccccgtcgaagaagaagacgccgccacctactactgccaacaatcaaacgaagacccctggacattcggaggcggcaccaaactcgaaatcaaacgcaccgtcgccgccccctccgtcttcatcttccctccctccgacgaacaactcaaatcaggcaccgcctccgtcgtctgcctactcaacaacttctacccccgcgaagccaaagtccaatggaaagtagacaacgccctccaatccggcaactcacaagaatccgtcaccgaacaagactccaaagactccacctactccctctcctcaaccctcaccctctccaaagccgactacgaaaaacacaaagtctacgcctgcgaagtcacccaccaaggcctttcctcacccgtcaccaaatccttcaaccgcggcgaatgc

SEQ ID NO: 53612 - RNA, 1335 nt, synthetic construct
  misc_feature 1..1335: note = derived and/or modified sequence opt11 from Briakinumab_HeavyChain1
  source 1..1335: mol_type = other RNA
caagttcaactcgtagagtccggcggcggagttgtccaacccggccgatcgctccgcctctcctgcgccgcctccggctttaccttctccagctacggcatgcactgggtccgacaagcccccggcaaaggcctcgaatgggtcgcctttatacgatacgacggctccaacaaatactacgccgactcagtcaaaggccgattcaccatctcccgcgacaactccaaaaacaccctatacctacaaatgaactcactccgagcagaagacaccgcagtctactactgcaagacccacggctcccacgacaactggggccaaggcaccatggtaaccgtctctagcgcatccaccaaaggcccctccgtattccccctagccccctccagcaaatccacctccggcggcacagcagcactcggctgcctcgtaaaagactacttccccgaaccggtcactgtctcgtggaactccggcgccctcacctccggcgtccacacgttccccgcagtcctccaatccagtggactctactctctcagctccgtcgtaaccgtcccctcctcatccctcggaactcaaacctacatctgcaacgtcaaccacaaaccatccaacaccaaagtcgacaagaaagtcgaacccaaatcatgcgacaaaacccacacctgtccaccctgccccgcccccgaactactaggcggcccctcagtcttcctattcccacccaaacccaaagacaccctcatgatctcccgcacacccgaagtaacttgcgtcgtcgtcgatgtatcccacgaagaccccgaagtcaaattcaactggtacgtagacggcgtcgaagtccacaacgccaaaaccaagccccgcgaagaacaatataactccacctaccgcgtcgtctccgtcctcactgtcctacaccaagactggctcaacggaaaagaatacaaatgcaaagtatccaacaaagctctccccgccccaatcgaaaagaccatcagcaaagcaaaaggccagccccgagaaccccaggtctacaccctcccacccagccgtgaagaaatgaccaaaaaccaagtatccctaacatgcctagtcaaaggcttctacccctccgacatcgccgtcgaatgggaatccaacggccaacccgaaaacaactacaaaacgaccccacccgtccttgactcagacggatccttcttcctatactccaaactcaccgtcgacaaatcccgatggcaacaaggcaacgtcttctcttgctccgtcatgcacgaagccctccacaaccattacacccaaaagtcactatccctatcacccggtaaa

SEQ ID NO: 53613 - RNA, 651 nt, synthetic construct
  misc_feature 1..651: note = derived and/or modified sequence opt11 from Briakinumab_LightChain1
  source 1..651: mol_type = other RNA
caatccgtcctaacccaacccccatccgtcagcggagcccccggccaacgcgtaaccatctcctgctccggctcccgctcaaacatcggctccaacaccgtcaaatggtaccaacaactccccggaaccgcccccaaactcctcatctactacaacgaccaacgcccctccggcgtcccagaccgcttctccggatccaaatccggcacctccgcatccctcgccatcaccggcctacaagccgaagacgaagcagactactactgccaatcctacgaccgctacacacaccctgccctcctattcggcaccggcaccaaagtcacagtcctcggccagcccaaagccgccccctccgtcacactcttccccccatcctccgaagaactacaagccaacaaagccaccctagtctgcctcatctccgacttctaccccggcgccgtcaccgtcgcctggaaagccgactcctcccccgtcaaagccggcgtcgaaacaaccaccccctccaaacaatccaacaacaaatacgccgcatcatcctacctctccctaacaccagaacaatggaaatcccaccgatcttactcctgccaagtcacccacgaaggatccacagtcgaaaaaaccgtcgcccccaccgaatgctcc

SEQ ID NO: 53614 - RNA, 1326 nt, synthetic construct
  misc_feature 1..1326: note = derived and/or modified sequence opt11 from Brodalumab_HeavyChain1
  source 1..1326: mol_type = other RNA
caagtccaactcgtacaatcaggagcagaagtcaagaaacccggcgcctccgtcaaagtctcatgtaaagcctcgggctacaccttcacccgctacggcatctcatgggtccgccaagcccccggccaaggcctcgaatggatgggctggatcagcacctactcaggtaacactaattacgcacaaaaactacaaggaagagtcaccatgacaaccgacacatcaacctcaaccgcctacatggaactccggtccctccgttcggacgacaccgcagtatactattgcgcccgtcgccaactctacttcgactactggggccagggaacactcgtaaccgtctccagcgccagcaccaaaggaccatcagtcttccccctcgccccatgctcccgatccacatcagaatccaccgcagccctcggctgcctcgtcaaagactacttccccgagcccgttaccgtatcatggaactccggcgccctaacctccggcgtccacacatttccagccgtcctgcaatcctccggcctctattccctgtcctcagtagtcaccgtcccctcaagcaacttcggcacccaaacctatacctgcaacgtcgaccacaaaccctccaataccaaagtcgacaaaaccgtcgaacgcaaatgctgcgtagaatgcccaccctgccccgccccacccgtcgctggcccctccgtatttctctttcccccaaaacccaaagacacgctcatgatatcccgcacacccgaagttacctgcgtcgtcgtcgacgtatcccacgaagaccctgaagtccaattcaattggtacgtcgacggcgttgaagtacacaacgccaaaaccaaaccccgcgaggaacaattcaactcaaccttccgcgtcgtatccgtcctcaccgtcgttcaccaagactggctcaacggtaaagaatacaaatgcaaagtctccaacaaaggcctaccagcacccatcgagaaaaccatatccaaaacaaaaggacaaccccgagaaccccaagtatacacactaccaccctcacgagaagaaatgaccaaaaaccaggtttccctaacttgcctcgtaaaaggcttctacccctccgatatcgccgtcgaatgggaatccaacggccaaccagaaaacaactacaaaaccaccccacccatgctcgactccgacggcagcttcttcctatactctaaactcaccgtcgacaaaagcagatggcaacaaggaaacgtcttctcatgctccgtcatgcacgaagccctccacaaccactacacacaaaaatcactatccctatcacccggaaaa

SEQ ID NO: 53615 - RNA, 642 nt, synthetic construct
  misc_feature 1..642: note = derived and/or modified sequence opt11 from Brodalumab_LightChain1
  source 1..642: mol_type = other RNA
gaaatagtcatgacccaatcccccgccaccctttccgtatccccaggcgaacgcgccaccctatcctgccgcgcctcccaaagcgtcagctccaacctcgcctggttccaacaaaaacccggacaagcaccccgaccactaatctacgacgcctccacccgcgccaccggcgtccccgccagattctccggctccggctccggaaccgacttcaccctcaccatctcctccctccaatcagaagacttcgccgtctactactgccaacaatacgacaactggcccctcaccttcggcggcggaaccaaagtagaaatcaaacgcaccgtcgccgccccctccgtctttatcttcccaccctccgacgaacaactcaaatcaggcaccgcctcagtcgtctgcctactcaacaacttctacccccgcgaagccaaagtccaatggaaagtcgacaacgccctccaatccggtaactcacaagaatccgtcaccgaacaagactccaaagactccacctactccctctcctccaccctcaccctctccaaagccgactacgaaaaacacaaagtctacgcatgcgaagtaacccaccaaggcctcagctcccccgtcacaaagagcttcaaccgcggcgaatgc

SEQ ID NO: 53616 - RNA, 756 nt, synthetic construct
  misc_feature 1..756: note = derived and/or modified sequence opt11 from Brolucizumab_HeavyChain1
  source 1..756: mol_type = other RNA
atggagatagtgatgacgcaatcgccatcaaccttgagcgcaagcgtgggcgatcgagtgatcataacctgtcaagcgagcgagatcatacactcgtggctggcatggtaccagcaaaagcccgggaaagcgcccaagctattgatatatctagcgagtacgcttgcgagcggggtcccgagcaggttctcgggctcgggctcgggagcggaatttaccttgaccataagctcgctccagcccgatgacttcgcaacgtactattgccagaacgtgtacttggcctcaaccaatggcgcaaactttggccagggcacgaaattgaccgtactagggggaggaggcgggagcggaggcgggggctcgggcgggggtgggagcgggggcgggggatcggaagtgcaattggtcgagagcgggggcgggctcgtgcaaccgggcggaagcctacgcttgagctgtaccgcgagtgggttctcactcacggactattactatatgacgtgggtgcgccaggcaccgggcaagggcttggaatgggtcgggttcatagacccggacgatgacccgtactatgccacgtgggcgaaagggcgatttaccataagcagggacaatagcaagaacacgctctacctccagatgaacagcttaagagcggaagataccgcggtctattactgtgccgggggcgatcacaatagcgggtgggggctcgatatctggggccagggcacattggtgaccgtgagctca

SEQ ID NO: 53617 - RNA, 756 nt, synthetic construct
  misc_feature 1..756: note = derived and/or modified sequence opt11 from Brolucizumab_scFv_fragment
  source 1..756: mol_type = other RNA
atggagatcgtgatgacgcaatcgccctcgacattgagcgcaagcgtaggcgatcgagtgataataacctgtcaagcgagcgagatcatacactcatggttggcatggtaccagcaaaaacccggaaaagcgcccaagctcctgatatacctagcgagcacgctagcaagcggggtcccgagcaggttctcgggatcgggctcaggcgcggaatttaccttgaccataagctcgctccagccagatgactttgcaacatactactgccagaacgtgtacctggcctcgaccaacggcgcaaacttcggccagggcacgaaactgactgtgctcgggggcgggggcgggagcgggggcggaggctcgggcgggggcgggagcggaggcgggggctcggaagtgcaattggtcgagagcggaggcgggctcgtgcaaccgggcgggagcctgcgattgagctgcaccgcgagcgggttctcactcacggactattactatatgacatgggtgcgccaggccccgggcaagggcttagaatgggtcggattcatagacccggacgatgacccatactatgccacatgggcgaaagggcgatttacaattagtagggacaatagcaaaaacacgctatacctacagatgaacagcctgcgcgcagaagataccgcggtatattactgtgccgggggcgatcacaatagcggatgggggctagatatctggggccagggcacactcgtgaccgtgagctca

SEQ ID NO: 53618 - RNA, 1341 nt, synthetic construct
  misc_feature 1..1341: note = derived and/or modified sequence opt11 from Brontictuzumab_HeavyChain1
  source 1..1341: mol_type = other RNA
caagtccagctagtccaaagcggagccgaagtcaagaaacccggcgccagcgtaaaaatctcatgcaaagtctccggctacaccctacgcggatactggatagaatgggtccgccaagcccccggcaaaggcctcgaatggatcggacaaatccttcccggaacgggccgcacaaactacaacgaaaaattcaaaggccgcgtcaccatgaccgcagacacctccacagacaccgcctacatggaactctcatcactacgcagcgaagacacagccgtctactactgtgcacgcttcgacggcaactacggatactacgccatggactactggggacaaggaaccaccgtcacggtctcctccgctagcaccaaaggcccctcagtattccccctcgccccctgctcacgctcgacctcggaatccaccgcagccctaggctgtctagtcaaagactacttcccagaacccgtcaccgtaagctggaacagcggcgcattaacatcaggcgtccataccttccccgcggtactacaatccagcggactctacagcctctcaagtgtcgtcaccgtacccagcagcaatttcggcacccaaacctatacctgcaacgtagaccacaaaccatcaaacacaaaagtagacaaaaccgtagaacgcaaatgctgcgtcgaatgcccaccctgccccgcacctcccgtcgcaggcccctccgtcttcctcttcccacccaaacccaaagacaccctcatgatctcccgcacccccgaagtcacatgcgtcgtcgtggacgtatcccatgaagaccccgaagtccaattcaactggtacgtagacggcgtcgaagtccacaatgccaaaaccaaaccccgagaagaacaattcaactccacattccgagtcgtctccgtcctcacagtcgtccatcaagactggctcaacggcaaagaatacaagtgcaaagtctccaacaaaggcctccccgcccccatagagaaaaccatctccaagaccaaaggccaaccacgcgaaccacaagtttacacccttccaccctcccgagaagaaatgaccaaaaaccaagtttcactaacctgcctagtaaaaggtttctacccctccgacatagcagtcgaatgggaatccaatggacaacccgaaaacaactacaaaaccaccccgcccatgcttgactccgacggcagtttcttcctttacagcaaacttaccgtagacaagtccagatggcaacaaggcaacgtcttctcatgctccgtcatgcacgaagccctacacaaccactacacacaaaagtctctctccctcagccccggaaag

SEQ ID NO: 53619 - RNA, 645 nt, synthetic construct
  misc_feature 1..645: note = derived and/or modified sequence opt11 from Brontictuzumab_LightChain1
  source 1..645: mol_type = other RNA
caagcagtcgtcacccaagaaccctccctcaccgtctcccccggcggcaccgtaaccctcacctgccgctcatccaccggcgccgtcaccacctccaactacgccaactggttccaacaaaaacccggccaagccccccgcaccctaatcggcggtacaaacaaccgagcccccggcgtcccagcccgattctccggctccctcctcggcggcaaagcagccctcaccctatccggcgcacaaccagaagacgaagccgaatactactgcgccctctggtactccaaccactgggtcttcggcggcggcaccaaacttacagtcctcggccaacccaaagccgccccatccgtcacactcttccccccctcctcagaagaactccaagccaacaaagccaccctcgtctgccttgtctccgacttctaccccggcgccgtcaccgtcgcctggaaagccgacggctcccccgtcaaagtcggcgtagaaaccaccaaaccctccaaacaatccaacaataaatacgccgcctcctcctacctctccctcacccccgaacaatggaaatcccaccgctcctactcctgcagagtcacccacgaaggctccaccgtcgaaaaaaccgtcgcccccgccgaatgctcc

SEQ ID NO: 53620 - RNA, 1332 nt, synthetic construct
  misc_feature 1..1332: note = derived and/or modified sequence opt11 from BTT-1023_HeavyChain1
  source 1..1332: mol_type = other RNA
caagtccaactcgtagaatcaggcggcggcgtcgtccaacccgggcgatccctccgcctctcctgcgccgcttcaggattcaccttcttctcctacgcaatgcactgggtccgccaaacacccggcaaaggcctcgaatgggtagcagtaatatggttcgacggctccaacgaaaactacgtggactcagtcaaaggccgcttcaccatatcacgagacaactccaaaaacaccctatacctccaaatgaataccctccgagcagaagacacagccgtctactactgcgcccgcgacgcctggtcctacttcgactactggggacaaggaaccctagtcacagtatccagcgcctcaactaaaggaccctcagtatttcccctcgccccctgctcacgctccacatccgaatccaccgcagccctcggctgccttgtcaaagactacttccccgaaccggtcacagtctcctggaactccggcgcacttacctctggcgtacacacgttcccagcagtactacaatcctcaggcctctactcactatcctccgtcgtcaccgtacccagcagctcactcggaacaaaaacatacacatgcaacgtagaccacaaaccctccaacacaaaagtcgacaaacgagttgaatccaaatacggccctccctgcccaccctgccccgcccccgagttcgccggtggaccctcggtattcctattcccacccaaacccaaagacacgctcatgataagccgcacccccgaagtcacatgcgtcgtcgtcgacgtctcccaggaagaccccgaagtacaattcaactggtacgtcgacggcgtcgaagtccacaacgccaaaaccaaaccacgcgaagaacaatttaattccacctaccgcgtcgtctcagtcctcaccgtcctacaccaagactggctcaacggcaaagaatacaaatgcaaggtctccaacaaaggcctacccagctccattgaaaagaccatctccaaagcgaaaggccaaccccgcgaaccccaggtatacacactcccgccctcccaagaagaaatgaccaaaaaccaagtctccctcacatgcctagtcaaaggattttacccctccgacatcgcagtcgaatgggaatccaacggccaacccgaaaacaactacaaaaccacaccacccgtcctcgactcagacggtagcttcttcctctactcccgcctcacagtcgacaaaagccgatggcaggaaggaaacgtcttctcctgctccgtcatgcacgaagccctccacaaccactacacccaaaaatcactgagcctctccctcggcaaa

SEQ ID NO: 53621 - RNA, 642 nt, synthetic construct
  misc_feature 1..642: note = derived and/or modified sequence opt11 from BTT-1023_LightChain1
  source 1..642: mol_type = other RNA
gtaatccagctcacccaatcaccctcttccctctccgcctccgtcggcgaccgcgtcaccataacctgccgcgcctcccaaggcatctcccgcgccctcgcctggtaccagcaaaaacccggcaaaggccccaaactcctcatctacgacgcctcctccctcgaatccggcgtaccctcccgcttctcaggctcaggctccggcacagacttcacccttaccatatcctccctccaacccgaagacttcgccacctactactgccaacaattcaactcataccccctcacattcggcggcggaaccaaagtcgaaatcaaacgcacagtcgcggccccctccgtattcatcttcccaccctccgacgaacaactaaaatcaggcacagcctccgtagtctgcctcctcaacaacttctacccccgcgaagccaaagtccaatggaaagtcgacaacgccctccaatccggcaactcccaagaatccgtcaccgaacaagactccaaagactccacctactccctgtcctcaaccctcaccctatccaaagccgactacgaaaaacacaaagtatacgcatgcgaagtcacccaccaaggcctctcatctcccgtcaccaaatccttcaaccgaggcgaatgc

SEQ ID NO: 53622 - RNA, 1341 nt, synthetic construct
  misc_feature 1..1341: note = derived and/or modified sequence opt11 from Burosumab_HeavyChain1
  source 1..1341: mol_type = other RNA
caagtccaactcgtccaatccggcgccgaagtcaagaaacccggcgcttccgtaaaagtctcatgcaaagcctccggatacacattcaccaaccactacatgcactgggtccgccaagccccaggccaaggcctagaatggatgggtataataaaccccatatccggatccacctccaacgcccaaaaattccaaggacgcgtcaccatgacacgcgacacctctacctccacagtctacatggaactttcctcactgcgcagcgaagacaccgccgtatactattgcgcccgagacatcgtcgacgcattcgacttctggggccaaggcacaatggtcacagtctcctcagcctcaaccaaaggcccatcagtcttccccctagccccctcctccaaatccacatccggcggcaccgccgcccttggatgcctcgtcaaagactatttccccgaacccgtcaccgtctcctggaactccggagccctcacatccggcgtccacaccttccccgcagtactccaatcatccggactctattccctctcctccgtcgttaccgttccctcctcctccctcggcacccagacctacatatgcaacgtaaaccacaaaccatcaaacacaaaagtcgacaagaaagtcgaacccaaatcatgcgacaaaacacacacatgcccaccctgccccgccccagaactcctcggaggcccctccgtattcctgttccctcccaaacctaaagacaccctaatgatctcccggacaccagaagtaacctgcgtagtcgtcgacgtctcacacgaagaccctgaagtcaaattcaactggtacgtagacggcgtagaggtacacaacgccaaaaccaaaccacgcgaagaacaatacaactccacctaccgcgtagtctccgtccttaccgtcctccaccaggactggctcaacggaaaagaatacaaatgcaaagtctccaacaaagcactccccgcccccatcgagaaaactatctcaaaggccaaaggacaaccccgagaaccccaagtctacaccctcccaccctcccgcgacgaactcaccaaaaaccaagtcagcctaacctgcctcgtaaaaggattctacccttccgacatcgccgtcgaatgggaatcaaacggtcaacccgaaaacaactacaaaacaacgcccccagtcctagactccgacggatccttcttcctctattccaaactcaccgtagacaaatcacgctggcaacaaggtaatgtcttctcctgctcagtaatgcacgaagccctacacaaccactacacccagaaaagcctatccctatcccccggcaaa

SEQ ID NO: 53623 - RNA, 639 nt, synthetic construct
  misc_feature 1..639: note = derived and/or modified sequence opt11 from Burosumab_LightChain1
  source 1..639: mol_type = other RNA
gccatccaactcacacaatcaccctcctcactctccgcctcagtcggcgaccgcgtcaccatcacatgccgcgcctcccaaggcatctcctccgccctcgtatggtaccaacaaaaacccggcaaagcccccaaactcctcatctacgacgcctcctcactagaatccggcgtcccctcacgcttctccggctccggatcaggcaccgacttcaccctcaccatctcctcccttcaacccgaagacttcgctacctactactgccaacaattcaacgactacttcaccttcggccccggcaccaaagtcgacatcaaacgcaccgtcgccgccccatccgtcttcatcttcccaccctcagacgaacaactcaaatccggaaccgcctccgtagtctgcctcctaaacaacttctacccccgcgaagccaaagtccaatggaaagtcgacaacgcactccaatccggcaactcccaagaatccgtcaccgaacaggactccaaagactcaacctactccctctcctccaccctaaccctctccaaagccgactacgaaaaacacaaagtctacgcctgcgaagtcacccaccaaggcctaagctcccccgtcaccaaatcattcaaccgcggcgaatgc

SEQ ID NO: 53624 - RNA, 1344 nt, synthetic construct
  misc_feature 1..1344: note = derived and/or modified sequence opt11 from Canakinumab_HeavyChain1
  source 1..1344: mol_type = other RNA
caagtccaactcgtcgaatcaggtggcggcgtcgtacaacccggacgtagcctccgcctctcatgcgccgcctcaggattcacattctccgtctacggcatgaactgggtccgccaagcccccggcaaaggactcgaatgggtagccataatctggtacgacggcgataaccaatactacgcagatagcgtcaagggacgcttcaccatatccagagacaacagcaaaaacaccctgtacctccaaatgaacggcctccgcgccgaagataccgccgtctactactgcgcccgcgacctgcgcacaggtcccttcgactactggggacagggcaccctagtcaccgtctcctccgcctccaccaaaggccccagcgtcttcccccttgcgccctcatcaaaaagcacctccggcggcaccgccgcactcggctgcctagtcaaagactacttccccgaacccgtcaccgtttcctggaactccggtgcccttacctccggagtccataccttcccagccgtactacaaagctcaggcctctactccctctccagcgtagttactgtcccctcctcttccctcggcacacaaacatacatatgcaacgtaaaccacaagcccagcaacaccaaagtcgacaagcgcgtagaaccaaaatcatgcgacaaaacccacacatgtccaccttgcccagcacccgaactactcggtggcccctcagtcttcctcttcccacccaaacccaaagacaccctcatgattagccgcacacccgaagtaacatgcgtcgtcgtcgacgtctcacacgaagacccagaagttaaattcaactggtacgtcgacggagtcgaggtccacaatgcaaagaccaaaccacgagaagaacaatacaactccacctaccgtgtagtatccgttcttaccgtcctccaccaagactggctcaacggcaaagaatacaaatgcaaagtctccaacaaagccctccccgcccccatcgagaagaccatatccaaagccaaaggccaacccagagaaccccaggtctacacacttcctccctcccgcgaagaaatgaccaaaaaccaagtaagcctaacctgcctagtaaaaggcttctacccctccgacatcgccgtagaatgggaatccaacggccaacccgagaacaactacaaaacaacaccacccgtcctcgattctgacggctcattcttcctctactcaaaactaaccgtcgacaaatcccgctggcaacaggggaatgtcttcagctgctccgtcatgcacgaagccctccacaaccactacacccaaaaatccttgtcactctcacccggcaaa

SEQ ID NO: 53625 - RNA, 1344 nt, synthetic construct
  misc_feature 1..1344: note = derived and/or modified sequence opt11 from Canakinumab_HeavyChain
  source 1..1344: mol_type = other RNA
caagtccaactcgtcgaatccggaggaggcgtcgtccaacccggaagaagccttagactcagctgcgccgcgtccggcttcacattctcggtatacggcatgaattgggtcagacaagcacccggcaaaggcctagaatgggtcgccatcatctggtacgacggcgacaaccaatactacgcagactcagtcaaaggcagattcaccataagcagagacaactccaaaaacacattatatctccaaatgaatggactccgcgccgaagacaccgcagtctactactgcgccagagacctacgaaccggccccttcgactactggggacaaggaaccctagtaaccgtctcttccgcctccactaagggcccctccgtcttcccactagcaccatcatcaaaatccacctcaggcggcactgccgccctcggctgcctagtaaaggactacttcccagaacctgtcaccgtctcttggaactccggcgccctcacatccggcgtccacacattccccgccgtcctccaaagctccggcctgtactccctaagctccgtcgtcaccgtcccatcctccagcctcggcacccaaacctacatctgcaacgtcaatcacaaaccatccaacaccaaagtagacaaacgtgtcgaacccaaatcctgcgacaaaacccacacatgcccgccctgcccagcccctgaactcctcggtggcccctccgtattccttttcccacccaaacctaaagacacccttatgatcagccgaacacccgaagtcacatgcgtagtcgtcgacgtctcacacgaagacccagaagtcaagttcaactggtacgtagacggcgtcgaagttcacaacgctaaaaccaaaccccgcgaagaacaatataactccacctaccgagtcgtatcggtcctcacagtcctccaccaagactggcttaacggcaaagaatacaaatgcaaagtctccaacaaagccctacccgcccccatagagaaaacaatctccaaagccaaaggacaacccagagaaccccaagtctacaccctcccaccctccagagaagaaatgaccaaaaaccaagtatcacttacctgcctagtcaaaggcttctacccctcggacatcgccgtcgaatgggaatcaaacggacaaccagaaaacaactacaaaaccacaccacccgtcctcgactccgacggctccttcttcctctactccaaactaaccgtagacaaatcccgctggcaacagggcaacgtcttctcttgctccgtcatgcatgaagcactccacaaccactacacccagaaaagcctatccctcagccccggaaaa

SEQ ID NO: 53626 - RNA, 642 nt, synthetic construct
  misc_feature 1..642: note = derived and/or modified sequence opt11 from Canakinumab_LightChain1
  source 1..642: mol_type = other RNA
gaaatcgtcctcacacaatcccccgacttccaatccgtcaccccaaaagaaaaagtaaccataacctgccgcgcctcccaatccatcggctccagcctccactggtaccaacaaaaacccgaccaatcccccaaactcctcatcaaatacgcatcccaatccttctccggcgtcccctcacgcttctccggctcaggctccggcaccgacttcaccctaaccatcaactccctcgaagccgaagacgcagccgcctactactgccaccaatcctcctcactccccttcaccttcggccccggcaccaaagtcgacataaaacgcacagtcgccgccccctccgtcttcatcttcccaccctccgacgaacaactcaaatccggcaccgcctccgtagtctgcctactcaacaacttctacccccgcgaagccaaagtccaatggaaagttgacaacgccctccaatccggcaactcacaagaatccgtcaccgaacaagactctaaagactccacatactcactcagctcaaccctcaccctttccaaagccgactacgaaaaacacaaagtctacgcctgcgaagtcacccaccagggcctctcctcacccgtcaccaaatccttcaaccgcggcgaatgc

SEQ ID NO: 53627 - RNA, 642 nt, synthetic construct
  misc_feature 1..642: note = derived and/or modified sequence opt11 from Canakinumab_LightChain
  source 1..642: mol_type = other RNA
gaaatcgtcctcacccaatcccccgacttccaaagcgtcacccccaaagaaaaagttaccatcacatgccgcgcctcccaatccatcggctcctccctacactggtaccaacaaaaacccgaccaatcccccaaactcctcatcaaatacgcctcccaatccttctccggcgtcccctcccgcttctcaggctccggctccggcaccgacttcaccctcaccatcaactcccttgaagccgaagacgccgccgcctactactgccaccaatcctcctccctccccttcaccttcggccccggcaccaaagtcgacatcaaacgcaccgtcgccgcccccagcgtcttcatcttcccaccctcagacgaacaactcaaatccggcaccgcctccgtcgtctgcctcctcaacaacttctacccccgcgaagccaaagtccagtggaaagtcgacaacgcactccaatccggcaactcacaagaatccgtaaccgaacaagactccaaagactccacctactccctctcctccaccctcaccctatccaaagccgactacgaaaaacacaaagtctacgcctgcgaagtcacgcaccaaggcctatcctcccccgtcaccaaatccttcaaccgaggcgaatgc

SEQ ID NO: 53628 - RNA, 1182 nt, synthetic construct
  misc_feature 1..1182: note = derived and/or modified sequence opt11 from Canakinumab_LightChain_variant_8836_L
  source 1..1182: mol_type = other RNA
caagtccaactcgtcgaatctggaggaggcgtcgtccaacctggccgctccctccgactctcctgcgccgcctccggcttcactttcagcgtatacggaatgaactgggtacgccaagcacccggaaaaggcctcgaatgggtagccatcatctggtacgacggagacaaccaatactacgccgactctgtcaaaggccgattcaccatctcccgagacaactccaaaaacacactctacctacaaatgaacgggctccgagccgaagacaccgccgtatactactgcgcaagagatctccgcaccggccccttcgactactggggccaaggcacactcgtcaccgtatcaagcgctagcaccaaaggcccaagtgtctttccactcgccccctcctccaaatccacctcaggcggcaccgcagctcttggctgcctcgtcaaagactatttccccgaacccgtaaccgtctcctggaactccggcgccctaacctcaggcgtccataccttcccggcggtactccaatctagcggcctcgaaatcgtactaacacaatcacccgactttcagtcagtcacacccaaagaaaaagtcaccatcacctgtcgcgcctcacaatccatcggctccagcctccactggtaccaacaaaagcccgaccaatcccccaaactcctaatcaaatacgcctcccaatccttctcaggcgtcccctcccgattctccggctccggctcaggcacagacttcaccctaaccataaactctctcgaagctgaagacgccgccgcttactactgccaccaatcctcttcactccctttcacgttcggccccggaaccaaagtagatatcaaacgcaccgtagctgccccctcggtattcatcttcccaccctcagacgaacaactcaaatccggcaccgcctccgtcgtctgcctactcaacaatttctacccccgtgaagccaaggtccaatggaaagtagacaacgccctccaatccggcaactcccaagaaagcgtaacagaacaagactccaaagactccacctactccctctcatccaccctcacactctccaaagccgactacgaaaaacataaagtctacgcctgcgaagtaacccaccaaggcctatcctcccccgtcactaagtcctttaaccgcggagaatgc

SEQ ID NO: 53629 - RNA, 1197 nt, synthetic construct
  misc_feature 1..1197: note = derived and/or modified sequence opt11 from Cantuzumab_HeavyChain1
  source 1..1197: mol_type = other RNA
atcgacaccaccaccggcgaacccacatacgcccaaaaattccagggccgaatcgccttctcgctcgaaacctcagcctcaaccgcttacctccaaataaaatcactcaaatcagaagacacagctacatatttctgtgcccgacgcggaccctacaactggtacttcgacgtctggggccaaggaaccactgtaaccgtatcctctgcctcaaccaaaggcccctccgtattccccctagcaccctcctcaaaatccacctccggcggcacagccgcactcggctgcctcgtcaaagactactttcccgaacccgtcactgtctcatggaactcaggcgccctcacttctggcgtccacaccttccccgccgtcctacaatcatccggcctctactccctctcatccgtcgtaactgtacccagctccagcctcggtacacaaacctacatatgcaacgtcaaccacaagcccagtaacactaaagtcgacaagaaagtcgaacccaaatcatgcgacaaaacccacacttgcccaccctgccccgcaccagaactcctaggcggcccatccgtcttcctattcccacccaagcccaaagacaccctaatgatctctcgtacaccagaagttacctgcgtagttgtcgatgtaagccacgaagaccccgaagtcaaattcaactggtacgtcgacggagtcgaagtccacaacgcaaaaaccaaaccccgcgaagaacaatataactccacataccgcgtcgtttccgtactcaccgtccttcaccaagactggctcaacggtaaagaatacaaatgcaaagtctccaacaaagcgctccccgccccaatcgagaaaaccatatccaaagccaaaggccaaccccgagaacctcaagtctacacactaccacccagcagagacgaactcaccaaaaaccaagtctcactaacctgcctcgtcaaaggcttctacccctcagacatcgcagtcgaatgggaatccaacggccaacccgaaaacaactacaaaaccactcccccagtcctcgactccgacggctcgttcttcctctacagcaagctcaccgtcgacaaatcacgatggcaacaaggaaacgtcttctcttgctcagtcatgcacgaagcactccacaaccactacacccaaaaatccctctccctctcccccggcaaa

SEQ ID NO: 53630 - RNA, 1347 nt, synthetic construct
  misc_feature 1..1347: note = derived and/or modified sequence opt11 from Cantuzumab_HeavyChain
  source 1..1347: mol_type = other RNA
caagtccaattggtccaatccggagccgaagttaagaaaccaggcgaaacagtaaaaatatcctgcaaagccagcgactacacctttacctactacggaatgaattgggtaaaacaagcccccggccaaggactcaaatggatggggtggatagacaccactaccggcgaaccaacctacgcccaaaaattccaaggccgcatcgccttctccctagaaacctccgcatcaactgcctacctccaaatcaaatccctcaaatccgaagacaccgccacatacttctgcgcccgccgaggcccatacaactggtacttcgacgtctggggacaaggcaccaccgttaccgtatcatcagcctccacaaaaggaccgtccgtcttccccctcgccccttcatcaaaatccacctccggtggtaccgcagccctcggctgtctcgtaaaagactacttccccgaacccgtaaccgtctcctggaactccggcgccctcacctccggcgtacacaccttcccagctgtgctccaatcctccgggctctactcactatcctccgtagtcacagtaccctcaagctcactcggcacacaaacatatatctgcaacgtaaaccacaaaccttccaacaccaaagtggacaagaaagtggaacccaaaagctgcgacaaaacacatacctgcccaccctgccccgcccccgaactacttggcggcccctctgtcttccttttcccacccaaacccaaagacaccctaatgatctcccgcaccccagaagtcacatgcgtcgtcgtcgacgtctcgcacgaagaccccgaagtcaaattcaactggtacgtcgacggagtcgaagttcacaacgccaaaaccaaacctcgcgaggaacaatacaactccacttacagagtcgtatcagtcctcacagtcctccaccaagactggctaaacggcaaagaatacaaatgcaaagtatccaacaaagccctgccagcccccattgagaaaaccatcagcaaagccaaaggacaaccccgcgaaccccaagtttatacactcccaccctcccgagacgaactcaccaaaaaccaagtctcattaacctgcctcgtcaaaggcttctacccatccgacattgccgtcgaatgggaatccaacggccaacccgaaaacaactacaaaacaaccccacccgtcctcgactctgacggctccttcttcctctattccaaactcaccgttgacaaatcccgctggcaacaagggaatgtcttctcctgctccgtcatgcacgaagccctgcacaaccactacacccaaaaatcactctcactctcccccggcaaa

SEQ ID NO: 53631 - RNA, 657 nt, synthetic construct
  misc_feature 1..657: note = derived and/or modified sequence opt11 from Cantuzumab_LightChain1
  source 1..657: mol_type = other RNA
gacatcgtcatgacccaatcccctctctccgtcccagtcacccccggcgaacccgtctccatctcatgccgctcctccaaatcactcctccactccaacggcaacacctacctctactggttcctccaacgacccggccaatccccacaactactcatctaccgcatgtccaacctcgtctccggagtccccgaccgcttctccggctccggctccggcaccgccttcaccctccgcatctcccgcgtcgaagccgaagacgtcggcgtctactactgcctccaacacctcgaatatcccttcaccttcggccccggcaccaaactcgaactcaaacgcaccgtcgccgccccctccgtcttcatcttcccaccctcagacgaacaactcaaatccggaaccgcctccgtcgtctgcctcctaaacaacttctacccccgcgaagccaaagtccaatggaaagtcgataacgccctccaatccggtaactcccaagaatccgtcaccgaacaagactccaaagactccacctactctctctcctccaccctcaccctctccaaagccgactacgaaaaacacaaagtctacgcctgcgaagtcacacaccaaggcctctcctccccagttaccaaatcattcaaccgcggcgaatgc

SEQ ID NO: 53632 - RNA, 1344 nt, synthetic construct
  misc_feature 1..1344: note = derived and/or modified sequence opt11 from Cantuzumab_mertansine_HeavyChain1
  source 1..1344: mol_type = other RNA
gtccagctcgttcaaagcggagccgaagtcaaaaaacccggcgaaacagtcaagatctcctgcaaagcctcggactacacattcacctactacggcatgaactgggtcaaacaagcccctggccaaggcctgaaatggatgggctggatcgacaccaccacaggcgaacccacctacgcccaaaaatttcaaggccgcatcgccttctcactcgaaacctccgcttcaaccgcctacctccagatcaaatctctcaaatcagaagacacagccacctacttctgcgcccgacgcggaccctacaactggtatttcgacgtctggggccaaggaaccaccgtcacagtctcctccgcctctaccaaaggcccctccgtcttcccactcgccccatcctcgaaatctacctccggcggcaccgctgccctcgggtgcctggtcaaagactacttccccgaaccagtcaccgtctcatggaactccggagccctcacctccggagtacacaccttccccgccgtcctccaatcttccggactctactccctatcctccgtcgtcaccgtcccctccagctccctcggcacccaaacctacatctgcaacgtcaaccacaaaccctcaaacacaaaagtcgacaaaaaagtcgaacccaaaagctgcgacaaaacccacacctgtcccccctgcccagcccccgaactcctaggaggcccctccgtcttcctcttccccccaaaaccaaaagacaccctcatgatatcccgaacccctgaagtcacctgcgtcgtcgtcgacgtctcacacgaagaccccgaagttaaattcaactggtacgtcgacggcgtcgaagttcacaatgccaaaaccaagccccgcgaagaacaatacaactcaacctaccgcgtcgtctccgtcctcaccgtcctacaccaagactggctcaacggaaaagaatacaaatgcaaagtatccaacaaagccctccccgcaccaatcgaaaaaaccatctcaaaagccaaaggccaaccccgagaaccccaagtctacaccctaccaccatcacgcgacgaacttacaaaaaaccaagtctcactcacctgcctcgtcaaaggattctacccctccgacatagcagtcgaatgggaatccaacggccaacccgaaaacaactacaaaaccaccccccccgtcctagactccgacggtagcttcttcctctactctaaactcaccgttgacaaaagccgctggcaacagggtaacgtcttcagctgctccgtcatgcacgaagccctccacaaccactacacccaaaaatcactctccctctcaccaggaaaa

SEQ ID NO: 53633 - RNA, 657 nt, synthetic construct
  misc_feature 1..657: note = derived and/or modified sequence opt11 from Cantuzumab_mertansine_LightChain1
  source 1..657: mol_type = other RNA
gacatcgtcatgacccaatcacccctctccgtccccgtcacccccggcgaacccgtctccatatcatgccgctcatcaaaatcgctcctccactccaacggaaacacatacctatactggttcctccaacgcccaggacaatcaccccaactcctcatctaccgcatgtccaacctcgtctccggcgtcccagaccgcttctccggatccggatccggcacagccttcaccctccgcatatcccgagtcgaagccgaagacgtaggcgtctactactgcctccaacacctcgaataccccttcaccttcggccccggcaccaaactcgaactcaaacgcaccgtcgccgccccctccgtattcatattcccaccctccgacgaacaactaaaatctggcaccgcctcagtcgtctgcctcctcaacaacttctacccccgcgaagccaaagtccaatggaaagtcgacaacgccctccaatccggaaactcccaagaatcagtcaccgaacaagactccaaagactccacctactccctctcctcaaccctcaccctctccaaagccgactacgaaaaacacaaagtctacgcctgcgaagtcacccaccaaggcctctcctcccccgtcaccaaatccttcaaccgcggcgaatgc

SEQ ID NO: 53634 - RNA, 1347 nt, synthetic construct
  misc_feature 1..1347: note = derived and/or modified sequence opt11 from Cantuzumab_ravtansine_HeavyChain1
  source 1..1347: mol_type = other RNA
caagtccaactcgtccaatccggcgcagaagtcaagaaacccggcgaaaccgtcaaaatcagctgcaaagcctccgactacacattcacctactacggaatgaactgggtcaaacaggcacccggccaaggcctgaaatggatgggctggatcgacacaaccaccggtgaaccaacatacgcacaaaaattccaaggccgcatcgccttcagtcttgaaacatcagcctccaccgcctacctccaaataaaatccctcaaaagcgaggacacagccacatacttctgcgcccgccgcggtccctacaactggtacttcgacgtctggggccaaggcacaaccgtcacagtgtcatccgcatccacaaaaggcccaagcgtcttccccctagccccctcctccaaaagcacctccggcggaacagccgccctcggctgcctagtcaaagactacttccccgaacccgtcaccgtttcatggaactcaggcgccctaacctccggagtacacacattccccgccgtactccaatcatcaggcctctactccctcagctccgtcgtaaccgtaccctcatcctccctcggaacccaaacatacatatgcaacgtcaaccacaaaccatccaacaccaaagtcgacaagaaagtagaacccaaatcgtgcgacaaaacccacacatgcccaccctgccccgcccccgaactcctcggcggaccctccgtcttcctcttcccacccaaacccaaagacaccctaatgatctcccgaacacccgaagtaacctgcgtcgtcgtcgacgtcagccacgaagacccagaagtaaaattcaactggtacgtcgacggcgtcgaagtccacaacgcgaagaccaaaccccgcgaagaacaatacaactccacataccgcgtcgtctccgttctcaccgtcctccaccaagactggcttaacggcaaagaatacaaatgcaaagtctcaaacaaggccctccccgctcccatcgagaaaaccatctcgaaagctaaaggccaaccccgtgaaccacaagtctacaccctcccgccctcccgcgacgaactcaccaaaaaccaagtctcccttacctgcctcgtaaaaggcttctacccctccgacatcgcagtcgaatgggaatccaacggccaacccgaaaacaactacaaaaccacccctcccgttctcgactcagacggctcattcttcctctactccaaactaacagttgacaaatcccgctggcaacaaggcaacgttttctcctgctccgtcatgcacgaagcattacacaaccactacactcaaaaatccctctccctttcccccggcaaa

SEQ ID NO: 53635 - RNA, 657 nt, synthetic construct
  misc_feature 1..657: note = derived and/or modified sequence opt11 from Cantuzumab_ravtansine_LightChain1
  source 1..657: mol_type = other RNA
gacatcgtcatgacccaatcacccctctcagtccccgtcacccccggcgaacccgtatccatatcatgccgctcctccaaatcactcctccactccaacggcaacacctacctctactggttcctacaacgacccggccaatccccccaactcctcatctaccgaatgtcaaacctagtctccggcgtccccgaccgcttctccggctccggctcaggaaccgccttcaccctccgcatctcacgcgtcgaagccgaagacgtcggtgtatactattgcctccaacacctcgaataccccttcaccttcggccccggaaccaaactcgaactcaaacgcaccgtcgcagccccctccgtcttcatcttccccccctccgacgagcaactcaaatccggcaccgcctcagtcgtctgcctactcaacaacttctacccccgcgaagccaaagtccaatggaaagtcgacaacgccctccaatccggaaactcacaagaatccgtcaccgaacaagactccaaagactccacttactccctatcctcaaccctcaccctatccaaagccgactacgaaaaacacaaagtctacgcctgcgaagtcacccaccaaggcctctcctcccccgtcaccaaatccttcaaccgaggcgaatgc

SEQ ID NO: 53636 - RNA, 777 nt, synthetic construct
  misc_feature 1..777: note = derived and/or modified sequence opt11 from Caplacizumab
  source 1..777: mol_type = other RNA
gaggtacagctagtggaaagcgggggagggctggtacagccaggagggtcgctaaggctatcgtgcgcggcatcggggaggacgttttcgtataacccgatggggtggtttagacaggcaccgggaaaaggaagggagttggtagcggcgataagcaggacaggaggaagcacgtattacccggactcggtagagggaaggttcacgatatcgagagataacgcgaaaaggatggtgtacttgcaaatgaactcactgagggcggaggacacggcagtgtactattgcgcagcagcgggagtgagagcagaagatggaagggtaaggacgttgccctcagaatatacattttgggggcaagggacacaggtaacagtaagtagcgcggcggcggaagtgcaattggtagagagcgggggagggctggtgcaaccgggagggagtttgagattgagctgtgcggcaagtgggagaacgttcagctacaatccgatgggatggttcaggcaagcaccggggaaagggcgagagctggtggcagcgatatcgagaacaggagggagcacgtactatccagacagcgtggaagggaggtttacaataagcagggacaatgccaagagaatggtatatctacagatgaatagcttgagggcggaagatacagcggtatattactgtgcagcagcgggggtaagggcagaggacgggagagtgagaacgctcccgagcgaatacacattctggggacagggaacacaagtgacagtgagtagc

SEQ ID NO: 53637 - RNA, 777 nt, synthetic construct
  misc_feature 1..777: note = derived and/or modified sequence opt11 from Caplacizumab_HeavyChain1
  source 1..777: mol_type = other RNA
gaggtgcagctggtggagagcgggggagggctggtgcagccgggagggagtctgaggctaagctgcgcggcgagtggaaggacgtttagctataacccgatggggtggttcaggcaggcgccggggaaggggagggagttagtagcggcgataagcaggacagggggaagtacgtattacccggacagcgtggaggggagattcacgataagcagggacaacgcgaagaggatggtgtacctgcagatgaacagtttgagggcggaggacacggcggtgtactattgcgcggcagcgggggtgagagcagaggatgggagagtaagaacactgccaagtgaatatacattttgggggcagggaacacaggtgacggtgagtagcgcggcggcggaggtgcagttggtggagagcgggggagggctagtgcagccgggagggagcttaaggttgagctgtgcggcgagtgggaggacgttcagttacaacccgatggggtggttcaggcaggcgccagggaaggggagggagttggtggcagcgataagcaggacagggggaagcacgtattacccggacagcgtggaggggaggttcacgataagcagggacaatgcgaagaggatggtgtatctgcaaatgaatagcttgagggcggaggatacggcggtgtattactgtgcagcggcgggggtaagggcggaggacgggagggtgaggacactgccgagcgagtacacgttctgggggcagggaacacaggtgacggtgagcagc

SEQ ID NO: 53638 - RNA, 777 nt, synthetic construct
  misc_feature 1..777: note = derived and/or modified sequence opt11 from Caplacizumab_HeavyChain1
  source 1..777: mol_type = other RNA
gaagtgcaactggtagagagcggaggagggctagtgcaaccaggaggaagtctgagactgagctgcgcagcgagcgggcgaacattcagctacaacccaatggggtggttcaggcaagcgccaggaaaagggagggagctagtggcagcaataagcagaacgggagggagcacgtactaccccgacagcgtggaaggaagattcacaataagcagagacaacgcaaagagaatggtatacctacagatgaacagcctacgagcagaagacacagcggtatactactgcgcggcggcaggggtaagggcggaggacgggagagtgaggacattaccgagcgagtacacgttctggggacagggaacgcaagtgacagtgagcagcgcagcagcagaagtacagctagtggaaagcggagggggattagtacaaccaggagggagcctcaggctctcgtgcgcggcaagcgggagaacattcagctacaacccaatggggtggttccgacaggcaccggggaagggaagagaactggtagcggcaataagcaggacaggaggaagcacatactacccggacagcgtagaggggagattcacgataagcagggacaacgccaaaagaatggtgtacctgcaaatgaacagcctaagggcggaagacacggcagtgtactactgcgcagcagcgggagtaagagcggaagacggaagggtaaggacactgccaagcgaatacaccttctggggacaagggacacaggtaacggtaagtagc

SEQ ID NO: 53639 - RNA, 1347 nt, synthetic construct
  misc_feature 1..1347: note = derived and/or modified sequence opt11 from Carlumab_HeavyChain1
  source 1..1347: mol_type = other RNA
caagtccagctagtccaatcaggcgccgaagtcaagaaacccggatcctccgtcaaagtctcctgcaaagcctccggcggcaccttctcctcgtacggcatctcttgggttcgacaagccccaggccaaggcctcgaatggatgggaggcatcatcccaatcttcggcactgccaactacgcacaaaaattccaaggccgagttaccatcaccgccgatgaatccacctccacagcctacatggaactaagctcccttcgcagcgaagacaccgccgtctactactgcgcccgctacgacggaatctacggcgaactcgacttctggggccaaggcacgctggtaaccgtctcttccgcctccacaaaaggtccctccgtattccccctcgccccctcctccaaatcaacctccggcggcactgctgccctcggctgcctcgtcaaagactacttccctgaacccgttaccgtctcctggaactcaggcgccctaacctcaggcgtccacaccttccccgccgtcctccaatcctccggtctatactcactctcatccgtagtcacggtaccctcatcttcgctcggcacccagacttacatatgcaacgtaaaccacaaaccctcaaacacaaaagtcgacaagaaagtcgaacccaaatcatgcgataaaacccacacctgtcccccatgcccagcccccgaattactaggcggcccctcagtctttctctttccacccaaacccaaagacacactaatgatttcccgcaccccagaagtcacatgcgtcgtcgttgacgtctcccacgaagaccccgaagtcaaattcaattggtacgtcgatggagtagaagtccacaacgcaaaaaccaaaccccgagaagaacaatacaactctacctaccgcgtagtctcagtcctaacagtcctccaccaagactggctcaacggaaaagaatacaaatgcaaagtttccaacaaagccctccccgcacccatcgagaaaaccatctcaaaagccaaaggccaaccccgcgaaccccaagtctataccctaccaccctcccgcgacgaactaaccaaaaaccaagtctccctaacatgcctcgtcaaaggcttctaccccagcgacatcgcagtcgaatgggaatcaaacggacagcccgaaaacaactacaaaacaaccccacccgtcctcgactctgacggctccttcttcctctacagcaaactcaccgtagacaaatcacgctggcaacaaggaaacgtcttctcctgctccgtcatgcacgaagcactccacaaccactacacacaaaaatcactatccctcagtcccggcaaa

SEQ ID NO: 53640 - RNA, 648 nt, synthetic construct
  misc_feature 1..648: note = derived and/or modified sequence opt11 from Carlumab_LightChain1
  source 1..648: mol_type = other RNA
gaaatcgtactcacccaatctcccgcaaccctctccctctcccccggcgaacgcgccaccctctcctgccgcgcctcccaatccgtctccgacgcctacctcgcctggtaccaacaaaaacccggccaagcaccccgcctcctcatctacgacgcctcctcccgtgccaccggagtacccgcccgattctccggctccggctccggcaccgacttcacccttaccatctcatcactagaacccgaagacttcgcagtctactactgccaccaatacatccaactccactccttcaccttcggccaaggcaccaaagtcgaaataaaacgcaccgtcgccgccccctccgtcttcatcttcccaccctccgacgaacaactcaaatccggcaccgcctccgtagtttgcctcctcaacaacttctacccccgcgaagccaaagtccaatggaaagtcgataacgcactccaatccggcaactcccaagaatccgtcaccgaacaagactccaaagactccacctactccctctcctccaccctcaccctctccaaagccgactacgaaaaacacaaagtctacgcctgcgaagtcacccaccaaggcctctcctcccccgtcaccaaatcattcaaccgaggcgaatgc

SEQ ID NO: 53641 - RNA, 1353 nt, synthetic construct
  misc_feature 1..1353: note = derived and/or modified sequence opt11 from Cergutuzumab_amunaleukin_HeavyChain1
  source 1..1353: mol_type = other RNA
caagtccaactcgtacaaagcggagccgaagtcaagaaaccgggcgcatccgtgaaagtatcctgcaaagccagcggctacaccttcaccgagttcggcatgaactgggtccgacaagcacccggccaaggacttgaatggatgggctggataaacaccaaaaccggcgaagcgacctacgtcgaagagttcaaaggacgcgtcacattcaccacggacacctcaacctccaccgcctacatggaactacgatccctccgctccgacgacaccgcagtctactactgcgcacgctgggacttcgcctactacgtcgaagcaatggactactggggacaaggcaccaccgtcaccgtctcctccgcctccaccaaaggtccctccgtcttccccctagcaccctccagtaaaagcacctccggcggaacagccgccctcggatgcctcgtcaaagactacttccccgaacccgtcaccgtatcctggaactccggcgcccttacctccggcgtacacacattcccggccgtcctccaatccagcggcctttactcactatccagcgtcgtaacagtcccctcctcctccctcggtacccaaacctacatatgcaatgtcaaccacaaaccctcaaacaccaaagtcgacaagaaagtcgaacccaaatcctgcgacaaaacccacacatgcccaccctgcccagcaccagaagcggccggcgggccctccgtcttcctcttccctcccaaacccaaagacaccctcatgatctcacgcaccccagaagttacctgcgtcgtcgtcgacgtatcacacgaagaccctgaagtcaaattcaactggtacgtcgacggagtagaagtccacaacgcgaaaaccaaaccccgcgaagaacaatacaactcaacctaccgagtcgtaagtgtcctcaccgtactacaccaagactggctcaacggcaaagaatacaaatgcaaagtttccaacaaagccctcggcgcccccatcgaaaagaccatctccaaagcaaaaggccaaccacgagaaccacaagtatgcacactaccaccctcccgcgacgaactcaccaaaaaccaagtaagcctctcctgcgccgtaaaagggttttacccctccgacatcgcggtcgaatgggaatccaacggacaacctgaaaacaactacaaaaccacacccccagtcctagactccgacggctccttcttcctagtctccaaactgaccgtagataaatcacgatggcaacaaggcaacgtcttcagctgctccgtcatgcacgaagccctccacaaccactacacccaaaagagcctatctctatccccaggaaaa

SEQ ID NO: 53642 - RNA, 1794 nt, synthetic construct
  misc_feature 1..1794: note = derived and/or modified sequence opt11 from Cergutuzumab_amunaleukin_HeavyChain2
  source 1..1794: mol_type = other RNA
caagtacaacttgtccaatcaggagccgaagtcaagaaacccggagccagcgtaaaagtctcctgcaaagcaagcggctacacattcaccgagttcggcatgaactgggtccgccaagccccaggacaaggcctggaatggatgggctggataaacacaaaaaccggcgaagccacctacgtcgaagagttcaaaggccgcgtcacattcaccaccgacacctccacatccacagcctatatggaactacgctccctccgctccgacgacaccgcggtatactactgcgcccgctgggacttcgcatactacgtcgaagccatggactactggggccaaggaacaactgtaaccgtatcaagtgccagcactaaaggaccatccgtcttccccctcgccccctcgtccaaatccacctccggcggcaccgctgcccttggctgcctcgtaaaagactacttcccggaacccgtaaccgtatcttggaactccggagccctgacctccggagtccacaccttccccgccgtactccagtcctctggactctattccctctcctcagtagtaaccgtaccgtcatcctccttaggaacccaaacctacatatgcaacgtaaaccacaaacccagcaacactaaagtagacaagaaagtcgaacccaaaagctgtgacaaaacccacacatgcccaccctgcccagcccccgaagcagccggcggcccatccgtcttcctcttcccacctaaacctaaagacaccctcatgatatcacgcacaccagaagtcacatgcgtagttgtcgacgtctcccacgaagatcctgaagtcaaatttaactggtacgtcgacggcgtcgaggtccacaacgccaaaacaaaaccccgcgaagaacaatacaactccacataccgagtcgtcagcgtcctcacagtactccaccaagactggcttaacggaaaagagtacaaatgcaaagtctccaataaagcactcggagccccaatcgagaaaaccatatcaaaagcaaaaggacaaccccgagaaccccaagtatacaccctacccccttgccgcgacgagctaaccaaaaaccaagtctctttatggtgcctcgtaaaaggcttctaccccagcgacatagccgttgagtgggaatcaaacggacaacccgagaacaactacaaaaccacacccccagtcctcgactcggacgggagcttctttctatacagcaaactaaccgtcgacaaatccagatggcaacaaggcaacgtcttctcctgctctgttatgcacgaagccctgcacaaccactacacccaaaagtcactctcactatccccgggcggaggcggcggctccggagggggcgggtccggtggcggaggtagcgcacccgcttcctcatcaaccaaaaagacccaactccaactcgaacacctactcctcgacctccaaatgatcctcaacggcatcaacaactacaaaaatcccaaactaacacggatgctcaccgccaaattcgcaatgccaaagaaagccaccgagctaaaacacctccaatgtctagaagaagaattaaaacccctagaagaagtattaaacggcgcccaatccaaaaacttccacctccgcccccgcgacctaatatcaaacatcaacgtcatcgttcttgaactgaaaggctctgaaaccaccttcatgtgtgagtacgccgacgaaaccgccaccatcgtagaatttctaaaccgctggatcaccttcgcacaaagcatcatctccacactaacc

SEQ ID NO: 53643 - RNA, 645 nt, synthetic construct
  misc_feature 1..645: note = derived and/or modified sequence opt11 from Cergutuzumab_amunaleukin_LightChain1
  source 1..645: mol_type = other RNA
gacatccaaatgacccaatccccctcctccctctccgcctcagtcggcgaccgcgtcaccatcacttgcaaagcctccgccgccgtcggcacctacgtcgcctggtaccaacaaaaacccggcaaagcccccaaactactcatctactccgcctcctaccgcaaacgcggcgtcccctcacgattctcaggatctggatccggcaccgacttcaccctcaccatctcctcactccaacccgaagacttcgcaacctactactgccaccaatactacacctaccccctattcaccttcggccaaggcaccaaactcgaaatcaaacgaaccgtcgccgccccctccgtcttcatcttccctccctcagacgaacaactcaaatccggaaccgcctccgttgtctgccttctcaacaacttctacccccgcgaagccaaagtccaatggaaagtagacaacgccctacaatcaggcaactcccaagaatccgtaaccgaacaagactccaaagactccacatactccctctcctccacactcaccctctccaaagccgactacgaaaaacacaaagtctacgcctgcgaagtcacccaccaaggcctctcctcccccgtcaccaaatccttcaaccgcggcgaatgc

SEQ ID NO: 53644 - RNA, 687 nt, synthetic construct
  misc_feature 1..687: note = derived and/or modified sequence opt11 from Certolizumab_pegol_HeavyChain1
  source 1..687: mol_type = other RNA
gaagtgcaattggtcgagagtggaggcgggctcgtacaaccaggcgggagcttgcgcctgagctgtgccgcgagcggatatgtgttcacagactatggcatgaactgggttaggcaagcgcccgggaaagggctcgagtggatgggctggatcaatacctatatcggggaaccgatctatgccgatagcgtgaaagggcgcttcacctttagcttggacacgagcaaaagcacggcctacctccaaatgaatagcttacgcgcggaagataccgcggtctattactgtgcaaggggctatcgctcatacgcgatggattactggggccagggcacgctcgtgacagtaagctcggcctcgaccaagggcccgagcgtgttcccgctagcgccctcgagcaagagcacgagtgggggcacggccgcgctagggtgcctggtcaaggactatttcccggaaccggtcacggtctcatggaatagcggggccctgacctcgggcgtacacacgttcccagccgtgctacaaagctcgggcctgtactcgctctcgagcgtggtcacggtcccaagctcgagcttgggcacgcaaacgtacatatgcaatgtcaaccacaagccatcaaatacgaaagtggacaagaaagtggaaccgaaatcatgcgataaaacgcacacgtgcgcggcc

SEQ ID NO: 53645 - RNA, 687 nt, synthetic construct
  misc_feature 1..687: note = derived and/or modified sequence opt11 from Certolizumab_pegol_HeavyChain
  source 1..687: mol_type = other RNA
gaagtccaactagtcgaatcaggcggcggcctcgtccaacccggcggatctctacgcctatcctgcgccgcctccggatacgtcttcaccgactacggcatgaactgggtccgccaagccccaggcaaaggcctcgaatggatgggctggatcaacacctacatcggcgaaccaatctacgccgactccgtcaaaggccgattcaccttctcactagacacctccaaaagcaccgcctacctccaaatgaactccctccgcgccgaagacaccgccgtctactactgcgcccgcggctaccgctcctacgccatggactactggggccaaggcaccctagtcaccgtcagctccgcctccaccaaaggcccctccgtattccccctcgccccctcctccaaatcaacctccggcggcaccgccgccctcggctgcctagtcaaagactacttccccgaacccgtcaccgtctcatggaactccggcgccctcacctccggagtacacactttccccgccgtcctccaaagctccggcctctactccctctcgtccgtcgtcaccgtcccctcctccagcctcggaacccaaacctacatatgcaacgtcaaccacaaaccctccaacaccaaagtcgacaaaaaagtcgaacccaaatcatgcgacaaaacccacacctgcgccgcc

SEQ ID NO: 53646 - RNA, 642 nt, synthetic construct
  misc_feature 1..642: note = derived and/or modified sequence opt11 from Certolizumab_pegol_LightChain1
  source 1..642: mol_type = other RNA
gacatccaaatgacccaatccccctcctccctatcggcctcagtaggcgaccgagtcaccatcacatgcaaagcctcccaaaacgtcggcaccaacgtcgcctggtaccaacaaaaacccggcaaagcccccaaagccctcatctactcagcctccttcctctactccggcgtcccataccgcttctctggctctggctccggcaccgacttcaccctaaccatctcctccctccaacccgaggacttcgcaacctactactgccaacaatacaacatctaccccctcaccttcggacaaggcaccaaagtcgaaatcaaacgcaccgtagctgccccctccgtattcatcttcccaccctcagacgaacaactcaaatcaggcaccgcctccgtcgtctgcctcctaaacaacttctacccccgcgaagccaaagtccagtggaaagtcgacaacgccctccaatccggaaactcccaagaatccgtcaccgaacaagactccaaagactccacctactccctcagctccaccctcaccctctcaaaagccgactacgaaaaacacaaagtttacgcctgcgaagtcacccaccaaggcctctcctcccccgtcaccaaatccttcaaccgcggcgaatgc

SEQ ID NO: 53647 - RNA, 642 nt, synthetic construct
  misc_feature 1..642: note = derived and/or modified sequence opt11 from Certolizumab_pegol_LightChain
  source 1..642: mol_type = other RNA
gacatccaaatgacacaatccccctcctccctcagcgccagcgtaggcgaccgcgtcaccatcacctgcaaagcatcccagaacgtgggcacaaacgtcgcctggtaccaacaaaaacccggaaaagcccccaaagccctcatctactcagcctccttcctctactccggagtcccctacagattctccggctccggctccggcaccgacttcaccctcaccatatcctcactccaacccgaagacttcgccacatactactgccaacaatacaacatctaccccctcacattcggccaaggcaccaaagtcgaaatcaaacgcaccgtcgccgccccctccgtattcatattccccccctccgacgaacaactcaaatccggcaccgcctccgtcgtctgcctccttaacaacttctacccccgcgaagcaaaagtccaatggaaagtcgacaacgccctacaatccggcaactctcaagaatccgtcaccgaacaagactccaaagactccacctacagcctatcctcaaccctcaccctatccaaagccgactacgaaaaacacaaagtctacgcctgcgaagtcacccaccaaggcctctcctcacccgtaaccaaatccttcaaccgcggcgaatgc

SEQ ID NO: 53648 - RNA, 1356 nt, synthetic construct
  misc_feature 1..1356: note = derived and/or modified sequence opt11 from Cetuximab_HeavyChain
  source 1..1356: mol_type = other RNA
caagtacaactcaaacaatccggcccaggcctcgtccaaccatcccaatccctctctatcacatgcacagtctcaggattctcactcaccaactacggggtccactgggtccgccaatcccctggaaaaggcctagaatggctaggagtcatatggtccggcggcaataccgactacaacacccccttcacctcacgcctatcaatcaacaaagacaactccaaatcacaagtcttcttcaaaatgaactcactccaatctaacgacaccgccatatactactgcgcccgtgccctcacttactacgactacgaatttgcatactggggtcaaggcacactcgtcacagtatccgccgcctcaaccaaaggcccatccgtcttccccctcgcaccctcatcaaaaagcacatccggcggtaccgccgccctaggctgcctcgtcaaagactacttcccagaacccgtcaccgtcagctggaacagcggcgccctcacctccggagtccacaccttcccagccgtcctacaatcctccggcctctactccctatcaagcgtcgtcactgtaccctcatcctcccttggcacccaaacatacatctgcaacgtcaaccacaaaccctcaaacaccaaagtcgacaaacgagtagaacccaaatcgcccaagtcctgcgacaaaacacacacctgtccaccctgccccgcacccgaactcctcggaggccccagcgtcttccttttccctcccaaacccaaagacaccctaatgatctcccgaacccccgaagtaacctgcgtcgtcgtagatgtatcgcacgaagaccccgaagtcaagttcaactggtatgtcgacggcgtcgaagttcacaacgccaaaaccaaaccccgcgaagaacaatataactccacctaccgagtcgtctccgtcctgaccgtcctacaccaagactggctcaacggcaaagaatacaaatgcaaagtctccaacaaagccctccccgcccccatagagaaaaccatctctaaagccaaaggccaacccagagaaccccaagtctacacactaccaccctcacgagacgaactaaccaaaaaccaagtctccctcacatgcctggtcaaaggcttctatccctcagacatcgccgtcgaatgggaatccaacggccaacccgaaaacaactacaaaacaacacccccagtcctcgactccgacgggtccttcttcctctactccaaactcactgtcgacaaatcacgctggcaacaagggaacgtcttctcctgctccgtcatgcacgaagccctgcacaaccattacacccaaaaatcactctccctctcccccggcaaa

SEQ ID NO: 53649 - RNA, 1347 nt, synthetic construct
  misc_feature 1..1347: note = derived and/or modified sequence opt11 from Cetuximab_HeavyChain_variant
  source 1..1347: mol_type = other RNA
caagtccaactcaaacaatcaggccccggcctagtccaaccaagccagtccctgtccattacctgcaccgtctccggcttctccctaaccaactacggagttcactgggtacgccagtcccccggaaaaggcctagaatggcttggcgtcatctggtctggcggaaacaccgactacaacacaccattcacctcacgactatcaatcaacaaagacaactccaaatcacaagtcttcttcaaaatgaactcactacaaagcaacgacactgcaatctattactgcgcccgcgccctcacatactatgactacgagttcgcatactggggccaaggcaccctcgtcaccgtcagcgccgcctccaccaaaggcccatccgtattcccactcgccccctcctccaaatcaaccagcggcggcacagccgccctcggctgcctcgtgaaagattacttcccagaacccgtcaccgtctcctggaacagcggcgccctaacttccggagtacacaccttccccgccgtgctccaatcctccggcctatactccttatcgagcgtcgtcaccgtcccctcctcaagcctgggaacccaaacctacatctgcaacgtgaaccacaaaccctccaacaccaaagtcgacaagaaagtcgaacccaaatcctgcgacaaaacgcacacatgccctccctgccccgcccccgaactccttggcggaccctctgtcttcctcttccctcccaaacccaaagacaccctaatgatatcccgcacccccgaagtaacctgcgtcgtcgtcgacgtctcacacgaagaccccgaagttaaatttaactggtacgtagacggcgtcgaagtgcacaacgccaaaaccaaaccccgcgaagaacaatacaactccacttaccgagtagtctccgtcctaaccgtcctccaccaagactggctcaacggcaaggaatacaaatgcaaagtatccaacaaagcactacccgcacccatcgaaaagaccatctccaaagccaaaggtcaaccccgcgaaccccaagtctacacccttcccccatcccgcgacgaactaaccaaaaaccaagtctcccttacctgcctagtcaaaggcttctacccctccgacatagcagtcgaatgggaatcaaacggccaacccgaaaacaactacaaaaccaccccacccgtcctcgattccgacggatctttcttcctctactcaaaactaaccgtcgacaaaagccgatggcaacaaggaaacgtcttcagctgctccgtcatgcacgaagccctccacaaccactacacccaaaaatcacttagcctaagccccggtaaa

SEQ ID NO: 53650 - RNA, 639 nt, synthetic construct
  misc_feature 1..639: note = derived and/or modified sequence opt11 from Cetuximab_LightChain
  source 1..639: mol_type = other RNA
gacatcctcctcacccaatcccccgtcatcctctccgtcagccccggcgaacgcgtctccttctcctgccgcgcctcccaatccatcggcaccaacatccactggtaccaacaacgcaccaacggctcaccccgactcctcatcaaatacgcctccgaatccatctccggcataccctcccgattctccggctctggctccggcaccgacttcaccctctccatcaactccgtcgaatccgaagacatcgccgactactactgccagcaaaacaacaactggccaaccaccttcggcgccggcaccaaactagaactcaaacgcacagtcgccgccccctccgtattcatattcccaccctcagacgaacaactcaaatccggcaccgcctctgtcgtatgcctcctcaacaacttctacccccgcgaagccaaagtccaatggaaagtcgacaacgccctccaatccggcaactcacaagaatccgtcaccgaacaagactcaaaagactccacctactccctctcctccaccctcactctatcaaaagccgattatgaaaaacacaaagtctacgcctgcgaagtcacacaccaaggcctctcctcccccgtcacaaaatccttcaaccgcggcgcc

SEQ ID NO: 53651 - RNA, 642 nt, synthetic construct
  misc_feature 1..642: note = derived and/or modified sequence opt11 from Cetuximab_LightChain_variant
  source 1..642: mol_type = other RNA
gacatcctgctcacccaatcccccgtaatcctaagcgtatccccaggcgaacgcgtcagcttctcctgccgcgcaagccaaagcataggcaccaacatacactggtaccaacaacgaaccaacggctcacccagactcctcatcaaatacgcatccgaaagcataagcggcatcccaagccgattctcaggctcaggctcaggcacggacttcaccctaagcataaactcagtcgaatcagaagacatagccgactactactgccagcaaaacaacaactggccaaccacattcggagccggaaccaaactagaactcaaacgcacagtcgcagccccatccgtattcatattcccaccctcagacgaacaactaaaatcaggcacagcctcagtcgtctgcctgctcaacaacttctacccccgcgaagccaaagtccaatggaaagtcgacaacgccctccagagcgggaactcacaagaaagcgtcaccgaacaagacagcaaagactcaacctacagcctaagctccaccctaaccctaagcaaagccgactacgaaaaacacaaagtctacgcctgcgaagtcacccaccaaggcctaagctcgcccgtaaccaaatccttcaaccgaggcgaatgc

SEQ ID NO: 53652 - RNA, 675 nt, synthetic construct
  misc_feature 1..675: note = derived and/or modified sequence opt11 from Citatuzumab_bogatox_HeavyChain1
  source 1..675: mol_type = other RNA
caccaccaccaccatcacgaagtacaactcgtacaatccggccccggcctcgtccaacccggcggatccgtccgcatctcatgcgccgcctccggctacacattcacaaactacggcatgaactgggtaaaacaagcccccggcaaaggcctcgaatggatgggctggatcaacacatacaccggcgaatcaacctacgccgactccttcaaaggccgattcaccttctcactagacacctccgcatccgccgcctacctccaaatcaactccctacgcgccgaagacaccgccgtctactactgcgcccgcttcgccatcaaaggcgactactggggccaaggcaccctcctcaccgtctcatcagcatccaccaaaggcccctccgtcttccccctcgccccctcctccaaatcaacctccggcggaaccgccgccctcggttgcctcgtcaaagactacttcccagaacccgtcaccgtctcctggaactccggcgccctcacctccggcgtccacaccttccccgccgtcctccaatcatccggcctttactctctctcctccgtcgtcaccgtcccatcctcctctctcggcacccaaacctacatatgcaacgtcaaccacaaaccctccaacacaaaagtcgacaaaaaagtagaaccaaaatcctgc

SEQ ID NO: 53653 - RNA, 1443 nt, synthetic construct
  misc_feature 1..1443: note = derived and/or modified sequence opt11 from Citatuzumab_bogatox_LightChain1
  source 1..1443: mol_type = other RNA
gacatacaaatgacccaatccccatcctcactctccgcctcagtcggcgacagagtcacaattacctgccgaagcaccaaatccctcctccactcaaacggcatcacatacctgtactggtaccaacaaaaacccggcaaggcccccaaactcctcatctaccaaatgtccaaccttgcctccggagtaccctcccgcttctcgagctcaggctctggcaccgactttaccctcaccatctcctctctccaacccgaggacttcgccacatactactgcgcccaaaacctcgaaatcccccggacattcggtcaaggaaccaaagtcgagctcaaacgaacagtcgccgcccccagcgtcttcatcttcccaccctcggacgaacaactcaaatccggaacagcctctgtagtctgcctcctcaacaacttctacccccgagaagccaaggtacaatggaaggtagacaacgccctccagtcaggaaactcacaagagtcagtcacagaacaagactccaaagactctacctactccctcagttcgacccttaccctaagcaaagccgactacgaaaaacacaaagtctacgcctgcgaagtaacccatcaaggcctatcctcgccagtgacaaaatccttcaaccgcggcgaatgcacccgccatcgccaacctcgaggctgggaacaactctacaacaccgtatcattcaacctaggggaagcctacgagtaccccacattcatccaagacctacgcaacgaactcgccaaaggtaccccagtctgccaactaccagtcacactccaaaccatcgccgacgacaaacgtttcgtcctagtcgacatcaccaccaccagcaaaaagaccgttaaagttgccatcgacgtcaccgacgtctatgtcgtcggctaccaagacaaatgggacggcaaagaccgcgccgtattcctcgacaaagtccccaccgtcgccaccagcaaactcttccccggagttaccaaccgcgtcacactcaccttcgacggatcgtaccaaaagctcgtcaacgccgcaaaagcggaccggaaagccctagaacttggagtcaataaactggaattttccatagaagccatccatggcaaaaccataaacggacaagaagccgccaaattcttcctaatcgtcatccaaatggtcagcgaagctgcccgattcaaatacatcgaaacagaagtcgtagaccgcgggctctacgggtccttcaaacccaactttaaagtcctcaacctagaaaacaactggggcgacatcagcgacgccatccacaaatcctctccacaatgcaccacaatcaaccccgccctccaactcatctcaccctccaacgacccctgggtcgtcaacaaggtatcccaaatcagccctgacatgggcatcttaaagttcaaaagctcaaaa

SEQ ID NO: 53654 - RNA, 1380 nt, synthetic construct
  misc_feature 1..1380: note = derived and/or modified sequence opt11 from Cixutumumab_HeavyChain1
  source 1..1380: mol_type = other RNA
gaagtccaactcgtccaaagcggcgcagaagtcaagaaacccggatcttcagtaaaagtctcctgcaaagccagcggcggcacattctcctcatacgccatatcatgggtgaggcaagcccccggccaaggcctagaatggatgggcggcatcatccccatcttcggaacagccaactacgcacaaaaattccagggacgcgtcacaatcaccgcagacaaatccacctccacagcatacatggaactctcctccctcagatccgaggacaccgccgtatactattgcgcgcgcgcaccactccggttcctagaatggtccacccaagaccactactactactactacatggacgtctggggcaaaggcacaacagtcactgtctcctccgccagcaccaaaggacccagcgtattccccctcgcaccgagctcaaaatccacatccggcggaaccgccgccctcggctgcctagtaaaagactacttcccagaacccgtcaccgtctcctggaactcaggcgccctcacatcaggagtacacacattccccgcggtcctacaatctagcggcctctactctctctcctcagtcgtaacggtcccctcttcctccctcgggacacaaacctacatatgcaacgtaaaccataaacccagcaacaccaaagtagacaagaaagtcgaacccaaaagctgcgacaaaacccacacctgtcccccatgcccagcacccgaactactaggaggaccctccgtcttcctattcccacccaaaccaaaagacaccctcatgatctcacgcacacccgaagtaacctgcgtcgtcgtcgacgtcagccacgaggaccccgaagtcaaattcaactggtatgtcgatggcgtcgaagtacacaacgccaaaaccaaaccacgagaagaacaatacaactcaacctatcgtgtcgtctccgttctaaccgtattacaccaagactggctcaacggaaaagagtacaaatgcaaagtcagcaacaaagccctccccgcccccatcgagaaaaccatatccaaagcgaaaggccaacccagggaaccacaagtctacactctcccgccatcaagagaagaaatgaccaaaaaccaagtatcactaacctgcctagtcaagggcttttacccgagcgacatcgccgtcgaatgggaatccaacggccaaccagaaaataactacaaaaccaccccacccgtcctagacagcgacggatccttcttcctctactccaaactcaccgtcgacaaatcccgatggcaacaaggcaacgtcttctcctgctccgtaatgcacgaagccctccacaaccactacacccagaaaagcctctcactctctcccggcaaa

SEQ ID NO: 53655 - RNA, 642 nt, synthetic construct
  misc_feature 1..642: note = derived and/or modified sequence opt11 from Cixutumumab_LightChain1
  source 1..642: mol_type = other RNA
tcatcagaactaacacaagaccccgccgtctccgtcgccctcggacaaaccgtccgaatcacctgccaaggcgactccctacgctcatactacgcaacctggtaccaacaaaaaccaggacaagccccaatcctcgtcatatacggcgaaaacaaacgcccctccggcatcccagaccgcttctccggctcctcctctggcaacaccgcctcactcacaataaccggcgcacaagccgaagacgaagccgactactactgcaaatcccgcgacggctccggccaacacctagtcttcggcggcggcacaaaactcaccgtcctcggccaaccaaaagccgccccctccgtaaccctcttccccccctcctccgaagaactccaagccaacaaagccaccctcgtctgcctcatctccgacttctaccccggagccgtcaccgtcgcatggaaagccgacagctcccccgtaaaagccggcgtagaaaccaccaccccctccaaacaatcaaacaacaaatacgccgcctcctcctacctatccctcacccccgaacaatggaaatcccaccgctcctactcctgccaagtcacacacgaaggctccacagtcgaaaaaacagtcgcccccgccgaatgctcc

SEQ ID NO: 53656 - RNA, 1350 nt, synthetic construct
  misc_feature 1..1350: note = derived and/or modified sequence opt11 from Clazakizumab_HeavyChain1
  source 1..1350: mol_type = other RNA
gaagtccaactcgtcgaatcagggggaggcctcgtgcagcccggaggctccctacgcctcagctgcgccgcctcgggcttctccctctccaactactacgtcacctgggtccgccaagcacccgggaaaggtctggaatgggtcggaataatctacggctcagacgaaacagcctacgccacatcagccatcgggagattcaccatttcccgcgacaactccaaaaacaccctctacctccaaatgaacagcctccgcgcagaagacacagccgtctactactgcgcccgagacgactcaagcgactgggacgccaagttcaacctatggggccaaggcacacttgtcaccgtatcatccgcctctaccaaaggaccatccgtcttcccactcgccccatcctccaaaagcacctccggcggcaccgcagccctcggatgcctagtaaaggactacttccccgaacccgtcaccgtctcctggaactctggagccctaacatccggcgtacatacattcccagcagtcctccaatcatccgggctctactcactaagctcagtcgtcactgtccccagctcctcgctcggcacccaaacatacatctgcaacgtcaaccacaaaccctcaaacaccaaagtcgacaaacgcgtagaacccaaatcctgcgacaaaacccacacatgcccaccctgccccgcccccgaacttctcggcggcccttcagtcttcctctttcccccaaaaccaaaagatacactcatgatctcacgcaccccagaagtaacctgcgtcgtcgtcgacgtctcacacgaagaccccgaagtaaaattcaactggtacgtcgacggcgtagaagtacacaacgccaaaacaaagccccgagaagaacagtacgcctcaacataccgcgtagtctcagtcctcacagtcctccaccaagactggctgaacggaaaagaatacaaatgcaaagtctccaacaaagccctcccagcccccatagagaaaacaatctccaaagccaaaggccaaccccgcgaaccccaagtctacaccctcccaccctcacgcgaagaaatgaccaaaaaccaagtctccctaacctgcctcgtaaaaggcttctacccctccgatatagcagtcgaatgggaaagcaacggccaacccgaaaacaactacaaaacaaccccacccgtactcgactccgacggatcctttttcctttactccaaactaacagtcgacaaatcacgctggcaacaaggcaacgtattctcatgctccgtcatgcacgaagccctacacaaccactacacacaaaaatccctcagtctctcccccggcaaa

SEQ ID NO: 53657 - RNA, 651 nt, synthetic construct
  misc_feature 1..651: note = derived and/or modified sequence opt11 from Clazakizumab_LightChain1
  source 1..651: mol_type = other RNA
gccatacaaatgacccaatccccctcctccctctccgcctccgtcggcgaccgcgtcaccataacctgccaagcctcacaatccatcaacaacgaactctcatggtaccaacaaaaacccggcaaagcccccaaactcctcatctaccgcgcctcaaccctcgcctcaggagtcccctcccgcttctccggctccggctccggcaccgacttcaccctcaccatctcctccctccaacccgacgacttcgccacatactactgccaacaaggctactccctcagaaacatcgacaacgccttcggaggcggcaccaaagtcgaaatcaaacgtaccgtcgccgccccctccgtatttatcttcccaccctccgacgagcaactcaaatccggcaccgcctccgtcgtctgcctactaaacaacttctacccccgcgaagccaaagtccaatggaaagtcgacaacgccctacaatccggaaactcccaagaatccgtcaccgaacaagactccaaagactccacatactcactctcctcaaccctcaccttatctaaagccgactacgaaaaacacaaagtatacgcctgcgaagtcacccaccaaggcctctcctcccccgtcaccaaatccttcaaccgcggcgaatgc

SEQ ID NO: 53658 - RNA, 1347 nt, synthetic construct
  misc_feature 1..1347: note = derived and/or modified sequence opt11 from Clivatuzumab_tetraxetan_HeavyChain1
  source 1..1347: mol_type = other RNA
caagtccaattacaacaatccggcgccgaagtcaagaaacccggagcctctgtcaaagtctcctgcgaagccagcggatacaccttcccctcctacgtcctccactgggtcaaacaagcaccaggacaaggcctcgaatggatcggctacatcaacccttacaacgacggaactcaatacaacgagaaattcaaaggcaaagccaccctcacccgagacacctccatcaacaccgcctacatggaactctcccgcctacgatccgacgacacagccgtctactactgcgcacgcggtttcggaggctcatatggtttcgcatactggggccaaggcaccctcgtcaccgtctcctccgcctccaccaaaggcccctcagtcttccccctcgcccccagctccaaatccacgtcaggaggaaccgccgccctcggatgcctcgtcaaagactacttccccgaacctgtcaccgtctcatggaactccggcgcgctgacctcaggcgtacacacattccccgccgtcctccaatcctcaggcctctattctctctcgtcagtcgtcaccgtcccctcctcctcactgggcacccaaacctacatctgcaacgtaaaccacaaaccatccaacaccaaggtcgacaaacgtgtcgaaccaaaaagctgcgacaaaacccacacatgcccaccctgccccgcccctgaactcctaggaggcccctccgtcttcctatttcccccaaaaccaaaagacaccctcatgatatcccgcacccccgaagtcacttgcgtcgtcgtcgacgtcagccacgaagacccagaagtaaaattcaactggtacgtcgatggcgtcgaagtccacaacgcaaaaaccaaaccccgggaagaacaatacaactccacgtatcgcgtcgtatcggtactcacagtcctccaccaagactggctcaacggaaaagaatataaatgcaaagtttccaacaaagccctccccgcaccaattgagaaaaccatctcaaaagcaaaaggccaaccacgcgaaccacaagtctacacactacccccttcacgggaagaaatgaccaaaaaccaagtcagcctcacatgcctagtaaaaggtttctacccctcagacattgccgtcgaatgggaatcaaacggccaacccgaaaataactacaaaaccaccccaccagtcctagactccgacggttcattcttcctttactccaaactaacagtagacaaaagccgctggcaacaaggcaacgtcttctcctgctccgtaatgcacgaggctctccacaaccactacacccaaaaatcactatcactctccccaggcaaa

SEQ ID NO: 53659 - RNA, 645 nt, synthetic construct
  misc_feature 1..645: note = derived and/or modified sequence opt11 from Clivatuzumab_tetraxetan_LightChain1
  source 1..645: mol_type = other RNA
gatatacaactcacccaatccccctcctccctttccgcctcagtaggcgaccgcgtcaccatgacctgctccgcctcctcctccgtctcctcctcctacctctactggtaccaacaaaaacccggcaaagcccccaaactatggatctactccacctccaacctcgcctccggcgtccccgcccgcttctccggctctggctccggcacagacttcaccctcaccatctcctccctacaacccgaagactcagcatcctacttctgccaccaatggaaccgctacccctacaccttcggcggcggcacccgcctcgaaatcaaacgaaccgtcgccgccccctccgtcttcatcttcccaccctccgacgaacaactcaaatccggcaccgcctcagtcgtctgcctactcaacaacttctacccccgcgaagccaaagtccaatggaaagtcgacaacgccctccaatccggcaactcccaagaatccgtcaccgaacaagactccaaagactccacctactccctctcctccaccctcaccctctccaaagcagactacgaaaaacacaaagtctacgcctgcgaagtcacccaccaaggcctctcctcccccgtcaccaaatccttcaaccgcggcgaatgc

SEQ ID NO: 53660 - RNA, 1335 nt, synthetic construct
  misc_feature 1..1335: note = derived and/or modified sequence opt11 from Codrituzumab_HeavyChain1
  source 1..1335: mol_type = other RNA
caagtccagctcgtccaaagcggcgccgaagtcaagaaaccaggcgcttcagtcaaagtctcctgcaaagcctcaggctataccttcaccgactacgaaatgcactgggtccgccaagctccaggccaaggcttagaatggatgggcgcactcgaccccaaaaccggcgacaccgcctactcccaaaaattcaaaggccgcgtcaccctaaccgccgataaatcaacctcaaccgcctacatggaactctcctccctaacctccgaggacaccgccgtctactactgcaccagattctacagctacacctactggggacaaggcacactcgtcacagtgtcatccgcctccaccaaaggcccttcagtcttcccactcgccccctcctccaaatccacctcgggcggaaccgccgctctcggatgcctcgtcaaagactacttccccgaacccgtaacagtctcctggaactccggcgccctaacctccggagtccacacattccccgccgtcctccaatcctccggcctctactccctctcctccgttgtaaccgtcccctcatcctccctcggcacccaaacatacatctgcaatgtcaatcacaaaccctctaacaccaaggtggataaaaaggtcgaacctaaatcatgcgacaaaacccacacctgtccaccctgccccgcccccgagctcctcggcggccctagcgttttcctcttccctcccaaacccaaagacaccctaatgatctcacgcacccccgaagtaacctgcgtcgtcgtcgatgtcagccacgaagaccccgaagtcaaattcaactggtacgtcgacggtgtcgaagtccacaacgccaaaactaaaccccgcgaagaacagtataactccacctaccgcgtcgtatccgtcctcaccgtactccaccaggactggctaaatggcaaagaatacaaatgcaaagtcagcaacaaagccctacccgcacccattgagaaaaccatctccaaagctaaaggtcaaccccgggaaccccaagtctacacattaccaccctctagagacgaactcaccaaaaaccaagtctcactaacctgcctcgtgaaaggcttctatccctccgatatcgccgtcgaatgggaatccaacggccaacccgaaaacaattacaaaactacacccccagtcctcgactccgacggctccttcttcctctactccaaactcaccgtcgacaaatcccgctggcaacaaggcaacgtcttctcatgctccgtcatgcacgaagcgctccacaaccactacacccaaaaatcactctccctctccccaggcaaa

SEQ ID NO: 53661 - RNA, 657 nt, synthetic construct
  misc_feature 1..657: note = derived and/or modified sequence opt11 from Codrituzumab_LightChain1
  source 1..657: mol_type = other RNA
gacgtcgtcatgacccaatcacccctctccctccccgtcacccccggcgaacccgcctccatctcctgccgctcctcccaatccctcgtccactcgaacagaaacacatacctccactggtacctccaaaaacccggacaatccccacaactcctcatctacaaagtctccaaccgcttctccggcgtccccgaccgattctccggctccggctccggcaccgacttcacccttaaaatctcccgcgtcgaagccgaagacgtcggcgtctactactgctcccaaaacacccacgtcccacccaccttcggacaaggcaccaaactcgaaatcaaacgcaccgtcgcagcaccctccgtcttcatcttcccaccctccgacgagcaactcaaatccggcacagcctccgtcgtctgcctcctcaacaacttctacccccgcgaagcaaaagtccaatggaaagtcgacaacgccctccaatccggcaactcccaagaatccgtcaccgaacaagactccaaagattccacctactccctatcctccaccctcaccctatccaaagccgactacgaaaaacacaaagtctacgcctgcgaagtcacccaccaaggcctctcctcccccgtcaccaaatccttcaaccgcggcgaatgc

SEQ ID NO: 53662 - RNA, 1350 nt, synthetic construct
  misc_feature 1..1350: note = derived and/or modified sequence opt11 from Coltuximab_ravtansine_HeavyChain1
  source 1..1350: mol_type = other RNA
caagtacagctagtccagccaggcgccgaagtagttaagccaggagcctccgtaaaactatcctgcaaaacctccggctacacattcacctcaaactggatgcactgggtcaaacaagcccccggccaaggccttgaatggatcggagaaatcgatccctcagactcctacaccaactacaaccaaaacttccaaggcaaagctaaactcaccgtagacaaatctaccagcaccgcctacatggaagtctcctccctccgctccgacgacacggcagtctactactgcgcccgcggatccaacccttactactacgccatggactactggggacaaggcacctccgtgaccgtttcctccgcatctaccaaaggcccctccgtcttccccttagccccctcatccaagtccacatctggcggaaccgccgcactcggctgcctcgtcaaagactacttccccgaacccgtcactgtctcatggaactcaggcgcacttacttcaggcgtacacaccttccccgctgtgctccaatcctcaggcctctactccctctcctcagtcgtcaccgttccatcatccagtctaggcacccaaacatatatctgcaacgtaaaccacaaaccctctaacaccaaagtggacaagaaagtcgaacccaaatcatgtgacaaaacccatacctgcccaccgtgccccgccccagaactactcggcggcccatccgtcttcctattcccacccaaaccaaaagacaccctcatgatatcccgcacccccgaagtcacctgtgtagttgtcgacgtctcacacgaagaccccgaagtcaaattcaactggtacgtagacggcgtagaagtccacaacgcaaaaaccaaaccaagagaagaacaatacaactccacctaccgcgtagtctctgtactcacagtcctccaccaagactggctcaacggcaaagaatataaatgcaaagtatccaacaaagccctccccgccccaatcgagaaaaccatctccaaagccaaaggccaaccccgagaaccccaagtctacacccttcccccatcccgcgacgaactcaccaaaaaccaggtctcccttacctgcctcgtcaaaggcttctacccatcagacatcgcagtcgaatgggaaagcaacggccaacccgaaaacaactacaaaaccacacccccagtactagactccgacggatccttcttcctctactccaaactcaccgtcgataaatcacgctggcaacaaggaaacgtcttctcttgctcagtcatgcacgaagcactccacaaccactacacccaaaaatccctctcccttagtcctggcaaa

SEQ ID NO: 53663 - RNA, 633 nt, synthetic construct
  misc_feature 1..633: note = derived and/or modified sequence opt11 from Coltuximab_ravtansine_LightChain1
  source 1..633: mol_type = other RNA
gaaatagtcctcacccaatcccccgccatcatgtccgcctctcccggcgaacgcgtaaccatgacctgctccgcctcctccggcgtcaactacatgcactggtaccaacaaaaacccggcacctcaccccgacgctggatctacgacacctccaaactagcctccggcgtcccagcccgcttctcaggctccggctccggcaccgactactccctcaccatatcctcaatggaacccgaagacgccgccacatactactgccaccaacgaggatcatataccttcggcggcggcaccaaactcgaaatcaaacgcaccgtcgccgccccctccgtcttcatcttcccaccctccgacgaacaactcaaatcaggcaccgcctccgtcgtctgcctactcaacaacttctacccccgcgaagcaaaagtccaatggaaagtcgacaacgccctacaatccggcaactcccaagaatccgtcaccgaacaagactccaaagactcaacatactcactctcctccaccctcaccctatccaaagccgactacgaaaaacacaaagtctacgcctgcgaagtcacccaccaaggcctatcctcccccgtaaccaaatccttcaaccgaggcgaatgc

SEQ ID NO: 53664 - RNA, 1356 nt, synthetic construct
  misc_feature 1..1356: note = derived and/or modified sequence opt11 from Conatumumab_CV_HeavyChain
  source 1..1356: mol_type = other RNA
caagttcaactacaagaatccggccccggtctcgtcaaaccttcacaaaccctctccctcacatgtactgtctcaggcggatcaatctcctcaggagactacttctggagctggatccgccaactccccggcaaaggcctcgagtggatcggccacatacacaactccggcaccacctactacaacccatccctcaaatcccgcgtcacaatatccgtagacacatcaaagaaacaattctccctgcgcctttcgtcagtcaccgcagccgacaccgccgtatactactgcgcccgcgaccgaggaggcgattactactacggcatggacgtctggggccaaggaaccactgtcaccgtctcatcagcctccaccaaaggaccctcagtattccccctagcacccagctccaaatctacgtccggcggcaccgcagccctcggctgcctcgtcaaagactacttccccgaacccgtaaccgtctcctggaactcaggagcgctcacctccggagtccacacattcccagccgtactccaatcctccggcctctactctctctcctccgtcgtaacggtcccatcctcttcccttggcacccaaacctacatctgcaacgtcaatcacaaaccctcaaacaccaaagtcgacaagcgcgtcgaacccaaatcctgcgacaaaacacacacatgcccaccctgccccgccccagaactactcggaggccccagcgttttcctcttcccgcccaaacccaaagacaccctaatgatctcacgtactcccgaagtaacctgcgtcgtcgtcgacgtctcccacgaagaccccgaagtaaagttcaactggtacgtcgacggtgtcgaagtgcacaacgctaagaccaaaccacgagaagaacaatacaactcaacctacagagtcgtctccgtactcaccgtcctccatcaagactggctcaacggcaaagaatacaaatgcaaagtctccaacaaagctctcccagccccaatcgagaaaaccatatcaaaagccaaaggccaacctcgtgaaccacaagtctacacactcccaccctccagagaagaaatgaccaaaaaccaagtctccctcacatgcctcgtcaaaggcttctatcccagcgacattgccgtcgaatgggaatctaacggccaacccgaaaacaactacaaaaccacaccgccagttcttgactccgacggctcattcttcctctactccaaactcaccgtcgacaaatcccggtggcaacaaggcaacgtattttcctgtagtgtcatgcacgaagccctccacaaccactacacccagaaaagcctctctctatcacccggcaaa

SEQ ID NO: 53665 - RNA, 645 nt, synthetic construct
  misc_feature 1..645: note = derived and/or modified sequence opt11 from Conatumumab_CV_LightChain
  source 1..645: mol_type = other RNA
gaaatcgtcctcacccaatcccccggcaccctctccctctcccccggcgaacgcgcaaccctctcctgccgcgcctcacaaggcatctcccgctcatacctcgcctggtaccaacaaaaacccggccaagccccctccctcctcatctacggcgcatcctcccgcgccaccggcatccccgaccgcttctccggctccggctccggcaccgactttaccctcaccatctcccgcctcgaacccgaagacttcgccgtctactactgccaacaattcggctcctccccctggaccttcggccaaggcacaaaagtcgaaatcaaacgcaccgtcgccgcccccagcgtcttcatcttcccaccctccgacgaacaactaaaatcaggcaccgcctccgtcgtctgcctcctcaacaacttctacccccgcgaagcaaaagtccaatggaaagtcgacaacgccctccaatccggcaactcccaagaatccgtaaccgaacaagactccaaagactccacctactccctctcctccaccctcaccctgtccaaagccgactacgaaaaacacaaagtctacgcatgtgaagtaacccaccaaggcctctcctcccccgtcaccaaatccttcaaccgaggcgaatgc

SEQ ID NO: 53666 - RNA, 1356 nt, synthetic construct
  misc_feature 1..1356: note = derived and/or modified sequence opt11 from Conatumumab_HeavyChain1
  source 1..1356: mol_type = other RNA
caggtccaactccaagagtctggccccggcctagtcaaaccatcacaaaccctctccctcacatgcaccgtctccggaggctcaatctcctctggcgattacttctggtcctggatccgacagctccctggaaaaggcctcgaatggatcggacacatacacaactcaggtacaacctactacaacccctccctcaaatcccgagtcaccataagcgtcgacacctccaagaaacaattctccctaagactatccagcgtcaccgcagccgacacagcagtctactattgcgcccgagacagaggcggcgactactactacggcatggacgtctggggccagggtaccaccgtcaccgtctcctccgcctccactaaaggcccttcagtcttccccctcgccccctcctccaaatccacctccggcggaaccgccgccctaggatgcctcgtcaaagactatttccccgaacccgtcaccgtctcctggaactccggcgcactcacctcaggcgtccacacattccccgcagtcctccaatcctcaggcctctactcactcagctccgtcgtcaccgtccccagctcatcactcggcacccaaacctacatatgcaacgtcaaccataaaccctccaacaccaaagtcgacaaacgagtagaacccaaaagctgcgacaaaacacacacctgtcctccctgccccgcacccgaactcctcggaggcccctccgtattcctcttcccacccaaacccaaagacacactaatgatctcccgcacccccgaagtaacatgcgtcgtagtagacgtctctcacgaggaccccgaagtcaaattcaactggtacgtcgacggagtcgaggtacacaacgcaaaaacaaaaccccgcgaggaacaatacaactccacctaccgcgtagtaagcgtcctaacagtcttacaccaagactggctcaacggtaaagaatacaaatgtaaagtttcaaataaagcactacccgctccaatagagaaaaccatatctaaagctaaaggtcaaccccgtgaaccccaagtctacacactcccaccctctcgcgaagaaatgaccaaaaaccaagtctccctcacctgtctagtcaaaggcttctacccctccgacatagccgtcgaatgggaatcaaacggccaacccgaaaacaactacaaaactacaccaccagtcctcgactccgacggctcattcttcctctacagcaaactcaccgtcgacaaatcacgctggcaacaaggcaacgtcttctcctgctccgtaatgcacgaagccctccacaaccattacacccaaaaatccctaagcctctccccaggcaaa

SEQ ID NO: 53667 - RNA, 1356 nt, synthetic construct
  misc_feature 1..1356: note = derived and/or modified sequence opt11 from Conatumumab_HeavyChain
  source 1..1356: mol_type = other RNA
caggtccaactccaagaatccggccccggcctcgtcaaaccctcccaaacactgtccctcacatgcacagtttccggaggctccatatcatcaggagactacttctggtcatggataagacaactccccggcaaaggactcgaatggatcggccacatccacaactccggcacaacatactacaacccctccctcaagtcacgcgtaaccatctcagtcgacacctccaagaaacaattcagcctacgactatcctctgtcacagccgccgacacagccgtctactactgcgcccgcgaccgcggcggcgactactactacggcatggacgtctggggccaaggcaccaccgtcactgtcagctccgcctccaccaaaggcccctccgtcttcccacttgcaccctcctccaaaagcacctcaggcggaacagccgccctcggctgcctcgtcaaagactacttccccgaacccgtcaccgtatcatggaactcgggagcactcacctccggcgtccacacattccccgccgtgctccaatcctcgggcctatactccctctcctccgtcgtcacagtcccatcctcttctttaggaacccaaacttacatctgcaacgtcaaccacaaaccatcaaacaccaaagtcgacaaacgcgtcgaacccaaatcatgcgacaaaacccatacctgcccaccctgccccgcacccgaactactaggcggtccctcagtcttcttattcccacccaaacccaaagacacactcatgatctcccgcacccccgaagttacctgcgtcgtagtcgacgtctcacacgaagacccagaagtcaaattcaactggtacgtagacggagtagaagtacacaacgccaaaacaaaaccccgcgaagaacaatacaactccacataccgagtcgtttccgtactcaccgtactccaccaagactggctcaacggcaaagaatacaaatgcaaagtaagcaacaaagcactccctgccccaatcgagaaaactatatccaaagcaaaaggccaacctcgcgaaccccaggtctacaccctcccaccctcacgcgaagaaatgaccaaaaaccaagtatcattgacctgcctcgttaaaggattctacccctccgacatcgccgtggaatgggaatccaacggacaacccgaaaacaactacaaaaccacacccccagtcctcgacagcgacggctccttctttctatacagcaaactcacagtcgacaaatcacgctggcaacaaggcaatgtcttctcttgctccgtcatgcacgaagccctacacaaccattacacacaaaaatccctttccctatccccaggcaag

SEQ ID NO: 53668 - RNA, 645 nt, synthetic construct
  misc_feature 1..645: note = derived and/or modified sequence opt11 from Conatumumab_LightChain1
  source 1..645: mol_type = other RNA
gaaatagtccttacccaatcccccggcaccctatccctctcgcccggcgaacgtgccaccctctcctgccgcgcctcacaaggcatctcccgttcatacctcgcctggtaccaacaaaaacccggccaagctccctccctactaatctacggcgcctcctcacgagccaccggaatccccgaccgcttctccggctccggctccggcaccgacttcaccctcaccatctcccgcctagaacccgaagacttcgccgtctactactgccaacaattcggctcatccccatggacattcggccaaggcacaaaagtagaaatcaaacgaaccgtcgccgccccctccgtcttcatcttcccaccctccgacgaacaactcaaatccggcaccgcctccgtcgtctgcctactcaacaacttctacccccgcgaagccaaagtccaatggaaagtcgacaacgccctccaatccggcaactcccaagaatccgtcaccgaacaagactccaaagactccacctactccctatcctccaccctaaccctatcaaaagccgactacgaaaaacacaaagtatacgcctgcgaagtcacccaccaaggcctctcctcaccagtaaccaaatccttcaaccgcggagaatgc

SEQ ID NO: 53669 - RNA, 645 nt, synthetic construct
  misc_feature 1..645: note = derived and/or modified sequence opt11 from Conatumumab_LightChain
  source 1..645: mol_type = other RNA
gaaatagtactcacccaatcccccggaaccctctccctctcacccggcgaacgcgccaccctctcctgccgagcctcccaaggcatctcccgctcctacctcgcctggtaccaacaaaaaccaggccaagccccctccctactaatctacggagcatcctcccgcgccaccggcatccccgaccgcttctccggctccggctccggcaccgacttcaccctcaccatctcccgcctcgaaccagaagacttcgccgtatactactgccaacaattcggctcctccccctggacattcggccaaggcaccaaagtcgaaatcaaacgcaccgtcgccgccccctcagtcttcatcttcccaccctccgacgaacaactaaaatccggcaccgcctccgtcgtatgcctactcaacaacttctacccccgcgaagccaaagtacaatggaaagtcgacaacgccctccaatccggcaactcccaagaatccgtaaccgaacaagactctaaagactccacctacagcctctcctccacactaaccctctccaaagccgactacgaaaaacacaaagtctacgcctgcgaagtcacccaccaaggcctctcctcccccgtcaccaaatccttcaaccgcggcgaatgc

SEQ ID NO: 53670 - RNA, 1344 nt, synthetic construct
  misc_feature 1..1344: note = derived and/or modified sequence opt11 from Concizumab_HeavyChain1
  source 1..1344: mol_type = other RNA
gaagtccaactcgtcgaatcaggcggcggcctagtaaaacccggaggatccctccgtctctcatgcgccgcctccggattcaccttctccaactacgccatgtcttgggtacgccaaaccccagaaaaacgcctcgaatgggtagcaaccatctccagatccggttcctactcctactttcccgactccgtccaaggccgcttcaccatctcccgcgacaacgctaaaaactccctctacctacaaatgaactcactaagagcagaggacacagcagtctactactgcgcccgactaggaggctacgacgaaggcgacgctatggactcctggggccaaggcaccaccgtcaccgtatcaagcgcctcaaccaaaggaccttccgtcttcccactcgccccctgctcacgctccacatcagaatccacagccgcccttggctgtctcgtaaaagactacttcccagagccagtcaccgtatcctggaacagcggggccctaacctcaggcgtgcacaccttccccgccgtcctccagtcttcaggcctctactccctctcatccgtcgtcaccgtacccagctcctcactcggcaccaaaacctacacatgcaacgtcgaccacaagccctccaacaccaaagtagataaacgcgtcgaatcaaaatacggcccaccatgccctccctgccccgcaccagagttcctaggaggcccttctgtcttcctatttcccccaaaacccaaagacaccctaatgatatcccgcacccccgaagtaacctgcgtcgtcgtcgatgtctcccaagaagaccccgaagtccaattcaactggtacgtcgacggcgtcgaagtccacaatgcaaaaaccaagccacgcgaagaacaattcaactccacataccgtgtcgtctccgtccttaccgtcctccaccaagactggctaaacggaaaagaatacaaatgcaaagtatccaacaaaggcctcccctcttcaatagagaaaaccatatctaaagcaaaaggccagccacgcgaaccacaagtgtacacccttcctccctcccaagaagaaatgaccaaaaaccaagtctccctaacctgcctagtcaagggcttctacccctcagacatagcagtcgaatgggaatccaacggccaacccgaaaacaactacaaaacaacaccccctgttctagactccgacggatcattcttcctctactcccgtctcaccgtagacaaatcacgatggcaagagggcaacgtcttctcctgctcagtaatgcacgaagcactccacaaccactacacccaaaaatccctatccctctccctcggaaaa

SEQ ID NO: 53671 - RNA, 657 nt, synthetic construct
  misc_feature 1..657: note = derived and/or modified sequence opt11 from Concizumab_LightChain1
  source 1..657: mol_type = other RNA
gacatagtcatgacccaaacacccctctcactctccgtcaccccaggccaacccgcatcaatctcctgcaaatcctcccaatcactcctagaatccgacggcaaaacctacctcaactggtacctccaaaaacccggccaatctccccaactactcatctacctcgtctccatcctcgactccggagtccccgaccgattctccggctccggatccggcaccgacttcaccctcaaaatctcccgagtcgaagcagaagacgtcggcgtatactactgcctccaagccacacacttcccccaaaccttcggcggcggcaccaaagtcgaaatcaaacgcacagtcgccgccccctccgtcttcatcttcccaccctccgacgaacaactaaaatcaggcaccgcctccgtcgtctgcctcctcaacaacttctacccccgtgaagccaaagtccaatggaaagtcgacaacgccctccaatccggcaactcccaagaatccgtcaccgaacaagactccaaagactccacctactccctctcctccaccctcaccctctccaaagccgactacgaaaaacacaaagtctacgcctgcgaagtcacccaccaaggcctctcctcccccgtcaccaaatcattcaaccgcggcgaatgc

SEQ ID NO: 53672 - RNA, 1314 nt, synthetic construct
  misc_feature 1..1314: note = derived and/or modified sequence opt11 from Crenezumab_HeavyChain1
  source 1..1314: mol_type = other RNA
gaagtgcaacttgttgaatccggcggaggcctcgtccaacccggcgggtccttgcgactcagctgcgccgcatccggctttacattctcatcctacggtatgagctgggtccgacaagcgcccggcaaaggactcgaacttgtcgccagcataaactccaacggcggctcaacatactaccccgactccgtgaaaggacgcttcacaatatcccgagacaatgccaaaaactcactatacctacaaatgaactccctccgcgccgaagacaccgcagtctactactgcgcatccggcgactactggggccaaggaaccacggtcacagtcagctcggcttctaccaaaggacccagcgtcttccccctagccccctgctcacgcagcacatccgaatccaccgccgccctcggttgcctagtcaaagactacttcccggaacccgtcacggtctcctggaactccggagcccttacctccggcgtccacaccttccccgccgtattacagtcctcaggactatactcactctcgagcgtggtcaccgtacccagctccagcctaggcaccaaaacctacacgtgcaacgtcgaccacaaaccctccaacaccaaagtggacaaacgcgtggaatcaaaatacggcccaccctgtcccccatgcccagcccctgaatttctcggaggcccctcagtattcctcttcccacccaaacccaaagacaccctcatgatctccagaacacccgaagtaacctgcgtcgtcgtagacgtatcccaagaagaccccgaagtccaattcaactggtacgtagacggcgtggaagtccacaacgccaaaacaaaacctcgcgaagaacaattcaactccacataccgcgtcgtctccgtccttaccgtactccaccaagactggctcaacggaaaagaatacaaatgcaaagtctcaaacaagggactaccctcaagcatcgaaaagaccatctccaaagccaaaggccagccacgagaaccacaagtctacacactaccaccctcccaagaagaaatgaccaaaaaccaggtctcgctcacatgcctcgtcaaaggcttctacccctccgacatagcagtcgaatgggaatccaacggtcaacccgaaaacaactacaaaaccacaccacccgtcctagactccgacggcagcttcttcctctactcccgactgaccgtcgacaaatcacgctggcaggaaggcaacgtattctcttgctccgtcatgcacgaagccctacataaccactatacccaaaaatccctatcactctcactcgga

SEQ ID NO: 53673 - RNA, 657 nt, synthetic construct
  misc_feature 1..657: note = derived and/or modified sequence opt11 from Crenezumab_LightChain1
  source 1..657: mol_type = other RNA
gacatcgtaatgacccaatccccactctccctccccgtcacacccggcgaacccgcctccatctcctgccgctcctcccaatcactcgtatactccaacggcgacacttacctccactggtacctacaaaaacccggccaatcaccccaactcctaatctacaaagtctccaaccgattctccggcgtccccgaccgcttctccggctcaggctccggcacagacttcaccctcaaaatctcccgagtagaagccgaagacgtcggcgtctactactgctcccaatccacccacgtcccctggacattcggccaaggcaccaaagtcgaaatcaaacgcacagtcgcagccccctccgtcttcatcttcccaccctccgacgaacaactaaaatccggcaccgcctccgtcgtctgcctcctcaacaacttctacccccgcgaagcaaaagtccaatggaaagtcgacaacgccctccaatccggcaactcacaagagtccgtaaccgaacaagactccaaagactccacctactccctctcatccaccctcaccctttccaaagccgactacgagaaacacaaagtctacgcctgcgaagtcacacaccaaggcctaagctcccccgtcacaaaatccttcaaccgaggcgaatgc

SEQ ID NO: 53674 - RNA, 1365 nt, synthetic construct
  misc_feature 1..1365: note = derived and/or modified sequence opt11 from Crotedumab_HeavyChain1
  source 1..1365: mol_type = other RNA
gaagtccaactcgtcgaatcaggcggaggcctcgtacaacccggcgggtcactccgcctaagctgcgccgcctccggcttcaccttctccaattacctcatgaactgggtaagacaagcccccggcaaaggcctcgaatggctagcaaatatccaggaagacggcatagaaaaatactacgtcgactccgtcaaaggccgcttcacaataagccgcgacaacgccaaaaactcactctacctacaaatgaactcactacgcgccgaagacaccgccgtctactactgcgccagggaaccctcccactacgacattctaacaggatacgactattactacggaatggacgtctggggacaaggaacaaccgtcacagtctcatccgcatctacaaaaggtccctccgtattccccctagcaccctgctcccgctcaacatcagaatcgaccgcagcactgggctgcctcgtaaaagactacttccccgaacctgttaccgttagcaacaactccggcgctctaacaagcggcgtacacaccttcccagcagtactccaaagctccggcctttattccctatcctcggtagtcaccgtcccctcctcctcccttggcaccaaaacatacacatgcaacgtagaccacaagccaagcaacaccaaagtcgataagcgcgtggaaagcaaatacggaccaccctgcccgccctgccccgcccccgagttcctcggaggccccagcgtcttcctcttcccaccaaaacccaaagacaccctcatgatctcacgaacccccgaagtaacctgcgtagtcgtcgacgtatcacaagaagaccccgaggtccaattcaactggtacgtcgacggcgtagaggtccacaacgctaaaaccaaaccccgagaagaacaattcaactccacctaccgcgtcgtgtcagtactaactgtcctacaccaagactggctcaacggaaaagaatacaaatgcaaagtcagcaacaagggcctccccagttccatcgagaaaaccataagcaaagccaaaggccaaccccgagaaccccaagtctacaccctaccaccctcccaagaagaaatgaccaaaaaccaagtctccctaacatgcctagtcaagggcttctacccctcagacattgcagtcgaatgggaatccaacggccagcccgaaaacaactacaaaaccaccccacccgtcctagactcagacggctccttcttcctatactcccgactcacagtcgacaaatcaagatggcaagaaggcaacgtcttctcctgctcagtcatgcacgaagccctccacaaccactacacccaaaaatccctctccctctcactcggcaaa

SEQ ID NO: 53675 - RNA, 1365 nt, synthetic construct
  misc_feature 1..1365: note = derived and/or modified sequence opt11 from Crotedumab_HeavyChain2
  source 1..1365: mol_type = other RNA
gaagtccagctcgtcgaatccggcggaggcctagtacaacccggaggctccctccacctctcatgcgccgcatccggcttcaccttctccaactacctcatgaactgggtcagacaagcccccggcaaaggcctcgaatggctagccaacatacaggaagacggaatcgaaaaatactacgttgacagcgtaaagggcagattcaccatctccagagacaacgccaaaaattccctctaccttcaaatgaactccctacgcgccgaagacacagccgtctactactgcgcccgcgaaccctcacactacgacatactgacgggctacgactactactacggcatggacgtctggggccaaggcaccaccgtaacggtctcctccgcaagcaccaaaggaccatctgtctttcccctagccccctgctcacggtccacctcagaatcaaccgctgccctgggctgcctcgtcaaagactacttcccagaacccgtcacagtatccaacaactctggcgccctcacctctggcgtacatacattccccgcggtcctccaatcatccggtctctactccctaagctcagtcgtcaccgtcccaagctcctccctcggcaccaaaacatacacatgcaacgtcgaccacaaaccctcaaacaccgaagtcgacgaacgcgtagaatccaaatacggacccccgtgtcccccatgccccgcccccgaatttctaggaggccccagcgtcttcctcttcccacccaaacccaaagacacactcatgatcagccgaaccccagaagtaacctgcgtcgtcgtcgacgtctcacaagaagaccccgaagtccaattcaactggtacgtcgacggcgtcgaagtccacaacgccaaaaccaaaccccgcgaagaacaattctggtcaacctaccgggtcgtctcagtcctaacagtccttcaccaagactggctcaatggaaaagaatacaaatgtaaagtctccaacaaaggactcccatcctcaatcgagaaaaccatctcaaaagccaaaggccaaccacgcgaaccccaagtatacaccctgcccccttcacaagaagaaatgactaagaaccaagtatccctaacctgcctcgtcaaaggcttctacccctccgacatcgccgtcgaatgggaaagcaacggccaaccagaaaacaactacaagaccactcccccagtcctcgactctgacggctccttcttcctctactcccgactcaccgtcgatgaaagccgatggcaagaacacaacgtcttctcctgcagcgtcatgcacgaagccctgcacaaccactacacacaaaaatcactatcactctcactaggaaaa

SEQ ID NO: 53676 - RNA, 642 nt, synthetic construct
  misc_feature 1..642: note = derived and/or modified sequence opt11 from Crotedumab_LightChain1
  source 1..642: mol_type = other RNA
gacatccaaatgacacaatccccctcctccctctccgcctccgtcggcgaccgcgtcaccatcacctgccgcgcaagccaaggcatcagaaacgacctcggctggtaccaacaaaaacccggcaaagcacccaaacgcctcatatacgccgcctcctcactccaatccggcgtcccctcccgcttctccggctccggctccggcaccgaattcatcctcaccgtctcatccctccaacccgaagacttcgccacctattactgcctccaatacaacgaaaaccccttcaccttcggccccggcaccaaagtcgacatcaaacgcaccgtcgccgcccccagcgtcttcatcttccccccctccgacgaacaactcaaatccggcaccgcctccgtcgtctgcctcctcaacaacttctacccccgcgaagccaaagtacaatggaaagtcgacaacgcactccaatcaggcaactcacaagaatccgtcaccgaacaagactccaaagactcaacctactccctctcctcaaccctcaccctatccaaagccgactacgaagaacacaaagtctacgcctgcgaagtcacacaccaaggcctctcctcacccgtaaccaaatccttcaaccgcggcgaatgc

SEQ ID NO: 53677 - RNA, 642 nt, synthetic construct
  misc_feature 1..642: note = derived and/or modified sequence opt11 from Crotedumab_LightChain2
  source 1..642: mol_type = other RNA
gacatccaaatgacccaatccccctcctcccttagcgcatccgtcggcgaccgcgtcaccatcacctgccgcgcctcacaaggcatccgcaacgacctcggatggtaccaacaaaaacccggcaaagccccaaaacgcctcatctacgccgcctcctccctccaaagcggcgtcccctcccgcttctccggctccggctccggcaccgaattcatcctaaccgtctcctccctacaaccagaagacttcgccacctactactgcctacaatacaactccaaccccttcacattcggccccggaaccaaagtcgacatcaaacgcacagtcgcagccccctccgtcttcatattcccaccctccgacgaacaactaaaatcaggaaccgcctccgtcgtctgcctactaaacaacttctacccccgcgaagcaaaagtccaaaacaaagtcgacaacgccctccaatccggcaactcccaagaatccgtcaccgaacaagactccaaagactccacctattccctctcctccaccctaaccctatccgaagccgactacgaaaaacacaaagtatacgcctgcgaagtaacccaccaaggcctctcctcacccgtaaccaaatccttcaaccgaggcgaatgc

SEQ ID NO: 53678 - RNA, 1332 nt, synthetic construct
  misc_feature 1..1332: note = derived and/or modified sequence opt11 from Dacetuzumab_HeavyChain1
  source 1..1332: mol_type = other RNA
gaagtccaactcgtcgaatccggcgggggcctggtccaacccggaggatctctccgcctatcatgcgccgcctcaggctactccttcacaggctactatatccactgggtacgccaagcacccggaaaaggactagaatgggtagcccgcgtcatcccaaacgccggcggcacctcatacaaccagaaattcaaaggtcgtttcacactatcagtagacaacagcaaaaacacagcctacctccaaatgaactcactcagagccgaggacaccgcagtctactactgcgccagagaaggtatatactggtggggccaaggtacactcgtcaccgtctcatccgcaagtaccaaaggcccttccgtcttccccctagccccctcctcaaaatctacatccggcggaaccgccgccctcggctgcctcgtcaaagactacttccccgagcccgtaaccgtctcctggaactcaggcgccctcacatccggagtccacactttcccagccgtactccaaagctccggcctctacagcctcagctcagtcgtcaccgtcccctcatccagcttaggaacccaaacctacatctgcaacgtaaaccacaaaccctcaaacaccaaagttgacaagaaagtagagcccaaatcctgcgataaaacccacacttgcccaccatgcccagccccagaactcctaggaggcccctccgtattcctcttccctcccaaacccaaagacaccctaatgatctcacgtacaccagaggtaacctgcgtcgtcgtcgacgtcagccacgaagaccccgaggtcaaattcaactggtacgtggatggcgtcgaagtacacaatgccaaaacaaaacctcgggaagaacaatacaactcaacctacagagtcgtctccgtcctcaccgttctacaccaagactggctcaatggcaaagaatacaaatgcaaagtctccaacaaagctctccccgcccccatcgagaaaaccatatcaaaagcaaaaggccaacccagagaaccccaagtctacaccctcccaccctcccgcgaagaaatgaccaaaaaccaggtatccctaacatgcctcgtaaaaggcttctacccaagcgacatcgccgtagaatgggaaagcaacggtcagccagaaaacaactacaaaaccacaccacccgtcctcgactccgacggatccttcttcctatactccaaactcacagtagacaaaagccgctggcaacaaggaaacgtcttcagctgctcagtcatgcacgaggccctccacaatcactacacccaaaaatccctctccctctcccccgggaaa

SEQ ID NO: 53679 - RNA, 657 nt, synthetic construct
  misc_feature 1..657: note = derived and/or modified sequence opt11 from Dacetuzumab_LightChain1
  source 1..657: mol_type = other RNA
gacatccaaatgactcaatcaccctcctccctatcagcctccgtcggagaccgcgtcaccatcacatgccgctcctcccaatccctagtccactccaacggaaacaccttcctccactggtaccaacaaaaacccggcaaagcccccaaactcctcatctacaccgtctctaaccgcttctccggagttccctcccgcttctccggctccggctccggaaccgacttcaccctcaccatctcatccctacaacccgaagacttcgccacctacttctgctcccaaaccacccacgtcccctggaccttcggccaaggcaccaaggtcgaaatcaaacgcaccgtcgccgccccctccgtattcatcttcccaccatcagacgaacaactcaaatcaggcaccgcctccgtcgtatgcctcctcaacaacttctacccccgagaagccaaagtccaatggaaagtcgacaacgcactccaatccggcaactcacaagaatcggtaaccgaacaagactccaaagactccacctactccctctcctccaccctcaccctatccaaagccgactacgaaaaacacaaagtctacgcctgcgaagtcacccaccaaggcctctcctcccccgtcaccaaatccttcaaccgaggcgaatgc

SEQ ID NO: 53680 - RNA, 318 nt, synthetic construct
  misc_feature 1..318: note = derived and/or modified sequence opt11 from Dacliximab_LightChain_VJ-Region
  source 1..318: mol_type = other RNA
gacatccaaatgacccaatccccctccaccctctccgcctccgtcggcgaccgcgtcaccatcacctgctccgcctcctcctccatctcctacatgcactggtaccaacaaaaacccggcaaagcccccaaactcctcatctacaccacctccaacctcgcctccggcgtccccgcccgcttctccggctccggctccggcaccgaattcaccctcaccatctcctccctccaacccgacgacttcgccacctactactgccaccaacgctccacctaccccctcaccttcggccaaggcaccaaagtcgaagtcaaa

SEQ ID NO: 53681 - RNA, 348 nt, synthetic construct
  misc_feature 1..348: note = derived and/or modified sequence opt11 from Dacliximab_gamma2-Chain_VDJ-Region
  source 1..348: mol_type = other RNA
caagtgcaattggtccagagcggggccgaggtcaagaaaccgggctcgagcgtgaaagtgagctgtaaagcgagcgggtacacgttcacgagctatcgcatgcactgggtcaggcaagcacccgggcaagggctcgagtggataggctatatcaatccctcgaccgggtacacggaatataaccagaaatttaaagataaagcgaccataaccgcggacgagagcacgaacacggcctatatggagctctcgagcttgcgctcggaagataccgcggtctattactgtgccagaggcgggggcgtgttcgattactggggccagggcacgctcgtgaccgtgagctcg

SEQ ID NO: 53682 - RNA, 1326 nt, synthetic construct
  misc_feature 1..1326: note = derived and/or modified sequence opt11 from Daclizumab_HeavyChain
  source 1..1326: mol_type = other RNA
caagtccaactcgtccaatccggcgccgaagtcaaaaagcccggcagctccgtcaaagtcagctgcaaagccagcggctacacattcacctcttatcgaatgcactgggtccgccaagcacccggccaaggcttagaatggatcggctacatcaacccctcaacaggctacaccgaatataaccaaaaattcaaagacaaagccacaatcaccgccgatgaatcaacaaacacagcctacatggaactatcctccctccgctccgaagacaccgctgtctactactgcgcacgaggaggcggagtattcgactactggggacaaggcacaaccctcaccgtctcctcaggcccctccgttttccccctagccccatcctccaaatccacctcaggcggcaccgcagcgctcggctgcctcgtaaaagactacttccctgaacccgtcaccgtctcctggaactcaggcgcgcttacctccggagtccacaccttccccgcagtcctccaatcatccggcctctactcactctcctcagtagtcaccgtcccctcatcatccctcggcacccaaacatacatatgcaacgtaaaccacaaaccatcaaacaccaaagtcgacaagaaagccgagcccaaatcctgcgacaaaacacacacttgcccaccctgccccgcccccgaactcctcggcggcccctcagtcttcctcttcccaccaaaacccaaagacaccctcatgatatcacgcacccccgaagtaacctgcgtcgtcgtagacgtctctcacgaagacccagaagttaaattcaactggtatgtagacggagtcgaagtccacaacgccaaaaccaagccccgcgaagaacagtacaactcaacataccgcgtcgtatcagtcctcaccgtactgcaccaagactggcttaacggaaaggaatacaaatgcaaagtatccaataaagcgctccccgcccccatcgagaaaaccatctccaaagccaaaggccaaccccgagaaccccaagtctacaccctaccaccatcccgcgacgaactcaccaaaaaccaagtctccctcacctgtcttgtcaaaggcttctacccctccgacatagcagttgaatgggaatccaacggacaaccagaaaataactacaaaacaaccccacccgtcctcgactcagacggtagcttcttcctctactccaaactcactgtcgacaaatcacgatggcagcagggcaatgtattctcttgctccgtcatgcacgaagcactccacaaccactacacacaaaaatccctctccctttcccccggcaaa

SEQ ID NO: 53683 - RNA, 630 nt, synthetic construct
  misc_feature 1..630: note = derived and/or modified sequence opt11 from Daclizumab_LightChain
  source 1..630: mol_type = other RNA
gacatccaaatgacccaatccccctcaaccctctccgcctccgtcggcgaccgtgtcaccatcacctgctccgcctcctcctccatctcctacatgcactggtaccaacaaaaacccggcaaagcccccaaactcctcatctacaccacctccaacctagcctccggcgtccccgcccgcttctccggctcaggctccggcacagaattcaccctcaccatctcctcactccaacccgacgacttcgctacctactactgccaccaacgctccacataccccctcaccttcggctccggcaccaaagtcgaagtcaaacgtaccgtcgccgccccctcagtcttcatcttccccccctccgacgaacaactcaaatccggcaccgcctccgtagtctgcctcctcaacaacttctacccccgcgaagcaaaagtccaatggaaagtcgacaacgccctccaatccggcaactcacaagaatccgtcaccgaacaagactccaaagactccacctactccctatcctcaacactaaccttatccaaagccgactacgaaaaacacaaagtctacgcctgcgaagtcacccaccaaggtctctcctcccccgtaaccaaatctttcaaccgc

SEQ ID NO: 53684 - RNA, 1341 nt, synthetic construct
  misc_feature 1..1341: note = derived and/or modified sequence opt11 from Dalotuzumab_HeavyChain1
  source 1..1341: mol_type = other RNA
caagtccaacttcaacaatcaggacccggactcgtcaagccatcccaaacattatccctaacttgcaccgtctccggatggtcaatctccggcggctggctatggaactggatacgccaaccacccggcaaaggcctccagtggattggatggatctcctgggacggtaccaacaactggaaaccctcactcaaagatcgtgtaaccatctccgtagacacttcgaaaaaccaattctctctaaaactttccagcgtcaccgccgccgacaccgctgtatggtggtgcgcccgctggggccgcgttttcttcgactggtggggacaaggcacactcgtcaccgtctcctccgcctccactaagggcccctccgtattccccctagcaccctcatccaaatcaacatcaggagggaccgccgccctaggctgcctcgtaaaagactacttccccgaaccagtcacagtatcatggaactcaggagcactgacctccggagtccacacattccccgccgtcctacaatcaagcggactctacagcctgtctagcgtcgtcaccgtcccctcatcctcactcggcacacaaacctacatctgcaacgtaaaccacaaaccctcaaacaccaaagtcgacaaacgcgtcgaacccaaatcctgcgacaaaacacatacctgcccaccctgccccgcccctgaactactcggcggaccctccgtatttctgttcccacccaaacccaaagacacactcatgatctcccgaacgcccgaagtaacctgcgtcgtagtagacgtctcccacgaagaccccgaagtaaaattcaactggtacgtcgacggcgtagaagtacacaacgccaaaacaaaacctcgcgaagaacaatacaactccacctacagagtagtctccgttctcacagtcctacaccaagattggctcaatggaaaagaatacaaatgcaaagtatccaacaaagccctccccgcccccatcgaaaagacaatcagcaaagccaaaggacaaccccgcgaaccccaagtctacacccttccaccctcacgcgaagaaatgaccaagaaccaagtctcccttacctgcctcgtaaaaggattctacccctccgacatcgccgtcgaatgggaatccaacggccaacccgaaaacaattacaaaacaactccacccgtcctcgactcagacggatcattcttcctctactccaaactcaccgtcgacaaatcgcgatggcaacaaggcaacgtcttctcctgctccgtaatgcacgaagccctccacaaccactacacccaaaaatctctatcactatcccccggcaag

SEQ ID NO: 53685 - RNA, 657 nt, synthetic construct
  misc_feature 1..657: note = derived and/or modified sequence opt11 from Dalotuzumab_LightChain1
  source 1..657: mol_type = other RNA
gacatcgtcatgacccaatctcccctctccctccccgtcacccccggccaacccgcctccatctcctgccgctcctcccaatccatcgtccactccaacggcaacacctggctacaatggtggctccaaaaacccggccaatcaccccaactcctcatctggaaagtctccaaccgcctctggggcgtccccgaccgattctccggctcaggctccggcaccgacttcaccctcaaaatctcccgcgtccaggcccaagacgtcggcgtctggtggtgcttccaaggctcccacgtcccctggactttcggccaaggcaccaaagtccaaatcaaacgcaccgtcgccgccccctccgtcttcatcttcccaccctccgacgaacaactcaaatccggaacagcctccgtcgtctgcctcctcaacaacttctacccccgcgaagccaaagtccaatggaaagtcgacaacgccctccaatccggaaactcccaagaatccgtcacagaacaagactccaaagactccacatactccctctcctccaccctcaccctctccaaagcagactacgaaaaacacaaagtctacgcttgcgaggtcacccaccaaggcctcagctcccccgtcaccaaatcattcaaccgcggcgaatgc

SEQ ID NO: 53686 - RNA, 687 nt, synthetic construct
  misc_feature 1..687: note = derived and/or modified sequence opt11 from Dapirolizumab_pegol_HeavyChain1
  source 1..687: mol_type = other RNA
gaagtacaactggtagagagcggaggagggctagtgcaaccgggcgggagcctgcgcctgagctgtgccgtaagcgggttctcaagcacaaactatcacgtacactgggtcagacaagcgcccgggaaagggctcgagtggatgggcgtgatctggggcgatggcgatacctcgtacaacagcgtgctcaagagcaggttcacaatctctcgcgatacctcgaaaaataccgtgtacttgcaaatgaactcactcagggccgaggacacggccgtatactattgcgcgcgccagctcacgcactactacgtactagcggcctggggccagggcacgctcgtaaccgtgagctcggcctcgacaaagggcccgagcgtgttcccgctcgcgccctcgagcaagagcacgagcgggggcacggccgcactcgggtgcctggtcaaggactatttcccggaaccggtcacggtctcgtggaacagcggggccttgacctcgggagtgcacacgttcccggccgtgctccagagctcgggcttgtactcactatccagcgtggtcacggtcccaagctcaagcctgggcacacaaacgtacatatgcaacgtcaatcacaaaccctcgaacacaaaagtggacaagaaagtggaaccgaaatcgtgcgacaaaacgcacacgtgcgcggcc

SEQ ID NO: 53687 - RNA, 642 nt, synthetic construct
  misc_feature 1..642: note = derived and/or modified sequence opt11 from Dapirolizumab_pegol_LightChain1
  source 1..642: mol_type = other RNA
gacatccaaatgacccaatccccttcctccctctccgcctcagtcggcgaccgcgtcaccatcacctgccgcgcctccgaagacctctactacaacctcgcctggtaccaacgcaaacccggcaaagcacccaaactcctcatctacgacacctaccgccttgccgacggcgtaccctcccgcttctccggctcaggctccggcaccgactacacccttaccatctcctccctccaaccagaagacttcgcctcctactactgccaacaatactacaaattccccttcaccttcggccaaggcaccaaagtcgaaatcaaacgcaccgtagccgccccctcagtcttcatcttcccaccctccgacgaacaactaaaatccggcaccgcctcagtcgtatgcctcctcaacaacttctacccacgcgaagccaaagtccagtggaaagtcgacaacgccctccaatcaggaaactcacaagaatcagtcaccgaacaagacagcaaagactccacctactccctttcctcaaccctcaccctctccaaagccgactacgaaaaacacaaagtctacgcctgcgaagtcacccaccaaggcctctcctcacccgtcaccaaatccttcaaccgcggcgaatgc

SEQ ID NO: 53688 - RNA, 1356 nt, synthetic construct
  misc_feature 1..1356: note = derived and/or modified sequence opt11 from Daratumumab_HeavyChain1
  source 1..1356: mol_type = other RNA
gaagtccaactcctcgaatcaggaggcggactcgtccaacccggcggctcactccgcctctcctgcgccgtctccgggttcacgttcaatagcttcgccatgtcctgggtccggcaagcccccggcaagggcctagaatgggtctccgccatctcaggctccggaggcggaacctactacgccgattccgtcaaaggccgattcaccatctcccgggacaactccaaaaacacactgtacctccaaatgaactcactaagagcagaagacaccgccgtatacttctgcgctaaagacaaaatcctctggttcggcgaacccgtcttcgactactggggacaaggcacactcgtcactgtcagctccgcatccaccaaaggtccctccgtattccccctggccccctcctccaaatccacttcaggaggcaccgccgccctcggctgcctagtcaaagattatttccccgagcccgtcaccgtatcatggaactccggagccctaacctccggagtccataccttccccgcagtcctccagtcctcaggcctatactccctctcaagcgtcgtcacagtcccctcctcgtccctcggaacccaaacctacatatgcaatgtcaaccacaaacccagcaacaccaaagtagacaaacgtgtcgaacccaaatcttgcgataaaacacacacatgtccaccatgccccgcgcccgaactcctaggtgggcccagcgtcttcctcttcccacccaaaccaaaagacaccttaatgatatcccgaacacccgaagtcacatgcgtcgtggtcgacgtctcacacgaagaccccgaagtaaaattcaactggtacgtagacggagtcgaagtacataacgcaaaaaccaaaccaagagaagaacaatacaactccacctaccgagtcgtcagcgtcctgaccgtcctgcaccaagactggctaaacggcaaagaatacaaatgcaaagtctccaacaaagccctccccgcccccatcgagaaaaccatctcaaaagccaaaggacaaccacgtgaaccccaagtctacaccctcccaccctcccgcgaagaaatgaccaaaaaccaagtatcgctaacctgcctcgtcaaaggattctacccctccgacatcgccgtcgagtgggaatcaaacggccagcccgaaaacaactacaaaaccaccccacccgtcctcgactccgacggatccttcttcctctactccaaactcacagtcgacaaatcccgctggcaacaaggcaacgtcttctcctgcagcgtcatgcacgaagccctacacaaccactacacacaaaaatccctatccctgagccccggtaaa

SEQ ID NO: 53689 - RNA, 642 nt, synthetic construct
  misc_feature 1..642: note = derived and/or modified sequence opt11 from Daratumumab_LightChain1
  source 1..642: mol_type = other RNA
gaaatcgtcctcacacaatctcccgcaaccctctccctatcccccggcgaacgcgccactctctcatgccgcgcatcccaatccgtctcctcttacctcgcctggtaccaacaaaaacccggccaagcaccccgcctcctaatctacgacgcaagcaaccgcgccaccggcatccccgcccgcttctccggctcaggctccggcacagacttcacactcaccatctcctcactcgaacccgaagacttcgccgtatactactgccaacaacgcagtaactggccacccaccttcggacaaggaacaaaagtcgaaatcaaacgcaccgtcgcagcccccagcgtcttcatcttcccaccctccgacgaacaactcaaatccggcaccgcctccgtcgtatgcctactcaacaacttctacccccgcgaagccaaagtccaatggaaagtcgacaacgccctccaatccggcaactctcaagaatccgtcaccgaacaagactccaaagactccacctactctctaagctcaaccctcaccctcagcaaggccgactacgaaaaacacaaagtctacgcctgcgaagtcacccaccaaggcctctcctcacccgtcaccaaatccttcaaccgcggcgaatgc

SEQ ID NO: 53690 - RNA, 1350 nt, synthetic construct
  misc_feature 1..1350: note = derived and/or modified sequence opt11 from Dectrekumab_HeavyChain1
  source 1..1350: mol_type = other RNA
gaagtccaactggtcgaaagcggaggaggcgtcgtacagcccggccgctccctccgcctatcctgcgccgccagcggattcacattctcctcctacggcatgcactgggtacgtcaagcccccggaaagggactagaatgggtggccattatatggtatgacggctccaacaaatactacgcagacagcgtaaaaggccgcttcaccatcagccgcgacaactccaaaaacaccctctacctccaaatgaactccctccgcgccgaagacaccgccgtctactactgcgcccgactctggttcggcgacctagacgcattcgacatctggggccaaggcaccatggtaactgtctcctccgcctcaacaaaaggcccctcagtcttccctctagccccctcgtcaaagagcacctccggtggaaccgctgcgctaggatgcctggtcaaagactacttcccagaaccagtcaccgtatcctggaactccggagccctcacttcaggcgtacacaccttccccgccgtcctccaatcatccggcctctacagcctttcgtccgtcgtcacagtccccagctcatccctcggcacccaaacgtatatctgcaacgtcaaccacaaaccgtcaaacaccaaagttgacaaacgcgttgagcccaaatcctgcgataaaacccatacctgcccaccatgccccgcacccgaactcctgggcggaccctctgtattcctctttcccccaaaaccaaaggacaccctgatgatctcacgaacaccagaagtaacctgcgtcgtggtagatgtcagccacgaagaccccgaagtaaaattcaactggtacgtagacggagtagaagtccacaacgccaaaaccaaacccagagaagaacaatacaacagcacataccgcgtagtctccgttctcaccgtactacaccaagactggctcaacggcaaagaatacaaatgcaaagtctccaacaaagcactcccggccccaattgagaaaaccatctccaaggccaaaggccaaccacgcgaaccccaagtctacaccctccctcccagccgagaagaaatgacgaaaaaccaagtctccctgacctgcctcgtcaaaggattctacccctcagacatcgccgtagaatgggaatccaacggccaacccgaaaacaactacaaaactactccgcccgtactcgactctgatggctcattcttcctctactccaagctcacagtagacaaatcccgatggcaacagggcaacgtattctcctgctccgtcatgcacgaagcactccacaaccactacacacaaaaatccctatccctaagccccggcaaa

SEQ ID NO: 53691 - RNA, 648 nt, synthetic construct
  misc_feature 1..648: note = derived and/or modified sequence opt11 from Dectrekumab_LightChain1
  source 1..648: mol_type = other RNA
gaaatcgtcctcacccaatcccccgccaccctctccctctcccccggcgaacgagccatactctcctgccgcgccggccaatccgtctcctcctacctcgtctggtaccaacaaaaacccggccaagccccccgactccttatctacgacgcatccaaccgcgcaaccggaatccccgcccgattctcaggctccggctcaggcaccgacttcaccctcaccatctcctcactcgaacccgaagacttcgccgtatactactgccaacaacgctcctcctggccccccgtctacacctttggccaaggcaccaaactagaaatcaaacgcaccgtcgccgccccatcagtcttcatcttccccccctccgacgaacaactcaaatcaggcaccgcctcagtcgtctgcctcctcaacaacttctacccccgcgaagccaaagtccaatggaaagtcgacaacgccctccaatccggtaactcacaagaatccgtcaccgaacaagacagcaaagactcaacctactccctctcctccacactcacactctccaaagccgactacgaaaaacacaaagtctacgcctgcgaagtcacccaccaaggcctctcctcacccgtcaccaaatccttcaaccgcggcgaatgc

SEQ ID NO: 53692 - RNA, 1332 nt, synthetic construct
  misc_feature 1..1332: note = derived and/or modified sequence opt11 from Demcizumab_HeavyChain1
  source 1..1332: mol_type = other RNA
caagtccaactcgtccaatctggcgcagaagtcaagaaacccggcgcctcagtaaaaatcagctgcaaagcctccggctactcattcaccgcatactacattcactgggtcaaacaagcccccggccaaggactcgaatggatcggctacatatccagctacaacggcgccactaactacaaccaaaaattcaaaggccgcgtcactttcaccaccgacacatccacctccaccgcctacatggaactccgatccctgagatcagacgacactgcagtatactactgcgcccgcgactacgactatgacgtcggcatggactactggggccaaggcactctagtaaccgtatcctcagcctccaccaaaggaccctccgtctttcccctcgccccctgctcccgctccaccagtgaatccacagccgccctcggctgcctcgtcaaagattacttcccagaacccgtcacagtctcctggaactccggggccctcacttcaggcgtacataccttccccgccgtcctacaatcctccggcctctactccctctcgtccgtcgtcaccgtcccctcatccaacttcggtacacaaacatacacttgcaatgtcgaccacaagccctccaacacaaaagtcgacaaaaccgtcgaacgcaagtgctgcgtagaatgtccaccttgccccgccccacccgtcgccggcccctccgtcttcctattccctcccaaacccaaagacacacttatgatctctcgaacacccgaagtaacatgcgtcgtcgtcgatgtctcccacgaagaccccgaagtccaattcaactggtacgtcgacggcgtcgaagttcacaacgccaaaaccaagccccgcgaagaacaattcaacagcaccttccgcgtcgtcagcgtcctcaccgtcgtccaccaagactggctcaacggcaaggaatacaaatgcaaagtctcaaacaaaggcctaccagcacccatcgagaaaaccatctccaaaaccaaaggccaaccccgcgaaccccaagtttacacactaccaccatcccgcgaagaaatgaccaagaaccaggtctccctaacctgcctcgtcaaaggcttctacccctccgacatcgccgtcgaatgggaatccaacggacaacccgaaaacaactacaaaaccaccccacccatgcttgactctgacggatccttcttcctatacagcaaactcaccgtcgacaaaagccgctggcaacaaggcaacgtcttcagctgctcagttatgcacgaagccctccacaaccactacacccaaaaatccctatccctctcccccggc

SEQ ID NO: 53693 - RNA, 654 nt, synthetic construct
  misc_feature 1..654: note = derived and/or modified sequence opt11 from Demcizumab_LightChain1
  source 1..654: mol_type = other RNA
gacatcgtaatgacacaatcccctgacagcctcgccgtctccctcggcgaacgcgccaccatcagctgccgcgcctccgaatccgtcgacaactacggcatctcattcatgaaatggttccaacaaaaacccggccaaccacccaaactcctaatctacgccgccagcaaccaaggctccggcgtacccgaccgcttctccggctccggctccggcaccgacttcaccctaaccatctcctccctccaagccgaagacgtcgccgtctactactgccaacaatccaaagaagtcccctggaccttcggcggcggcaccaaagtcgaaatcaaacgcaccgtcgcagcccccagcgtattcatcttcccaccctcagacgaacaactcaaatccggcacagcctccgtcgtctgcctcctcaacaacttctacccacgcgaagccaaagtccaatggaaagtcgacaacgccctccaatccggaaactcacaagaatcagtcaccgaacaagactccaaagactccacctactccctctcctccaccctcaccctctccaaagccgactacgaaaaacacaaagtttacgcctgcgaagtcacccaccaaggcctcagctcacccgtcaccaaatccttcaaccgcggcgaatgc

SEQ ID NO: 53694 - RNA, 1350 nt, synthetic construct
  misc_feature 1..1350: note = derived and/or modified sequence opt11 from Denintuzumab_mafodotin_HeavyChain1
  source 1..1350: mol_type = other RNA
caagtccaactccaagaatcaggacccggcctagtaaagccctcacaaaccctctccctaacatgcaccgtctccggcggctccatatccaccagcggcatgggcgtaggatggatccgccaacaccccggaaaaggcctcgaatggatcggacacatctggtgggacgacgacaaacgctacaaccccgcactaaaatcacgtgtcaccatctccgtcgacacctccaaaaaccaattctcactcaaactttcttccgtcaccgccgccgatacagctgtttactactgcgcccgcatggagctatggtcatactacttcgactactggggccaaggtacacttgtcaccgtatcctccgcctcaacaaaaggcccctccgtattccccctcgccccatcctccaaatctacatccggcggcaccgccgctctaggatgcctcgtcaaagactacttcccagaacccgtcaccgtctcttggaactccggcgccctcacctcaggcgtacacaccttcccagcagtcctacaatccagcggtctctactctctctcatccgtcgtcacagtaccctcatcctcactaggcacccaaacctacatctgcaacgtaaaccacaagccctccaacaccaaagtcgacaagaaagtcgaacccaaatcctgcgacaaaacccatacctgcccaccctgccccgcccccgaactcctaggaggcccctccgtcttcctcttcccacccaaacccaaagacaccctaatgatatcccgaacccccgaagtaacctgcgtagttgtagacgtatcacacgaggaccccgaagtgaaattcaactggtacgtcgacggcgtagaagtccacaacgcaaaaaccaaaccccgagaagaacaatacaactccacctaccgcgtagtaagcgttctcaccgtacttcaccaagactggctcaatggtaaagaatacaaatgcaaggtctccaacaaagccctccccgcccccatcgagaaaacaatctccaaagccaaaggccaaccccgagaaccacaagtctacaccctcccaccctcacgcgacgaactaaccaaaaaccaagtctcacttacctgcctggtcaaaggcttctacccttccgacatcgccgtcgaatgggaatcaaacggccaacccgaaaacaactataagaccactccacccgttctcgactccgacggcagcttctttctttactccaaactcaccgtcgacaaatcccgatggcaacaaggtaacgtgttctcctgctccgttatgcacgaagccctacacaaccactacacccaaaaatcactcagcctctctcccggcaaa

SEQ ID NO: 53695 - RNA, 639 nt, synthetic construct
  misc_feature 1..639: note = derived and/or modified sequence opt11 from Denintuzumab_mafodotin_LightChain1
  source 1..639: mol_type = other RNA
gaaatcgtcctcacccaatcccccgccaccctctccctctcccccggagaacgcgccaccctctcctgctccgcctcctcctccgtatcctacatgcactggtaccaacaaaaacccggccaagcaccccgactcctaatctacgacacctcaaaactcgcctccggcatccccgcccgcttctccggctccggctccggcaccgacttcaccctcaccatctcctcactcgaacccgaagacgtcgccgtctactactgcttccaaggatccgtctaccccttcaccttcggccaaggcaccaaactcgaaatcaaacgcaccgtcgccgccccctctgtcttcatcttcccaccctccgacgaacaactcaaatccggcaccgcctccgtcgtctgcctactcaacaatttctacccccgtgaagccaaagtccaatggaaagtagacaatgccctccagtccggcaactcacaagaatccgtaaccgaacaagactccaaagactccacctacagcctttcctcaacactaaccttatccaaagccgactacgaaaaacacaaagtctacgcctgcgaagtcacccaccaaggcctctcatcccccgtcaccaaatccttcaaccgtggcgaatgc

SEQ ID NO: 53696 - RNA, 1356 nt, synthetic construct
  misc_feature 1..1356: note = derived and/or modified sequence opt11 from Denosumab_HeavyChain
  source 1..1356: mol_type = other RNA
gaagtccaactactagaatcaggcggaggcctcgtccaacccggcggctccctcagactcagctgcgccgcctcaggcttcaccttctcttcctacgccatgtcctgggtccgccaagcacccggcaaaggactcgaatgggtatccggaatcaccggatccggcggatccacctactacgcagactcagtcaaaggccgcttcaccatcagccgcgacaactccaaaaacacactatacctacaaatgaactccctccgcgccgaagacaccgcagtatactactgcgcaaaagaccccggtactacagtcatcatgtcctggttcgacccctggggccaaggtaccctcgtcaccgtctcctccgcctcgaccaaaggcccaagcgtcttcccactcgcaccatccagcaaatctaccagcggcggaaccgccgccctcggctgcctcgtcaaagactacttccccgaacccgtcaccgtctcctggaactccggcgccttaacctccggagtacacaccttccctgccgtcctccagtccagcggtctatactccctatcatcagtcgtaaccgtcccaagctcatccctgggaacccaaacctacatctgcaacgtgaaccacaagccctccaacaccaaagttgacaaaaaggtcgagcccaaatcctgcgacaaaacccacacatgccctccctgccccgcccccgaacttctcggcggcccctctgtctttctctttcccccaaaacccaaagacaccctaatgatctcgcgcacccccgaagtaacctgcgtcgtagtcgacgtctcacacgaagaccccgaagtcaagttcaactggtacgtcgacggcgtagaagttcacaacgccaaaaccaaaccccgggaagaacaatataactcaacctatcgcgtcgtatccgtcctaaccgtcctacaccaagactggctcaacggaaaagaatacaaatgcaaagtctccaacaaagcactcccggcccccatagagaaaaccatctccaaagccaaaggacaaccacgcgaaccccaagtctacaccctcccaccctcacgggacgaactcaccaaaaaccaagtatcactcacatgcctagtaaaaggattctatccctcagacatcgcggtcgaatgggaatccaacggccaacccgaaaacaactacaaaacaacccctcccgtcctagactccgacggctccttcttcctatattcaaaactcacagtagacaaatctcgctggcaacaaggcaacgtcttctcatgcagcgtcatgcacgaagccctacacaaccactacacccagaaatcactctccctatcccccggcaaa

SEQ ID NO: 53697 - RNA, 645 nt, synthetic construct
  misc_feature 1..645: note = derived and/or modified sequence opt11 from Denosumab_LightChain
  source 1..645: mol_type = other RNA
gaaatcgtcctcacccaaagccccggcaccctctcactctcccccggcgaacgcgccaccctctcctgccgcgcctcccaatccgtacgaggccgctacctcgcctggtaccaacaaaaacccggccaagcaccccgcctcctcatttacggcgcctcatcccgagccaccggcatccccgaccgcttctccggctcaggctccggcaccgacttcaccctcaccatctcccgactcgaacccgaagacttcgccgtattctactgccaacaatacggctcctcaccccgcaccttcggacaaggcacaaaagtcgaaatcaaacgcaccgtcgccgccccctccgtattcatcttcccaccctccgacgaacaactaaaatcaggcacagccagcgtcgtctgcctactcaacaacttctacccccgcgaagccaaagtccaatggaaagtcgacaacgccctccaatccggcaactcccaagaatccgtcaccgaacaagactccaaagactccacatactccctatcctccaccctcacactctccaaagccgactacgaaaaacacaaagtatatgcctgcgaagtcacccaccaaggcctctcctcccccgtcacaaaatcattcaaccgcggcgaatgc

SEQ ID NO: 53698 - RNA, 1338 nt, synthetic construct
  misc_feature 1..1338: note = derived and/or modified sequence opt11 from Depatuxizumab_HeavyChain1
  source 1..1338: mol_type = other RNA
caagtgcaactacaagaatccggacccggactcgtcaaaccctcccaaaccctctccctaacctgcaccgtctccggctactccatctcctccgacttcgcctggaactggatccgacaaccacccggaaaaggcctagaatggatgggctacatctcctactccggcaacacccgctaccaaccctccctcaaatcacgcatcacaatatcccgagacacttccaaaaaccaattcttcctaaaactcaacagcgtcaccgcagccgacaccgccacctactactgcgtcaccgccggccgcggcttcccctactggggccagggcaccctcgtaacagtctcctccgcctccaccaaaggcccatccgtcttcccgctcgctccatcctccaaatccacgagcggcggcaccgccgcactcggctgcctcgtcaaagactacttcccagaacccgtaaccgtgtcctggaacagcggagccctgacctcaggcgtccacacattccccgcagtgctccagtcctccggactctactcactctcctccgtcgtgacagtcccctcttcctcccttggcacccaaacctacatctgcaacgtaaaccacaaaccctccaacaccaaagtcgacaaaaaggttgaaccaaaatcctgcgacaaaacccacacctgtccaccctgccccgcccccgaactcctaggcggaccctccgtattcctattcccacccaaacccaaagacaccctcatgatatcaagaaccccagaggtaacctgcgtcgtcgtcgacgtctcccacgaagaccccgaagtaaaattcaactggtacgtcgacggcgttgaagttcacaacgccaaaaccaaaccacgcgaagaacaatacaactcaacgtaccgcgtagtctccgtgctcaccgtcctacaccaagactggctaaacggaaaagaatacaaatgtaaagtatccaacaaagccctacccgcccccatagagaaaaccatatcaaaagccaaaggtcaaccccgtgaaccccaagtctacacactaccaccatcccgcgacgaactcaccaaaaatcaagtctccctaacctgcctcgtcaaaggcttctacccctctgacatcgccgtagaatgggaatcaaatggccaacccgaaaacaactacaaaaccaccccacctgtcctcgactccgacggctcattcttcctctactccaaactaaccgtggacaaatctcgttggcaacaaggcaacgtcttctcctgctccgtcatgcatgaagcactccataaccactacacccaaaaatccctatccctcagccccggaaaa

SEQ ID NO: 53699 - RNA, 642 nt, synthetic construct
  misc_feature 1..642: note = derived and/or modified sequence opt11 from Depatuxizumab_LightChain1
  source 1..642: mol_type = other RNA
gacatccaaatgacccaatccccctcatccatgtcagtctcagtaggcgaccgcgtcaccatcacctgtcactcctcccaagacatcaactcaaacatcggctggctccaacaaaaacccggcaaatcattcaaaggcctcatctaccacggcaccaacctcgacgacggcgtaccctcccgcttctccggatcaggctccggcaccgactacaccctcactatctcctccctccaacccgaagacttcgccacatactactgcgtacaatacgcccaattcccatggaccttcggcggcggcaccaaactcgaaatcaaacgcaccgtcgcagccccctccgtcttcatattcccaccctccgacgaacaactaaaatccggcacggcatccgtcgtctgcctcctcaacaacttctacccccgagaagccaaagtccaatggaaagtcgacaacgccctccaatcaggcaactcccaagaatccgtcaccgaacaagacagcaaagactccacctactccctctcctccaccctcaccctctccaaagccgactacgaaaaacacaaagtctacgcctgcgaagtaacccaccaaggcctctcatcccccgtcaccaaatccttcaaccgcggcgaatgc

SEQ ID NO: 53700 - RNA, 1338 nt, synthetic construct
  misc_feature 1..1338: note = derived and/or modified sequence opt11 from Depatuxizumab_mafodotin_HeavyChain1
  source 1..1338: mol_type = other RNA
caagtccaactgcaagaatccggacccggcctcgtcaaaccctcccaaactctgtcactaacctgcacagtatcgggctactcaatctcctccgacttcgcatggaactggatccgccaacctccaggcaaaggcctcgaatggatgggatacatctcctactccggcaacacacgctaccaaccctcactcaaatcgcgcataacaatctctcgcgacaccagcaaaaatcaattcttcctcaaactcaactcagtaaccgccgccgacaccgccacctactactgtgtcaccgccggtcgtggcttcccatactggggacaaggcacactcgtcaccgtgagctctgccagcaccaagggcccctctgtattccctttagcaccctcatccaaatccacctccggcggcacggcagcgctaggatgcctcgtcaaagactacttccccgaaccagtaaccgtctcctggaactccggcgcccttacctccggcgtacacaccttcccagccgtcctccaaagctctggcctctattccctctcctcagtcgtcacagtcccctcctcctccctcggcacccaaacctacatctgcaacgtcaaccacaaaccttcaaacaccaaagtagacaagaaagtagaaccaaaatcctgcgacaaaacccacacatgcccaccctgccccgcacccgaactactcggcggaccctcagtattcctctttcccccaaaacccaaagacaccctcatgatatccagaacccccgaagtcacctgtgtagtagtcgacgtctcccacgaagatcccgaagtcaaattcaactggtacgtcgacggcgtcgaagtacacaacgccaaaaccaaaccccgcgaagaacaatacaactccacctaccgggtcgtttcagtactcaccgtactccaccaagactggctcaacggaaaagaatacaaatgcaaagtctcaaacaaagcactcccagcacccatcgagaaaacaatctcaaaagccaaaggacaaccccgcgaaccccaagtatacaccctcccaccttcacgcgacgaactcaccaaaaaccaagtcagcctcacatgtcttgtaaaaggcttctacccctctgacatcgccgtcgaatgggaatccaacggccaacccgaaaacaactacaaaaccaccccacccgtcctagactccgatggctccttcttcctatactccaaactcaccgtcgacaaatctcgatggcaacaaggcaacgtcttctcctgctccgtaatgcacgaagcactccacaaccactacacacaaaaatccctctcactctcacccggcaaa

SEQ ID NO: 53701 - RNA, 642 nt, synthetic construct
  misc_feature 1..642: note = derived and/or modified sequence opt11 from Depatuxizumab_mafodotin_LightChain1
  source 1..642: mol_type = other RNA
gacatccaaatgacccaatccccctcctccatgagcgtctctgtcggcgaccgcgtcaccatcacctgccactcctcccaagacatcaactccaacatcggctggctacaacaaaaacccggaaaatcattcaaaggcctcatataccacggcaccaacctcgatgacggcgtcccctcccgcttctccggctcgggctccggcaccgactacaccctcaccatctcatcactccaacccgaagacttcgccacctactactgcgtccaatacgcccaattcccctggaccttcggcggcggaaccaaactcgaaatcaaacgaacagtcgccgccccctccgtattcatcttccccccctccgacgaacaactaaaatccggcaccgcctccgtagtctgcctcctcaacaacttctacccccgcgaagccaaagtccaatggaaagtcgacaacgctctccaatccggcaactcccaagaatccgtaacagaacaagactccaaagactccacctactccctctcctccaccctaaccctttccaaagccgactatgaaaaacacaaagtctacgcctgcgaagtcacccaccaaggcctctcctcacccgtcaccaaatccttcaaccgcggcgaatgc

SEQ ID NO: 53702 - RNA, 1329 nt, synthetic construct
  misc_feature 1..1329: note = derived and/or modified sequence opt11 from Dinutuximab_beta_HeavyChain1
  source 1..1329: mol_type = other RNA
gaagttcaactactacaatccggccccgaactcgaaaaacccggagcctccgtaatgatctcctgcaaagcctccggatcctccttcaccgggtacaatatgaactgggtccgccaaaacataggcaaatctctcgaatggataggagccatcgacccctactacggaggcacctcctacaaccaaaaattcaagggccgcgccacccttaccgtcgacaaatcctcctcaacagcctacatgcacctaaagtcgctcacctccgaagacagcgccgtttactattgcgtatcaggaatggaatactggggccaaggcacatccgtcaccgtctcctcagcctcaaccaaaggccccagtgtcttcccattagctccatcctcaaaatcaacctcaggcggcactgccgcactaggctgcctcgtcaaagactacttccccgaaccagtaaccgtatcctggaactcaggcgcccttacctccggagtccacacattccccgccgtactccaatcctccggcctctactccctatcctcagtagtaaccgttccttcctcctccctcggaacccaaacctacatatgcaacgtcaaccacaaaccatccaacactaaagtggacaagcgcgtagaacccaaatcatgcgacaagacccacacatgcccaccctgccccgcacccgaactcctcggcggcccctcggtcttcctcttcccacccaaacccaaagacaccctaatgatctcccgcacccccgaagtaacctgcgtcgtcgtcgacgtatctcacgaagaccccgaagtcaaattcaactggtacgtagacggagtagaagtccacaacgcgaaaaccaaaccccgcgaagaacaatacaactcaacctaccgtgtcgtttccgtcctcaccgtcctacaccaagattggctcaacggcaaagagtacaaatgcaaagtctctaacaaagcactgcccgccccaatagaaaagacaatctccaaagcaaaaggccaaccccgcgaaccacaagtctacaccctccctccctcccgcgaagagatgaccaaaaaccaagtctccctaacctgccttgtcaaaggcttctacccctccgacatcgcagtagagtgggaatcaaacggccaacccgaaaacaactacaaaacaaccccacccgtactagactccgacggatcattctttctatactccaaactaaccgtggacaaatcccgctggcaacaaggaaacgtcttcagctgctcagtcatgcacgaagccctccacaaccactacacccaaaaatccctgtccctctcgcccggaaaa

SEQ ID NO: 53703 - RNA, 660 nt, synthetic construct
  misc_feature 1..660: note = derived and/or modified sequence opt11 from Dinutuximab_beta_LightChain1
  source 1..660: mol_type = other RNA
gagatcgtcatgacccaaagccccgccaccctttccgtctcccccggcgaacgcgccaccctcagctgccgctcctcccagtccctagtccaccgcaacggcaacacctacctccactggtacctccaaaaacccggccaatcccccaaactcctcatccacaaagtctccaaccgattctccggagtacccgaccgcttctccggctccggctccggcaccgacttcaccctcaaaatctcccgcgtcgaagccgaagacctcggcgtctacttctgctcccagtccacccacgtcccacccctcaccttcggcgccggcaccaaactcgaactcaaacgcaccgtcgcagccccctccgtcttcatcttcccaccctcagacgaacaacttaaatccggcaccgcctcagtcgtatgcctcctcaacaacttctacccccgcgaagccaaagtccaatggaaagtcgacaacgccctccagtccggtaactcacaagaatccgtcaccgaacaagactcaaaagactccacctacagcctctcctcaaccctcaccctctccaaagccgactacgaaaaacacaaagtctacgcctgcgaagtcacccaccaaggcctcagctcacccgtcaccaaatcattcaaccgcggtgaatgc

SEQ ID NO: 53704 - RNA, 1329 nt, synthetic construct
  misc_feature 1..1329: note = derived and/or modified sequence opt11 from Dinutuximab_HeavyChain1
  source 1..1329: mol_type = other RNA
gaagtccaactcctccaatccggccccgaactcgaaaaacccggtgcctccgtgatgatctcttgcaaagcctcaggatcctccttcaccggctataacatgaactgggtccgccaaaacatcggcaaatcactcgaatggattggcgcaatagacccatactacggcggaacctcctacaaccaaaaattcaaaggcagagccaccctcacagtagacaaatcatcctccaccgcatacatgcacctcaaatcactcacctccgaagactccgcagtctactactgcgtctccggcatggaatactggggtcaaggcacctccgtcaccgtatcctccgcctcaactaaaggcccctccgtattccccctcgccccctcctcaaaatccacctccggcggcaccgccgcacttggctgcctcgtaaaggactactttcccgaacccgtcaccgtgtcatggaactcaggagccctgacctcaggcgtacacaccttccccgccgtcctacaatcttcaggactgtactccctctcctcagtagtcaccgtccccagctcatcactaggtacacaaacttacatctgcaacgtcaatcacaaaccctccaacaccaaagtcgacaaacgcgtcgaaccaaaatcgtgcgacaaaacccatacctgcccaccctgcccagcacccgaactcctcggcggcccatctgttttcctcttccctcccaaacccaaggacacactcatgatctcccgaactccagaagttacctgcgtcgtcgtcgacgtcagtcacgaagacccagaagtaaaattcaactggtacgtcgacggcgtcgaagttcacaacgccaaaacgaaacccagagaagaacaatacaactcaacctaccgcgtcgtatccgtactaaccgtcctccaccaagactggctaaacggcaaagaatacaaatgcaaagtctccaacaaagcactcccagctcccatcgagaaaacaatctcaaaagccaaaggacaaccacgcgaaccccaagtctacacactccctccctcccgcgaagaaatgaccaaaaaccaagtatccctaacatgcctagtcaaaggattttacccctccgacatcgccgtcgaatgggaatccaacggacaacccgaaaacaactacaaaacaacaccgcccgtcctagactccgacggatcattcttcctttactccaaactaaccgtagacaaatctcgatggcaacaagggaacgtcttctcctgctcagtcatgcacgaggccctacacaaccactacacccaaaaatccctctctctaagccccggaaaa

SEQ ID NO: 53705 - RNA, 660 nt, synthetic construct
  misc_feature 1..660: note = derived and/or modified sequence opt11 from Dinutuximab_LightChain1
  source 1..660: mol_type = other RNA
gaaatcgtcatgacccaatcccccgccaccctcagcgtaagccccggcgaacgcgccaccctcagctgccgctccagccagtccctcgtccaccgcaacggcaacacatacctccactggtacctacaaaaaccaggccaatcccccaaactcctcatacacaaagtctccaacagattctccggcgtacccgaccgcttctccggcagcggctccggcaccgacttcaccctcaaaatatcacgcgtcgaagccgaagacctcggcgtctacttctgctcccaatccacccacgtaccccccctcaccttcggagccggcaccaaactcgaactcaaacgcaccgtcgcagccccctcagtcttcatcttccccccctccgacgaacaattaaaatccggcaccgcctccgtcgtctgcctcctaaacaacttctacccccgcgaagccaaagtccaatggaaagtcgacaacgccctccagtccggcaactcccaagaatccgtaaccgaacaagactccaaagactccacctactccctatcctcaaccctcaccctaagcaaagccgactacgaaaaacacaaagtctacgcctgcgaagtcacccaccaaggcctctcctcacccgtcaccaaatccttcaatcgaggcgaatgc

SEQ ID NO: 53706 - RNA, 660 nt, synthetic construct
  misc_feature 1..660: note = derived and/or modified sequence opt11 from Dinutuximab_LightChain
  source 1..660: mol_type = other RNA
gaaatcgtaatgacccaatcccccgcaaccctctccgtctcccccggcgaacgcgcaaccctctcctgccgctcctcccagtccctcgtccaccgcaacggcaacacctacctccactggtaccttcaaaaacccggccaatcccccaaactcctcatccacaaagtctccaaccgattctccggcgtacccgatcgcttctccggctccggctccggcaccgacttcaccctcaaaatctcccgcgtcgaagccgaagacctcggcgtctacttctgctcccaatccacccacgtacccccactcaccttcggcgccggaaccaaactcgaactcaaacgcaccgtcgccgccccctccgtcttcatattccccccctccgacgaacaactcaaatccggcacagcctcagtcgtatgcctcctcaacaacttctacccccgcgaagcaaaagtccaatggaaagtcgacaacgccctccaatccggaaactctcaagaatctgtcaccgaacaagactccaaagactcaacctactccctctcatccaccctcaccctctcaaaagcagactacgaaaaacacaaagtctacgcctgcgaagtcacccaccaaggcctatcctcccccgtcaccaaatcctttaaccgaggcgaatgc

SEQ ID NO: 53707 - RNA, 1350 nt, synthetic construct
  misc_feature 1..1350: note = derived and/or modified sequence opt11 from Diridavumab_HeavyChain1
  source 1..1350: mol_type = other RNA
gaagtccaactggtcgaatccggcgccgaagtcaagaaacccggctcaagcgtcaaagtctcatgcaaagcctcaggagggcccttccggtcatacgcaatatcatgggtcagacaagcccccggccaaggccccgaatggatgggaggcataatacccatcttcggcaccaccaaatacgctccaaaattccaaggcagagtaacaataaccgctgacgactttgcaggcacagtctatatggaactctcaagcctccgatcagaagacaccgccatgtactactgcgccaaacacatgggataccaagtccgcgaaaccatggacgtctggggcaaagggacaaccgtcacagtttcctcagcctccaccaaaggcccctcagtcttccccctcgcaccctcctcaaaaagcaccagcggcggcaccgccgctctaggatgcctcgtaaaagactacttcccagagcccgtcaccgtcagctggaactccggcgccctcacctccggtgttcacaccttccccgcagtactccaatcctccggcctctactccctaagctccgtcgtaaccgtaccatcctcatccctcggcacacaaacctacatctgcaacgtgaaccataaaccctccaacaccaaagtcgacaaaagagtagaaccaaaatcctgcgacaaaacccacacatgcccaccctgccccgcccccgaactactaggcggcccatccgtattcctgttcccacccaaacccaaagacaccctcatgatctcccgcactcccgaagtcacatgtgtcgtcgtcgacgtctcacacgaagaccccgaagtcaaattcaactggtacgtcgacggcgtagaagtccacaacgcgaaaacaaaaccccgcgaagaacaatacaactcaacctacagagtagtcagcgtcctcacagtactccaccaggattggttgaacggcaaagaatacaaatgcaaagtatcaaacaaagccctccccgcccccattgagaaaacaatttccaaagccaaaggccagccccgcgaaccccaggtctacaccctaccaccctcccgcgaagaaatgaccaaaaaccaagtctcactaacctgcctcgtcaagggattctacccctcagacatcgccgttgaatgggaatccaacggccagcccgaaaacaactacaagaccaccccacccgtcctcgactcagacggctcattcttcctctactccaaactaacagtagacaaatctcgttggcaacaaggcaacgtcttctcatgctccgtcatgcacgaagccctccacaaccactacacccaaaaatccctcagcctatcacccggc

SEQ ID NO: 53708 - RNA, 651 nt, synthetic construct
  misc_feature 1..651: note = derived and/or modified sequence opt11 from Diridavumab_LightChain1
  source 1..651: mol_type = other RNA
caatccgtcctcacccaacccccctccgtctcagccgcccccggccaaaaagtcaccatctcctgctccggctcctcatccaacatcggcaacgattacgtctcctggtaccaacaactccccggcaccgcccccaaactcctcatctacgacaacaataaacgcccatccggcatccccgaccgcttctcaggctccaaatcaggcacctccgcaaccctaggcatcaccggcctccaaaccggcgacgaagccaactactactgcgccacctgggaccgccgccccaccgcatacgtagtcttcggcggaggcaccaaactcaccgtcctcggccaacccaaagccgcaccctccgtcaccctcttccccccctcctccgaagaactccaagccaacaaagccaccctcgtctgcctcatctccgacttctaccccggcgccgtaaccgtcgcatggaaagccgactcctcccccgtaaaagccggcgtcgaaacaaccaccccatccaaacaatcaaacaacaaatacgcagcctcctcctacctctccctaaccccagaacaatggaaatcccaccgctcctactcctgccaagtcacccacgaaggctccacagtcgaaaaaaccgtcgcacccaccgaatgctcc

SEQ ID NO: 53709 - RNA, 1338 nt, synthetic construct
  misc_feature 1..1338: note = derived and/or modified sequence opt11 from Domagrozumab_HeavyChain1
  source 1..1338: mol_type = other RNA
gaagtccaactcctcgaatcaggcggaggcctagtccaacccggcggctcactccgcctttcctgcgcagcctccggctttaccttctcctcctacgcaatgtcctgggtccgccaagccccaggcaaaggcctcgagtgggtctcaaccatctcatccggcggctcctacacctcctaccccgactcagtcaaaggaagattcacaatctcccgcgacaacagcaaaaacaccctctacctccaaatgaactcactccgtgctgaagataccgcagtctactactgcgccaaacaagactacgccatgaactactggggccaaggcaccctagtcaccgtctcctcagcctcaacaaaaggcccctccgtcttcccactagccccgtcctcaaaatcaacctccggcggcaccgccgccctaggctgcctcgtcaaagactacttccccgaaccagtaactgtctcctggaactccggcgccctaacctcaggcgtccacaccttcccagcagtcctccaatcatccggcctatactcactcagctccgtagtcaccgtccccagctcctccctgggcactcaaacctacatctgcaatgtcaaccacaaaccctctaacaccaaagtcgacaagaaagtcgaaccaaaaagctgcgacaaaactcacacatgcccaccctgcccagccccggaagcagctggagcccccagcgtctttctcttcccaccaaaaccaaaagacacactaatgatcagccgcacaccagaagtcacatgcgtcgtagtcgacgtctcccacgaagaccccgaagtaaaattcaactggtacgtcgacggcgtcgaagtccacaacgctaaaacaaaaccccgcgaagaacaatacaactcaacatacagagtagtctccgttctaaccgtactacaccaagactggctcaacggaaaagaatacaaatgcaaagtatccaacaaagcactacccgctcccatcgagaaaaccatctcaaaagcaaaaggacaaccccgagaaccacaagtttacaccctaccaccctcacgcgaagaaatgaccaaaaaccaagtctcactaacctgcctcgtcaaaggcttctaccccagcgatatcgcggtcgaatgggaatccaacggccagcccgaaaacaactataaaacaacaccacccgtactcgactccgacggctcattcttcctctattcaaaactaaccgtcgacaaatcccgctggcaacaaggaaacgtcttctcctgctccgtcatgcacgaggccctccacaaccactacactcaaaaatccctcagcctctctcccggaaaa

SEQ ID NO: 53710 - RNA, 1335 nt, synthetic construct
  misc_feature 1..1335: note = derived and/or modified sequence opt11 from Domagrozumab_HeavyChain
  source 1..1335: mol_type = other RNA
gaagtccaactgctcgagtccggcgggggcctcgtacaacccggcggatcactccgcctctcatgcgcagcctcaggattcacattctccagctacgccatgtcctgggtccgacaagcccccggcaaaggactcgaatgggtctcaacaatctcctcagggggctcatacacctcctaccccgactcagtcaaaggacgctttaccataagccgcgacaacagcaaaaacaccttatacctccaaatgaactccctccgcgccgaagacaccgccgtctactactgcgccaaacaagactacgccatgaactactggggccaaggaacccttgtaaccgtctcttccgcatcgacaaaaggcccctccgtcttccccctcgcaccctcctccaaaagcacatccggcggaaccgcagccctcggatgcctagtcaaggactacttcccggaacccgtaacagtctcctggaactccggagcccttacctcgggcgtccatactttccccgccgtcctccaatcgtccggcctctactcactctcctcagtcgtaacagtcccatcctcctcccttggcacccaaacatacatctgcaatgtcaatcacaaaccctcaaacaccaaagttgacaaaaaggtcgaacccaaatcctgcgacaaaactcatacctgcccaccctgccccgcccccgaagccgccggagctccctccgtattcctcttccctcccaaacccaaagacaccctcatgataagccgcaccccagaagtgacctgtgtcgtagtcgacgtatcacacgaagatcctgaagttaaattcaactggtacgtcgacggcgtagaagtccacaacgccaaaacaaaaccacgtgaagaacaatacaactcaacataccgcgtcgtatccgtcctcaccgtcctccaccaagactggctaaacggcaaagaatacaaatgcaaagtatccaataaagccctccccgcaccgatcgagaaaaccatatccaaagccaaaggccaaccccgcgaacctcaagtttacaccctcccaccctctcgagaagaaatgaccaaaaaccaagtttccctaacctgcctcgtcaaaggcttctacccctctgacatagccgtcgaatgggaatcaaacggccaacccgaaaacaactacaaaaccaccccacccgtcctcgactccgacggcagtttcttcctctactcaaaactcaccgtcgacaaatcccgctggcaacaaggcaatgtattctcatgctccgtcatgcacgaagcactccacaaccactacacccagaaaagcctctccctctcccccgga

SEQ ID NO: 53711 - RNA, 642 nt, synthetic construct
  misc_feature 1..642: note = derived and/or modified sequence opt11 from Domagrozumab_LightChain1
  source 1..642: mol_type = other RNA
gacatccaaatgacccaatccccctcctccttatccgcatccgtcggcgaccgcgtcaccatcacatgcaaagcctcccaagacgtatccaccgccgtagcctggtaccaacaaaaacccggaaaagcccccaaactcctaatctactcagcctcctaccgatataccggcgtcccctcccgcttctcaggctccggctccggcaccgacttcaccctcaccatctcctcactccaacccgaagacttcgccacctactactgccaacaacactactccaccccctggaccttcggcggcggcaccaaagtcgaaatcaaacgcacagtcgccgccccctccgtcttcatcttcccaccctcagacgaacaactcaaatcgggcaccgcctccgtcgtctgcctcctcaacaacttctacccccgcgaagccaaagtccaatggaaagtcgacaacgccctccaatccggcaactcccaagaatccgtcaccgaacaagactccaaagactccacctactccctctcatccacactgaccctctccaaagccgactacgaaaaacacaaagtctacgcctgcgaagtcactcaccaaggcctctcctcccccgtcaccaaatcattcaaccgcggcgaatgc

SEQ ID NO: 53712 - RNA, 1335 nt, synthetic construct
  misc_feature 1..1335: note = derived and/or modified sequence opt11 from Drozituab_HeavyChain1
  source 1..1335: mol_type = other RNA
gaagtccaactcgtccaatccggtggcggagtagaacgccccggaggctccctccgcctctcatgcgcggcctcaggattcaccttcgacgactacgctagctgggtccgacaagcccccggcaaaggcctcgaatgggtatctggcatcaactggcaaggcggatccaccggctatgcagactccgtcaaaggacgcgtgaccatctcaagagacaacgccaagaactccctctacctacaaaactccctccgagccgaagacaccgccgtctactactgcgccaaaatcctaggggcaggacgaggctggtactttgactactggggcaagggcactaccgtcaccgtctcctccgcatccacgaaaggcccctccgtcttccccctcgctccctcgtccaaatccacctcaggcggcacagccgccctcggctgcctagtcaaagactacttccccgaacccgtcaccgtctcctggaactccggcgccctcacctccggcgtacacacattccccgccgtactccaatcatcaggactatactccctctcgtccgtcgtcaccgtcccctcctccagcctcggcacccaaacctacatatgcaacgtcaaccacaaaccctccaacaccaaagtagacaagaaagtagaacccaaatcatgtgacaaaacccacacctgtccaccctgccccgctcccgaactactaggaggcccctctgtattcctctttcccccaaaacccaaagacaccctaatctcccgcacacccgaagttacttgcgtagtagtcgacgtatcccacgaagacccagaagtcaaattcaactggtacgttgacggagtagaagtacacaacgctaaaaccaaaccccgcgaagaacaatacaactcaacataccgagtcgtttccgtcctcacagtcctccaccaagattggttaaacggaaaagaatacaaatgcaaagtatccaacaaagccctaccagcaccaatcgaaaagaccatcagcaaagccaaaggccaaccccgcgaaccccaagtatacaccctcccaccctctcgcgaagaaaccaaaaatcaagtcagccttacctgcctcgtaaaaggcttctacccctccgacatcgccgtcgaatgggaaagcaacggccaacccgaaaacaactacaaaaccaccccacccgtcctcgactccgacggctcattcttcctctactctaaactcaccgtcgacaaatcacgatggcaacaaggcaacgtattcagctgctccgtgcacgaagccctccacaaccactacacccagaaatccctatctctctcgcccggc

SEQ ID NO: 53713 - RNA, 639 nt, synthetic construct
  misc_feature 1..639: note = derived and/or modified sequence opt11 from Drozituab_LightChain1
  source 1..639: mol_type = other RNA
tccgaactcacccaagaccccgccgtctccgtagccctcggacaaaccgtccgaatcacctgctcaggagacagcctccgatcctactacgcctcctggtaccaacaaaaacccggccaagcccctgtcctcgtcatctacggcgcaaacaaccgtccctccggcatccccgaccgattctcaggctcatcctccggcaacaccgcctccctcaccatcaccggcgcccaagccgaagacgaagccgactactactgcaactccgcagactcctccggcaaccacgtcgtcttcggaggcggcaccaaactcaccgtcctcggccaacccaaagccgccccctccgtcaccctattccccccatcctccgaagaactccaagccaacaaagccaccctagtctgcctaatctccgacttctaccctggcgccgtcaccgtcgcctggaaagccgactcctcaccagtcaaagccggcgtcgaaacaacaaccccctccaaacaatccaacaacaaatacgccgcctcctcctacctatccctcacccccgaacaatggaaatcccacaaaagctactcctgccaagtcacccacgaaggatccacagtcgaaaaaaccgtcgcccccacagaatgctca

SEQ ID NO: 53714 - RNA, 1353 nt, synthetic construct
  misc_feature 1..1353: note = derived and/or modified sequence opt11 from Drozitumab_HeavyChain1
  source 1..1353: mol_type = other RNA
gaagtacagctcgtccagtccggcggcggagtcgagcgaccaggcggatccctcagactctcatgcgcagcatccggcttcaccttcgacgactacgcaatgtcctgggtccgccaagcacccggcaaaggactcgaatgggtctccggcatcaactggcaaggcggaagcaccggctacgcagactccgtaaaaggaagagtcaccatctcccgcgacaacgccaaaaactccctatacctccagatgaatagcctccgcgccgaagacaccgccgtatactactgcgccaaaatcctcggcgccggccgcggttggtatttcgactactggggaaaaggcaccaccgtaaccgtaagctccgcctccaccaaaggcccctccgtcttcccacttgcaccttcctcaaaaagcacctccggcggaacagccgccctcggctgcctcgtgaaagactacttccccgaaccagtcactgtctcctggaactccggcgccctaacctccggcgtacacaccttccccgcagtcctccaatcctccggcctatactcactctcctccgtcgtaacagtcccatcctcctccctcggaacccaaacctacatctgcaacgtcaaccacaaaccctccaacacaaaagtcgacaagaaagtagaacccaaatcttgcgacaaaacacatacctgcccaccctgcccagcccccgaacttttaggtggtcccagcgtattcctatttccacccaaacccaaagacaccctcatgatatctcgaacccccgaagtaacctgcgtcgttgtcgacgtcagccacgaagaccccgaagtcaaatttaactggtacgtcgacggcgttgaagtccacaacgccaaaactaaacccagagaggaacaatacaactcaacctaccgcgtcgtctccgtcctcaccgtacttcaccaagactggctcaacggcaaagaatacaaatgcaaggtgtccaacaaagcactacccgcccccatcgagaaaaccatcagcaaagccaaaggacaaccacgcgaaccccaagtctacacactcccaccctcccgcgaagaaatgaccaaaaaccaagtctcactaacctgcctcgtcaaaggcttctacccctccgacatagccgtcgaatgggaaagcaacggccaacccgaaaataactacaaaaccactcccccagtactcgactcagacggcagcttcttcttatactccaaactaacggtcgacaaatcccgatggcagcaaggaaacgtattctcctgcagcgtcatgcacgaagctctccacaatcactacacccaaaaatcactctccctctcccccggcaaa

SEQ ID NO: 53715 - RNA, 639 nt, synthetic construct
  misc_feature 1..639: note = derived and/or modified sequence opt11 from Drozitumab_LightChain1
  source 1..639: mol_type = other RNA
tccgaactcacccaagaccccgccgtctccgtcgccctcggccaaaccgtccgcatcacctgctccggcgactccctccgctcctactacgcctcctggtaccaacaaaaacccggccaagcccccgtactcgtcatctacggcgccaacaaccgcccatccggcatccccgaccgcttctccggctcatcatcaggcaacaccgcctccctcaccatcaccggagcccaagccgaagacgaagccgactactactgcaactccgccgactcctccggcaaccacgtcgttttcggcggcggaaccaaactcaccgtcctcggccaacccaaagccgccccctcagtcacactcttccccccctcctccgaagaacttcaagccaacaaagccaccctcgtatgcctaatctccgacttctaccccggcgccgtcaccgtagcctggaaagccgactcctcccccgtcaaagccggcgtcgaaacaaccaccccctccaaacaatccaacaacaaatacgccgcctcctcctacctatcccttacccccgaacaatggaaatcccacaaatcctactcatgccaagtaacccacgaaggctcaaccgtcgaaaaaaccgtcgcccccaccgaatgctcc

SEQ ID NO: 53716 - RNA, 1353 nt, synthetic construct
  misc_feature 1..1353: note = derived and/or modified sequence opt11 from Duligotumab_HeavyChain1
  source 1..1353: mol_type = other RNA
gaagtacagctagtagaatcaggaggcggcctcgtccaacccggcggcagcctaagactatcctgcgcggcctcaggattcacactatcaggcgactggatccactgggtccgccaagctcccggcaaaggcctcgaatgggtcggcgaaatctccgccgccggcggctacaccgactacgccgactccgtcaaaggacgcttcaccatctccgccgacacctccaaaaacaccgcctatctccaaatgaactccctccgcgccgaagacacagccgtctactactgcgcccgggaatcacgcgtatccttcgaagcagccatggactactggggccaaggcaccctagtcaccgttagctccgcctccaccaaaggacccagcgtatttcccctagctccctcctccaaatccacctccggaggcaccgccgccctcggatgcctcgtgaaagactacttccccgaacccgtcaccgtcagttggaactccggagcactcacatccggcgtccacacattccccgccgtactacaaagctccggcctctactcactctcatcagtagtaaccgtgccctcaagctccctaggcacccaaacatacatatgcaatgtcaatcacaaaccatccaacaccaaagtcgacaagaaagtcgaaccaaaatcctgcgacaaaacccacacatgcccaccatgcccagcacccgaactcctcggcggcccatccgtattcctcttcccaccgaaacccaaagacaccctgatgatctcacgcacacccgaagtcacatgcgtcgtagtcgatgtctcccacgaagaccccgaggtaaaattcaactggtacgtcgacggcgtcgaagtacacaacgccaaaacaaaaccccgcgaggaacaatacaacagcacctaccgcgtagtgagcgtcctcacagtactgcaccaagactggctcaacggcaaagaatacaaatgcaaagtctcgaacaaagcgctccccgcacccatcgagaaaaccatatcaaaagccaagggccaaccccgtgaaccccaagtctatactctcccaccctcacgcgaagaaatgaccaaaaaccaagtctccctaacatgcctagtcaaaggattctacccctccgacatcgccgtcgaatgggaatcaaacggccaacccgaaaacaactacaaaacaacccctcccgtcctagactcagacggcagcttctttctatactccaagctaaccgtcgacaaatcccgatggcaacaaggcaacgtattctcctgcagcgtcatgcacgaagccctccacaaccactacacccaaaaatcgctctccctttcccccggaaaa

SEQ ID NO: 53717 - RNA, 642 nt, synthetic construct
  misc_feature 1..642: note = derived and/or modified sequence opt11 from Duligotumab_LightChain1
  source 1..642: mol_type = other RNA
gacatccaaatgacccaatcaccatcctccctctccgcatccgtcggcgaccgagtaaccataacctgccgcgcatcccaaaacatcgccaccgacgtcgcctggtaccaacaaaaacccggcaaagcccccaaactcctcatctactccgcctccttcctctactccggcgtcccctcccgcttctccggctcaggctccggcaccgacttcaccctaaccatctcctccctccaacccgaagacttcgccacctactactgccaacaatccgaacccgaaccctacaccttcggccaaggcaccaaagtcgaaatcaagcgcaccgtagcagccccctcagtcttcatcttcccaccctccgacgaacaactcaaatcaggcaccgcctccgtcgtctgcctacttaacaacttctacccccgagaagccaaagtccaatggaaagtcgacaacgccctccagtccggcaactcccaagaatccgtcacagaacaagactccaaagactcgacctactccctatcctcaaccctcaccctctcaaaagccgactacgaaaaacacaaagtctacgcctgcgaagtcacccaccaaggcctctcctcccccgtcaccaaatcattcaaccgcggcgaatgc

SEQ ID NO: 53718 - RNA, 1353 nt, synthetic construct
  misc_feature 1..1353: note = derived and/or modified sequence opt11 from Duligotuzumab_HeavyChain1
  source 1..1353: mol_type = other RNA
gaagtccagctagtcgaatccggcggcggcctcgtccaacccggcgggtctctcagactcagctgcgcagcaagcggcttcaccctctccggcgactggatccactgggtacgccaagcccccggaaaaggactcgaatgggtcggagaaatctccgccgccggaggatacaccgactacgcagactccgtaaagggacgattcaccatctccgctgacacctccaaaaacaccgcctacctacaaatgaacagcttacgcgctgaagacacagcagtctactactgcgcccgcgagtcaagagtatccttcgaggccgcaatggactactggggccaaggcaccctagtcaccgtcagctctgcatcaaccaaaggcccctcagtattccccctcgcccccagctccaaatcaacatccggcggcaccgccgccctaggctgcctcgtcaaagactatttccccgaacccgtcaccgtgtcctggaactcaggcgccctcacctcaggcgttcacaccttccccgcagtcctccaatcatctggcctatactccctatcatccgtcgttaccgtaccctcgagctccctgggcacgcaaacatacatatgcaacgtcaaccacaaaccatctaataccaaagtcgacaagaaagtagaacccaaatcctgcgacaaaacccacacctgtccaccctgccccgcccccgaactcctcggcggtccctcagtatttctcttcccacccaaacccaaagacacattaatgatctcccgcacacccgaagttacctgcgtcgtcgtcgacgtcagccacgaagaccccgaagtcaaattcaactggtacgtcgatggcgtcgaagtccacaacgccaaaacaaaaccccgagaagaacaatataactctacatatcgcgtcgtcagcgtcctaaccgtgctacaccaagactggctcaacggaaaagaatacaaatgcaaagtctcaaacaaagccctacccgcccccatcgagaaaaccatatccaaagccaaaggccaaccccgcgaaccccaagtctacactctccctccctctcgcgaagaaatgaccaaaaaccaagtctccctaacctgcctcgtaaaaggcttctacccctccgacatagcagtcgaatgggaatccaacggccaacccgaaaacaactacaaaaccaccccgcccgtcctcgactccgacggctcattcttcctctactccaaactcacagtagacaaatcccgctggcaacagggtaacgtcttctcctgttccgtcatgcatgaagccctccacaaccactacacccaaaaatccctttcactttcccccggaaaa

SEQ ID NO: 53719 - RNA, 642 nt, synthetic construct
  misc_feature 1..642: note = derived and/or modified sequence opt11 from Duligotuzumab_LightChain1
  source 1..642: mol_type = other RNA
gacatccaaatgacccaatccccctcctccctatccgcctccgtcggcgaccgcgtcaccataacctgccgcgcctcacaaaacatcgcaaccgacgtcgcctggtaccaacaaaaacccggcaaagcccccaaactcctcatctactccgcctccttcctctactccggcgtcccctcccgcttctcaggctcaggctccggcaccgacttcaccctaacaatctcatccctccaacccgaagacttcgccacctactactgccaacaatccgaaccagaaccatacaccttcggccaaggaaccaaagtcgaaatcaaacgcacagtcgccgccccctcagtattcatcttcccaccctccgacgaacaactcaaatccggaacagcctccgtcgtctgcctcctcaacaacttctacccccgagaagccaaagtccaatggaaagtcgacaacgcactccaatccggcaactcccaagaatccgtcaccgaacaagactcaaaagactccacctactccctctcctcaaccctaaccctctccaaagccgactacgaaaaacacaaagtatacgcctgcgaagtcacccaccaaggcctatcctcccccgtcacaaaatccttcaacagaggcgaatgc

SEQ ID NO: 53720 - RNA, 1353 nt, synthetic construct
  misc_feature 1..1353: note = derived and/or modified sequence opt11 from Dupilumab_HeavyChain1
  source 1..1353: mol_type = other RNA
gaagtccagctagtagaatcaggcggcggcctcgaacaaccaggaggctccctccgcctctcatgcgcaggctccggcttcaccttccgcgactacgccatgacctgggtacgccaggccccaggcaagggactcgaatgggtctcaagcatctccggatccggaggcaacacctactacgccgactcagtcaaaggacgcttcaccatctcacgtgacaactccaaaaacaccctatacctccaaatgaactccctacgagctgaagacaccgccgtctactactgcgccaaagaccgcttatccatcacaatccgcccacgctactacggactagacgtatggggccaaggcacaaccgtcaccgtgagctcagcatcaaccaaaggcccctccgtcttccccctcgctccctgctcccgatcaacctccgaatcaacagccgccctaggatgcctcgtcaaagactacttccccgaacccgtaaccgtatcatggaatagcggggccctcacctccggcgtgcacacattccccgccgtactccaatcctcaggcctctactccctctcctctgtcgtcaccgttccgagctcctccctgggcacaaaaacctatacctgcaacgtcgaccacaaaccctcgaacaccaaagtcgacaaacgcgtcgaatcaaaatacggacccccatgcccaccctgccccgcccccgaatttctcggcggcccctccgtcttcctattcccaccaaaacccaaagacacactcatgatctctcgcactccagaagtaacctgcgtcgttgtcgacgtcagccaagaagatcccgaagtccagttcaactggtacgtcgacggcgtagaagtccacaacgctaaaaccaagccaagagaagaacaattcaactcaacctaccgtgtcgtatccgtcctcacagtactacaccaagactggctcaacggcaaagaatacaaatgcaaagtatcgaacaagggtctgccatcatctatagagaaaacaatctccaaagccaaaggacaaccccgcgaaccccaagtttacaccctcccaccctcacaagaagaaatgaccaaaaaccaagtatccctaacatgcctagtcaaaggattctacccaagcgacatcgcagtggagtgggaatccaacggccaacctgaaaacaactacaaaaccacacccccggtcctagactccgacggatccttcttcctatacagccgcctcaccgtcgacaagtcccgctggcaagaaggaaacgtattctcatgctccgtcatgcacgaagcattgcacaatcactacacccaaaaatccctttccctatcactcggc

SEQ ID NO: 53721 - RNA, 657 nt, synthetic construct
  misc_feature 1..657: note = derived and/or modified sequence opt11 from Dupilumab_LightChain1
  source 1..657: mol_type = other RNA
gacatcgtcatgacccaatcacccctctctctccccgtcacccccggcgaacccgcctcaatctcctgccgctcctcacaatccctcctctactccatcggctacaactacctagactggtacctccaaaaatccggccaatcaccccaactcctcatctacctcggctccaaccgcgcctccggagtcccagaccgattctccggctccggctcaggcaccgacttcaccctcaaaatctcccgcgtcgaagccgaagacgtcggattctactactgcatgcaagccctacaaaccccctacaccttcggccaaggcaccaaactcgaaatcaaacgcaccgtcgcagcaccctccgtcttcatcttcccaccctcagacgaacaactcaaatccggcaccgcatccgtcgtctgcctcctcaacaacttctacccccgtgaagccaaagtccaatggaaagtcgacaacgccctccaatccggcaactcccaagaatcagtcaccgaacaagactccaaagactccacctactccctatcatcaaccctcaccctctccaaagcagactacgaaaaacacaaagtatacgcatgcgaagtcacccaccaaggcctctcctcccccgtgaccaaatccttcaaccgcggcgaatgc

SEQ ID NO: 53722 - RNA, 1353 nt, synthetic construct
  misc_feature 1..1353: note = derived and/or modified sequence opt11 from Durvalumab_HeavyChain1
  source 1..1353: mol_type = other RNA
gaagtacagctagtcgaatcaggcggcggactcgtccaacccggaggctcacttcgcctctcatgtgccgcctcgggattcaccttctcccgatactggatgtcttgggtccgccaagcacccggtaaaggactggaatgggtcgccaacatcaaacaggacggatccgaaaaatactacgtagacagcgtcaaaggccgcttcacaatctcgcgcgacaacgccaaaaactccctatacctccaaatgaactcactccgagcagaagacaccgccgtatactactgcgcccgagaaggcggttggttcggcgagctagccttcgactactggggccaaggcaccctcgttaccgtctcctccgcctccaccaaaggccccagcgtcttcccactagcgccctccagcaaatcaacaagcggcggaaccgccgcactcggttgcctcgtcaaagactacttccccgaacccgtcaccgtgtcctggaacagcggagccctgacatcaggagtccacaccttcccagcagtcctccagagctcaggcttatactcccttagctccgtagtcaccgtcccctcctcttcactaggaacacaaacatacatctgcaacgtcaaccacaagccatccaacaccaaagtagacaaacgcgtcgaaccgaagtcgtgcgacaaaacccacacttgcccaccctgccccgcacccgagttcgaaggaggaccctcagtcttcctattcccacccaaacccaaagacacactgatgatatcacgcacacccgaagtaacctgtgtcgtagttgacgtatcccacgaggaccccgaagtaaaattcaactggtacgtagacggagtcgaagtccacaacgccaaaacaaaacctcgcgaagaacaatacaactccacctaccgagtcgtctccgtcctaactgtactccaccaagactggctcaacggcaaagaatacaaatgcaaagtctccaacaaagccctccccgcctccatcgagaaaaccatctcaaaagccaaaggccaaccccgcgaaccccaagtctacaccttgcctcccagccgcgaagaaatgaccaaaaaccaagtatctcttacctgcctcgtcaaaggcttctacccctccgatatcgcagtcgaatgggaatctaatggccaacccgaaaacaactacaaaaccaccccacccgtcctcgacagcgacggctccttcttcctatacagcaaactaaccgtcgacaaatctagatggcaacaaggaaacgtcttctcctgctcagtaatgcacgaagccctccacaaccactacactcaaaagagcctgtccctctcacccggcaaa

SEQ ID NO: 53723 - RNA, 645 nt, synthetic construct
  misc_feature 1..645: note = derived and/or modified sequence opt11 from Durvalumab_LightChain1
  source 1..645: mol_type = other RNA
gaaatcgtcctcacccaatcccccggcaccctctccctatcccccggcgaacgagccaccctctcctgccgagcctcccaacgcgtctcctcctcctacctcgcctggtaccaacaaaaacccggccaagccccacgcctacttatctacgacgcctcatcccgcgccactggcatccccgaccgcttctcaggctcaggatccggcaccgactttaccctaactatctcccgcctcgaacccgaagacttcgccgtctactactgccaacaatacggctccctcccctggaccttcggccaaggcaccaaagtcgaaataaaacgcaccgtcgccgccccatccgtcttcatcttcccaccctccgacgaacaactcaaatccggcacagcctcagtcgtctgcctactcaacaacttctaccccagagaagccaaagtccaatggaaagtcgacaacgccctccaatccggaaactcccaagaatcagtcaccgaacaagactccaaagactcaacttactccctctcctcaaccctcaccctctccaaagccgactacgaaaaacataaagtctacgcctgcgaagtcacccaccaaggcctctcctcacccgtcacaaaatccttcaaccgcggcgaatgt

SEQ ID NO: 53724 - RNA, 1338 nt, synthetic construct
  misc_feature 1..1338: note = derived and/or modified sequence opt11 from Dusigitumab_HeavyChain1
  source 1..1338: mol_type = other RNA
caagtacaactcgtccaatcaggcgcagaagtgaaaaagcccggagcctccgtcaaagtctcctgcaaagcctctggatacacctttacctcctacgacatcaactgggttcgacaagcaacaggccaaggcctcgaatggatgggctggatgaatcccaactccggcaacaccggctacgcacaaaaattccaaggccgcgtcaccatgacccgcaacacctcaatctccactgcctacatggaactctcatccctccggagcgaagacacagccgtctactactgcgcccgagacccctactactactactacggcatggacgtctggggccaaggcaccacagttaccgtctcaagcgcctcaaccaaggggccctccgtcttccccctcgccccatgctcacgctcgacctctgaatcaacagccgccctaggatgcctcgtcaaagattacttccccgaaccagtcacagtctcctggaactctggcgcactcacctccggcgtccacaccttccccgccgtcctacaatcatcaggcctctattccctgtcctcagttgtcaccgtaccctcttccaacttcggcacacaaacctatacctgcaacgtcgaccacaaaccctccaacacaaaagtagacaaaaccgtcgaacgcaaatgctgcgtcgagtgccctccctgccctgctcctcccgtcgccggcccctccgtcttcctattcccacccaaacccaaagataccctcatgatctcacgcacacccgaagtaacctgcgtcgtcgtcgacgtcagccacgaagaccccgaagtccaattcaactggtacgtggacggcgtcgaggtacacaacgcaaaaaccaaaccccgcgaagaacaattcaattcaaccttccgcgtcgtctctgtccttaccgtagtccaccaagactggctcaacggcaaagaatacaagtgcaaggtctccaataaaggcctccccgcccccatcgagaaaactatctccaaaaccaaaggccaaccccgcgaaccccaagtatacacactcccgccctcccgcgaagaaatgactaaaaaccaagtctccctcacatgcttggtcaagggattctacccctccgacatagcggtcgaatgggaatccaacggccaacccgaaaacaactacaaaaccacacccccaatgctcgactcagacggatccttcttcctctactccaaactcaccgtcgacaaaagccgatggcagcaaggaaacgtcttctcctgctccgtcatgcacgaagccctacacaaccactacacccaaaaatcactatccctctcacccggcaaa

SEQ ID NO: 53725 - RNA, 651 nt, synthetic construct
  misc_feature 1..651: note = derived and/or modified sequence opt11 from Dusigitumab_LightChain1
  source 1..651: mol_type = other RNA
caatccgtcctaacacaacccccctcagtcagcgccgccccaggccaaaaagtaaccatctcctgctccggctcctcctccaacatcgaaaacaaccacgtctcctggtaccaacaactcccaggcaccgcccccaaactcctcatctacgacaacaacaaacgcccctccggcatccccgaccgcttctccggctccaaatccggaacctccgccaccctcggaatcaccggcctccaaaccggcgacgaagccgactactactgcgaaacctgggacacctccctatccgccggccgcgtcttcggcggcggcaccaaactcaccgtcctcggccaacccaaagccgccccatccgtcaccctcttccccccctcatccgaagaactacaagccaacaaagccaccctcgtctgcctcatctccgacttctaccccggcgcagtcaccgtcgcctggaaagcagactcctcccccgtaaaagcaggcgtcgaaaccaccaccccctccaaacaatctaacaacaaatacgcagcctcctcctacctctccctcacccccgaacaatggaaatcccaccgctcctactcctgccaagtcacccacgaaggctccaccgtcgaaaaaaccgtcgcccccaccgaatgctcc

SEQ ID NO: 53726 - RNA, 1347 nt, synthetic construct
  misc_feature 1..1347: note = derived and/or modified sequence opt11 from Ecromeximab_HeavyChain1
  source 1..1347: mol_type = other RNA
gaagtcaccctcgtagaatccggcggagacttcgtaaaacccggcggaagcctaaaagtaagctgcgcagcatccggcttcgcattctcccactacgccatgtcttgggtccgccaaacccccgcaaaaaggctagaatgggtcgcatacatctcctcaggtggctccggcacctattactccgactccgtcaaaggacgctttaccatctccagagacaacgccaaaaacaccctatacctacaaatgcgaagcctccgctccgaagactcagcaatgtacttttgcacccgagtcaaactcggaacctactacttcgactcctggggccaaggaaccaccctcaccgtcagcagcgcatccaccaaaggcccctccgtcttccccctcgccccctcatcaaaatccacctccggtggaacagccgcccttggctgtctagtcaaagactatttccccgaacccgtaacagtatcctggaacagcggagccctcacctcaggagtccacacattccccgcagtcctccaatcttccggactctactcactctcctcagtagtaaccgtcccatcctccagcttaggaacccaaacctacatctgcaacgtaaaccacaaaccctcaaacacaaaagttgacaagaaagtcgaacccaaatcatgcgacaaaacccatacctgcccaccctgccccgcccccgaactcctcggaggccccagcgtcttcctcttcccaccaaaaccaaaagacaccctcatgatctcccgaacccccgaagtaacctgcgtcgtcgtcgacgtcagccacgaagaccccgaggtcaaattcaactggtacgtagatggcgtcgaagtccacaacgccaaaactaaacccagagaagaacaatacaacagcacctaccgcgtcgtcagcgtactaacagtactgcaccaagattggctaaatggcaaagaatacaaatgcaaagtatcaaacaaagccctccccgcccccatcgagaaaaccatctccaaagccaaaggccaaccacgcgaaccacaagtctacacactacctccctcccgcgacgaactaaccaaaaaccaagtctccctaacctgcctcgtcaaaggcttctacccctcagacatagccgtcgaatgggaatccaacggccagcccgaaaacaactacaaaacaaccccacccgtcctcgattcagacggatcattcttcctttactccaaactcaccgtagacaaatcccgctggcaacaaggcaacgtcttctcatgctccgtcatgcacgaagcactccacaatcattacacccaaaaatccctctctctatcccccggcaag

SEQ ID NO: 53727 - RNA, 642 nt, synthetic construct
  misc_feature 1..642: note = derived and/or modified sequence opt11 from Ecromeximab_LightChain1
  source 1..642: mol_type = other RNA
gacatccaaatgacccaaactgcctcttccctccccgcctccctcggcgaccgcgtcaccatctcctgctccgcctcccaagacatctccaactacctcaactggtaccaacaaaaacccgacggcaccgtcaaactcctaatcttctactcctccaacctccactccggcgtcccctcccgcttctcaggcggcggctccggcacagactactccctaaccatcagcaacctcgaaccagaagacatcgccacctacttctgccaccaatactccaaactcccctggacattcggaggcggcaccaaactcgaaatcaaacgaaccgtcgccgcccccagcgtcttcatattccctccctcagacgaacaactcaaatcaggcaccgcatccgtcgtctgcctactcaacaacttctacccccgcgaagccaaagtccaatggaaagtcgacaacgccctccaatccggcaactcccaagaatccgtcaccgaacaagactccaaagactccacctactccctctcatccaccctcaccctctctaaagccgactacgaaaaacacaaagtctacgcctgcgaagtcacccaccaaggcctctcctcccccgtcaccaaatcattcaacagaggcgagtgc

SEQ ID NO: 53728 - RNA, 1341 nt, synthetic construct
  misc_feature 1..1341: note = derived and/or modified sequence opt11 from Eculizumab_HeavyChain1
  source 1..1341: mol_type = other RNA
gtacaactcgttcaatcaggcgccgaagtcaagaaacccggagcctcagtcaaagtatcatgcaaagcctccggctacatattcagcaactactggatccaatgggtccgccaagcccccggacaaggcctagaatggatgggcgaaatcctcccaggctccggctcaaccgaatacaccgaaaacttcaaagaccgcgtcaccatgacacgtgacacctcaacctccacggtatacatggaactatcctccctccgatccgaagacacagcagtatactactgcgcccgctacttcttcggctcatcacccaactggtacttcgacgtatgggggcagggcaccctcgtaacagtctcctccgcgtccacaaaaggcccctccgtcttccccctcgcaccatgctcacgctccacctctgaatcaaccgcagcccttggctgcctcgtcaaggattacttccccgaacccgttaccgtctcctggaactcaggcgcactaacctccggcgtccacaccttcccagctgtacttcaatcctcaggactctactccctttcatcagtcgtgacagtcccctcctccaacttcggaacacaaacctacacatgcaacgtcgaccacaaaccatccaacacaaaagtcgacaaaaccgtcgaacgcaaatgctgcgtagaatgccctccctgccccgcccctcccgtcgccggcccctcagtcttcctattcccacccaaacctaaggacaccctcatgatttcccgcacacccgaagttacctgcgtcgtcgtcgacgtctcacaagaagacccagaagtacaattcaactggtacgtcgacggcgtcgaagtccacaacgcaaagaccaaaccccgcgaagaacaattcaactctacctaccgcgtcgtctccgtcctcaccgtcctccaccaagactggctcaacggcaaagaatacaaatgcaaagtctccaacaaaggactaccctcgtccatcgagaaaaccatatccaaagctaagggccaaccccgcgaaccccaagtctatacactcccaccctcacaagaagaaatgaccaaaaaccaagtctcactaacctgcctcgtcaaaggcttctacccaagcgacatagccgtcgaatgggaatccaacggccagcctgaaaacaattacaagaccaccccacccgtactcgacagcgacggctccttcttcctctactctcgtctcaccgtggacaaatcccgctggcaagaaggcaacgtcttctcgtgctcagtcatgcatgaagcacttcacaaccactacacccaaaaatcactctccctctccctcggcaaa

SEQ ID NO: 53729 - RNA, 642 nt, synthetic construct
  misc_feature 1..642: note = derived and/or modified sequence opt11 from Eculizumab_LightChain1
  source 1..642: mol_type = other RNA
gacatccaaatgacccaatccccctcatccctctccgcaagcgtaggcgaccgcgtcaccatcacctgcggcgcctccgagaacatctacggcgccctaaactggtaccaacaaaaacccggcaaagcccccaaactcctcatctacggcgccaccaacctcgccgacggagtcccctcccgcttctcaggctccggctcaggcaccgacttcaccctaaccatatcatcccttcaacccgaagacttcgccacctactactgccaaaacgtcctcaacacccccctcaccttcggccaaggcaccaaagtcgaaataaaacgcaccgtcgccgccccctcagtattcatcttccccccctccgacgaacaactaaaatccggcacagcctccgtcgtctgcctactaaacaacttctacccccgcgaagccaaagtccaatggaaagtcgacaacgccctccaatccggcaactcacaagaatccgtaaccgaacaagacagcaaagactcaacctactccctaagctccaccctcaccctatccaaagccgactacgaaaaacacaaagtctacgcctgcgaagtcacacaccaaggcctaagctcccccgttaccaaatccttcaaccgcggcgaatgc

SEQ ID NO: 53730 - RNA, 375 nt, synthetic construct
  misc_feature 1..375: note = derived and/or modified sequence opt11 from Efalizumab_HeavyChain
  source 1..375: mol_type = other RNA
gaagtgcaattggtcgagagcgggggcgggctcgtgcaaccgggcgggagcttacgcttgagctgtgccgcgagcgggtactcgttcacgggccattggatgaactgggtcaggcaagcgcccgggaaagggctcgagtgggtgggcataatgatacacccgagcgatagcgagaccaggtacaatcaaaagttcaaggacatacgctttaccataagcgtggacaagagcaagaacacgctctatctccagatgaatagcttgcgcgcggaagataccgcggtctattactgtgccaggatcgggatctatttctatggcacgacctatttcgattacatatgggggcaagggaccttggtcacggtctcgagc

SEQ ID NO: 53731 - RNA, 324 nt, synthetic construct
  misc_feature 1..324: note = derived and/or modified sequence opt11 from Efalizumab_LightChain
  source 1..324: mol_type = other RNA
gacatccaaatgacccaatccccctcatccctctccgcctccgtcggcgaccgcgtcaccatcacctgccgcgcctccaaaaccatctccaaatacctagcctggtaccaacaaaaacccggcaaagcccccaaactcctaatctactccggctccaccctccaatccggcgtcccctcccgcttctccggctccggctccggcaccgacttcaccctcaccatctcctccctccaacccgaagacttcgccacctactactgccaacaacacaacgaataccccctcaccttcggccaaggcaccaaagtcgaaatcaaacgc

SEQ ID NO: 53732 - RNA, 768 nt, synthetic construct
  misc_feature 1..768: note = derived and/or modified sequence opt11 from Efungumab_SingleChain_variable_fragment
  source 1..768: mol_type = other RNA
atggcagaagtgcaactggtcgaaagcggggccgaggtcaagaaaccgggcgagagcttgcgcataagctgcaaaggaagcgggtgcataatctcgagctattggataagctgggtcagacaaatgcccgggaaagggctcgagtggatgggcaagatcgatcccggggactcgtacataaactatagcccgagctttcaaggacacgtgaccataagcgcggacaagagcataaacacggcctatctccaatggaatagcttgaaagcgagcgataccgcgatgtattactgcgccaggggcgggcgcgatttcggggactcgttcgactactggggccagggaacactcgtgaccgtgagctcaggcggaggaggcagcgggggcgggggctcgggaggaggaggaagcgacgtcgtgatgacacaatcaccctcgttcctgagcgcattcgtgggcgaccgcataaccataacatgccgagcaagctcaggcataagcaggtacctggcctggtaccaacaagcgccagggaaagcgcccaagctcttgatctacgccgcaagcacgctccagaccggagtaccaagcaggttctcgggatcgggctcgggcacggagttcaccctaaccataaactcgctccaacccgaagacttcgccacgtactattgccagcacctgaactcgtacccgctcacgttcgggggcgggaccaaggtcgacatcaagcgcgcggccgcactcgaacaccaccaccatcaccac

SEQ ID NO: 53733 - RNA, 1362 nt, synthetic construct
  misc_feature 1..1362: note = derived and/or modified sequence opt11 from Eldelumab_HeavyChain1
  source 1..1362: mol_type = other RNA
caaatgcagctagtagaatccggaggaggcgtcgtccaacccggacgatccctcagactctcctgcaccgcctcaggcttcaccttctcaaacaacgggatgcactgggtacgccaagcccccggcaaaggtctcgaatgggtagccgtcatctggttcgacggaatgaacaaattctacgtcgactcagtcaaaggccgattcaccatctcccgagacaactcgaaaaacaccctctacctcgagatgaactccctacgcgccgaagacaccgccatctactactgtgcacgcgaaggagacggcagcggcatatactactactacggcatggacgtctggggtcaaggcactacagtaaccgtatcctcagccagcaccaaaggaccttcggtcttccccctcgccccctcctcaaaatcaaccagcggaggcaccgccgccctaggatgcctcgtcaaagactacttcccagaacccgtgaccgtatcatggaactccggagcactcacatccggagtccacaccttcccagccgtcctacaatcctcaggcctctattctctctcctcagtagtaacagtaccttcatcctcactcggcacccagacctacatatgcaacgtcaaccacaagccatccaacacaaaggtcgacaaacgagtagaaccaaaaagctgcgacaaaacccacacatgcccaccctgcccagcccccgaactcctaggcggacccagcgtattcctattcccacccaaacccaaagacacacttatgatctcgcgaacccccgaagtaacctgcgtcgtcgtcgacgtctcccacgaagaccccgaagtcaagttcaactggtacgtcgatggcgtagaagtccacaacgcaaaaaccaaaccccgcgaagaacaatacaactccacctaccgagtagtctcagtcctaactgtactccaccaagactggctcaatggcaaagaatacaaatgcaaagtatccaacaaagccctccctgcaccgatcgagaaaaccatatccaaagccaaaggccaaccccgcgaaccccaagtatacactctcccaccctctcgcgaagaaatgaccaaaaaccaagtctcactcacctgtctcgttaagggcttctacccctcagacatcgccgtcgaatgggaatcaaacggccagcccgaaaacaactacaaaaccacacctcccgtcctagactcagacggctccttcttcctatactccaaactcaccgtcgacaaatcacgctggcagcaaggcaacgtcttctcctgcagcgttatgcacgaagccctccacaaccactatacccaaaagtccctctcactcagtcccggaaaa

SEQ ID NO: 53734 - RNA, 648 nt, synthetic construct
  misc_feature 1..648: note = derived and/or modified sequence opt11 from Eldelumab_LightChain1
  source 1..648: mol_type = other RNA
gaaatcgtcctcacacaatcccccggcaccctctccctatcccccggcgaacgagccaccctatcctgccgagcctcccaatcagtctcctcctcatacctagcctggtaccaacaaaaacccggccaagcaccccgcctcctaatctacggcgcctcctcccgcgccaccggcatccccgaccgtttctcaggatccggctccggcacagacttcaccctaacaatctcacgcctagaaccagaagacttcgccgtctactactgccaacaatacggctcctctcccatcttcacattcggacccggcaccaaagtcgacatcaaacgcaccgtcgccgccccctccgtcttcatcttcccaccctccgacgaacaacttaaatccggcaccgcctccgtcgtctgcctcctaaacaacttctacccccgcgaagccaaagtccaatggaaagtcgacaacgcactccaatccggcaactcccaagaatccgtcacagaacaagactccaaagactccacctactccctctcctcaaccctcaccctctccaaagccgactacgaaaaacacaaagtctacgcctgcgaagtcacccaccaaggactatcctcccccgtcaccaaatccttcaacagaggagaatgc

SEQ ID NO: 53735 - RNA, 1341 nt, synthetic construct
  misc_feature 1..1341: note = derived and/or modified sequence opt11 from Elgemtumab_HeavyChain1
  source 1..1341: mol_type = other RNA
gaagtacaactcctcgaatccggaggcggcctcgtgcaaccaggaggttcactacgcctatcctgcgcagcctcaggattcacattctcatcatacgccatgtcctgggtacgccaagcccccgggaaaggcctggaatgggttagcgcaatcaactcacaaggaaagtccacctactacgcagattccgtcaagggcagattcaccatatcccgcgacaactccaaaaacaccctctacctccaaatgaactccctccgcgctgaagacaccgccgtctactactgcgcccggtggggcgacgaaggcttcgacatctggggccaaggcaccctagtcacagtctcatcagcatccaccaaaggcccctccgtcttcccactcgccccatcctcaaaatccacctccggcggcaccgccgcactaggctgcctagtcaaagactatttccccgagcccgtaaccgtatcctggaactcaggcgcactcacctcaggcgtgcacaccttcccagcagtcctccaatcatccggactctactccctctcctctgtcgttaccgtaccctcctcaagcctaggcacccaaacttacatctgcaacgtcaaccacaaaccctccaacacaaaagtcgacaaacgcgtagaaccaaagtcctgcgacaaaacccacacatgccctccctgccccgcgccggaacttctcggtggcccatcagtcttcctcttcccgccaaaacccaaagacaccctcatgatctcccgcacccccgaagtaacctgcgtcgtcgtcgacgtatcacacgaagaccccgaagtcaaattcaactggtacgtcgacggcgtagaagtccacaacgccaaaacaaagcccagagaagaacaatacaactccacctaccgcgtagtatccgtcctaacagttctacaccaagactggctcaacggaaaagaatacaagtgcaaagtctccaacaaagctctccccgctcccatcgagaaaaccatcagcaaagccaaaggccaaccccgcgaaccccaagtctacacccttcccccatcccgcgaagaaatgaccaaaaaccaggtctctctcacatgcctagtcaaaggattctacccttccgacatcgcagtcgaatgggagtccaacggccaacccgaaaacaactacaaaacaactcccccagtcctagactccgacggctccttcttcctgtactccaagctgaccgtcgacaaatcccgctggcaacaaggaaacgtattctcatgctccgtcatgcacgaagcactccacaaccactacacccagaaaagcctctccctctcacccggcaaa

SEQ ID NO: 53736 - RNA, 642 nt, synthetic construct
  misc_feature 1..642: note = derived and/or modified sequence opt11 from Elgemtumab_LightChain1
  source 1..642: mol_type = other RNA
gacatccaaatgacccaaagcccctcctccctctccgcctccgtcggcgaccgagtcaccataacctgccgcgcctcccaaggaatctccaactggctcgcctggtaccaacaaaaacccggcaaagcccccaaactactcatctacggcgcctcctccctccaatccggcgtcccctcccgcttctccggctccggctccggcaccgacttcaccctcaccatatcctccctccaacccgaagacttcgccacctactactgccaacaatacagctccttccccaccaccttcggccaaggaaccaaagtcgaaatcaaacgcaccgtcgccgccccctccgtcttcatcttcccaccctccgacgaacaactcaaatccggcactgcctcagtcgtctgcctcctcaacaacttctacccccgagaagccaaagtccaatggaaagtcgacaacgccctccagtccggcaactcccaagaatcagtaaccgaacaagactccaaagactccacctactctctatcttcaaccctcaccctctccaaagccgactacgaaaaacacaaagtctacgcctgcgaagtcacccaccaaggcctctcctctcccgtcaccaaatcattcaaccgcggcgaatgc

SEQ ID NO: 53737 - RNA, 1347 nt, synthetic construct
  misc_feature 1..1347: note = derived and/or modified sequence opt11 from Elotuzumab_HeavyChain1
  source 1..1347: mol_type = other RNA
gaagttcaactcgtagaatcaggcggtggactcgtccaacccggaggatccctccgtctctcctgcgccgcctccggctttgacttctcccgctactggatgtcctgggtacgccaagcccccgggaaaggtctcgaatggatcggcgaaataaaccccgactcctcaaccataaactacgccccctcactaaaagacaaattcatcatatcccgcgataacgccaaaaactccctatacctccaaatgaactctctccgagccgaagacaccgccgtttactactgcgcccgcccagacggcaactactggtacttcgacgtctggggccaaggcaccctagtcactgtctcttccgcctccaccaaaggaccctccgtcttcccccttgccccctcttccaaatccacatccggcggaaccgccgcactcggctgcctcgtcaaagactacttccccgaaccagtcacagtctcatggaacagcggcgccctcacctccggcgtccacaccttccctgccgttctccaatcctccggtctctattccctttcatccgtcgtcaccgtcccctcatcctccctcggcacccaaacatacatctgcaacgtaaaccacaaaccttcaaacaccaaagtcgacaagaaagtagaaccaaaatcatgcgacaaaacccatacctgccctccctgccccgcccccgaactcctcggaggaccctcagtcttcctcttcccacccaaacccaaagacaccttgatgatctctcgcacacccgaagtcacatgcgtcgtcgttgacgtatcccacgaagaccccgaagtcaaattcaactggtacgtagacggggtagaagtacacaacgccaaaaccaaaccccgcgaagaacaatacaacagcacataccgagttgtctccgtcctcactgtcctgcaccaagactggctcaacggcaaggaatacaaatgcaaagtctcaaacaaagcactccccgctcccatcgaaaagaccatctccaaagctaaaggacaacccagagaaccccaagtctacaccctcccaccctcccgagacgaactcaccaaaaaccaagtctccctaacctgcttagtcaaaggtttctacccctccgacatcgccgtcgaatgggaatccaacggtcaacccgaaaacaactacaaaaccaccccacccgtcctagactccgacggctccttcttcctatacagcaaactcaccgtagacaaatcacgatggcaacaaggcaacgttttctcctgcagcgtcatgcacgaagcactacacaaccactacacccaaaaatccctttcactctcacccgggaaa

SEQ ID NO: 53738 - RNA, 642 nt, synthetic construct
  misc_feature 1..642: note = derived and/or modified sequence opt11 from Elotuzumab_LightChain1
  source 1..642: mol_type = other RNA
gacatccaaatgacccaatcaccctcctccctatccgcatccgtcggagaccgcgtcaccataacctgcaaagcctcccaagacgtcggaatcgccgtcgcctggtaccaacaaaaacccggcaaagtccccaaactcctcatctactgggcctccacccgccacaccggcgtccccgaccgattctctggctccggctccggcaccgacttcaccctcaccatctcctccctccaacccgaagacgtagccacctactactgccaacaatactcctcctacccatacaccttcggccaaggcaccaaagtcgaaatcaaacgcaccgtcgcagccccctccgtcttcatcttcccaccctcagacgagcaactcaaatccggcaccgcctccgtcgtctgcctcctaaacaacttctacccccgcgaagccaaagtccaatggaaagtcgacaacgcactccaatccggcaactcccaagaatccgtcaccgaacaagactcaaaagactccacctattcactatcctccaccctaaccctctccaaagccgactacgaaaaacacaaagtctacgcctgcgaagtcacccaccaaggcctctcctcccccgtcaccaaatccttcaaccgaggcgaatgc

SEQ ID NO: 53739 - RNA, 1338 nt, synthetic construct
  misc_feature 1..1338: note = derived and/or modified sequence opt11 from Emactuzumab_HeavyChain1
  source 1..1338: mol_type = other RNA
caagtccagctagtccaatcaggcgccgaagtcaagaaacccggagctagcgtcaaagtcagctgcaaagcctccggatacaccttcacctcatacgacatctcctgggtccgacaagcccccggccaaggactcgaatggatgggtgtaatctggaccgacggaggcaccaattacgcccagaaacttcaaggccgcgtcaccatgaccaccgacacctccactagcacagcctacatggaactccgatccctccgatctgacgacaccgccgtctattactgcgctcgagaccaacgactctattttgacgtatggggccaaggaaccacagtcacagtcagctccgcctccaccaaaggtccctcagtcttccccctcgctccctcctccaaatcaacatccggcggcaccgcagccctaggatgcctcgtcaaagactacttccccgaaccagtaaccgtctcctggaactccggagcactcacatccggagtccacaccttccccgccgtactacaatcatccggcctctactcactatcctccgtcgtaaccgtaccatcatcatcccttggcacccaaacatacatatgcaacgttaaccacaaaccctcaaacaccaaagtcgacaagaaagtcgaacccaaatcatgcgacaaaacccacacatgccctccctgccccgcccccgaactcctcggcggccccagcgtcttcctcttcccacccaaaccaaaagacaccctcatgatctcacgcacccccgaagtgacctgcgtcgtcgtcgacgtcagccacgaagatcctgaagtcaaattcaactggtacgtcgacggcgtcgaagtccacaacgccaaaaccaaaccccgagaagaacaatacaactcaacctaccgcgtagtatccgtgctcaccgtcctccaccaagactggcttaacggaaaagaatacaaatgcaaagtatcaaacaaagccctcccagctccaatcgagaaaacaatctccaaagccaaaggacaacccagagaaccacaagtatacaccctcccgccctcccgcgacgaactcactaaaaatcaggtcagcctaacctgcctcgtaaaaggtttttacccctccgacatagccgtcgaatgggaatcaaacggccaaccagaaaacaactacaaaaccactccccctgtcctagactcagacggctcctttttcctatactccaaactcaccgtagacaaatcccgatggcaacagggcaacgtcttcagctgctccgtcatgcacgaagccctacacaaccactacacccaaaaatccctctcactctccccaggcaaa

SEQ ID NO: 53740 - RNA, 639 nt, synthetic construct
  misc_feature 1..639: note = derived and/or modified sequence opt11 from Emactuzumab_LightChain1
  source 1..639: mol_type = other RNA
gacatccaaatgacccaatccccctcctccctctccgcctcagtcggcgaccgcgtcacaatcacatgccgagcctccgaagacgtcaacacctacgtatcctggtaccaacaaaaacccggaaaagcccccaaactactcatctacgccgcctccaaccgctacaccggcgtcccctcccgcttctcaggctcaggctccggcaccgacttcaccctcaccatctcatccctccaacccgaagacttcgccacctactactgccaacaatccttctcctaccccaccttcggccaaggaaccaaactcgaaatcaaacgcaccgtcgccgccccctccgtcttcatcttcccgccctcagacgaacaactcaaatccggcaccgcatctgtcgtctgcctcctcaacaacttctacccccgtgaagccaaagtccaatggaaagtcgacaacgccctccaatccggcaactcacaagaatcagtcaccgaacaagactcaaaagactccacctactcactctcctccaccctcaccctctccaaagccgactacgaaaaacacaaagtctacgcatgcgaagtcacccaccaaggcctatcctcccccgtcaccaaatccttcaaccgcggcgaatgc

SEQ ID NO: 53741 - RNA, 1323 nt, synthetic construct
  misc_feature 1..1323: note = derived and/or modified sequence opt11 from Emibetuzumab_HeavyChain1
  source 1..1323: mol_type = other RNA
caagtccagctcgtccaatcaggagccgaagtaaagaaacccggcgcctcagtcaaagtctcatgcaaagcatcaggctacaccttcaccgactactacatgcactgggtgagacaggcccccggacaaggcctagaatggatggggcgagtaaacccaaaccgccgcggcaccacatacaaccaaaaattcgagggccgcgtcaccatgacgaccgacacctcaacaagcacagcatacatggaactccgatccctccgcagcgacgacaccgccgtctactactgcgcacgcgcaaactggctcgactactggggacaaggcaccaccgtcaccgtctcatccgcctccacaaaaggcccatccgtattcccgctagcaccctgctcccgcagcacctcagaaagcacagccgcactcggctgcctagtcaaagactacttcccagaaccggtgaccgtctcatggaactccggcgcactcacctcaggagtacacaccttccccgccgtactccaatcctccggcctgtactctctatcgtccgtcgtaacagtcccgtcctccagcctaggaaccaaaacttacacatgcaacgtcgaccacaaaccatccaacaccaaagtcgacaaacgcgtcgaatccaaatacggtcccccatgccctccctgccccgcccctgaagcagccggcggcccctcagtcttcctcttcccacccaaacccaaagacaccctcatgatctcaagaacccccgaagttacctgcgtcgtcgtagacgtaagccaagaagaccccgaggtccaattcaactggtacgtcgacggcgtcgaagtccacaacgccaaaaccaaaccccgcgaagaacagttcaactccacctaccgagtcgtttccgtcttaacagtgctccaccaagactggctcaacgggaaagaatacaaatgcaaagtctccaacaaaggcctaccctcctcaatcgagaaaaccatctcaaaagcaaaaggacaaccccgcgaaccacaggtctacaccctaccaccctcccaagaagaaatgaccaaaaaccaagtctccctcacttgccttgtcaagggcttctacccctccgacatcgcagtcgaatgggaatccaacggccaacccgaaaacaactacaaaaccacacccccagtcctggactccgacggatccttcttcctctactcccgcctcactgtcgacaagtcacgatggcaggaaggcaacgtcttcagctgctccgtcatgcacgaagccctacataaccactacacccagaaatccctctctctatctctcggc

SEQ ID NO: 53742 - RNA, 645 nt, synthetic construct
  misc_feature 1..645: note = derived and/or modified sequence opt11 from Emibetuzumab_LightChain1
  source 1..645: mol_type = other RNA
gacatccaaatgacccaatccccctcctccctttcagcctccgtcggcgaccgcgtcaccatcacctgctccgtctcctcctcagtctcctccatctacctacactggtaccaacaaaaacccggcaaagcccccaaactcctcatatactccacctcaaacctcgcctctggcgtcccctcccgattctccggctccggctccggcacagacttcaccctcaccatctcctccctacaacccgaagacttcgccacctactactgccaagtctactccggctaccccctcaccttcggcggtggcaccaaagtcgaaatcaaacgcaccgtagccgccccctccgtcttcatattccccccctcagacgaacaactcaaatccggcaccgcctccgtcgtctgcctactaaacaacttctacccccgagaagccaaagtccaatggaaagtcgacaacgctctccaatcaggaaactcccaagaatccgtcaccgaacaagactcaaaagactccacatactccctctcctccaccctcaccctctccaaagccgactacgaaaaacacaaagtctacgcctgcgaagtcacccaccaaggcctctcatcccccgtcaccaaatcattcaaccgcggcgaatgc

SEQ ID NO: 53743 - RNA, 1344 nt, synthetic construct
  misc_feature 1..1344: note = derived and/or modified sequence opt11 from Emicizumab_HeavyChain1
  source 1..1344: mol_type = other RNA
caagtacaactcgtcgaatcaggaggaggcctggtccagcctggaggatccctccgcctctcatgcgcggcatccggattcaccttcagctactatgacatacaatgggtccgccaagcccccggcaaaggcctagaatgggtctcaagcatcagcccgagcggacagtccacatactatcgcagggaagtgaagggccggttcacaatatcacgcgacaactccaaaaacacactatacctccaaatgaactcactacgggcagaagacacagccgtatactactgcgcccgcagaaccggccgcgagtacggaggcggatggtacttcgactattggggccagggcaccctagtcacagtcagctccgcctcgaccaaagggcccagcgtcttcccactcgccccctgttcccgatccacctccgagagcaccgccgcactaggatgcctcgtcaaagactatttccccgaacccgtcacagtatcatggaactcaggcgccctaacctccggcgtacacacctttcccgccgtactacaaagctcaggcctctactccctctcatccgtcgtcaccgtacccagctcgtcactgggcacccaaacatatacctgcaacgtcgaccacaaaccctcgaacaccaaagtcgacaaacgagttgaatccaaatacggcccaccctgcccaccctgccccgcccccgagttcctaggcggaccgtccgtattcctatttcccccaaaaccaaaagacacactaatgatctcccgcacccccgaagtaacctgcgtcgtcgtcgacgtctcacaagaagaccccgaagtccaattcaactggtacgtcgacggagtggaagtccacaacgctaaaacaaaacctcgggaagaacaatacaactccacctaccgcgtagtctccgtcctgacagtcctccaccaagactggctaaacggcaaagaatacaaatgcaaagtctcaaacaaaggcctaccttcctccatagagaaaaccatatccaaagccaaaggccaaccccgcgaaccacaagtatacacactacccccatcacaaaaagaaatgaccaaaaatcaagtctccctaacatgcctcgtaaaaggcttctaccccagcgacatcgcagtcgaatgggaatccaacggccaacccgagaacaactacaaaacaacacccccagtcctagactccgacggcagcttcttcctttactccaaactaaccgtcgacaaaagccgctggcaagaaggaaacgtcttctcatgctccgttatgcacgaagccttgcacaaccgctacacccaaaaatccctctcactctccccc

SEQ ID NO: 53744 - RNA, 1332 nt, synthetic construct
  misc_feature 1..1332: note = derived and/or modified sequence opt11 from Emicizumab_HeavyChain2
  source 1..1332: mol_type = other RNA
caagtacaactcgtacaatccggctccgaactaaagaaacccggcgcctcagtcaaagtctcctgcaaagcctccggctacacattcactgacaacaacatggactgggtccgccaggctcccggccaaggactcgaatggatgggcgacattaacacccgttctggcggctcaatctacaacgaagaatttcaagaccgagtcatcatgacagtagacaaatccaccgataccgcatacatggaactctcctccctccgctccgaagacacagccacctaccactgcgcacgccgtaaatcatacggatactatctagatgaatggggagaaggcacactcgtcaccgtatcatccgcatccaccaaaggcccctcagtcttcccactcgccccctgctcccgatcaacctcagaaagcacagccgcacttggctgcctcgtcaaggactacttcccagaacccgtcaccgtctcctggaactcaggcgcactcacatccggcgtccacaccttccccgccgtactacaaagctcaggactgtactcactctcctcagtcgtcaccgtcccatcatccagcctcggcacccaaacctacacatgcaacgtcgaccacaaaccatccaacacaaaagtcgacaaacgcgtagaatcaaaatacggcccaccatgccctccctgccccgcacccgagttcctcggcggcccctccgtattcctcttcccacccaaacccaaagacacccttatgatctcccgcacccccgaagttacatgcgtcgtcgtcgatgtatctcaagaagaccccgaagtccaattcaactggtacgtagacggcgtcgaagtacacaacgccaaaacaaaacccagggaagaacaatacaactccacctatcgagtcgtctccgtccttacagtcctacaccaagactggctcaatggcaaagaatacaagtgcaaagtctccaacaagggcctcccctccagcatcgagaaaaccatctccaaagccaaaggacaaccccgagaaccccaagtctataccctcccaccctcacaagaagaaatgaccaaaaaccaagtctccctcacatgcctagtaaaaggcttctacccctccgacatcgcagtcgaatgggaatccaacggacaacccgaaaataactacaaaaccacacctccagtcctcgacagcgacggcagcttcttcctgtactccaaactaaccgtcgataaatcccgctggcaggaaggcaacgtcttcagctgctctgtcatgcacgaagccctacacaaccactacacccaggaatccctcagcctatccccc

SEQ ID NO: 53745 - RNA, 642 nt, synthetic construct
  misc_feature 1..642: note = derived and/or modified sequence opt11 from Emicizumab_LightChain1
  source 1..642: mol_type = other RNA
gacatccaaatgacccaatcaccctccagcctatccgcaagcgtcggagaccgcgtcaccataacctgcaaagcctcccgaaacatcgaacgacaactcgcctggtaccaacaaaaacccggccaagcccccgaactcctaatctaccaagccagccgaaaagaatccggcgtccccgaccgtttctcaggctcccgctacggcaccgacttcaccctaaccatcagctccctccaacccgaagacatcgccacatactactgccaacaatactccgacccgcccctcaccttcggcggcggcaccaaagtcgaaatcaaacgcacagtcgccgccccgtccgtcttcatcttcccaccctccgacgaacaactaaaatccggcacagcctccgtcgtctgcctcctcaacaacttctacccccgtgaagccaaagtccaatggaaagtcgacaacgccctccaatccggcaactcccaagaatccgtaaccgaacaagacagcaaagactccacctactccctctcctccaccctcaccctctccaaagccgactacgaaaaacacaaagtatacgcatgcgaagtcacccaccaaggcctaagctcccccgtcaccaaatccttcaaccgcggcgaatgc

SEQ ID NO: 53746 - RNA, 1347 nt, synthetic construct
  misc_feature 1..1347: note = derived and/or modified sequence opt11 from Enavatuzumab_HeavyChain1
  source 1..1347: mol_type = other RNA
gaagtccaacttgtcgaatccggaggcggcctcgtacagccaggcggctccctacgcctatcatgcgccgcctccggctttaccttctccagctactggatgtcatgggtccgtcaggcccccggcaaaggcctcgaatgggtcgccgaaatccgactaaaatccgacaactatgccacacactacgccgaatcggtcaaaggccgattcaccatcagccgtgacgactccaaaaactccctctacctccaaatgaactctctccgcgcagaagacactgccgtctactactgcaccggatactacgccgacgccatggactattggggacagggcactctggtaactgtaagctccgcctcaacgaaaggaccctccgtcttccccctcgccccctcctccaaatccacttccggcggcaccgccgccctaggatgcctcgtaaaagactacttccccgaacctgttaccgtttcctggaactcaggcgccctcacctcgggcgtccacacctttcccgccgtcctacaaagctccggcctctactcactatcctcagtcgtcaccgtaccctccagctcactcggaacccaaacatacatctgtaacgtcaaccacaaaccatcaaacacaaaagttgacaaaaaagtcgaacccaaaagttgcgacaaaacacatacctgccccccctgccccgcccccgaactcctaggcggaccttcagtcttcctattcccccccaaacccaaagacaccctcatgatcagccgcaccccagaagtcacatgcgtcgtcgttgacgtcagccacgaagaccccgaagtcaaattcaactggtacgtagacggcgtcgaagtacacaacgccaaaacaaaaccccgagaagaacaatacaattccacctacagagtagtctccgtcctaaccgtactacaccaagactggctcaacggcaaagaatacaaatgcaaagtctccaacaaagccctccccgcacccatcgaaaaaaccatttccaaagcaaaaggccaacccagagaaccacaggtctacacactccccccatcccgagaagaaatgaccaaaaatcaagtctccctcacctgcctcgtaaaaggcttctacccctccgacatcgccgtcgaatgggaatccaacggccaaccagaaaacaactacaaaacaaccccacctgtcctcgattccgacggatcattcttcctatactccaagctcaccgtagacaaatcacgctggcaacaaggaaacgtattctcctgctccgtaatgcacgaagcgctacacaaccactacacccagaaatccctatccctatcaccaggcaaa

SEQ ID NO: 53747 - RNA, 654 nt, synthetic construct
  misc_feature 1..654: note = derived and/or modified sequence opt11 from Enavatuzumab_LightChain1
  source 1..654: mol_type = other RNA
gacatccaaatgacacaatcgccctcatccctcagcgcctccgtcggcgaccgcgtaaccataacctgccgagccagccaatccgtcagcacaagctcatactcatacatgcactggtaccaacaaaaacccggcaaagcacccaaactcttaatcaaatacgcctccaacctagagagcggcgtcccaagccgattctccggctcaggctcaggcaccgacttcaccctcaccatcagctccctccagcccgaagacttcgccacctactactgccaacactcctgggaaatcccctacacattcggcggcggcaccaaagtcgaaatcaaacgcaccgtcgcagccccctccgtgttcatcttcccaccctccgacgaacaactcaaatcaggcaccgcctccgtcgtctgcctactcaacaacttctacccccgcgaagccaaagtccaatggaaagtagacaacgcactccaatccggcaactcacaagaatccgtaaccgaacaagattccaaagactcaacctactccctgtcctcaaccctaaccctatccaaagccgactacgaaaaacacaaagtatacgcatgcgaagtcacccaccaaggcctctcctcaccagtcaccaaatccttcaacagaggcgaatgc

SEQ ID NO: 53748 - RNA, 1341 nt, synthetic construct
  misc_feature 1..1341: note = derived and/or modified sequence opt11 from Enfortumab_HeavyChain
  source 1..1341: mol_type = other RNA
gaagtccagcttgtagaatccggcggtggactcgtccaaccaggcggctccctacgcctctcctgcgccgcctccggcttcaccttctcctcctacaacatgaactgggtccgccaagcccccggaaagggcctcgaatgggtatcatacatatcctcctcctcctccaccatctattacgcagactccgtcaaaggacgcttcacgatatcccgggacaacgctaaaaacagcctgtccctccaaatgaactcattacgcgacgaagacaccgcagtttactactgcgcacgcgcctactactacggcatggacgtctggggccagggtactactgtaaccgtctcctccgcatccaccaaaggacccagcgtcttccccctcgccccctcctccaaatccacctcaggcggcaccgccgcactcggctgcctcgtcaaagactacttcccagagccagttaccgtcagctggaactccggtgcgctcacatccggcgtccacacattcccagcagtactccaatcctccggcctttactccctctcctccgttgtcaccgttccctcctccagccttggcacacaaacatacatctgcaatgtcaaccacaaaccctctaacaccaaagtggacaaaagagtcgaacccaaatcctgcgataaaacccacacatgcccaccctgccccgcaccagaactcctcggcgggccatcagtattcctcttcccacccaaacccaaagacaccctcatgatatctagaacccccgaagtcacatgcgtcgtagtcgacgtaagccacgaagacccagaagtcaaattcaactggtacgtcgacggtgtcgaagtccacaacgcaaaaaccaaaccacgcgaagaacaatacaattcaacataccgcgtcgtctcagtactcaccgtcctccaccaagactggctcaacggcaaagaatacaaatgcaaagtatccaataaagctctacctgcacccatcgagaaaaccatctccaaggccaaaggccaaccccgtgaaccccaggtctatacccttcccccatcccgcgaagaaatgaccaaaaaccaagtctcactaacctgcctcgtaaaaggcttctacccatccgacatagccgtagaatgggaatccaacggacaaccagaaaacaactacaaaaccacacccccagtcctcgactcagacggttccttcttcctctactcgaagctcaccgtcgataaatcacgctggcaacagggcaacgtcttctcctgctccgtcatgcacgaagccctccacaaccactatacccaaaaatcactaagcctatctcccggaaaa

SEQ ID NO: 53749 - RNA, 642 nt, synthetic construct
  misc_feature 1..642: note = derived and/or modified sequence opt11 from Enfortumab_LightChain
  source 1..642: mol_type = other RNA
gacatccaaatgacccaatccccatcatccgtctccgcctccgtcggcgaccgcgtcaccatcacttgccgcgcctcccaaggcatctccggttggctcgcatggtaccaacaaaaacccggcaaagcccccaaattcctcatctacgccgcctccaccctacaatccggcgtcccctcccgcttctccggctccggctcaggcaccgacttcaccctaaccatctcctcactccaacccgaagacttcgccacctactactgccaacaagccaactccttcccacccaccttcggcggcggcaccaaagtcgaaatcaaacgcaccgtagcagccccctccgtattcatcttccctccctccgacgaacaactaaaatcaggcaccgcctccgtcgtctgccttctcaacaacttctacccccgcgaagccaaagtccaatggaaagtcgacaacgcattacaatccggaaactcacaagaatccgtcaccgaacaagactccaaagactcaacctactccctctcttctaccctcaccctctccaaagccgactacgaaaaacacaaagtctacgcctgcgaggtcacccaccaaggcctctcctcacccgtcaccaaatccttcaaccgaggagaatgc

SEQ ID NO: 53750 - RNA, 1341 nt, synthetic construct
  misc_feature 1..1341: note = derived and/or modified sequence opt11 from Enfortumab_vedotin_HeavyChain1
  source 1..1341: mol_type = other RNA
gaagtacaactcgtcgaatccggcggcggcctcgtacaacccggcggctcgttacgcctctcctgcgccgcctccggattcaccttttcaagctataacatgaactgggtcagacaagcacccggtaaaggcctcgaatgggtatcctacatcagcagctccagttctaccatctactacgcagattcggttaaaggccgcttcaccatttcccgcgacaacgccaaaaattcactctccctccaaatgaactcactccgcgacgaagacactgccgtctactactgcgccagagcctactactacggcatggacgtctggggacaaggcaccaccgtcaccgtatcatctgcctccaccaaaggtccatcagtcttccccctcgccccctcctccaaatccaccagcggaggcaccgccgccctcggctgcctcgtaaaagactactttcccgaaccggtcaccgtatcatggaactccggcgccctcacctccggcgttcacacctttcctgccgttctccaatcatccgggctttactcactcagttccgtcgtaaccgttccctcctcctccctcggcactcaaacgtacatatgcaacgtcaaccacaaaccatcaaacaccaaagtcgacaaacgtgtcgaacccaaaagctgcgacaaaacccatacctgcccaccctgccccgccccagaactcctaggcggcccctccgtattccttttccctccaaaacccaaagacacccttatgatctcccgcaccccagaggtaacctgcgtcgtcgtcgacgtctcccacgaagaccccgaagtcaaattcaactggtacgtcgacggcgtcgaagtccacaacgcaaaaaccaaaccacgtgaagaacaatacaactccacataccgagtcgtctccgttctcaccgtcctccaccaagactggctaaacggtaaagaatacaaatgcaaagtaagcaacaaagcccttcccgctcccatcgagaaaaccatctccaaagcaaaaggacaaccccgcgaaccccaagtctataccctcccaccctcgagagaagaaatgactaaaaaccaagtatcccttacctgcctcgtcaaaggcttctacccctccgacatcgcagtcgaatgggaatctaatggccaacccgaaaacaactacaaaaccacaccacccgtgctcgactcggacggctcctttttcctctactccaaactcaccgttgacaaatcccgctggcaacaaggcaacgtcttctcctgctccgtaatgcacgaggcacttcacaaccactatacccagaaatccctctccctctcccccggtaaa

SEQ ID NO: 53751 - RNA, 642 nt, synthetic construct
  misc_feature 1..642: note = derived and/or modified sequence opt11 from Enfortumab_vedotin_LightChain1
  source 1..642: mol_type = other RNA
gacatccaaatgacacaatccccctcctccgtctccgcctcagtcggcgaccgcgtcaccataacctgccgcgcctcccaaggcatctccggctggctagcctggtaccaacaaaaacccggaaaagcccccaaattcctcatctatgccgcatcaaccctccaaagcggcgtcccctcccgcttctccggatcaggctcaggcaccgacttcaccctaaccatctcatccctccaacccgaagacttcgccacatactactgccaacaagcaaactcattcccacccaccttcggcggcggcaccaaagtcgaaatcaaacgcacagtcgccgccccctccgtattcatcttcccaccctccgacgaacaactcaaatcaggcaccgcctccgtcgtctgcctcctcaacaacttctacccccgcgaagccaaagtccaatggaaagtcgacaacgccctccaaagcggaaactctcaagaaagcgtaaccgaacaagactccaaagactccacctactccctctcctccaccctcaccctatccaaagccgactacgaaaaacacaaagtctacgcctgcgaagtcacccaccaaggcctatcctcccccgtcaccaaatccttcaaccgaggcgaatgc

SEQ ID NO: 53752 - RNA, 1356 nt, synthetic construct
  misc_feature 1..1356: note = derived and/or modified sequence opt11 from Enoblituzumab_HeavyChain
  source 1..1356: mol_type = other RNA
gaagtacaactcgtagaatcaggtggaggcctcgtccaacccggcggctccctccgactctcatgcgccgcctccggattcaccttctcgtccttcggaatgcactgggtccgccaagccccaggcaaaggtctcgaatgggtagcctacatctcatctgactcctccgcaatctattacgccgacaccgtcaaaggccgattcactatatcccgcgacaacgccaaaaactcactctacctacaaatgaactcactccgcgacgaagacaccgccgtctactactgcggccgcggtcgagaaaacatatactacggcagccgcctcgactattggggacaaggaaccaccgtaaccgtctcctcagcctcaaccaaaggaccatctgtcttccccctcgccccttcctcaaaatccactagcggcggaaccgccgcactcggctgcctagtcaaagattacttccccgagcccgtcaccgtatcatggaactccggtgccctcacctccggagtacacaccttccccgccgtcctccaatccagcggcctctactccctttcctccgtcgtcaccgtgccttcaagctcactaggcacccaaacctacatctgcaacgtaaaccacaaaccctccaacaccaaagtcgataaacgcgtcgaacccaagagctgcgacaaaacacacacatgccctccctgccccgctccagaactcgtcggcggcccaagcgtcttcctactaccacccaaacccaaagacacactcatgatctcacgcacacccgaagtaacctgcgtcgtcgtcgacgtctcccacgaagacccagaagtaaaatttaactggtacgtcgacggcgtggaagtccacaacgccaaaaccaaaccacccgaagaacaatacaactcaaccctccgcgtcgtctccgtcctgaccgtcttacaccaagactggctcaacggcaaagaatacaaatgcaaagtctccaacaaagccttacccgcacccatcgaaaagaccatctctaaagccaaaggccaaccccgcgaaccccaagtctacaccctaccaccctcacgagaagaaatgaccaaaaaccaagtctccctcacatgcctcgtcaaaggcttctacccctccgatatcgccgtcgaatgggaatcaaacggccaacccgaaaataactacaaaacaaccccactcgtcctcgactctgacggatccttctttctctacagcaaacttaccgtcgacaaatcccgctggcaacaaggcaacgtattctcctgctccgtaatgcacgaagccctacacaaccactacacccagaaatccctctccctctcacccggcaaa

SEQ ID NO: 53753 - RNA, 642 nt, synthetic construct
  misc_feature 1..642: note = derived and/or modified sequence opt11 from Enoblituzumab_LightChain
  source 1..642: mol_type = other RNA
gacatccaactcacccaatcaccctccttcctctccgcctccgtaggcgaccgcgtcacaatcacctgcaaagccagccaaaacgtcgacaccaacgtcgcctggtaccaacaaaaacccggaaaagcacccaaagccctcatctactccgcctcctaccgctactccggcgtcccctcccgcttctcaggctccggatccggcacagacttcaccctcaccatctcctctctccaacccgaagacttcgccacctactactgccaacaatacaacaactaccccttcaccttcggacaaggcaccaaactagaaatcaaacgcaccgtcgcagccccctcagtcttcatattccccccctccgacgaacaactcaaatccggcaccgcctccgtcgtatgcctcctcaacaacttctacccccgcgaagccaaagtccaatggaaagtcgacaacgccctccaatccggaaactcccaagaatccgtcaccgaacaagactccaaagactccacctacagcctctcctccaccctcacactctcaaaagccgactacgaaaaacacaaagtctacgcatgcgaagtcacccaccaaggcctctcctcccccgtcaccaaatctttcaaccgcggcgaatgc

SEQ ID NO: 53754 - RNA, 1356 nt, synthetic construct
  misc_feature 1..1356: note = derived and/or modified sequence opt11 from Enokizumab_HeavyChain1
  source 1..1356: mol_type = other RNA
caagtacaactcgtccaatctggtgccgaggtcaagaaaccaggctcatccgtcaaagtctcctgcaaagccagcggcggaaccttctcctactactggatagaatgggtcagacaggccccaggacaagggctcgaatggatgggcgaaatcctacccggatcaggcacaaccaaccccaacgaaaaattcaaaggccgcgtcaccatcaccgccgacgagtcgacctccacagcctacatggaactatcatcactccgctccgaagacaccgccgtatactactgcgccagagccgactactacggcagcgactacgtcaaattcgactactggggacaaggaaccctagtcaccgtcagctcagcctccaccaaaggaccatcagtattcccactcgccccctcctcaaaatcaacctctggcggcaccgccgccctcggctgccttgtcaaagactacttccccgaaccagtcaccgtctcctggaactcaggagcactcacaagcggcgtccacactttccccgccgtcctacaatcctccggtctctactccctgtcctcagtcgtaaccgtaccctccagctccctcggcacacaaacctacatctgcaacgtcaaccacaaacccagcaataccaaagtcgacaaacgagtagaacctaagtcctgcgacaaaacccacacatgcccaccctgccccgcccccgaactcctaggaggcccctcagtattcctcttcccacccaaacccaaagacactctaatgatatcccgcacccccgaagtgacctgcgtcgtcgtcgacgtatcccacgaagatccagaagtcaaattcaattggtacgtcgacggagtcgaagtccacaacgcgaagacaaaaccccgcgaagaacaatacaactcaacctatcgcgttgtcagcgtcctcacagtcctacaccaggactggctcaacggtaaagaatacaaatgcaaagtatccaacaaagccctccccgccccaatagaaaagactatatcaaaagccaaaggtcaaccccgagaaccacaagtatacaccttaccaccctcccgcgaagaaatgaccaaaaaccaggtctcactaacctgcctcgtaaaaggattctacccctccgacatcgccgtagaatgggaatcaaacggccaaccagaaaacaactacaaaaccacacccccagtactcgactccgacggctccttcttcctctactccaaactgaccgtcgacaaatcccgctggcaacaaggcaacgttttcagctgctccgtcatgcacgaagccctacacaaccactatacccaaaaatcactctccctgtccccaggcaaa

SEQ ID NO: 53755 - RNA, 642 nt, synthetic construct
  misc_feature 1..642: note = derived and/or modified sequence opt11 from Enokizumab_LightChain1
  source 1..642: mol_type = other RNA
gacatccaaatgacccaatccccctcctccctctccgcctccgtcggcgaccgcgtcaccatcacatgcaaagcctcccaacacgtaatcacccacgtcacctggtaccaacaaaaacccggcaaagcacccaaactcctaatctacggcacctcctactcctactccggagtcccctcccgattctcaggctccggctccggcaccgactttacccttaccatctcctccctccaacccgaagactttgccacctactactgccaacaattctacgaataccccctcacattcggcggcggcaccaaagtcgaaatcaaacgcacagtcgccgccccctccgtcttcatcttcccaccctccgacgaacaactaaaatccggcaccgcctcagtcgtctgcctcctcaacaacttctacccccgcgaagccaaagtccaatggaaagtcgacaacgccctccaatccggcaactcacaagaatccgtcaccgaacaagactccaaagactccacctattccctctcctcaaccctcaccctctccaaagccgactacgaaaaacacaaagtctacgcatgcgaagtcacacaccaaggcctatcctcccccgtcaccaaatccttcaaccgcggcgaatgc

SEQ ID NO: 53756 - RNA, 612 nt, synthetic construct
  misc_feature 1..612: note = derived and/or modified sequence opt11 from Enokizumab_LightChain
  source 1..612: mol_type = other RNA
gacatccaaatgacccaatccccctcctccctctccgcctccgtcggcgaccgcgtcaccataacctgcaaagcctcccaacacgtcatcacccacgtcacatggtaccaacaaaaacccggcaaagcccccaaactccttatctacggcacctcctactcctactccggtgtcccctcccgcttctccggctccggctccggcaccgacttcaccctcaccatctcctccctccaacccgaagacttcgccacctactactgccaacaattctacgaatacccccttaccttcggcggcggcaccaaagtcgaaataaaacgcaccgtcgccgccccctccgtcttcatcttcccaccctccgacgaacaactcaaatccggcacagcctccgtagtctgcctacttaacaacttctatccccgcgaagccaaagtccaatggaaagtcgaatccgtaaccgaacaagactccaaagactcaacctactctctctcctcaaccctcaccctctccaaagccgactacgaaaaacacaaagtatacgcctgcgaagtaacccaccaaggcctctcctcccccgtcaccaaatcattcaaccgcggcgaatgc

SEQ ID NO: 53757 - RNA, 1356 nt, synthetic construct
  misc_feature 1..1356: note = derived and/or modified sequence opt11 from Enoticumab_HeavyChain1
  source 1..1356: mol_type = other RNA
caagtccaactcgtagaatccggcggcggcgtagtccaaccaggtcgcagcctccgcctatcatgcgccgcttccggcttcaccttctcctcatacggcatgcactgggtacgccaagctcccggcaaaggactcgaatgggtatcatttctatggtatgacgggaccaacaaaaactatgtcgaaagcgtaaaaggacgatttaccatctcacgagacaattccaaaaacatgctctacctcgaaatgaactcactccgcgctgaagacaccgccgtctactactgcgcacgagaccacgacttccgctccggctacgaaggatggttcgacccgtggggccaaggcaccctcgtcaccgtctcatccgcatctaccaaaggcccttccgtcttccccctcgccccctcctccaaatccaccagtggcggcaccgccgccctaggctgcctcgtcaaagactacttccccgagcccgtcaccgtaagctggaactcaggagccctcacttcaggcgtccacaccttccccgctgtccttcaatcctccggcctatactcactaagctcagtcgtcaccgtcccatcctcctccctcggtacccaaacctacatatgcaacgtaaaccataaaccttcaaacaccaaagtcgacaaaaaagtcgaacccaaaagttgcgacaaaacccacacatgccccccatgtcccgccccagaactcctaggcggcccaagcgtcttcctattcccacccaaacccaaagacacactcatgatctcccgcacccccgaagtaacctgcgtcgtcgtcgacgtatcccacgaagaccccgaggtaaaattcaactggtacgtcgacggagtcgaagtccacaacgccaaaacaaaaccccgcgaagaacaatacaactcgacctatcgtgtagtctcagtcctcaccgtcctccaccaggactggctcaacggcaaagaatacaaatgcaaagtctctaacaaagccctacccgcaccaatcgaaaaaaccataagcaaagccaaaggccaaccacgagaaccacaagtctacaccctcccccccagccgcgacgaactcacaaaaaaccaagtctcccttacatgccttgtcaaaggcttttacccctccgacatcgcagtcgaatgggaatcgaacggccaacccgaaaacaactacaaaaccaccccaccagtactcgactccgacggatcattcttcctttactccaaactaaccgtcgacaaatctcgctggcaacaagggaacgtattctcctgctccgtcatgcacgaagcccttcacaaccactacacacaaaaatcactctcactctcaccaggc

SEQ ID NO: 53758 - RNA, 642 nt, synthetic construct
  misc_feature 1..642: note = derived and/or modified sequence opt11 from Enoticumab_LightChain1
  source 1..642: mol_type = other RNA
gaaatcgtactcacccaatcgcccgcaaccctatccctaagccccggcgaacgcgccaccctcagctgccgcgcaagccaaagcgtatcctcgtacctagcctggtaccaacaaaagcccggccaagcacccagactactcatctacgacgcaagcaaccgcgcaaccggaatcccagcccgcttctcaggctcaggctcaggcacagacttcaccctcaccatatcctcactcgaacccgaagacttcgccgtctactactgccaacacaggagcaactggccacccacattcggaggcggaaccaaagtcgaaatcaaacgcacagtcgcagcccccagcgtcttcatattcccaccctccgacgaacaactaaaatcaggcaccgcctccgtcgtatgcctactcaacaacttctacccacgcgaagccaaagtccaatggaaagtcgacaacgcactccaatccggaaactcacaagaaagcgtcaccgaacaagacagcaaagactctacctactccctctcctcaaccctaaccctcagcaaagccgactacgaaaaacacaaagtctacgcatgcgaagtcacccaccaaggcctcagctcacccgtcaccaaatccttcaacagaggcgaatgc

SEQ ID NO: 53759 - RNA, 1329 nt, synthetic construct
  misc_feature 1..1329: note = derived and/or modified sequence opt11 from Ensituximab_HeavyChain1
  source 1..1329: mol_type = other RNA
caagtacaactcaaagaatcaggccccgacctcgtcgccccctcgcaaagcctatccatcacttgcaccgtatcaggattctccctatctaaattcggtgtcaactgggtaagacaaccacccggcaaaggtctagaatggctcggcgtaatatggggcgacggctcgacctcctacaactcaggcctcatctcccgactctccatatccaaagaaaactcaaaatcccaagtattcctcaaactcaacagcctccaagccgatgacaccgcaacatactactgcgtaaaacccggcggcgactactggggccacggaacatccgtcaccgtctcctccgcgtcaacaaaaggcccctcagtcttccccctcgctccctcctccaaatccacatccggcgggaccgcagccctaggctgcctcgttaaagactatttccccgaacccgtaaccgtctcctggaactccggcgcactcacctccggcgtgcatacattccccgccgtcctacaatcttccggcccctactccctttcctccgtcgttactgtccccagctcctccctcggcacccaaacctacatctgcaacgtcaaccataaaccctccaacaccaaggtcgacaagaaagtcgaacccaaatcctgcgacaaaacccacacatgccctccctgccccgccccggaactgctcggaggcccctccgttttcctcttcccacccaaacccaaagacacccttatgatatcacgaacccccgaagtaacctgcgtcgtcgtagacgtctcacacgaagacccagaagtcaaatttaactggtacgttgacggtgtcgaagtccacaacgccaaaaccaaacctcgagaagaacaatacaactccacctacagagtcgtctccgtcctaaccgtactccaccaagactggctaaacggcaaagagtacaaatgcaaagtctccaacaaagccctaccagcaccaatcgagaaaaccatctccaaagccaaaggtcaaccccgcgaaccccaagtctacaccctaccaccctcacgcgacgaactcaccaaaaaccaagtctcactcacttgccttgtcaaaggcttctacccctccgacatcgccgtagaatgggaaagcaacggccaacccgaaaacaactacaaaaccatgccacccgtactagactctgacggctccttcttcctctactctaaactcaccgtcgacaaatcccgatggcaacaaggcaacgtcttctcctgctcagttatgcacgaagccctccacaaccactacacccaaaaatccctctcactctcccccggaaaa

SEQ ID NO: 53760 - RNA, 639 nt, synthetic construct
  misc_feature 1..639: note = derived and/or modified sequence opt11 from Ensituximab_LightChain1
  source 1..639: mol_type = other RNA
caagtcgtcctcacccaatcccccgtcatcatgtccgcctcccccggcgaaaaagtcacaatgacctgctccgcctcctcttccatctcctacatgtactggtaccaacaaaaacccggcacctcccccaaacgctggatctacgacacctccaaactagcctccggcgtccccgcccgcttctccggctccggctcaggcacctcctactccctcaccatctcaaacatggaagccggcgacgccgccacatactactgccatcaacgcgactcctacccctggaccttcggcggcggcaccaacctcgaaatcaaacgcaccgtcgccgccccctccgtattcatcttcccaccctcagacgaacaactcaaatcaggcacagcctccgtcgtctgcctcctcaacaacttctacccccgagaagccaaagtccaatggaaagtcgacaacgcactacaatccggcaactcccaagaatcagtcacagaacaagactccaaagactccacctacagcctatcctccacactaaccctctccaaagccgactacgaaaaacacaaagtctacgcctgcgaagtcacccaccaaggcctctcctcccccgtcaccaaatctttcaaccgcggcgaatgc

SEQ ID NO: 53761 - RNA, 768 nt, synthetic construct
  misc_feature 1..768: note = derived and/or modified sequence opt11 from Ensituximab_SingleChain_variable_fragment
  source 1..768: mol_type = other RNA
atggcggaagtgcaactggtcgagagcggggccgaggtcaagaaaccgggcgagagcctacgaataagctgcaaagggagcgggtgcataatctcaagctactggataagctgggtcaggcaaatgcccgggaaagggctcgagtggatgggcaagatcgaccccggagactcatacataaactatagccccagcttccaaggacacgtaaccataagcgcagacaaaagtataaacacggcctacctacagtggaacagcttaaaagcaagcgacaccgccatgtactactgcgccaggggagggcgcgacttcggggactcgttcgactactggggccagggcaccctcgtaaccgtgagctcaggcggcggcgggagcggaggcgggggctcaggcggaggcggaagcgacgtcgtgatgacgcaatcaccatcgttcctaagcgcgttcgtgggcgaccgaataaccataacctgccgagcatcctcgggaataagcaggtacctggcctggtaccagcaagcgcccgggaaagcacccaagctcctaatctacgcagcaagcacactccaaaccggggtcccgagcaggttctcaggctcgggctcgggcacagagttcacactaaccataaactcactccagccagaagacttcgccacatactactgccagcatctgaactcctacccactcacgttcgggggcggaacaaaggtcgatatcaagcgcgcagctgcgctagaacaccaccaccaccaccac

SEQ ID NO: 53762 - RNA, 987 nt, synthetic construct
  misc_feature 1..987: note = derived and/or modified sequence opt11 from Entolimod_chain1
  source 1..987: mol_type = other RNA
atgcgcggatcacaccaccaccaccaccacggcatggcctccatgacaggcggccaacaaatgggccgcgacctatacgacgacgacgacaaagacccaatggcccaagtaataaacaccaactccctcagcctcctcacccaaaacaacctcaacaaatcacaaagctcactctcatccgccatcgaacgcctctcatcaggcctccgcataaactccgccaaagacgacgccgccggccaagctatcgccaaccgcttcacctccaacataaaaggcctcacccaggcttcccgaaacgcaaacgacggcatcagcatcgcacaaaccaccgaaggagccctaaacgaaatcaacaacaacctacaacgcgtacgagaactttccgtccaagccaccaacggaacgaactcagacagcgacctcaaatccatccaagacgaaatacaacaacgcctcgaagaaatcgaccgagtctcaaaccaaacccaattcaacggcgtcaaagtcctctcccaagacaaccaaatgaaaatacaagtcggagccaacgacggcgaaaccatcacaatcgacctccagaaaatcgacgtcaaatccctcggacttgacggattcaacgtcaactcccccggcatatccggcggcgggggaggcatcctcgactcaatgggaacccttatcaacgaagatgcagccgcagccaaaaagtcaaccgctaaccccctcgcctccatcgactccgcactatccaaagtcgacgccgtccgatcatcactcggagccatacaaaaccgattcgactccgccattaccaacctcggaaacaccgttacaaacctaaactccgcccgaagccgaatcgaagacgccgactacgcaactgaagtctccaacatgtcaaaagcccaaatactacaacaagccggcacaagcgtattagcccaagccaaccaagtcccccaaaacgtcctatccctactacgc

SEQ ID NO: 53763 - RNA, 1338 nt, synthetic construct
  misc_feature 1..1338: note = derived and/or modified sequence opt11 from Epratuzumab_HeavyChain
  source 1..1338: mol_type = other RNA
caagtccaactggtccaatccggagcagaagtcaagaaacccggctcatccgtcaaagtatcctgcaaagcctccggctacaccttcacctcatactggctccactgggtccgacaggcccccggacaaggtctcgaatggatcggctacataaacccccgaaacgactacacagaatacaaccaaaacttcaaagacaaagccaccattaccgccgacgaatccacaaacaccgcctacatggaactctccagcctccgatccgaagacaccgccttctacttctgcgcccgacgcgacatcaccactttctactggggccaaggcaccctagtcacagtctctagcgcatcaaccaaaggaccaagcgtcttccccctggcgccctcttccaaaagcacctctggcggcaccgccgccctcggctgcctcgtcaaagactacttcccggaacccgtaaccgtctcctggaactccggcgccctcacctcaggtgtccacaccttccccgccgtcctccaatcctccggcctctactcactctcctccgtcgtcaccgtccccagctcctcccttggcacacaaacatacatctgcaacgtcaaccacaaaccctccaacaccaaagtggacaagaaagttgaacccaaatcatgcgataaaacccacacatgccctccatgcccggccccagaactcctaggtggcccatctgttttcctctttcccccaaaaccgaaagacaccctaatgatcagcagaaccccagaagtaacctgtgtcgtagtcgacgtcagccacgaagaccccgaagtcaaattcaactggtacgtagacggcgtcgaagtccacaacgccaaaaccaagccccgcgaagaacaatacaactcaacataccgcgtagtctccgtcctcacagtccttcaccaggactggctaaacggcaaagaatacaaatgcaaagtttccaacaaagcacttcccgcccccatcgagaaaaccatctccaaggccaaagggcaaccccgcgaaccgcaagtatacaccctacccccatcacgagacgaactcaccaaaaaccaagtatcactcacatgcctcgtcaaaggcttctacccctccgacatagcagtagaatgggaatcgaacggccaacccgaaaacaattacaaaaccacacccccagtcctcgacagcgacgggtccttcttcctctacagcaaacttaccgtagacaaatcccgatggcaacagggcaacgtattctcgtgctccgtcatgcacgaagcgttacacaaccactacacccaaaaatccctctcactctcccccggaaaa

SEQ ID NO: 53764 - RNA, 657 nt, synthetic construct
  misc_feature 1..657: note = derived and/or modified sequence opt11 from Epratuzumab_LightChain
  source 1..657: mol_type = other RNA
gacatccaactaacccaatccccctcctccctctccgcctccgtcggcgaccgcgtcaccatgtcctgcaaatcatcccaatccgtcctttactccgcaaaccacaaaaactacctcgcctggtaccaacaaaaacccggcaaagcacccaaactcctcatctactgggcctccacccgcgaatcaggcgtcccctcccgattctccggctcaggatccggaaccgacttcaccttcaccatatcctccctccaacccgaagacatcgcaacctactactgccaccaatacctctcctcatggaccttcggccaaggcaccaaagtcgaaatcaaacgcaccgtcgccgccccctccgtattcatcttcccaccctccgacgaacaactcaaatccggaaccgcaagcgtcgtctgcctcctcaacaacttctacccccgagaagccaaagtccaatggaaagtcgacaacgccctccaatccggcaactcacaagaatccgtcaccgaacaagactccaaagactccacctactccctctcctctaccctcaccctctccaaagccgactacgaaaaacacaaagtctacgcctgcgaagtaacccaccaaggcctctcctcccccgtcaccaaatccttcaaccgcggcgaatgc

SEQ ID NO: 53765 - RNA, 762 nt, synthetic construct
  misc_feature 1..762: note = derived and/or modified sequence opt11 from Eptacog_beta_HeavyChain1
  source 1..762: mol_type = other RNA
atcgtaggcggcaaagtctgccccaaaggagaatgcccctggcaagtcctcctcctcgtcaacggcgcccaactctgcggcggcaccctcatcaacaccatctgggtcgtctccgccgcacactgcttcgacaaaatcaaaaactggcgcaacctcatcgccgtactcggcgaacacgacctctccgaacacgacggcgacgaacaatcccgccgagtcgcccaagtcatcatcccctccacctacgtacccggcaccaccaaccacgacatcgccctcctcagactccaccaaccagtcgtcctcaccgaccacgtagtccccctatgcctcccagaacgcacattctccgaacgaaccctagccttcgtccgcttctccctcgtttccggctggggacaactactagaccgaggagccaccgcactagaactcatggtcctcaacgtaccccgactaatgacccaagactgcctacaacaaagccgcaaagtcggcgacagccccaacatcacagaatacatgttctgcgcaggctactccgacggctcaaaagactcctgcaaaggcgacagcggcggcccacacgcaacacactaccgaggcacctggtacctaaccggcatagtctcctggggccaaggctgcgccaccgtaggccacttcggcgtctacaccagagtctcccaatacatcgaatggctccaaaaactcatgcgctcagaaccccgccccggcgtactcctccgcgcccccttcccc

SEQ ID NO: 53766 - RNA, 456 nt, synthetic construct
  misc_feature 1..456: note = derived and/or modified sequence opt11 from Eptacog_beta_LightChain1
  source 1..456: mol_type = other RNA
gccaacgccttcctcgaagaactacgccccggctccctcgaacgcgaatgcaaagaagaacaatgctccttcgaagaagcccgcgaaatcttcaaagacgccgaacgaaccaaactcttctggatctcctactccgacggcgaccaatgcgcatcctccccctgccaaaacggcggctcatgcaaagaccaactccaatcctacatctgcttctgcctccccgccttcgaaggccgaaactgcgaaacccacaaagacgaccaactcatctgcgtcaacgaaaacggcggctgcgaacaatactgctccgaccacaccggcaccaaacgaagctgccgctgccacgaaggctacagcctcctcgccgacggcgtctcctgcaccccaacagtcgaatacccctgcggcaaaatccccatactcgaaaaacgcaacgcctcaaaaccccaaggccgc

SEQ ID NO: 53767 - RNA, 708 nt, synthetic construct
  misc_feature 1..708: note = derived and/or modified sequence opt11 from Erlizuab_HeavyChain1
  source 1..708: mol_type = other RNA
gaagtccaactcgtcgaatccggcggcggcctagtccaacccggcggctccctccgcctctcatgcgccacctccggctacacattcactgaatacacccactggcgccaagcccccggaaaaggcctcgaatgggtcgccggcatcaacccaaaaaacggcggcacctcccacaaccaacgcttcgaccgcttcactatctcagtcgacaaatccacatcaaccgcctaccaaaactccctacgcgccgaagacaccgccgtctactactgtgcccgatggcgaggcctcaactacggcttcgacgtccgctacttcgacgtctggggccaaggcaccctagtcaccgtctcctccgcctccacaaaaggcccctccgtcttccccctcgccccctcatccaaatccacctccggcggcaccgccgcactcggctgcctagtcaaagactacttccccgaacccgtaacagtatcctggaactcaggcgccctcacctcaggcgtccacaccttccccgccgtcctccaatcctcaggcctctactccctctcatccgtcgtcaccgtcccctcctcctccctcggcacacaaacatacatctgcaacgtcaaccacaaaccctccaacaccaaagtcgacaaaaaagtcgaacccaaatcatgcgacaaaacccacacttgccccccctgccccgcccccgaactc

SEQ ID NO: 53768 - RNA, 639 nt, synthetic construct
  misc_feature 1..639: note = derived and/or modified sequence opt11 from Erlizuab_LightChain1
  source 1..639: mol_type = other RNA
gacatccaaacccaatccccctcctccctctccgcatccgtcggcgaccgcgtcaccataacctgccgagcctcccaagacatcaacaactacctaaactggtaccaacaaaaacccggcaaagcccccaaactcctcatctactacacctccacactccacagcggcgtcccctcccgcttctcaggctccggctcaggcacagactacaccctcaccatctcctccctccaaccagaagacttcgccacctactactgccaacaaggcaacaccctcccacccaccttcggccaaggcaccaaagtcgaaatcaaacgcacagtcgccgcaccctccgtattcatcttcccaccctccgacgaacaactcaaatccggcacagcctccgtcgtctgcctactcaacaacttctacccccgcgaagccaaagtccaatggaaagtagacaacgccctccaatccggcaactcccaagaatccgtcaccgaacaagactccaaagactcaacctactccctttcctccaccctcaccctctccaaagccgactacgaaaaacacaaagtctacgcctgcgaagtcacccaccaaggcctctcctcccccgtcaccaaatccttcaaccgcggcgaatgc

SEQ ID NO: 53769 - RNA, 1341 nt, synthetic construct
  misc_feature 1..1341: note = derived and/or modified sequence opt11 from Etaracizumab_HeavyChain1
  source 1..1341: mol_type = other RNA
caagtccagctagtcgaatccggaggcggagtcgtccaacccggccgctcactacgcctatcttgcgcagcctccggattcacattctcctcctacgacatgtcctgggtaagacaagcccccggcaaaggccttgaatgggtcgcaaaagtctcctctggaggcggatcaacatactacctcgacaccgtccaaggccgattcaccatctcacgcgacaactccaaaaacaccctctacctacaaatgaactccctacgagccgaggacacagccgtctattactgcgctcgccacctccacggctccttcgcatcctggggccaaggcaccaccgtcaccgtctccagtgcctccacaaaaggaccctcagtttttcccctcgccccctcatccaaatcaacctccggaggtacagccgcactcggctgcctcgtcaaagattacttcccagaacccgtcaccgtatcctggaactcaggcgccctcacctccggagtacacacattccccgccgtactccaaagctccggtctatacagcttatcctccgtcgtcaccgtacccagctcctccttaggcacccaaacctacatctgcaatgtcaaccacaaaccatctaatactaaagtcgacaaacgggtagaacccaaatcctgcgacaaaacccatacctgcccaccctgcccagcccccgaactcctcggaggaccctcagtcttcctattcccacccaaacccaaagacaccctcatgatctcgcgaacccccgaagtaacctgcgtcgtcgtcgacgtctcccacgaagaccccgaagtcaaattcaactggtacgtcgatggcgtcgaagtccacaacgccaaaacaaagccccgcgaggaacaatacaactcaacctaccgcgtcgtttccgtccttactgtcctccaccaggactggctcaacggcaaagaatacaaatgcaaagtcagcaacaaagcactacccgcacctatcgagaaaaccatctcaaaagccaaaggacaacctcgcgaaccccaagtatacaccctcccaccatcccgagaagaaatgaccaaaaaccaagtatctctcacatgtctcgtcaaaggcttctacccctccgacatcgccgtcgaatgggaaagcaatggccaacccgaaaacaactacaaaaccacacccccagtcctcgactccgacggctccttcttcctatactccaaactcaccgtagacaaatcccgctggcaacaaggaaacgttttctcctgcagcgtcatgcacgaagccctccacaaccactacacgcaaaaatccctaagcctctccccaggaaaa

SEQ ID NO: 53770 - RNA, 642 nt, synthetic construct
  misc_feature 1..642: note = derived and/or modified sequence opt11 from Etaracizumab_LightChain1
  source 1..642: mol_type = other RNA
gaaatcgtccttacccaatcccccgccaccctatccctctcccccggcgaacgcgcaaccctctcttgccaagcctcccaatccatctccaacttcctccactggtaccaacaacgccccggccaagctccccgcctcctcatccgctaccgctcccaatccatctccggcatccccgcccgattctccggctccggctccggcaccgacttcaccctcacaatctcctctctcgaacccgaagacttcgccgtctactactgccaacaatccggctcctggcccctcacattcggaggcggcaccaaagtcgaaatcaaacgcaccgtcgccgccccctccgtcttcatcttcccaccctccgacgaacaactcaaatccggcaccgcctccgtcgtctgcctactaaacaacttctacccccgagaagccaaagtccaatggaaagtcgacaacgccctccaatcaggcaactcccaagaatccgtcacagaacaagactccaaagactcgacctactccctcagctccaccctcaccctgtccaaagcagactacgaaaaacacaaagtatacgcctgcgaagtcacccaccaaggcctatcctccccagtaaccaaatccttcaaccgcggcgaatgc

SEQ ID NO: 53771 - RNA, 1326 nt, synthetic construct
  misc_feature 1..1326: note = derived and/or modified sequence opt11 from Etrolizuab_HeavyChain1
  source 1..1326: mol_type = other RNA
gaagtccaactggtcgaatccggcggcggcctcgtccaaccaggaggctccctacgtctttcatgcgcagcatccggcttcttcatcaccaacaattactggggctgggtccgccaagcccctggcaaaggtcttgaatgggtaggatacatcagctactcaggctccaccagctacaacccctccctaaaatcccgcttcacaatctcgcgcgacacctccaaaaacaccttctacctccaaaactcactccgagccgaagacaccgccgtctactactgcgcccgcacaggctcctcaggatacttcgacttctggggccaaggcaccctagtaaccgtaagctccgcctctaccaaaggcccctctgtcttccccctcgcaccctcaagcaaatcaacctcaggcggcacagccgcactcggctgtctcgtcaaagactacttccctgaaccagtcactgtctcctggaactccggcgccctcacaagcggcgtacacactttcccggccgtcctccaatcaagcggcctttattccctctcgtcggtcgtcaccgtaccctccagctcacttggcacacaaacctacatctgcaacgtcaaccacaaaccctccaacacaaaagtcgacaagaaagtcgaacccaaatcctgcgacaaaacccatacctgcccaccctgcccagcccccgaactcctcggcggaccttcagtcttccttttcccacccaaacctaaagataccctaatctcccgcaccccagaagtcacatgcgtcgttgtagacgtttcccacgaagaccccgaagtaaaattcaactggtacgtcgacggagtcgaagtccacaatgccaaaacaaaaccccgtgaagaacaatacaattccacataccgcgtcgtttccgtactcacagtactccaccaagactggctaaacggcaaagaatacaaatgtaaagtctccaacaaagccctccccgcccccatcgagaaaaccatctccaaagccaaaggccaaccacgagaaccccaagtctacacacttccaccctcacgcgaagagaccaaaaaccaagtctcactcacttgcctcgtcaaaggcttctaccccagcgacatcgcagtcgaatgggaatccaacggccaaccagaaaacaactataaaactaccccacccgtcctagactccgatggcagcttcttcctctactccaaactcactgtcgacaaatcccgctggcaacaaggcaacgtcttctcctgctcagtccacgaagcactccacaaccactatacacaaaaatccctcagcctctccccaggc

SEQ ID NO: 53772 - RNA, 1326 nt, synthetic construct
  misc_feature 1..1326: note = derived and/or modified sequence opt11 from Etrolizuab_HeavyChain2
  source 1..1326: mol_type = other RNA
gaagttcaactcgtagaatccggcggcggactcgtacaacccggcggttcgctccgcctcagctgcgcagcctccggtttcttcatcaccaacaactactggggctgggtacgacaagccccaggcaaaggcctcgaatgggtaggatacatctcctactcaggctccacctcctacaacccctccaaactatcccgattcaccataagccgcgacacatccaaaaacacattctacctccaaaactccctccgagccgaagacacagctgtatactactgcgcccgcactggctcctccgggtacttcgacttctggggccaaggcactctcgtcactgtctcatcagcctccaccaaaggcccctcagtattccccctcgctccatcctctaaatccacctccggcggcaccgccgcactcggatgtctcgtcaaagattacttcccagaaccagtcaccgtcagctggaactccggcgccctcacctcaggcgtccacacattcccagcagtcctccaatcctcaggcctttactccctctcctccgtcgttaccgtcccctcatcctccctaggcacacaaacctacatctgcaatgtaaaccacaaacccagtaacaccaaagtcgacaagaaagtagaacccaaatcatgcgacaaaacccacacatgcccaccttgtccagcccccgaactcctcggcggaccctcagtattcctattcccgcccaaacccaaagacaccctaatctcccgaaccccagaagttacatgcgtcgtagtcgacgtctcccacgaagaccccgaagtcaaattcaactggtacgtagacggtgtcgaagtccacaacgccaaaaccaaaccccgcgaagaacaatacaactctacctaccgagtcgtatcagtcctaacagtgctccaccaagactggctcaacggcaaagaatacaaatgcaaagtatccaacaaagccctccccgccccgatcgaaaagaccatctccaaagcaaaaggccagccccgagaaccccaagtctacaccctacccccatcccgagaagaaaccaaaaaccaagtctccctaacctgcctcgtaaaaggcttctacccctccgacatcgcagtcgaatgggaaagcaatggacaacccgaaaacaactacaaaacaacacctcccgtactggactccgacggctccttcttcctatactccaaactcaccgtagacaaatcccgctggcaacaaggtaacgtcttcagctgttcagtccacgaagcactccacaaccactacacccaaaaatccctctcactctcccccggc

SEQ ID NO: 53773 - RNA, 639 nt, synthetic construct
  misc_feature 1..639: note = derived and/or modified sequence opt11 from Etrolizuab_LightChain1
  source 1..639: mol_type = other RNA
gacatccaaacccaatctccctcctccctctccgcctccgtcggcgaccgcgtcaccataacctgccgcgcctccgaatccgtcgacgacctcctacactggtaccaacaaaaacccggcaaagcccccaaactcctcatcaaatacgcctcccaatccatctccggcgtccccagccgcttctcaggctccggctccggcaccgacttcaccctcaccatctcctccctccaacccgaagacttcgccacctactactgccaacaaggcaactccctacccaacaccttcggtcaaggaaccaaagtcgaaatcaaacgcaccgtcgcagccccctccgtattcatcttcccaccctcagacgaacaactcaaatcaggcaccgcctccgtcgtctgcctactcaacaacttctacccccgcgaagccaaagtccaatggaaagtcgacaacgccctccaatccggcaactcccaagaatccgtaaccgaacaagactcaaaagactccacctactccctctcctcaaccctcaccctatccaaagccgactacgaaaaacacaaagtatacgcctgcgaagtcacccaccaaggcctatcatcacccgtaaccaaatccttcaaccgcggcgaatgc

SEQ ID NO: 53774 - RNA, 1338 nt, synthetic construct
  misc_feature 1..1338: note = derived and/or modified sequence opt11 from Etrolizumab_HeavyChain1
  source 1..1338: mol_type = other RNA
gaagtccagctagtcgaatccggcggaggcctcgtacaacctggcggctcccttcgactttcatgcgccgccagcggcttctttatcaccaataactactggggctgggtcagacaagcccccgggaaaggcctagaatgggtgggctacatatcctactccggctccacttcatacaacccatccctcaaatcccgattcaccatctcccgcgacacctccaaaaacaccttttacctacaaatgaactccctccgagcagaagacaccgccgtctactactgcgcaagaactggctcatccggctacttcgacttctggggccaaggcaccctcgtcacagtatcctccgcatcaacaaaaggcccctccgtcttccccctcgccccatcctccaaatcaacttccggtggcacagcagccctcggctgcctcgtcaaagattactttcccgaaccagtcaccgtaagctggaactccggagccctcacctccggagtacacacattccccgccgtcctccaatcctccggcctttactcactctcctccgtcgtaaccgttccctcctcctcccttggcacccaaacatacatatgcaatgtcaaccacaaaccctcaaacaccaaagtcgacaagaaagttgaacccaaatcctgcgacaaaacacatacctgcccaccatgccccgccccagaactcctaggcggtccatccgtcttcctattcccgccaaaaccaaaagacactctaatgatctcccgcacccccgaagtaacgtgcgtagtcgtagacgtatcccacgaggacccagaagtcaaattcaactggtatgtcgacggcgtcgaagtccacaatgccaaaacaaaaccacgagaagaacaatacaactccacctatcgagtagtatccgtcctcacagttctccaccaagactggctcaacggcaaagaatacaaatgcaaagtctccaacaaggccctccctgctcccatcgagaaaaccatctccaaagccaaaggccaaccccgcgaaccccaagtctacacgctcccaccatccagagaagaaatgaccaaaaatcaagtctcgctcacatgcctcgtaaaaggcttctacccctccgacatcgccgtcgaatgggaaagcaacggccaaccagaaaacaactacaaaaccacaccacccgtcctcgacagcgacggctccttctttctctactccaaactcaccgtcgacaaatcacgctggcaacaaggcaacgtcttctcctgctcagtcatgcacgaagccctacacaaccactacacccaaaaatcactctcactatccccaggc

SEQ ID NO: 53775 - RNA, 642 nt, synthetic construct
  misc_feature 1..642: note = derived and/or modified sequence opt11 from Etrolizumab_LightChain1
  source 1..642: mol_type = other RNA
gacatccaaatgacccaatccccctcatcactatccgcctcagtcggcgaccgcgtaaccatcacttgccgcgcctccgaatccgtcgacgacctcctccactggtaccaacaaaaacctggcaaagcccccaaactcctcatcaaatacgcctcccaatccatctccggcgtaccatcccgcttctcaggatccggctccggcaccgacttcacccttaccatctcatccctacaacccgaagacttcgccacctactactgccaacaaggcaactccctcccaaacaccttcggccaaggcaccaaagtcgaaatcaaacgcaccgtcgccgccccctccgtcttcatcttccctccctcagacgaacaactcaaatcaggcaccgcctccgtcgtctgcctcctcaacaacttctacccccgcgaagccaaagtccaatggaaagtagacaacgccctccaatcaggcaactcacaagaatccgtcaccgaacaagactcaaaagactccacctactccctctcctccaccctcaccctctcaaaagccgactacgaaaaacacaaagtctacgcatgcgaagtaacccaccaaggcctatcctcccccgtcaccaaatccttcaaccgaggcgaatgc

SEQ ID NO: 53776 - RNA, 1359 nt, synthetic construct
  misc_feature 1..1359: note = derived and/or modified sequence opt11 from Evinacumab_HeavyChain1
  source 1..1359: mol_type = other RNA
gaagtacaactcgtcgaatcaggaggcggagtcattcaacccggcggatctcttcgcctcagctgcgccgcctcaggcttcacattcgatgactacgccatgaattgggtccgccaaggtcccggcaaaggcctcgaatgggtatcagccatctccggggacggcggatccacgtactacgcagactccgtcaaagggcgcttcaccatctcccgcgataacagcaaaaattcgctctacctccaaatgaactccctccgtgccgaagacaccgccttcttctactgcgccaaagacttaagaaacaccatattcggcgtcgtcatccccgacgccttcgatatctggggccaaggcaccatggtaaccgtatcctcagcctcaaccaaaggtccctccgtattccccctagcgccctgctctcgatcaacatcagaatccaccgccgccctcggctgcctagtaaaagactacttccccgaacccgtcaccgtctcatggaactccggcgcattaacatccggcgtacacacctttcccgccgtcctccaatcctcaggcctctactccctctcctccgttgtcaccgtcccctcatcttcactcggcaccaaaacctatacctgcaacgtagaccacaagccctccaacaccaaagtcgacaaacgagtagaatcaaaatacggcccaccctgcccaccctgccccgcccctgaatttctcggcggcccctccgtcttcctctttccaccaaaacccaaagacacactaatgatctctcgcacacccgaagtcacatgcgtagtagtagacgtctcccaagaagacccagaagtccaattcaactggtacgtagacggcgtcgaagtccacaacgccaaaacaaagccccgtgaagaacaattcaactccacataccgtgtagtctccgtcctcaccgtcctacaccaagactggctaaacggcaaagaatacaaatgcaaggtctcaaacaaaggactcccctcaagcatagagaaaaccatctccaaagcaaaaggccaaccccgagaaccccaagtctacacactcccaccctcccaagaagaaatgaccaaaaaccaagtttcactcacttgcctcgtcaaaggcttctacccaagcgacatcgccgtcgaatgggaatcaaacggccaacccgaaaacaactacaagaccaccccacccgtcctagactccgacggcagcttcttcctctactcccgcctaaccgtagacaaaagcagatggcaagaaggaaacgtcttctcctgctcagtcatgcacgaagcactacacaaccactacacccaaaagtcactctccctatcactcggaaag

SEQ ID NO: 53777 - RNA, 642 nt, synthetic construct
  misc_feature 1..642: note = derived and/or modified sequence opt11 from Evinacumab_LightChain1
  source 1..642: mol_type = other RNA
gacatccaaatgacccaatccccctccaccctctcagcctccgtcggcgaccgcgtcaccatcacctgccgcgcctcccaatccatccgttcctggctcgcctggtaccaacaaaaacccggcaaagcccccaaactcctcatctacaaagcctcctccctcgaatccggcgtaccctctcgcttctcaggctcaggctccggcaccgaattcaccctcaccatctcctcactccaacccgacgacttcgccacctactactgccaacaatacaactcctactcatacacattcggccaaggcaccaaactcgaaatcaaacgaaccgtcgccgccccctccgtcttcatcttccccccctccgacgaacaactaaaatccggaaccgcctccgtcgtctgcctcctcaacaacttctacccccgcgaagccaaagtccaatggaaagtcgacaacgccctccaatccggcaactcacaagaatccgtcaccgaacaagactctaaagactccacctactcactcagctcaaccctaaccctctctaaagccgactacgaaaaacacaaagtctacgcctgcgaagtcacccaccaaggcctatcatcacccgtcaccaaatccttcaaccgaggcgaatgc

SEQ ID NO: 53778 - RNA, 1323 nt, synthetic construct
  misc_feature 1..1323: note = derived and/or modified sequence opt11 from Evolocumab_HeavyChain1
  source 1..1323: mol_type = other RNA
gaagtccaactagtgcaatccggagcagaagtcaaaaaacccggcgcctccgtaaaagtctcatgcaaagcctccggctacaccctcaccagctacggcatctcctgggtccgccaagcacccggccaaggcctcgaatggatgggctgggtcagcttctacaacggaaacaccaactacgcccaaaaacttcaaggtcgcggcaccatgaccactgaccccagcacatccacagcatacatggaactccgatcactacgctccgacgatactgcagtctactactgcgccagaggctacggtatggacgtctggggccaaggaaccaccgtcacagtctcgtccgcttctaccaaaggtccctccgtctttccattagcaccatgctcccgctcaacctcggaatccaccgccgctctcggctgcctcgtaaaagactacttccccgaacccgtcaccgtctcttggaactccggcgccctcacatcaggcgtccacacattccccgccgtgctccaatcctccggcctctactcactctcatccgtcgtcaccgtcccctcatccaacttcggcacccaaacttacacttgcaacgtcgaccacaaaccctcgaacaccaaagtcgacaaaaccgtcgaacgaaaatgctgcgtcgagtgccccccctgcccagccccccccgtagccggtccctccgttttcctattccccccaaaaccaaaagacacactcatgatctcccgcacccccgaagtcacctgcgtcgtagtcgacgtctcccacgaagatcccgaagtccaattcaactggtacgtagacggcgtcgaagtccacaacgcaaaaaccaaaccccgcgaggagcaattcaactccacattccgagtcgtctccgtcctaaccgtcgtccaccaagactggctgaacggcaaagaatacaaatgcaaagtctcaaacaaaggccttcctgccccaatcgagaaaaccatatccaaaaccaaaggccaacctcgcgaaccccaagtctacactctccccccctctcgtgaagaaatgacaaaaaaccaagtctcactcacctgccttgttaaaggcttttacccatccgacatagccgtcgaatgggaaagcaacggtcaacccgaaaataactacaaaaccacacccccaatgctggactccgacggatccttcttcctatattccaaactcacggtcgacaaatcacgttggcaacaaggcaacgtattctcctgttccgtaatgcacgaagccctacacaaccactacacccaaaaatcactctccctctccccaggcaaa

SEQ ID NO: 53779 - RNA, 645 nt, synthetic construct
  misc_feature 1..645: note = derived and/or modified sequence opt11 from Evolocumab_LightChain1
  source 1..645: mol_type = other RNA
gaatccgccctcacccaacccgcctccgtctccggctccccaggccaatccatcaccatctcctgcaccggcacctcttcagacgtcggaggctacaactccgtatcctggtatcaacaacaccccggcaaagcccccaaactcatgatctacgaagtctccaaccgcccctccggcgtctccaaccgcttctccggctccaaatccggcaacaccgcctccctcaccatatcaggcctccaagccgaagacgaagccgactactactgcaactcctacacctccacctcaatggtcttcggcggaggcaccaaactcaccgtcctcggccaacccaaagccgccccctccgtcactctctttcccccctcctccgaagaactccaagccaacaaagccaccctagtctgcctcatatccgacttctaccccggcgccgtcaccgtcgcctggaaagccgactcctcacccgtcaaagccggcgtcgaaaccaccaccccctccaaacaatccaacaacaaatacgccgcctcctcctacctctccctcacccccgaacaatggaaatcccaccgatcctactcctgccaagtcacccacgaaggctccacagtcgaaaaaaccgtagcccccaccgaatgctcc

SEQ ID NO: 53780 - RNA, 1353 nt, synthetic construct
  misc_feature 1..1353: note = derived and/or modified sequence opt11 from Exbivirumab_HeavyChain1
  source 1..1353: mol_type = other RNA
caagtacagctagtcgaatcaggcggcggagtcgtccaacccggcggaagcctccgcctatcatgcgccccctccggcttcgtcttccgttcctacggcatgcactgggtccgccaaacacccggcaaaggcctcgaatgggtctccctcatatggcacgacggctccaaccgattctacgcagactccgtcaaaggccgattcacaatctcacgcgacaactccaaaaataccctctacctccaaatgaactccctccgcgccgaagacaccgcaatgtacttctgcgcccgagaacgcctcatcgcggcacccgctgccttcgacctctggggacaaggaacactcgtcactgtatcctctgcctccaccaaaggcccctccgtcttcccactcgcaccctcctccaaaagcacctcaggaggaactgctgccttgggatgcctagtaaaagactactttcccgaaccagtcacagtctcctggaactccggagcactcacatccggcgtccacacattccccgcagtactccaatcttccggcctctacagcctatcctccgtcgtcacagtcccatcctcctcactcggcacccaaacctacatatgcaacgtcaaccacaaaccctccaatacaaaagtcgacaaacgcgtcgaacccaaaagctgcgacaaaacacacacttgcccaccctgccccgcccccgaactccttggcggcccatctgtcttcctattcccacccaaacccaaagacaccctaatgatatcacgaacccccgaagtgacatgcgtcgtcgtcgacgtctcacacgaagaccccgaagtcaaattcaactggtacgtcgacggagtcgaagttcacaacgccaaaaccaaaccacgagaagaacaatacaactccacctatcgagtcgtctccgtactcaccgtactccaccaagactggctaaacggaaaagaatacaaatgcaaagtttcaaacaaagcactccccgccccaatcgagaaaaccatctctaaagccaaaggacaaccccgcgaaccacaagtctatacattacccccttcccgggaagaaatgaccaaaaaccaagtctccctcacatgccttgtaaaaggcttctacccctctgacatcgccgtcgaatgggaatccaacggccagcccgaaaataactacaaaacaactccacccgtcctcgactccgacggctccttcttcctctactccaagctcaccgtcgacaaatcacgctggcaacaaggcaacgtcttctcctgctccgtcatgcacgaagccttacacaaccactacacccaaaaatccctctccctctccccaggcaaa

SEQ ID NO: 53781 - RNA, 642 nt, synthetic construct
  misc_feature 1..642: note = derived and/or modified sequence opt11 from Exbivirumab_LightChain1
  source 1..642: mol_type = other RNA
tcttacgtcctaacacaacccccatccgtctcagtcgcccccggcaaaaccgcccgcatctcctgcggcggcaacaacatcggcaccaaaaacgtacactggtaccaacaaaaacccggccaagcccccgtcctcgtcgtctacgccgactcagaccgcccctccggaatccccgaacgcttctctggatccaactccggaaacaccgccaccctcacaatctcccgcgtcgaagccggcgacgaagccgactactactgccaagtatgggactccgtctcctaccacgtcgtatttggcggaggcaccaccctcaccgtcctcggacaacccaaagccgccccctccgtcaccctcttccccccttccagcgaagaactccaagccaataaagccaccctcgtctgcctcatctccgacttctacccaggcgccgtcaccgtagcctggaaagccgactcctcccccgtcaaagccggcgtcgaaaccaccaccccctccaaacaatccaacaacaaatacgcagcctcatcctacctctccctcacccccgaacaatggaaatcacaccgctcctactcctgccaagtcacccacgaaggctccacagtcgaaaaaaccgtcgcccccaccgaatgctcc

SEQ ID NO: 53782 - RNA, 1347 nt, synthetic construct
  misc_feature 1..1347: note = derived and/or modified sequence opt11 from Farletuzumab_HeavyChain1
  source 1..1347: mol_type = other RNA
gaagtgcaactcgtcgaatcaggcggaggagtagtccaacccggtcgctcccttcgactctcatgctccgcctccggctttaccttctccggctatggcctctcatgggtccgccaagcccccggaaaaggcttagaatgggtcgctatgatctcgtcgggcggctcatacacctactacgcagacagcgtaaaaggccgattcgcgatctcacgcgacaacgccaaaaacaccctcttcctccagatggactccctccggccagaagacaccggcgtttacttctgcgcccgacacggcgacgacccagcctggttcgcatattggggccaaggcacccccgtcaccgtctcctcagcctcaaccaaaggcccctcagtcttccccctcgccccatcatccaaatccacatcaggaggcaccgccgccctaggctgcctcgtcaaagactacttccccgaacccgtcaccgtatcctggaatagcggcgcactcaccagcggcgtccacacattcccagctgtcctccaatcctccggactctactccctctcctccgtcgtcacagtcccctcatccagcctcggcacccaaacctacatatgcaacgtcaaccacaaaccatcaaatacaaaagtcgacaagaaggtagaacccaaatcctgcgataaaacacacacctgtccaccctgccccgcacccgaactcctcggcggcccctccgtattcctcttcccgcccaaacccaaagacaccctcatgatttcacgcacccccgaagtcacatgcgtcgtagtcgacgtctcccacgaagaccccgaagtcaagttcaattggtacgtagacggcgtcgaagtccacaacgccaaaacaaaaccccgtgaagaacaatacaactccacctaccgtgtcgtatccgtcctcaccgtcctccaccaggactggctcaacggcaaagaatacaaatgcaaagtcagcaacaaagccctccccgcccccatcgagaaaaccatctccaaagcgaaaggccaaccccgagaaccccaagtctacaccctcccaccatcccgcgacgaactcaccaaaaaccaagtctccctcacttgcctagtaaaaggattctacccctccgacatcgccgtcgaatgggaatctaacggccaacccgaaaacaactacaaaaccacaccgcccgtcctcgactcagacggatccttcttcttatactccaaactcacagtagataaatcacgttggcaacagggaaatgttttctcctgctccgtcatgcacgaagcactccacaaccactacactcaaaaatccctctctctctcccccggaaaa

SEQ ID NO: 53783 - RNA, 651 nt, synthetic construct
  misc_feature 1..651: note = derived and/or modified sequence opt11 from Farletuzumab_LightChain1
  source 1..651: mol_type = other RNA
gacatccaactcacccaatcaccctcctccctatcagcctcagtcggcgaccgcgtcaccatcacatgctcagtctcctcctcaatctcatccaacaacctacactggtaccaacaaaaacccggcaaagcacccaaaccctggatctacggcacatccaacctagcctcaggagtcccctcacgcttctcaggctccggctcaggcacagactacaccttcaccatctcctcactccaacccgaagacatcgccacctactactgccaacaatggtcctcctacccctacatgtacaccttcggccaaggcaccaaagtcgaaatcaaacgcaccgtcgccgccccctccgtcttcatcttcccaccctcggacgaacaactcaaatccggcaccgcctccgtcgtatgcctcctcaacaacttctacccccgagaagcaaaagtacaatggaaagtcgacaacgcactccaatccggcaactcccaagaatccgtcaccgaacaagactccaaagactccacctactccctctcctcaaccctcacactctcaaaagccgactacgaaaaacacaaagtctacgcctgcgaagtcacacaccaaggcctctcttcccccgtcaccaaatccttcaaccgcggcgaatgc

SEQ ID NO: 53784 - RNA, 1338 nt, synthetic construct
  misc_feature 1..1338: note = derived and/or modified sequence opt11 from Fasinumab_HeavyChain1
  source 1..1338: mol_type = other RNA
caagttcaactcgtccaaagcggagccgaagtaaagaaacccggagcctccgtaaaagtatcctgcaaagtctcaggcttcaccctcaccgaactcagcatccactgggtccgccaagccccaggcaagggcctcgaatggatgggcggcttcgaccccgaagacggcgaaaccatctacgctcaaaaattccagggccgcgtcaccatgaccgaagacacctccacagacaccgcctacatggaactcacctccctcagaagcgaggacaccgccgtctactactgctccaccatatttggcgtcgtcaccaatttcgacaactggggccaaggaacacttgtcaccgtctcctccgcctccacaaaaggcccctccgtcttcccactagccccctgctcacgatccacatccgaatccaccgcagcactcggctgcctagtcaaagactacttcccagaacccgtcaccgtcagctggaactccggagctctaacctccggagtacacaccttccccgctgtccttcaatcctcaggcctctacagcctctcctccgtcgtcaccgtaccaagctcctcactcggcacaaaaacctacacatgcaacgtcgaccacaaaccaagcaacacgaaagtcgacaaacgcgtagaatcaaaatacggacccccatgcccaccctgcccagcacccgagttcctcggcggaccctccgtgttcctctttccccctaaaccaaaagacacactaatgatctcacgcacccccgaagttacctgcgtagtcgtcgacgtaagccaagaagaccccgaggtccaattcaactggtacgtcgacggagtcgaagtccacaacgccaaaacaaaaccccgcgaagaacaattcaactccacgtaccgcgtcgttagcgtcctcacagtcctacaccaagactggctaaacggcaaagaatacaaatgcaaagtcagcaacaaaggactaccatcgtcaatcgagaaaaccatctctaaagcgaaaggccaaccaagagaaccccaagtctacaccctacccccaagccaagaagaaatgaccaaaaaccaagtctcactgacctgccttgtcaaaggcttctacccctcagacatcgccgtcgaatgggaatcaaacggccaacccgaaaacaactacaaaaccaccccacccgtactcgattccgatggatccttcttcctctattcacgactaacagtcgacaaatcacgttggcaagaaggaaacgtcttctcctgctccgtcatgcacgaagccctccacaaccattacacccaaaaatcactatccctctccctcggcaaa

SEQ ID NO: 53785 - RNA, 642 nt, synthetic construct
  misc_feature 1..642: note = derived and/or modified sequence opt11 from Fasinumab_LightChain1
  source 1..642: mol_type = other RNA
gacatccaaatgacccaatcaccatcctccctctccgcctccgccggcgaccgcgtcaccatcacctgccgcgcctcccaagcaatccgcaacgacctcggctggtaccaacaaaaacccggcaaagcccccaaacgcctaatctacgccgccttcaaccttcaatccggcgtcccctcccgattctcaggctccggctcaggcacagaattcaccctaaccatctcctccctccaacccgaagacctcgcctcctactactgccaacaatacaaccgctacccctggaccttcggccaaggaaccaaagtcgaaataaaacgaaccgtcgccgccccctccgtcttcatcttccccccctccgacgaacaactaaaatccggaacagcctcagtcgtctgcctcctaaacaacttctacccccgcgaagccaaagtccaatggaaagtcgacaacgccctccaatccggcaactcacaagaatccgtcaccgaacaagacagcaaagactccacctactccctatcctcaaccctaaccctctccaaagccgactacgaaaaacacaaagtctacgcctgcgaagttacccaccaaggactctcctcccccgtcaccaaatccttcaaccgaggagaatgc

SEQ ID NO: 53786 - RNA, 1350 nt, synthetic construct
  misc_feature 1..1350: note = derived and/or modified sequence opt11 from Fezakinumab_HeavyChain1
  source 1..1350: mol_type = other RNA
caagtccagctagtacaatccggcgccgaggtcaagaaacccggcgccagcgtcaaagtcagctgcaaagcctccggctacacatttacaaactactacatgcactgggttcgccaagcccccggccaaggcttagaatgggtaggctggatcaacccatacaccggatccgccttctacgcacaaaaattccgaggcagagtcacaatgacccgagacacctccatttccaccgcctacatggaactatcccgcctccgctccgacgacaccgccgtctattactgcgcacgtgaaccagaaaaattcgacagcgacgactccgacgtatggggccgcggcaccctggtaacagtctcatccgcctccaccaaaggcccctcggtcttccccctcgctccatcctcaaaatccacctccggcggcacagcagccctcggatgcctcgtgaaagactatttccctgagccagtcaccgtctcctggaactcaggcgcactcacatccggcgtccacaccttcccagcagtcctccaatcctctggactctactctctctcctccgtagtcaccgtcccttcatccagcctgggaacccaaacttacatctgtaacgtcaaccacaaacccagcaacaccaaagtcgacaagaaagtcgaaccaaaatcctgcgacaaaacccacacatgccctccctgtcccgcaccagaactactcggcgggccctccgtattcctatttcccccaaaaccaaaagacaccctcatgatatcccgcacccccgaagtcacatgcgtagtagtcgacgtctcccacgaagaccccgaagtcaaattcaactggtacgtcgacggcgtcgaagtccacaacgccaagaccaaaccccgggaagaacaatacaactccacctaccgcgtagtctcagtactcacagtcctccaccaagactggctaaatgggaaagaatacaaatgcaaagtctccaacaaagccctccccgcacccatcgagaaaaccatctccaaagccaaaggccaaccacgagaaccccaagtctacacattaccaccctcccgcgaagagatgaccaaaaaccaagtcagccttacctgcctcgtcaagggcttctacccctcagacatcgccgtcgaatgggaatccaacggccaacccgaaaacaactacaaaacaactcctcccgtcctcgactccgacggctccttcttcctctactccaaacttaccgttgacaaatctcgatggcaacaaggaaacgtcttctcttgctccgtaatgcacgaagccctccacaaccactacacccagaaatcactctccctctcacccggc

SEQ ID NO: 53787 - RNA, 651 nt, synthetic construct
  misc_feature 1..651: note = derived and/or modified sequence opt11 from Fezakinumab_LightChain1
  source 1..651: mol_type = other RNA
caagccgtcctcacacaacccccctccgtctccggagcacccggccaacgtgtcaccatctcctgcaccggctcctcctcaaacatcggcgccggctacggcgtccactggtaccaacaactcccaggcaccgcccccaaactcctcatctacggcgactccaaccgaccctccggagttcccgaccgcttctccggttcaaaatcaggcacctccgcctccctcgccatcaccggcctccaagccgaagacgaagccgactactactgccaatcctacgacaactccctctcaggctacgtcttcggaggcggaacccaactaaccgtcctaggccaacccaaagccgcaccctccgtcacactcttccccccctcctccgaagaactccaagccaacaaagccaccctcgtatgcctaatctccgacttctaccctggcgccgtcaccgtcgcctggaaagccgactcatcacccgtcaaagccggcgtcgaaaccaccacaccctccaaacaatcaaacaacaaatacgcagcctcctcctacctctcactcaccccagaacaatggaaatcccaccgctcatactcctgccaagtcacccacgaaggctccaccgtcgaaaaaacagtcgccccaaccgaatgctcc

SEQ ID NO: 53788 - RNA, 1347 nt, synthetic construct
  misc_feature 1..1347: note = derived and/or modified sequence opt11 from FG-3019_HeavyChain1
  source 1..1347: mol_type = other RNA
gaaggccaactcgtccaatccggcggcggcctcgtccaccccggcggctcactccgcctatcttgcgccggctcaggattcaccttcagctcctacggcatgcactgggtccgccaggccccaggcaaaggcctcgaatgggtctcaggcatcggcaccggcggcggcacctactccaccgacagcgttaaaggccgcttcaccatctcccgagacaacgccaaaaacagcctctatctccaaatgaactccctccgagccgaagacatggcagtttactactgcgcccgcggcgactactacggatccggctcattcttcgactgctggggacagggaacactcgtaaccgtatcatcagcttccaccaaaggcccctccgtcttcccacttgcaccctcatctaaaagcacctccggaggcaccgcagcgctcggatgcctagttaaagactatttccccgaacctgtcacagtttcatggaactccggcgccctaacctccggcgtccacaccttcccagccgtcctacaatcatctggcctttactcactctcatccgtagtcaccgtcccctcctcctcgctcggcacacaaacatacatatgcaacgtcaaccacaaacccagcaacaccaaagtcgacaaacgagtcgaaccaaagtcctgcgacaaaacccacacatgcccaccctgccccgcccccgaactactcggcggaccctccgtcttcctcttcccacccaaacccaaagacaccctcatgatctccagaacccccgaagttacctgcgtagtcgtcgacgtctcccacgaagacccagaagtaaaattcaactggtatgtcgatggagtagaagtacacaacgccaaaacaaaaccccgcgaagaacaatacaactccacataccgcgtagtctcagtcctcaccgtcctccaccaagactggctgaacggcaaagaatacaaatgcaaggtctccaacaaagccctacccgcccccatagagaaaaccatatcaaaagccaaaggccagccccgcgaaccacaagtctacacactacctccctcacgcgaagaaatgaccaaaaaccaagtcagcttaacctgcctcgttaaaggcttctacccctccgacatcgctgtcgaatgggaatcaaacggccaacccgaaaacaactacaaaaccacaccgcccgtactcgactccgacggctcattcttcctctactcaaaactcacagtagacaaatcccgctggcaacaaggcaacgtcttctcctgctccgtaatgcacgaagccctccacaaccactacacccaaaaatccctctcgctctcccccgga

SEQ ID NO: 53789 - RNA, 642 nt, synthetic construct
  misc_feature 1..642: note = derived and/or modified sequence opt11 from FG-3019_LightChain1
  source 1..642: mol_type = other RNA
gacatccaaatgacccaatcaccctcctcactctccgcctcagtcggcgaccgcgtcaccatcacatgccgagcctcccaaggcatctcctcctggctcgcctggtaccaacaaaaacccgaaaaagcccccaaatccctcatctacgccgcctcctccctacaatccggcgtccccagccgcttctccggctcaggctccggcaccgacttcaccctcaccatctcctcccttcaacccgaagacttcgcaacctactactgccaacaatacaactcctacccacccaccttcggacaaggaaccaaactcgagatcaaacgcaccgttgccgccccctccgtattcatcttcccaccctccgacgaacaactcaaatccggcaccgcctccgtcgtatgcctactcaacaacttctacccccgcgaagccaaagtccaatggaaagtcgacaacgccctccaatccggcaactcccaagaatcagtcaccgaacaagactccaaagactcaacctactcactaagctcaaccctaaccctatcaaaagccgactacgaaaaacacaaagtctacgcatgcgaagtcacccaccaaggcctctcctcccccgtcaccaaatccttcaaccgcggcgaatgc

SEQ ID NO: 53790 - RNA, 1344 nt, synthetic construct
  misc_feature 1..1344: note = derived and/or modified sequence opt11 from Fibatuzumab_HeavyChain1
  source 1..1344: mol_type = other RNA
caagtacaactcgtccaatccggcgcagaagtcaagaaacctggcgcatccgtcaaagtttcctgcaaagccagcggctacactttcaccggctactggatgaactgggtccgccaagcccccgggcaaggcctcgaatggatgggagacatctaccccggatccggcaacaccaactacgacgaaaaattccaaggccgagtcaccatgacccgagacacctcaatctcaaccgcatacatggaacttagccgactccgctccgacgacaccgctgtatactactgcgcacgcggcggttactacgaagacttcgattcctggggccaaggcaccacagtcaccgtctcctccgcctccaccaaaggcccctcagtcttccccctagccccctcctcaaaaagcacctccggcggaaccgccgcactcggctgcctagtcaaagattactttccagagcccgtaaccgtcagctggaactccggcgccctcacgtccggcgtccacacattcccagccgtactacaaagcagcggtctctactcactctcatcagtcgtcacagtcccctccagctcactcggaacccaaacctacatctgcaacgtaaaccacaaaccttctaacaccaaggtcgacaagcgcgtcgaacccaaatcctgcgacaaaacccacacctgtccaccctgccccgcccccgaactcctaggcggcccctccgtcttcctcttcccacccaaacccaaagacacactcatgatctcccgtacacccgaagttacctgcgtcgtcgtagacgtctcccacgaagaccccgaggtcaaattcaactggtacgtcgacggcgtcgaagtccacaacgccaaaacaaaaccccgagaagaacaatacaactcaacataccgcgtagtctcggtcctaacagtcctccaccaagactggctcaacggaaaagaatacaaatgcaaagtatccaacaaagccctacccgcccccatcgagaaaaccatctcaaaagcaaaaggccaaccccgcgaaccccaagtatacaccctcccaccctcaagagaagaaatgaccaaaaaccaagtatctctaacctgcctcgtcaaaggattctacccctccgacattgccgtcgaatgggaatccaacggacaacccgaaaacaactacaaaaccaccccacccgtcctcgactcagatggctcctttttcctctactccaaactaaccgtagacaaaagtagatggcaacaaggcaacgtcttcagctgctccgtcatgcacgaagcactacataaccactacacccaaaaatccctttcactttcacccggcaaa

SEQ ID NO: 53791 - RNA, 642 nt, synthetic construct
  misc_feature 1..642: note = derived and/or modified sequence opt11 from Fibatuzumab_LightChain1
  source 1..642: mol_type = other RNA
gacatccaaatgacccaatccccatcattcctctcagcctctgtcggcgaccgagtcaccatcacctgccgtgcctcccaaggcatcatctcctacctcgcctggtaccaacaaaaacccgaaaaagcccccaaacgcctcatatacgccgcctcctccctccaatcaggcgtcccctctcgcttctccggctccggctccggcaccgaattcaccctcaccatctcctccctccaacccgaagacttcgccacctactactgcggccaatacgccaactacccctacacattcggccaaggcaccaaactcgaaatcaaacgcaccgtcgccgccccctccgtcttcatattccccccctccgacgaacaactcaaatccggcaccgcctccgtcgtctgcctactcaacaacttctacccacgcgaagccaaagtccaatggaaagtcgacaacgcactccaatccggcaactcacaagaaagcgtcaccgaacaagacagcaaagactccacctactccctctcctcaaccctcaccctatcaaaagccgactacgaaaaacacaaagtctacgcctgcgaagtcacccaccaaggcctctcctcccccgtcaccaaatccttcaaccgaggagaatgc

SEQ ID NO: 53792 - RNA, 1344 nt, synthetic construct
  misc_feature 1..1344: note = derived and/or modified sequence opt11 from Ficlatuzumab_HeavyChain1
  source 1..1344: mol_type = other RNA
caagtacaattagtccaacccggagcagaggtaaagaaacccggcacctccgttaaactcagctgcaaagcatccggatacaccttcacaacgtactggatgcactgggtacgccaagcgcccggccaaggcctcgaatggatcggcgaaatcaaccccacaaacggccacacaaactataaccaaaaattccaaggccgagccaccctaaccgtggacaaatcaacctccacggcctacatggaactctcctccctccgctcagaggacaccgcagtatactactgcgcccgaaactacgtaggatccatcttcgactactgggggcaaggcacgctactcaccgtctcctccgcctccaccaaaggcccttcagtcttcccacttgcaccaagcagcaaaagcacatcaggcggaacagccgctctaggctgcctcgtcaaagactacttccccgaacccgtcactgtctcctggaactccggcgccctaacctccggagtccacacattccccgccgtccttcaatcctccggactctacagcctttcaagcgtcgtcaccgtcccatcatcttcactaggcacccaaacctacatctgcaacgtcaaccacaaaccctcaaacaccaaagtcgacaagcgagtcgaacccaagagctgcgacaaaacccatacctgcccaccctgccccgccccagaacttctaggcggcccctccgtattccttttcccacccaaaccaaaagacaccctcatgatctcacgtaccccagaagtaacctgcgtcgtcgtagacgtctcccacgaagacccagaagtgaaattcaactggtacgtagacggcgtcgaagtacacaacgcaaaaacaaaaccccgagaagaacaatacaactccacctaccgcgtagtgtccgtcctcacagtcctccaccaagactggctaaacggcaaagaatacaaatgcaaagtaagcaacaaagccctccccgcccccatagagaaaaccatcagcaaagccaaaggacaaccccgcgaaccacaagtctacaccctacccccaagcagagaagaaatgaccaaaaatcaagtctccctaacctgcctcgtcaaaggtttctacccctccgacatcgcagtcgaatgggaatcaaacggacaacccgaaaacaactacaaaaccaccccacccgtactcgactctgacggttccttcttcctctactccaaactcaccgtagacaaatcccgatggcaacaaggcaacgtcttctcctgctcagtaatgcacgaagccctacacaaccactacacacagaaaagcctctctctatcccccggcaaa

SEQ ID NO: 53793 - RNA, 1341 nt, synthetic construct
  misc_feature 1..1341: note = derived and/or modified sequence opt11 from Ficlatuzumab_HeavyChain
  source 1..1341: mol_type = other RNA
gtccagctcgtgcaaccaggagcagaagtcaagaaacccggcacctccgtcaaactgtcctgcaaagccagcggctacacattcaccacatactggatgcactgggtccgacaagcacccggacaaggcctcgaatggatcggagaaataaaccccaccaacggccacacaaattacaaccaaaaattccagggccgcgccaccctcaccgtcgacaaatctacgtccacagcctacatggaacttagctccctccgcagcgaagacaccgccgtctactactgcgcacgcaattacgtcggatccatcttcgactactggggacaagggaccctcctaaccgtatcctccgcctccaccaaaggcccttctgtattccccctcgccccttcctccaaatccacctccggtggcactgccgcactaggctgcctcgtcaaagactacttccccgaacccgtcacagtctcctggaactccggcgcactaacaagcggcgttcacaccttcccagcagtactccaatcatccggcctatactctctatcctcagttgttaccgtcccttcttcctccctcggcacacaaacctacatctgcaacgtaaaccacaaaccatccaacaccaaagtagacaaaagagtagaacccaaatcatgcgacaaaacacacacatgccctccttgcccagcccccgaactactcggcggcccctcagtcttcctcttcccgcccaaacccaaagacacccttatgatatcccgaacccccgaagtaacctgcgtcgtcgtcgacgtctcccacgaagaccccgaagtcaaattcaactggtacgtcgacggagtagaagtacacaacgccaaaaccaaaccccgcgaagaacaatacaactccacctaccgcgtcgtctctgtcctaactgtcctacaccaagactggctcaacggcaaagaatacaaatgcaaagtctcgaacaaagccctccccgcccccatcgagaaaaccatatctaaggccaaaggccagccccgagaaccccaagtatacaccctcccaccctcccgagaagaaatgaccaaaaaccaggtctccctaacatgcctcgtgaaaggcttctacccctccgacatcgccgtcgaatgggaatccaacggccaaccagaaaacaactacaaaaccacacccccagtcttagacagcgacggctccttcttcctttactcaaaactgaccgtcgacaagagccgctggcaacaaggcaacgtcttctcctgctcagtcatgcacgaagccctacacaaccactacacacagaaatccctttcactctcacccggcaaa

SEQ ID NO: 53794 - RNA, 642 nt, synthetic construct
  misc_feature 1..642: note = derived and/or modified sequence opt11 from Ficlatuzumab_LightChain1
  source 1..642: mol_type = other RNA
gacatcgttatgacacaatcacccgactcccttgccatgtccctcggcgaacgcgtaaccctcaactgcaaagcctccgaaaacgtcgtctcctacgtctcctggtaccagcaaaaacccggccaatcacccaaactcctcatctacggcgcctccaaccgcgaatccggcgtccccgaccgattctcaggctcaggctcagccaccgacttcaccctcaccatctcctccgtccaagccgaagacgtcgccgactaccactgcggccaatcctacaactacccctacaccttcggccaaggtaccaaactcgaaatcaaacgcaccgtcgccgccccctccgtcttcatcttccccccctccgacgaacaactcaaatccggcacggcctccgtcgtctgcctactcaacaacttctacccccgcgaagccaaagtccaatggaaagtcgacaacgccctccaatcaggtaactcacaagaaagcgtcaccgaacaagactccaaagactcaacctactccctctcctccaccctcaccctctccaaggccgactacgaaaaacacaaagtatacgcctgcgaagtcacccaccaaggcctctcctcccccgtcaccaaatccttcaaccgcggcgaatgc

SEQ ID NO: 53795 - RNA, 1350 nt, synthetic construct
  misc_feature 1..1350: note = derived and/or modified sequence opt11 from Figitumumab_HeavyChain1
  source 1..1350: mol_type = other RNA
gaagtacaattactagaatccggaggcggactcgtccaaccaggcggatccctccgactatcctgcaccgcaagcgggttcacattctcatcctacgccatgaattgggtccgccaagcccccggaaaaggcctcgaatgggtctcagccatatcaggctcaggcggcaccacattttacgccgattcagtcaaaggacgcttcaccataagcagagacaactcccggacaaccctatacctacaaatgaactccctcagagccgaagacaccgccgtctactactgtgccaaagacctcggctggtcagacagctactactactactacggcatggacgtatggggccaaggcaccacggttacagtatcctcagcatccactaaaggcccatccgtattccccctagccccctgctcacgctccacatcagaatcaaccgccgcccttggctgcctcgtcaaagactacttccccgaacccgtcaccgtatcctggaactccggcgccctcacctccggtgtccacaccttcccagcggtcctccaatcatctgggctctactccctctcctcagtcgtaaccgtccccagcagcaacttcggaacccaaacctatacctgcaacgtcgaccacaaaccttccaacaccaaagtcgacaaaaccgtagaacgcaaatgctgcgtcgaatgcccaccctgtcccgcaccacccgtcgccggcccctccgtcttcctgttcccacccaaacccaaggataccctcatgatctcccgcacccccgaagttacctgcgtcgtcgtcgacgtaagccacgaagaccccgaagtccaattcaattggtacgtcgacggcgtggaagtacacaacgccaagaccaaaccccgagaagaacaattcaactccacatttcgcgtcgtctccgtcctcaccgtagttcaccaggactggctcaacggtaaagagtacaaatgcaaagtatccaacaagggcctccccgctcccatagagaaaacaatcagcaaaacgaaaggccaaccccgcgaaccccaagtctacaccctcccgccctctcgagaagaaatgaccaaaaaccaagtatcgctcacatgcctcgtcaaaggcttctacccctccgacatagcagtcgagtgggaatccaacggccaacccgagaacaactacaaaaccaccccaccaatgctagactccgacggcagcttctttctatactccaaactaaccgtcgacaaatcccgatggcaacaaggcaacgtcttctcgtgctccgtcatgcacgaagccctgcacaaccactacacccaaaaatccctctcactctcacccggt

SEQ ID NO: 53796 - RNA, 642 nt, synthetic construct
  misc_feature 1..642: note = derived and/or modified sequence opt11 from Figitumumab_LightChain1
  source 1..642: mol_type = other RNA
gacatccaaatgacacaattcccctccagcctctccgcctccgtcggcgaccgcgtcaccatcacctgccgcgcatcccaaggcatacgcaacgaccttggctggtaccagcaaaaacccggcaaagcaccaaaacgactaatctacgccgcaagccgactccaccgaggcgtcccctccagattctccggctccggctccggcaccgaattcaccctcaccatatcctccctccaacccgaagacttcgccacctactactgcctccaacacaactcatacccctgctccttcggccaaggcaccaaactcgaaatcaaacgcaccgtcgccgccccttccgtcttcatcttccccccctcagacgaacaactcaaatccggcacggcctcagtcgtatgcctactcaacaacttctacccacgcgaagccaaagtccaatggaaggtcgacaacgcgctccaatccggcaactcacaagaatccgttaccgaacaagactcaaaagactccacctactccctcagctccaccctcaccctcagcaaagccgactacgaaaaacacaaagtatacgcctgcgaagtcacacaccaaggcctctcctcacccgtaaccaagagcttcaaccgcggcgaatgc

SEQ ID NO: 53797 - RNA, 1359 nt, synthetic construct
  misc_feature 1..1359: note = derived and/or modified sequence opt11 from Firivumab_HeavyChain1
  source 1..1359: mol_type = other RNA
caagttcaactcgtacaatccggcgccgaagtgaaaatgcccggatcttcagtaaaagtctcctgcaaaaccagcggcgtcttcttctcctcccacgccatatcctgggtacgtcaagcccccggccaaggcctagaatggatgggcggcatctcccccatgttcggcaccacccactacgcccaaaaattccaaggccgagtcaccatcacagccgaccaatcgacaaccacagcctacatggaactcacctcacttacctccgaagatacagccgtctactactgcgccagagacggcgccggctcatactaccccctcaactggttcgacccctggggccaaggcaccctcgtcaccgtctcctctgcctccacaaaaggcccatccgtctttccactcgccccctcatccaaatctacctccggcggcaccgccgcgctcggctgcttagtaaaagactacttccccgaaccagtaaccgtctcctggaactccggcgccctcacctcaggcgttcacacctttcccgcagttctccaaagttcaggcctctactccctctcctctgtcgtcaccgtcccctcctcctccctcggcacccagacctacatctgcaacgtaaaccacaaaccctctaacactaaagtcgacaaacgcgtagaacccaaatcttgcgacaaaacacacacatgcccaccctgccccgcccccgaactcctcggcggaccatccgttttcctattcccacccaaaccaaaagacaccctcatgataagccgaactccagaagtcacatgcgtcgtcgtcgacgtctcccacgaagatccggaagtaaaattcaactggtacgtagacggagtcgaagtccacaacgcaaaaacaaaaccacgcgaagaacaatacaactccacctaccgcgtagtctccgtcctaaccgtactccaccaagactggctcaacggtaaagaatacaaatgcaaggtctccaataaagctctacccgcccccatcgagaaaacaatctccaaggcaaaaggacaaccacgcgaaccccaagtctatactctaccaccatcccgtgacgaactcaccaaaaaccaagtctccctcacttgcctcgtcaagggcttctacccctccgacatcgccgtcgaatgggagtccaatggccaacccgaaaacaactacaagaccacaccacccgtcctagacagcgacggctcattcttcctctacagtaaactcaccgtcgacaaatcccgctggcagcaaggcaacgtcttctcatgctccgtaatgcacgagggacttcacaaccactacacacaaaaatccctatccctatcccccggaaaa

SEQ ID NO: 53798 - RNA, 642 nt, synthetic construct
  misc_feature 1..642: note = derived and/or modified sequence opt11 from Firivumab_LightChain1
  source 1..642: mol_type = other RNA
gaaatcgtcctcacccaatcccccgcaaccctcagcctatcccccggcgaacgcgcaaccctctcctgccgcgcctccgaaaacatctggaacaacctagcctggtaccaacaaaaacccggccaagccccacgcctcctcatctcaggcgcctccaccggcgccaccggcgtcccctcccgattcagaggctccggctcacgcaccgaattcaccctaacaatctcctcactccagtcagaagacttcgccatctacttctgccaacaatacaactcctggccccgcacattcggccccggcacaaaagtcgaaatcaaacgcacagtcgcagccccctcagtcttcatcttcccaccctccgacgaacaactcaaatccggcaccgcctccgtcgtatgcctcctcaacaacttctacccacgcgaagccaaagtccaatggaaagtcgacaacgccctccaatccggcaactcccaagaaagcgtcaccgaacaagacagcaaagactccacctactccctcagctccaccctcaccctctccaaagccgactacgaaaaacacaaagtctacgcatgcgaagtcactcaccaaggcctaagctcccccgtaaccaaaagcttcaacagaggcgaatgc

SEQ ID NO: 53799 - RNA, 1347 nt, synthetic construct
  misc_feature 1..1347: note = derived and/or modified sequence opt11 from Flanvotumab_HeavyChain1
  source 1..1347: mol_type = other RNA
caagtacagctagtacaatccggttcagagctcaagaaacccggcgccagcgtcaaaatatcatgcaaagcatccggctacaccttcacttcctacgccatgaactgggtccgccaagcccccggccaaggactcgaatccatgggctggatcaacacaaacaccggaaacccaacatacgcacagggcttcaccggtcgcttcgtcttcagcatggacacctccgtctccaccgcatacctccaaattagctccctcaaagctgaagataccgccatctactactgcgctccacgctactcctcatcatggtacctggactactggggccagggcaccctggtcaccgtctcgagcgcctcaacaaaaggcccgtcagtcttcccgctagccccctcatccaaatccacctcaggcggcaccgccgccctcggctgcctcgtcaaagactacttccccgaacccgtcacggtatcatggaactcaggcgcactaacctctggcgtccacaccttccctgcagtccttcaatcatccggcctatattcactctcctccgtagtcaccgtcccatcctcctcacttggcacccaaacctacatctgcaacgtgaaccacaaaccaagcaacaccaaagtcgacaaacgcgttgaacctaaatcctgcgacaaaacccacacatgcccaccctgtcccgcccccgaactactcggcggacccagcgtcttcctctttccacccaaacccaaagacaccctaatgatctcgcgcacacccgaagtaacctgcgtcgtcgtcgacgtctcccacgaagaccccgaagttaaattcaactggtacgtagatggcgtcgaagtccacaacgccaaaaccaaaccccgcgaagaacaatataactccacctaccgcgtcgtcagcgtccttaccgtcctccaccaagactggctcaacggtaaagaatacaaatgcaaagtctccaacaaagccctccccgcacccatagagaaaaccatttcaaaagccaaaggccaaccccgcgaaccacaagtatacaccctaccaccctcacgcgaagaaatgaccaaaaaccaagtctccctgacctgcctcgtaaaaggattctacccctccgacatcgcagtcgaatgggaatccaacggacaacccgaaaacaactacaaaaccacgcccccggtcctagactcagacggttccttctttctctacagcaaactcaccgtcgacaaaagccgctggcaacaaggcaatgtattctcatgctcagtcatgcacgaagccctccacaaccactacacccaaaaatcactctctctatcccccggaaaa

SEQ ID NO: 53800 - RNA, 645 nt, synthetic construct
  misc_feature 1..645: note = derived and/or modified sequence opt11 from Flanvotumab_LightChain1
  source 1..645: mol_type = other RNA
gaaatcgtcctaacccaatcccccgcaacactctccctctcacccggcgaacgcgccaccctctcctgccgcgcatcccaatcagtctcctcctaccttgcatggtaccaacaaaaacccggccaagcaccccgcctcctcatctacgacgcctccaaccgagccaccggaatccccgcccgcttctcaggctccggctccggaaccgacttcaccctcaccatctcctccctagaacccgaagacttcgccgtctactactgccaacaacgctcaaactggctcatgtacaccttcggccaaggaaccaaactcgaaatcaaacgcaccgtcgccgccccatccgtcttcatcttcccaccctccgacgaacaactcaaatccggcacagcctccgtcgtctgcctcctcaacaacttctacccccgcgaagccaaagtccaatggaaagtcgacaacgccctccaatccggcaactcacaagaatccgtcaccgaacaagactccaaagactccacctactccctctcctctaccctcaccctctccaaagccgactacgaaaaacacaaagtctacgcctgcgaagtcacccaccaaggcctctcctcccccgtaaccaaatccttcaaccgcggcgaatgc

SEQ ID NO: 53801 - RNA, 1362 nt, synthetic construct
  misc_feature 1..1362: note = derived and/or modified sequence opt11 from Fletikumab_HeavyChain1
  source 1..1362: mol_type = other RNA
caagtacagctcgtccaatccggcgctgaagtcaaacgccccggcgccagcgtcaaagtctcgtgcaaagcctccggctacaccttcaccaatgacataattcactgggtacgacaagcccccggacaacgcctagaatggatgggctggatcaacgccggctacggcaacacacaatactcacaaaatttccaagaccgcgtctccatcacacgtgacacctccgcctccaccgcctacatggaattaatctcccttcgatccgaggataccgcagtttactactgcgcccgcgaacccctctggttcggcgaatcctccccacacgactactatggcatggatgtctggggccaaggaacaaccgtaaccgtctcatcagcctcaaccaaaggtccctccgtcttcccccttgccccctgcagccgatctacctccgaatccaccgctgccctaggatgcctcgtaaaagactacttccccgaacccgtcacagtctcctggaactcaggcgccctcacctccggcgtccacaccttcccagccgtcctccaatcctccggactctactccctctcctccgtcgtcacagtcccctcctcctcccttggcacaaaaacctatacctgcaacgtcgaccacaaaccaagcaacaccaaagtcgacaaacgcgtcgaatccaaatacggcccaccctgcccaccctgccccgcacccgaatttctaggcggcccctccgtcttcctcttcccacccaaacccaaagacacactcatgatcagccgcacacccgaagtcacatgcgtcgtagtcgacgtgtcccaagaagaccccgaagttcaattcaactggtacgtcgacggcgtcgaagtccacaacgcaaaaacaaaacccagagaagaacaattcaactccacataccgtgttgtttcagtcctcacagtactccaccaggactggctaaacggaaaggaatacaaatgcaaagtctccaacaagggcctcccctcttccatcgagaaaaccatctccaaggccaaaggtcaaccccgagaaccccaagtctacaccctcccacccagccaggaagaaatgaccaaaaaccaagtaagcctcacttgcctagtcaaaggattctacccctcagacatagccgtcgaatgggaatccaatggacaacccgaaaacaattacaagacaacaccacccgtactcgactccgacggcagcttctttctctactcacgcctcaccgtcgacaaatccaggtggcaggaaggcaacgttttcagctgctccgtcatgcacgaggccttacacaaccactacacccagaaatcactcagcctctccctcggaaaa

SEQ ID NO: 53802 - RNA, 642 nt, synthetic construct
  misc_feature 1..642: note = derived and/or modified sequence opt11 from Fletikumab_LightChain1
  source 1..642: mol_type = other RNA
gccatccaactaacccaatcaccctcatccctctccgccagcgtcggcgaccgcgtcaccataacctgccgcgcctcacaaggcatctcctccgccctagcctggtaccaacaaaaacccggcaaagcccccaagctcctcatctacgacgccagctccctcgaatccggagtcccctccagattctcaggctccggctcgggcaccgacttcaccctcaccatctcctcactccaacccgaagacttcgccacctactactgccaacaattcaactcataccccctcaccttcggaggcggcaccaaagtcgaaatcaaacgcacagtcgcagccccctccgtattcatcttcccaccctcagacgaacaactcaaatccggcacagcctccgtcgtctgcctactcaacaacttctacccccgcgaagccaaagtccaatggaaagtcgacaacgccctccaatccggcaactcacaagaatcagtcacagaacaagacagcaaagactcaacctactcactatcctcaaccctaacactatccaaagccgactacgaaaaacacaaagtctacgcctgcgaagtcacacaccaaggcctctcctcccccgtcaccaaatccttcaacagaggcgaatgc

SEQ ID NO: 53803 - RNA, 1341 nt, synthetic construct
  misc_feature 1..1341: note = derived and/or modified sequence opt11 from Fontolizumab_HeavyChain1
  source 1..1341: mol_type = other RNA
caagtccaactcgtccaatccggcgccgaactcaaaaagccaggctcctcagtcaaggtatcctgcaaagcctccggctacatcttcacctcttcttggataaactgggtcaaacaagcccccggccagggcctagaatggatagggagaatcgacccctccgacggcgaagtccactacaatcaagacttcaaagataaggccaccctaaccgtcgacaaatccaccaacacagcatacatggaactctcatcactcagatccgaagacactgccgtatactactgtgcccgcggcttcctcccctggttcgccgactggggccaaggcacgctagttaccgtctcctccgcctcaaccaaaggaccatccgtcttcccccttgcaccctccagcaaatcaaccagcggaggaacagcagccctcggctgcctagtcaaagactatttccccgaaccagtcaccgtatcctggaactcaggagccctaacctccggagtacacacattccccgcagtactccaatccagcggactctacagcctctcatcagtcgtcaccgtaccctcctctagcctcggcacccaaacctacatctgcaacgtcaaccacaaaccatcaaacaccaaagtcgacaagaaagtcgaacccaaatcctgcgacaaaacccatacctgcccaccctgcccagcccccgaactcctcggcggcccaagcgtcttcctattcccacccaaacccaaagacaccctcatgatatcccgaacccccgaagtaacctgcgtcgtcgtcgacgtctcccacgaagaccccgaagtaaaattcaactggtacgtcgacggagtcgaagtccacaacgcaaagaccaaaccaagagaagaacaatacaactccacctaccgagtcgtgagtgtcctcacagtcctccaccaagactggcttaacggcaaagaatacaaatgcaaagtctcaaacaaagccctccccgcaccaatcgaaaagaccatctccaaagccaaaggccaaccccgcgaaccccaagtctacaccctacccccgagcagggacgaactcaccaaaaaccaagtctctctcacctgtcttgtaaaagggttctatccctcggacatcgccgttgaatgggaatcgaacggccaaccagaaaacaactacaaaacaacccctcccgtcctagactccgacggctccttcttcctctactccaaactcactgtcgataaatctcgctggcaacaaggaaacgtattctcctgctccgtcatgcacgaagcactccacaaccactacacccaaaaatccctaagcctcagccccggcaaa

SEQ ID NO: 53804 - RNA, 642 nt, synthetic construct
  misc_feature 1..642: note = derived and/or modified sequence opt11 from Fontolizumab_LightChain1
  source 1..642: mol_type = other RNA
gacatccaaatgacccaaagcccctcgaccctctccgcctccgtcggcgaccgcgtcacaataacctgcaaagcctccgaaaacgtagacacctacgtctcctggtaccaacaaaaacccggcaaagcccccaaactcctcatctacggagcctccaaccgctacacaggcgtcccctcccgattctccggctccggatccggcaccgacttcacccttaccatctcctccctccaacccgacgacttcgccacctactactgcggacaatcctacaactaccctttcaccttcggccaaggaaccaaagtcgaagtcaaacgcaccgtcgccgccccctccgtcttcatcttcccaccctccgatgaacaactcaaatcaggcaccgcctccgtcgtctgcctcctcaacaacttctacccccgcgaagccaaagtccaatggaaagtcgacaacgccctccaaagcggcaactcccaagaatccgtaaccgaacaagactcaaaagactccacctactccctctcctccaccctaaccctctccaaagccgactatgaaaaacacaaagtctacgcctgcgaagtcacccaccaaggcctctcctccccagtcaccaaatcattcaaccgcggcgaatgc

SEQ ID NO: 53805 - RNA, 1344 nt, synthetic construct
  misc_feature 1..1344: note = derived and/or modified sequence opt11 from Foralumab_HeavyChain1
  source 1..1344: mol_type = other RNA
caggtacagctcgtagaaagcggcggcggcgtcgtacaacccggccgctccctcagactatcctgcgccgcctccggattcaaattcagcggctacggaatgcactgggtacgccaagcacccggaaaaggcctcgaatgggtcgccgtcatctggtacgacggctccaagaaatactacgtcgattccgtgaaaggccgattcacaatatcacgtgacaactccaaaaacaccctatacctccaaatgaactcactacgagcagaagacaccgccgtatactactgcgcccgacaaatgggctactggcacttcgacctctggggccgtggcaccctagtcaccgtaagctccgcctccaccaaaggcccctccgtcttccccctcgcaccatcctccaaatcgacctccggcggcaccgccgccctcggatgcctcgtaaaagattacttccccgaaccagtcaccgtctcctggaactccggtgccctcacctccggcgtgcacacattccctgcagtcctccaatcatctggcctctactccctctcttccgtcgtaaccgtcccatccagctccctcggcacccaaacctacatctgcaacgtcaaccacaaaccatccaacaccaaagtcgacaaacgcgtcgaacccaaatcctgcgacaaaacccacacatgcccaccatgccccgccccagaggccgaaggcggccccagcgtctttctcttccctcccaaacccaaagacaccctaatgatctccagaacccccgaagtcacctgtgtcgtcgtcgacgtctcccacgaagaccctgaagtaaaattcaactggtatgtggacggcgtcgaagtccacaacgccaaaaccaaacccagagaagaacaatacaactcaacctaccgcgtagtctcagtacttacagtcctccaccaagactggctcaacgggaaagaatacaaatgcaaagtaagcaacaaagccctccccgccccaatcgagaaaaccattagcaaagccaaaggacaaccccgcgaaccccaagtctacaccctacccccatcccgcgaagaaatgaccaaaaatcaagtctcgctaacctgcctcgtcaaaggcttttaccccagcgacatcgccgtagaatgggaatccaacggccaacccgaaaacaactacaaaaccaccccacccgtcctcgactccgacggcagcttcttcctctactccaaactcaccgtagataaatccagatggcaacaaggaaacgtcttctcatgctccgtaatgcacgaagccctacacaaccactacacacaaaaatcactctcactctcccccggcaaa

SEQ ID NO: 53806 - RNA, 645 nt, synthetic construct
  misc_feature 1..645: note = derived and/or modified sequence opt11 from Foralumab_LightChain1
  source 1..645: mol_type = other RNA
gaaatcgtcctcacacaatcccccgccaccctctccctctcccccggcgaacgcgccaccctctcatgccgagcctcccaatccgtctcctcctacctcgcctggtaccaacaaaaacccggccaagccccccgcctcctcatctacgacgcctccaaccgtgccaccggcatccccgcccgattctccggctccggctccggcaccgacttcaccctcacaatctcctccctcgaacccgaagacttcgccgtctactactgccaacaacgctccaactggccccccctcaccttcggcggcggcaccaaagtagaaatcaaacgcaccgtcgccgccccatccgtcttcatcttccccccctccgacgaacaactcaaatccggaaccgcctccgtcgtctgcctcctcaacaacttctacccacgcgaagccaaagtccaatggaaagtagacaacgccctccaatccggcaactcccaagaatcagtcaccgaacaagactcaaaagactccacctactccctctcatccaccctcaccctctctaaagccgactacgaaaaacacaaagtctacgcctgcgaagtcacccaccaaggactctcctcccccgtcactaaatccttcaaccgcggcgaatgc

SEQ ID NO: 53807 - RNA, 1344 nt, synthetic construct
  misc_feature 1..1344: note = derived and/or modified sequence opt11 from Foravirumab_HeavyChain1
  source 1..1344: mol_type = other RNA
caagtccagttagtcgaatccggcggaggcgccgtccaaccgggccgttcccttagactctcctgcgccgcctccggcttcaccttctccagctacggcatgcactgggtcagacaagcaccaggaaaaggactcgaatgggtcgccgtaatcctttacgacggctccgacaaattctacgccgactccgtcaaaggccgcttcaccatctcccgagacaactctaaaaacactctctacctccaaatgaactccctacgcgccgaggacactgcagtctactactgcgctaaagtcgccgtcgccggcacccatttcgactactggggccaaggcaccctcgtcacagtctcatccgcctccacgaaaggtccatccgtatttcccctcgccccctcatccaaatctacctccggcggtaccgccgccctcggctgccttgtcaaagactacttccccgaacccgtcaccgtatcctggaactccggagccctaacctccggcgtccacaccttccccgcagtcctccaatcctccggactctactccctctcctccgtagttaccgtcccatcctcctcacttggaacacaaacctatatctgcaacgtcaaccacaaacccagcaacaccaaagtagacaaacgcgttgagcccaaatcatgcgacaaaacccacacctgtccaccctgccccgcccccgaactcctcggcggcccatcagtattcctcttcccacccaaacccaaagacacactaatgatctcgcgcacccccgaggtaacctgcgtcgtcgtcgacgtctcacacgaagaccccgaagtcaaatttaactggtacgttgacggcgtagaagtccacaacgctaaaaccaaaccccgagaagaacaatacaactcaacctaccgcgtcgtatccgtactaaccgtccttcaccaagactggctcaatggcaaagaatacaaatgcaaagtctctaacaaagccctacccgcccccattgagaaaaccatctccaaagcaaaaggacaaccccgcgaaccccaagtctatacactaccaccctcccgagaagaaatgaccaaaaaccaagtctccttaacctgcctcgtcaaaggattctacccctccgacatcgccgtcgaatgggagagcaacggccaacccgaaaacaactacaaaaccacaccgcccgtactcgactcagacggctcattctttctatactccaaactaacagtagacaaatcacgatggcaacaaggcaacgtcttttcctgctcagtcatgcacgaagccctacacaaccactacacccaaaaatccctatccctctcccccggc

SEQ ID NO: 53808 - RNA, 1344 nt, synthetic construct
  misc_feature 1..1344: note = derived and/or modified sequence opt11 from Foravirumab_HeavyChain
  source 1..1344: mol_type = other RNA
gaagtacagctagttgaatccggcggaggagccgtccaacccggccgctccctcagactatcctgcgctgccagcggattcaccttcagctcatacggcatgcactgggtcagacaagcacccggcaaaggtctggaatgggtcgcagtcatcctatacgacggctccgacaaattctacgcagactccgtcaaaggacgattcaccatctcccgcgacaactccaaaaacaccctatacctccaaatgaactccctcagagcagaagacacagccgtatattactgcgccaaagtcgccgtcgccggaacacacttcgactactgggggcaaggcactctagtcaccgtctcttccgcctccaccaagggcccaagcgtcttccccctggcaccctcctccaaatccacatccggcggaacagcagcactgggctgcctagtcaaagactacttccccgaacctgtcaccgtcagctggaactcaggagcgctcacatccggcgttcacactttccctgccgtactacaatcctcaggcctctactccttatcatcagtcgtaactgtcccctcctcctcactaggcactcaaacatacatctgcaacgtcaaccacaagccctcaaacaccaaagtagacaaacgagtcgaacccaaatcctgcgacaaaacacacacatgcccgccctgccccgcccctgaactccttggaggccccagcgtcttcctcttcccacccaaacccaaagacacactaatgatctcccgtacccccgaagtaacctgcgtcgtggtagacgtcagccacgaagaccccgaagtcaaattcaactggtacgtcgacggggtagaagtccataacgccaaaacaaaaccccgcgaagaacaatacaactcaacctaccgagtcgtctcagtgctcacagtcctccaccaagactggctcaacggaaaagaatacaaatgcaaagtatccaacaaagccctacccgctcccatcgaaaagacaatatcaaaagccaaaggccaaccccgagaaccccaagtatacaccctccctccctcacgagaagaaatgaccaaaaaccaagtctcactcacttgcctcgtcaaaggattctacccctccgacatagcagtagaatgggaatccaacggccaaccagaaaacaactacaaaacaacccctcccgtcctcgactccgacggctccttcttcctctactcaaagctaaccgtcgacaaatccagatggcaacaaggcaacgtattctcatgctccgtaatgcacgaagccctccacaaccattacacccaaaagtccctctccctcagccccggc

SEQ ID NO: 53809 - RNA, 642 nt, synthetic construct
  misc_feature 1..642: note = derived and/or modified sequence opt11 from Foravirumab_LightChain1
  source 1..642: mol_type = other RNA
gacatccaaatgacccaatcaccctcctccctatccgcatccgtaggcgaccgcgtcaccataacctgccgcgcatcccaaggcatccgcaacgacctaggctggtaccaacaaaaacccggaaaagcccccaaactcctcatctacgccgcctcctccctccaatccggcgtaccctcccgcttctcaggctccggctccggaacagacttcaccctcaccatcagctcactccaacccgaagacttcgccacctactactgccaacaactcaactcatacccacccaccttcggcggcggcacaaaagtcgaaattaaacgtaccgtagccgcaccctccgtcttcatcttcccaccctccgacgaacaactcaaatccggcaccgcctcagtcgtctgcctactcaacaacttctacccccgcgaagccaaagtccaatggaaagtcgacaacgccctccaatccggaaactcccaagagagcgtcaccgaacaagactccaaagactcaacctactcactatcctccaccctaaccctatccaaagccgactacgaaaaacacaaagtctacgcatgcgaagtcacacaccaaggcctcagctcacccgtcaccaaatccttcaaccgcggcgaatgc

SEQ ID NO: 53810 - RNA, 1341 nt, synthetic construct
  misc_feature 1..1341: note = derived and/or modified sequence opt11 from Fresolimumab_HeavyChain1
  source 1..1341: mol_type = other RNA
caagttcaactcgtccaatcaggagccgaagtcaagaaacccggctcatccgtcaaagtttcttgcaaagccagcggatataccttctcctcaaacgtcatatcctgggtccggcaagcacccggtcaagggctcgaatggatgggcggcgttatacccatagtcgacatagcaaactacgcccaacgcttcaaaggaagagtcacaatcaccgccgacgaatccacctcgaccacctacatggaactctcctcactacgctccgaagacaccgccgtctactactgcgcctcaacactcggcctagtcctcgacgccatggactactggggccagggcactctcgtcaccgtatccagcgcatccacaaaaggacccagcgtcttccccctagcaccctgcagccgatcaacctccgagtctacagcagccctcggctgcctagtcaaagactacttcccagaaccagtcaccgtctcctggaactccggcgccctcacatccggcgtccacaccttcccagccgtcctccaaagttccggcctctactcactttccagcgtagtaacagttccctcctcatctctaggcaccaaaacctacacttgcaatgtcgatcacaaaccatccaacaccaaagtcgacaaacgcgtcgaatctaaatacggaccaccctgtccctcctgccccgccccagagttcctcggcggaccatcagtcttcctcttcccacccaaaccaaaagacaccctcatgatctcccgcaccccagaggtaacctgcgtcgtcgtcgacgtcagccaagaagacccagaagtccaattcaactggtacgtagacggagtcgaagttcacaacgcaaaaacaaaaccccgagaagaacaattcaactcaacataccgcgtggtctcagtcctcacagtcctccaccaagactggctcaacggcaaagaatacaaatgcaaagtctccaacaaaggcctaccctcctccatcgagaaaaccatatcaaaagccaaaggccaaccccgcgaaccacaagtctacacactcccaccctctcaagaagaaatgaccaaaaaccaagtgtcactcacatgcctcgtcaagggcttctacccctccgacatcgcagtcgaatgggaatccaacggccagcccgaaaacaactacaaaaccacacccccagtcctcgactcagacggatccttcttcctctattcccgcctaacagtagacaaatcccgctggcaggaagggaacgtcttctcctgctccgtaatgcatgaagccctacacaaccactacacccaaaaatccctatctctctcactcgggaaa

SEQ ID NO: 53811 - RNA, 645 nt, synthetic construct
  misc_feature 1..645: note = derived and/or modified sequence opt11 from Fresolimumab_LightChain1
  source 1..645: mol_type = other RNA
gaaacagtcctaacccaatcccccggcactctctccctctcccccggcgaacgcgcaactctctcttgccgcgcctcccaatccctcggctcctcctacctcgcctggtaccaacaaaaacccggacaagcaccccgtctcctcatctacggcgcctcctcccgcgcccctggcatccccgaccgattctccggctcaggctccggcaccgacttcaccctcaccatctcccgtctagaacccgaagacttcgccgtctactactgccaacaatacgccgactccccaatcaccttcggccaaggcacccgactcgaaatcaaacgcaccgtcgccgccccctccgtcttcatcttcccaccctccgacgaacaactcaaatccggcaccgcctccgtcgtctgcctcctcaacaacttctacccccgagaagccaaagtccaatggaaagtcgacaacgccctccaatccggcaactcccaagaatcagtcaccgaacaagactccaaagactcaacatactccctatcctcaaccctcaccctctccaaagccgactacgaaaaacacaaagtctacgcctgcgaagtcacacaccaaggcctctcatcccccgtcacaaaatccttcaaccgcggcgaatgc

SEQ ID NO: 53812 - RNA, 1347 nt, synthetic construct
  misc_feature 1..1347: note = derived and/or modified sequence opt11 from Fulranumab_HeavyChain1
  source 1..1347: mol_type = other RNA
gaagtacaactcgtcgaatccggaggcggcctagttcaacccggaggctccctaagactatcctgtgccgcgtccggcttcaccctcagatcctactccatgaactgggtccgccaagcccccggcaaaggcctcgaatgggtctcatatatctcccgatccagccacaccatcttctacgcagacagcgtaaaaggtcgcttcaccatctcccgagataacgcgaaaaactcactctaccttcaaatggactcacttcgagacgaagacaccgccatgtactactgcgcccgagtctactcatccggctggcacgtatccgactacttcgactattggggacaaggcatcctcgtcacagtctcatccgccagcaccaaaggaccaagcgtcttccccctagccccctgctcacgctccacatctgaatccaccgccgccctcggctgcctcgtcaaagactatttccccgaaccagtcaccgtctcatggaactccggcgccctaacctcaggcgtacataccttcccagccgtcctccaatcatccggactttactccctctcctccgtagtcacagtcccctcttccaacttcggaacacaaacctacacatgcaacgtcgaccacaaaccctccaacaccaaagtcgacaaaaccgttgaacgcaaatgctgcgtcgaatgcccaccctgcccagccccaccagttgccggcccctccgtattcctatttcccccgaagcccaaagacacactaatgatctctcgcacccccgaagtcacctgtgtcgtcgtcgacgtctcccacgaagacccagaagtccaattcaactggtacgtcgacggcgtcgaagtacacaacgcaaaaaccaaaccccgagaagaacaattcaactccacattccgagtagtctccgtcctaaccgtcgtccaccaagactggctcaacggaaaagaatacaaatgcaaagtctccaacaaaggactaccggccccaatcgagaaaaccatatccaaaacaaaaggccaaccccgcgaaccccaagtctacacactcccaccctcccgcgaggaaatgaccaaaaaccaggtgtcactcacatgcttagtcaaaggcttctacccctccgacatcgcagtcgaatgggaatcaaacggacaacccgaaaacaactacaaaacgacaccacccatgctcgacagcgacggatcattcttcctatactcgaaacttactgtcgacaaatcacgttggcaacaaggcaacgttttctcctgttccgtcatgcacgaagcccttcacaaccactacacacaaaaatccctctccctctcccccggcaaa

SEQ ID NO: 53813 - RNA, 642 nt, synthetic construct
  misc_feature 1..642: note = derived and/or modified sequence opt11 from Fulranumab_LightChain1
  source 1..642: mol_type = other RNA
gccatccaactaacacaatccccctcctccctatccgcctccgtcggcgaccgcgtaaccatcacatgccgcgcctcccaaggcatctcctccgccctcgcctggtaccaacaaaaacccggcaaagcccccaaactcctcatctacgacgcatcctcactcgaatccggcgtcccatctcgcttctccggatccggctcaggcaccgacttcacactaaccatctcctccctccaacccgaagacttcgccacctactactgccaacaattcaactcctacccactcaccttcggcggcggcaccaaagtcgaaatcaaacgcacagtcgccgccccctccgtattcatcttcccaccctcagacgaacaactcaaatcaggaacagcctcagtcgtctgcctacttaacaacttctacccccgcgaagccaaagtccaatggaaagtagacaacgccctccaatccggcaactcccaagaatccgtaaccgaacaagactctaaagactcaacctactcactctcttcaaccctcacactctccaaagccgactacgaaaaacacaaagtctacgcctgcgaagtcacacaccaaggcctctcctccccagtcaccaaatccttcaaccgcggcgaatgc

SEQ ID NO: 53814 - RNA, 1356 nt, synthetic construct
  misc_feature 1..1356: note = derived and/or modified sequence opt11 from Futuximab_HeavyChain1
  source 1..1356: mol_type = other RNA
gaggtacaactccaacaacccggctccgaactggtccgccccggcgcctccgtcaaactcagctgcaaagcctccggatacaccttcacctcctactggatgcactgggtaaaacaacgccccggccaaggcctcgaatggatcggcaacatataccccggctctcgcagcaccaactacgacgaaaaattcaagtctaaagcaaccctcaccgtcgacaccagctcatccaccgcatacatgcaactcagctcacttacctccgaagattcagccgtatactactgcacccgaaacggagactactacgtctcatccggcgacgccatggactactggggccaaggaacttccgtcaccgtatcctccgcatcaacaaagggcccatcagtattccccctcgcaccctcaagcaaatccacctcgggcggaaccgcagccctcggatgcctcgtaaaagattacttccccgaacccgtcaccgtctcctggaacagcggcgccctcacctccggcgtccacacattcccagccgtcctacaatcatcaggcctctactccctctcatccgtagtcaccgtaccatcctcttccctcggcacccaaacctacatatgcaacgtaaatcacaaaccatccaacacaaaggtcgacaaacgcgtagaaccaaaatcctgcgacaaaacccacacatgcccaccctgccccgcccccgagctactaggcggaccatccgtcttcctattcccacccaaacccaaagacaccctcatgatctcacgcacaccagaggtaacctgcgtcgtcgtcgatgttagccacgaagaccccgaagtcaaattcaactggtacgtcgacggcgtagaagtacacaacgccaaaaccaagccccgcgaggaacagtacaactcaacctaccgcgtagtctccgtcctcaccgtactccaccaagactggcttaacggcaaagaatacaaatgcaaagtatcaaacaaagccctcccagcacccatcgaaaagacgataagcaaagcgaaaggccaacccagagaaccccaggtctacactctaccaccctcccgcgaagaaatgaccaaaaaccaagtctccctaacctgcctcgtcaagggcttctacccctccgacatcgcagtcgaatgggaatcaaacggacaacccgaaaacaactacaaaacaacaccacccgtcctcgactccgacggatccttcttcctctactcaaagctcaccgtagacaaatcacgctggcaacaaggaaacgtcttctcatgctctgtcatgcacgaagccctccacaaccactacacccaaaaatccctctctctctcacccgga

SEQ ID NO: 53815 - RNA, 642 nt, synthetic construct
  misc_feature 1..642: note = derived and/or modified sequence opt11 from Futuximab_LightChain1
  source 1..642: mol_type = other RNA
gacatccaaatgacccaaaccacctcctcactctccgcctccctcggcgaccgcgtcaccatatcctgccgcacctcccaagacatcggcaattacctcaactggtaccaacaaaaacccgacggcaccgtcaaactcctcatctactacacctcccgcctccactccggcgtcccctcccgcttctcaggctccggctccggcaccgacttctccctaaccatcaacaacgtcgaacaagaagacgtcgccacatacttctgccaacactacaacacagtcccccccacattcggcggcggcaccaaactcgaaatcaaacgcaccgtcgccgccccctccgtcttcatcttccccccctccgacgaacaactaaaatccggcaccgcctccgtagtatgcctcctcaacaacttctacccccgcgaagccaaagtccaatggaaagtcgacaacgcccttcaatccggcaactcccaagaatccgtcaccgaacaagactccaaagactccacctactccctctcctccaccctcaccctctccaaagccgactacgaaaaacacaaagtatacgcatgcgaagtaacccaccaaggcctctcctcccccgtcaccaaatccttcaaccgcggtgaatgc

SEQ ID NO: 53816 - RNA, 1335 nt, synthetic construct
  misc_feature 1..1335: note = derived and/or modified sequence opt11 from Galcanezumab_HeavyChain1
  source 1..1335: mol_type = other RNA
caggtccaactcgtacaatcaggcgcagaagtaaagaaacccggtagctcagtcaaagtctcctgcaaagcctcaggctacaccttcggcaactactggatgcaatgggtccgccaagcccccggccagggactcgaatggatgggcgccatctatgaaggcacgggcaaaaccgtctacatccaaaaattcgccgaccgcgtcacaatcaccgcagacaaatcgacctccaccgcctacatggaactcagctcactcagatccgaagacacagccgtctactattgcgcgcgcctcagcgattacgtatccggtttcggttactggggacagggcaccaccgtgaccgtatcctcggcttcaacaaaaggccccagcgtattccccctcgccccctgcagccgatccacatcagaatccaccgccgcactaggatgcctagtcaaagactacttcccagaaccagtcaccgtatcatggaacagcggagccctaacctcaggcgtacacaccttccccgcagtcctacaatcctccggcctctactccctctcatccgtcgtcacagtcccaagctcctccttgggcacgaaaacgtatacctgcaacgtcgaccacaaaccctccaacacgaaagtggacaaacgcgtagaatccaaatacggcccgccctgcccaccctgccccgcccccgaagcagccggaggccccagcgtattcctcttcccacccaagccaaaggacaccctcatgatatcccgaacgcccgaagtaacctgcgtagtcgtggacgtgtcccaagaagaccccgaagtacaattcaattggtacgtcgacggcgtcgaagtccacaacgccaaaacaaaaccccgcgaagaacaattcaactcaacctaccgcgtggtctcagtcctgaccgtactccaccaagactggctaaacggaaaagaatacaaatgcaaagtctccaacaaaggcctaccctccagcatcgaaaagaccatctcaaaagccaaaggccaaccacgagaaccccaagtatacacgctcccgccctctcaagaagaaatgaccaaaaaccaagtctcactcacatgcctagtcaaaggcttctaccccagcgacatcgccgtcgaatgggaatccaacggccagcccgaaaacaactacaaaaccacaccacccgtcctagactccgacggctccttcttcctctattcacgcctcaccgtggacaaaagccggtggcaggaaggcaacgtattttcctgctccgtaatgcacgaagcactccacaaccactacacccagaaatcactatccctatcgctcggc

SEQ ID NO: 53817 - RNA, 642 nt, synthetic construct
  misc_feature 1..642: note = derived and/or modified sequence opt11 from Galcanezumab_LightChain1
  source 1..642: mol_type = other RNA
gacatccaaatgacccaatccccctcaagcctctccgcctccgtcggcgaccgagtcaccatcacctgccgcgcctccaaagacatctccaaatacctcaactggtaccaacaaaaacccggcaaagcccccaaactcctcatctactacacctccggctaccactccggcgtcccctcccgattctccggctccggctccggcaccgacttcaccctaaccatctcctccctacaacccgaagacttcgccacctactactgccaacaaggcgacgccctcccacccactttcggcggcggaaccaaagtcgaaatcaaacgaaccgtcgccgccccctccgtcttcatattccccccctccgacgaacaactcaaatccggcaccgcctccgtcgtctgcctcctcaacaacttctacccccgtgaagccaaagtccaatggaaagtcgacaacgccctccaatccggaaactcacaagaatccgtcacagaacaagactctaaagactccacctactcactctcctccaccctcaccctctccaaagccgactacgaaaaacacaaagtctacgcctgcgaagtcacccaccaaggcctatcctcacccgtcaccaaatccttcaaccgcggcgaatgc

SEQ ID NO: 53818 - RNA, 1371 nt, synthetic construct
  misc_feature 1..1371: note = derived and/or modified sequence opt11 from Galiximab_HeavyChain1
  source 1..1371: mol_type = other RNA
caagtccaactccaagaaagcggacccggcctagtcaagccctccgaaaccctctctctaacctgcgccgtctcgggcggatccatctctggcggctacggctggggctggataagacaaccacccggcaaaggactcgaatggataggatctttctactcatcttccggtaacacctactacaacccctctctcaaatcccaagtcacaatctccacagacacctccaagaaccagttctccctcaaactcaactccatgaccgccgcagacaccgcagtctactactgcgtccgagaccgcctattcagcgtagtcggcatggtctacaacaactggtttgacgtatggggccccggcgtcctagtcactgtctcctccgcctccaccaaagggccctctgtcttccccctagccccctcgagcaaaagcacctccggcggcaccgcagccctcggctgcctagtcaaagactacttccccgaacccgtcaccgtatcttggaactccggggccctcacaagtggcgtccacaccttccccgccgtactacaatcctccggcctctactcactctcctccgtcgtaacagtcccctcctcatcactaggtacccaaacatacatttgcaacgttaaccacaaaccctccaacaccaaagtcgacaagaaagccgaacccaaatcctgtgacaaaacccacacctgtccaccctgccccgcccccgaactcctcggcggcccttccgtcttcctcttcccaccaaaacccaaagacaccctaatgatctcccgcacccccgaagttacctgcgtcgtcgtcgacgtctcccacgaagacccagaagtcaaattcaactggtacgtagacggagtcgaagtccacaacgccaaaaccaaaccccgcgaagaacaatacaactctacctaccgagtcgtctcagtactcaccgtcctccaccaagactggctcaacggcaaagaatacaaatgcaaagtctctaataaagccctcccagccccgattgagaaaacaatctcaaaagccaaaggccaaccacgcgaaccccaagtatacaccctacccccatcccgcgatgaactcaccaaaaaccaagtctccctgacctgcctcgtcaaaggcttctaccccagcgatatagcagtcgaatgggaatccaacggtcaacccgaaaacaactataaaacaactccacccgtcctcgactccgacggcagctttttcctctactccaaactcaccgtcgacaaatccagatggcaacaaggcaacgtcttcagctgctcagtcatgcacgaagcccttcacaaccactacacacaaaaatcactctctctcagccccggcaaa

SEQ ID NO: 53819 - RNA, 648 nt, synthetic construct
  misc_feature 1..648: note = derived and/or modified sequence opt11 from Galiximab_LightChain1
  source 1..648: mol_type = other RNA
gaatcagccctcacccaacccccaagcgtctccggcgcccccggccaaaaagtcaccatctcctgcaccggctccacctcaaacatcggcggctacgacctccactggtaccaacaactccccggcaccgcacccaaactcctcatctacgacatcaacaaacgcccctccggaatctccgaccgcttctccggctccaaatccggcacagccgcctccctcgccatcaccggcctacaaaccgaagacgaagccgactactactgccaatcctacgactcatccctaaacgcccaagtcttcggcggaggaacccgcctaaccgtcctcggccaacccaaagccgcccccaccgtcaccctcttccccccctcctccgaagaactacaagccaacaaagccaccctcgtctgccttatctccgacttctacccaggcgccgtcaccgtcgcctggaaagccgactcctcccccgtcaaagccggcgtagaaaccaccaccccctccaaacaatccaacaacaaatacgcagcctcctcctacctctcactaacccccgaacaatggaaatcccaccgctcctactcctgccaagtcacacacgaaggctccacagtcgaaaaaaccgtcgcccccacagaatgctcc

SEQ ID NO: 53820 - RNA, 1347 nt, synthetic construct
  misc_feature 1..1347: note = derived and/or modified sequence opt11 from Ganitumab_HeavyChain1
  source 1..1347: mol_type = other RNA
caggtacaactacaagaatccggccccggtctcgttaaaccatccggcaccctatcacttacctgcgccgtctccggtggatccatctcatccagcaactggtggagctgggtcagacaacctcccggcaaaggcctcgaatggatcggcgaaatctaccacagcggatcgaccaactacaacccctccctcaaaagccgcgtcaccatatccgtagacaaatccaaaaaccaattctctctcaaactctcatctgtcacagccgccgacaccgccgtctactactgcgcccgctggaccggccgaaccgatgccttcgacatatggggacaaggcaccatggtaacagtctcctccgcatccaccaaaggaccatccgtattccccctcgccccatcatccaaaagcaccagcggaggcaccgccgcactcggctgcctcgtgaaagactacttcccagaacccgtaaccgtctcatggaactccggagcccttacatccggcgtacacaccttccctgccgtcctccaaagctccggcctctactcactctcatcagtcgtcaccgtcccctcttcctccctcggaacccaaacttacatctgcaacgtcaaccacaaacccagcaacaccaaagtcgacaaaaaggtcgaacccaaaagctgcgacaaaacccacacatgcccaccctgccccgcacccgaactgctcggaggcccgtcagtattcctattcccacccaaacccaaagacaccctcatgatctcacgaacccccgaagttacatgcgtagtggtcgacgtctcccacgaagacccagaagtaaaattcaactggtatgtcgacggcgtagaagtacacaacgcaaaaaccaaaccccgagaagaacaatacaattccacataccgagtcgtgtcagtcctcaccgtcctacaccaagactggctgaacggaaaagaatacaaatgcaaagtctccaacaaagccctacccgccccaatagagaaaacaatcagcaaagccaaaggtcaaccccgagaaccccaagtatacaccctcccaccctcacgagacgaactcaccaaaaaccaagtctcactaacctgccttgtaaaaggcttctacccttccgacatcgccgtagaatgggaatccaatggccaacccgaaaacaactacaaaaccacaccccctgtactcgactcagacggatccttcttcctttactcaaaactcaccgtcgacaaatcccgctggcaacagggaaacgtcttctcctgcagcgtcatgcacgaagccctccacaaccactacacccaaaaatccctaagcctatcaccaggcaaa

SEQ ID NO: 53821 - RNA, 657 nt, synthetic construct
  misc_feature 1..657: note = derived and/or modified sequence opt11 from Ganitumab_LightChain1
  source 1..657: mol_type = other RNA
gacgtagtcatgacccaatctcccctctccctcccagtcacccccggcgaacccgcctccatctcctgccgatcctcccaatccctactccactccaacggctacaactacctcgactggtacctccaaaaacccggccaatcaccccaactcctcatctacctcggctccaaccgcgcatccggcgtccccgaccgcttctccggctccggctccggcaccgacttcaccctcaaaatctcccgagtagaagccgaagacgtcggcgtctactactgcatgcaaggcacccactggcccctcaccttcggccaaggcaccaaagtcgaaatcaaacgcaccgtcgccgccccctccgtcttcatcttcccaccctctgacgaacaactcaaatccggcaccgcatccgtcgtctgcctcctcaacaacttctacccacgcgaagccaaagtacaatggaaagtcgacaacgccctccaatcaggcaactcccaagaatccgtcaccgaacaagactccaaagactccacatactccctctcctcaaccctcaccctatcaaaagccgactacgaaaaacacaaagtctacgcctgcgaagtcacccaccaaggcctctcatccccagtcaccaaatccttcaaccgcggagaatgc

SEQ ID NO: 53822 - RNA, 1368 nt, synthetic construct
  misc_feature 1..1368: note = derived and/or modified sequence opt11 from Gantenerumab_HeavyChain1
  source 1..1368: mol_type = other RNA
caagtcgaactcgtcgaatccggcggaggccttgtccaaccaggcggctctctacgcctctcctgtgccgcctccggcttcaccttctcctcatacgccatgtcatgggtacgccaagcccccggcaaaggactcgaatgggtatcagctatcaacgcgtccggcacccgcacctactacgcagattctgtcaaaggcagattcaccatatcccgcgacaacagcaaaaacaccctatacctacaaatgaactcactccgcgccgaagacaccgccgtctactactgcgcgcgcggcaaaggaaacactcacaaaccatacggttatgtccgctacttcgacgtttggggccaaggtaccctcgtcacagtctcctccgcctcaaccaaaggcccatccgtcttcccacttgcaccctcctcaaaatccacctccggcggaaccgccgcactcggatgcctcgtcaaagactacttccccgaacccgtcaccgtctcgtggaactccggagcactaacctccggcgtccacacattcccagccgtcctccaatcatcgggcctctactcactcagctccgtcgtcaccgtccccagctcctccctaggcacccaaacctacatctgcaacgtcaatcacaaacctagcaacacaaaagtagacaaaaaggtagagccaaaaagctgcgacaaaacccacacatgcccaccctgccccgcaccagaactcctcggcggcccaagcgtcttcctctttcctcccaaaccaaaagacaccctcatgatctcccgcacacctgaagtaacctgcgtagtcgtcgacgtatcccacgaagacccagaagtaaagtttaactggtacgtcgacggcgtagaagtacacaacgcaaaaaccaaaccccgcgaagaacaatacaactcaacataccgcgtcgtctccgtcctcacagtcctacaccaagactggctcaacggcaaagaatacaaatgcaaagtctccaacaaagctctacccgcccccatagagaaaaccatctccaaagccaagggccaacctcgagaaccacaagtatacaccctcccaccctcccgagacgaactaacgaaaaaccaagtctctctaacctgcctagtcaaaggcttctacccctccgacatcgcagtcgaatgggaatccaacggccaacccgaaaacaactacaaaacaacccctccagtcctagactcagacggatcatttttcctctactcaaaactcaccgtggacaaatcccgctggcagcaaggcaacgtcttcagctgctccgtcatgcacgaagccctacacaaccactacacccaaaaatcactctccctctcaccaggcaaa

SEQ ID NO: 53823 - RNA, 645 nt, synthetic construct
  misc_feature 1..645: note = derived and/or modified sequence opt11 from Gantenerumab_LightChain1
  source 1..645: mol_type = other RNA
gatatcgtcctcacccaatcccccgccaccctctccctctcacccggcgaacgcgcaacactatcctgccgcgcatcccaatcagtctcatcctcatacctcgcatggtaccaacaaaaacccggccaagcaccccgcctcctcatatacggcgcctcatcccgcgccacaggcgtccccgcccgattctccggctccggctccggcacagacttcaccctcaccatatcctccctcgaacccgaagacttcgccacctactactgcctccaaatatacaacatgcccatcaccttcggacaaggcacaaaagtcgaaatcaaacgcaccgtcgccgccccctcagtcttcattttccctccctccgacgaacaactcaaatcaggtaccgcctccgtcgtctgcctcctcaacaacttctacccccgcgaagcaaaagtccaatggaaagtcgacaacgccctccaatccggcaactcccaagaatccgtcaccgaacaagactccaaagactcaacatactccctctcctccaccctcaccctctcaaaagccgactacgaaaaacacaaagtatacgcctgcgaagtcacccaccaaggcctttcctcccccgtcacaaaatccttcaaccgaggcgaatgc

SEQ ID NO: 53824 - RNA, 348 nt, synthetic construct
  misc_feature 1..348: note = derived and/or modified sequence opt11 from Gemtuzumab_HeavyChain1
  source 1..348: mol_type = other RNA
caagtccaactccaacaatccggcgccgaactagccaaacccggcgcctccgtcaaaatgtcctgcaaagcctccggctacacattcacctcctaccgcatgcactgggtcaaacaacgcccaggccaaggcctcgaatggatcggctacatcaacccctccaccggctacaccgaatacaaccaaaaattcaaagacaaagccaccctaaccgccgacaaatcctcctccaccgcctacatgcaactctcctccctcaccttcgaagactccgccgtctactactgcgcccgcggcggcggagtcttcgactactggggccaaggcaccaccctaaccgtctcctcc

SEQ ID NO: 53825 - RNA, 351 nt, synthetic construct
  misc_feature 1..351: note = derived and/or modified sequence opt11 from Gemtuzumab_HeavyChain2
  source 1..351: mol_type = other RNA
caagtccaactcgtccaatccggcgccgaagtcaaaaaacccggctcctccgtcaaagtctcctgcaaagcctccggcggcaccttctcccgctccgccatcatctgggtccgccaagcccccggccaaggcctcgaatggatgggcggcatcgtccccatgttcggcccccccaactacgcccaaaaattccaaggccgcgtcaccatcaccgcagacgaatccaccaacaccgcctacatggaactctcctccctccgctctgaagacaccgccttctacttctgcgccggcggctacggcatctactcccccgaagaatacaacggcggcctagtcaccgtctcctcc

SEQ ID NO: 53826 - RNA, 321 nt, synthetic construct
  misc_feature 1..321: note = derived and/or modified sequence opt11 from Gemtuzumab_LightChain2
  source 1..321: mol_type = other RNA
gacatccaaatgacccaatccccctccaccctatccgcctccgtcggcgaccgcgtcaccatcacctgccgcgcctcccaatccatcaacacctggctcgcctggtaccaacaaaaaccaggcaaagcccccaaactcctcatgtacaaagcctcctccctcgaatccggcgtcccctcccgattcatcggctccggctccggcaccgaattcaccctcaccatctcctccctccaacccgacgacttcgccacctactactgccaacaatacaactccgactccaaaatgttcggccaaggcaccaaagtcgaagtcaaa

SEQ ID NO: 53827 - RNA, 318 nt, synthetic construct
  misc_feature 1..318: note = derived and/or modified sequence opt11 from Gemtuzumab_ozogamicin_LightChain1
  source 1..318: mol_type = other RNA
caaatcgtcctcacccaatcccccgccatcatgtccgcctcccccggcgaaaaagtcaccatcacctgctcagcctcctcctccatctcctacatgcactggttccaacaaaaacccggcacctcccccaaactatggatctacaccacctccaacctcgcctccggcgtccccgcccgcttctccggctccggctccggcacctcctactccctcaccatctcccgcatggaagccgaagacgccgccacctactactgccaccaacgctccacctaccccctcaccttcggctccggcaccaaactcgaactcaaa

SEQ ID NO: 53828 - RNA, 1335 nt, synthetic construct
  misc_feature 1..1335: note = derived and/or modified sequence opt11 from Gevokizumab_HeavyChain1
  source 1..1335: mol_type = other RNA
caagttcaactccaagaatctggccccggactcgtaaaaccctcccaaacacttagccttacctgcagcttctccggcttctccctctcaacatccggaatgggcgtcggctggatccgccaaccatcaggcaagggcctcgagtggctcgcacacatctggtgggacggcgacgaaagctacaacccatccctcaaatcacgcctcaccatatcaaaagacactagcaaaaaccaagtttccctcaaaatcacctctgtaaccgcagccgacactgcagtctacttctgcgcccgtaaccggtacgacccaccctggttcgtcgactggggccaaggcactctagtcaccgtctcatccgccagtaccaaaggaccatccgtcttcccgctagccccctgctcccgttcaacctccgaatcaacagccgccctaggctgcctagtaaaagactacttccccgaaccagtaaccgtctcatggaactccggcgcactcacctccggagtccacaccttccccgccgtcctccaatcatccggcctctactccctatcctccgtcgtcaccgtaacctcatcaaacttcggcacccaaacctacacatgcaacgtcgaccacaaaccctcaaacaccaaagtcgacaaaaccgtcgaacgcaaatgctgcgtagaatgtcccccatgcccagcacccccagtcgccggaccatcagtatttctcttcccacccaagcccaaagatacacttatgatctcccgcacacccgaagtgacctgcgtcgttgtcgacgtcagccacgaagatccagaagtccaattcaactggtacgttgacggcatggaagtccataatgccaaaaccaaaccccgcgaagaacaattcaactccacattccgtgtcgtgtcagtcctcaccgtcgttcaccaagactggctcaacggcaaagaatacaaatgcaaagtctcgaataaaggcctcccagcacccatcgagaaaacaatatccaaaacaaaaggccaaccccgcgaaccacaagtctacacactcccaccctcccgagaagaaatgaccaaaaaccaagtctcactaacctgcctcgtcaaaggcttctacccctccgacatagccgtagaatgggaatccaacggccaacccgagaacaactacaaaacaaccccaccaatgctcgacagcgacggatccttcttcctctactccaaactcaccgtcgacaaatccagatggcaacaaggcaacgtcttctcatgctcagtcatgcacgaagccctacacaaccactacacccaaaaatccctctccctctcacctgga

SEQ ID NO: 53829 - RNA, 642 nt, synthetic construct
  misc_feature 1..642: note = derived and/or modified sequence opt11 from Gevokizumab_LightChain1
  source 1..642: mol_type = other RNA
gacatccaaatgacacaatccacctcctcactctccgcatccgtcggcgaccgcgtcaccatcacatgccgcgcctcccaagacatctccaactacttatcatggtaccaacaaaaacccggcaaagccgtcaaactcctcatctactacacctccaaactccactccggagtcccctcccgcttctccggctcaggctccggcaccgactacaccctcaccatctcctccctccaacaagaagacttcgccacatacttctgcctccaaggcaaaatgctcccctggaccttcggccaaggcaccaaactcgaaatcaaacgcaccgtcgccgccccctcagtcttcatcttcccaccctctgacgaacaactaaaatccggcaccgcctccgtcgtctgccttctcaacaacttctacccccgcgaagccaaagtccaatggaaagtcgacaacgccctccaatccggcaactcccaagaatccgtaaccgaacaagactccaaagactccacctactccctctcctccaccctaaccctctccaaagccgactacgaaaaacacaaagtctacgcctgcgaagtcacccaccaaggcctctcctccccagtcaccaaatccttcaacagaggcgaatgt

SEQ ID NO: 53830 - RNA, 1347 nt, synthetic construct
  misc_feature 1..1347: note = derived and/or modified sequence opt11 from Girentuximab_HeavyChain1
  source 1..1347: mol_type = other RNA
gacgtcaaacttgtcgaatccggcggcggcctagtaaaacttggcggcagcctcaaactttcctgtgccgcatcaggattcaccttcagcaactattacatgtcctgggtacgtcagaccccagaaaaacgactcgaactcgtcgccgccataaactcggacggaggcatcacctactacctcgacacagtcaaaggacgtttcaccatatcccgcgataacgccaaaaacaccctctacctacaaatgtccagcctcaaatccgaagacaccgcactcttttactgcgcccgccaccgctccggctacttctccatggactactggggacaaggcacctccgtaaccgttagctcagcctccactaaaggcccctcagtcttccccctcgcccccagcagtaaatccaccagcggtggcaccgccgcgctgggatgcctcgtcaaagactacttccccgaaccagtcaccgtatcctggaactccggcgctctaacctccggcgtccacacattccccgccgtcctgcaaagcagcggcctatactccctctcgtccgtcgtgaccgtcccctcctcctccctaggcacccaaacttacatctgcaacgtcaatcacaaacccagcaacactaaagtcgacaagaaagtcgaaccaaaatcctgcgacaaaacacacacttgcccaccctgcccagccccagaactactcggaggcccatccgtcttcctattcccacccaaacccaaagacacccttatgatctcccgtacccccgaagtcacatgcgtcgtagtagacgtttcccacgaagacccagaagtcaaattcaactggtacgtcgatggtgtagaagtacacaacgccaaaaccaaaccacgggaagaacaatacaattcaacataccgagtcgtctcagtcctcaccgtactccaccaagactggctcaacggcaaagaatacaaatgcaaagtctccaacaaagcactccccgcacccatcgaaaagaccatatccaaagcgaaaggccaaccacgagaaccccaagtctacaccctcccaccctcacgggacgaactcaccaaaaaccaagtctcactgacctgcctcgtcaaaggcttctacccctccgacatcgccgtcgaatgggaatccaacggccaacccgaaaacaactacaaaaccacaccacccgtcctcgactccgacggcagcttcttcctctacagcaaactcaccgtcgacaaaagccgctggcaacaaggcaacgttttctcttgcagcgtaatgcacgaagcactccataaccactacacacaaaaatcactctctctctcacccggaaaa

SEQ ID NO: 53831 - RNA, 642 nt, synthetic construct
  misc_feature 1..642: note = derived and/or modified sequence opt11 from Girentuximab_LightChain1
  source 1..642: mol_type = other RNA
gacatcgtaatgacccaatcacaaagattcatgtccacaaccgtcggcgaccgcgtgagcataacctgcaaagcaagccaaaacgtagtctcagccgtcgcctggtaccaacaaaaacccggacaatcgcccaaactcctaatctacagcgccagcaaccgctacaccggagtcccagaccgattcaccggctcaggctcgggcacagacttcaccctaaccataagcaacatgcaaagcgaagacctcgccgacttcttctgccaacaatacagcaactacccatggacattcggaggcggaaccaaactcgaaatcaaacgcacagtcgccgcccccagcgtattcatattcccgccatcggacgaacaactcaaatccggcacagcctcagtcgtatgcctactcaacaacttctacccgcgcgaagccaaagtccaatggaaagtcgacaacgccctccaaagcggaaactcacaagaaagcgtaaccgaacaagacagcaaagactccacctacagcctcagctcaaccctgacactcagcaaagccgactacgaaaaacacaaagtatacgcctgcgaagtcacccaccaaggcctaagctcacccgtcaccaagagcttcaaccgaggcgaatgc

SEQ ID NO: 53832 - RNA, 1335 nt, synthetic construct
  misc_feature 1..1335: note = derived and/or modified sequence opt11 from Glembatumumab_HeavyChain1
  source 1..1335: mol_type = other RNA
caggtccaactccaagaatccggccccggcctcgtaaaaccctcccagaccctttccctaacctgtacagtctcaggcggatcgatctcctccttcaactactactggtcctggatccgccaccaccccggcaaaggtctcgaatggattggctacatatactactcaggttctacctactcaaacccctccttaaaatcgcgcgtcaccatatcagtcgacacatctaaaaaccaattctccctgaccctcagctccgtaacagccgcagacaccgccgtctactactgcgcccgtggctacaactggaactacttcgactactggggacaaggcaccctcgtaaccgtctcctcagcctcaaccaaaggcccctccgttttccccctagctccatgctcacgctccacatctgaatccaccgccgctctcggctgcctagtcaaagactacttccccgaacccgtcaccgtatcatggaactccggcgccctcacttcaggagtacacaccttccccgccgtcctacaatcttccggtctatactcactctcatccgtcgtcaccgttccctccagcaacttcggcacacaaacctatacctgcaacgtcgaccacaaaccctctaacaccaaagtcgacaaaacagtcgaacgcaaatgctgcgtcgaatgcccaccctgccccgccccaccagtcgccggaccatccgtcttcctatttcccccaaaaccaaaagacaccctcatgatcagccgtacccccgaagttacctgcgtcgtcgtagacgtctcccacgaagaccctgaagtccaattcaactggtacgtagacggcgtagaagtccacaacgccaaaacaaagccccgcgaagaacaattcaactccaccttccgcgtcgtctctgttctaaccgtagtccaccaagattggctaaacggaaaagaatacaaatgcaaagtatccaacaagggcctacccgcacccatagagaaaaccatctcaaaaaccaaaggccaaccccgtgaacctcaagtctacaccctgccgccctcccgagaagaaatgaccaaaaaccaagtctccctaacctgcctcgttaaaggcttctacccctccgacatagccgtcgaatgggaatccaacggccaacccgaaaacaactacaaaacaaccccacccatgcttgactccgacggctccttcttcctctactccaaactcaccgtcgacaaatcccgctggcaacaaggaaacgtcttctcatgctcagtcatgcacgaagcacttcataaccattacacccaaaaatccctcagcctatcccccggcaaa

SEQ ID NO: 53833 - RNA, 645 nt, synthetic construct
  misc_feature 1..645: note = derived and/or modified sequence opt11 from Glembatumumab_LightChain1
  source 1..645: mol_type = other RNA
gaaatcgtcatgacccaatcccccgccaccctctcagtctcccccggcgaacgagccacactctcctgtcgcgcctcccaatccgtcgacaacaacctcgtctggtaccaacaaaaacccggccaagccccccgcctactaatctacggcgcctcaacccgcgccaccggcatccccgcccgcttctccggctccggctccggcaccgaattcaccctcaccatctcctccctacaatccgaagacttcgccgtctactactgccaacaatacaacaactggcccccatggaccttcggccaaggaactaaagtcgaaatcaaacgcaccgtcgcagccccctccgtcttcatcttccccccctctgacgaacaactcaaatccggcaccgcctccgtcgtctgcctcctcaacaacttctacccccgcgaagccaaagtccaatggaaagtcgacaacgcactccaatccggcaactcccaagaatccgtcaccgaacaagactcaaaagactcaacatactccctcagctccaccctcaccctctccaaagccgactacgaaaaacacaaagtctacgcctgcgaagtcacccaccaaggcctctcctcccccgtcaccaaatccttcaaccgaggcgaatgc

SEQ ID NO: 53834 - RNA, 1332 nt, synthetic construct
  misc_feature 1..1332: note = derived and/or modified sequence opt11 from Goilixiab_HeavyChain1
  source 1..1332: mol_type = other RNA
gaagtccaactcgtagaatccggcggcggcctagcaaagcccggaggctcactacgactctcctgcgccgcctccggcttccgattcaccttcaacaactactacgactgggtacgccaggcccccggccaaggccttgaatgggtctcccgcatctcatcatctggcgaccccacatggtacgcagactccgtaaaaggacgattcaccatctctcgtgaaaacgccaaaaacacactcttcctccaaaactcactccgtgcagaggatacagccgtctactactgcgcctccctcaccaccggctccgactcctggggacagggcgtcctcgtcacagtttcctccgcctccaccaaaggcccctccgtattccccctcgccccctcctcaaaatccacctcaggcggcaccgccgccctcggctgcctcgtcaaagactacttccccgaacctgtcactgtctcctggaactcaggcgcactaacctcaggagtgcacaccttccctgccgtactccagtcctcaggtctctactcactctcctccgtcgttaccgtaccatcctcctccctcggtacccaaacctacatatgcaacgtcaaccacaaaccctcaaacactaaagtcgacaagaaagtcgaacccaaatcctgcgacaaaacccacacatgcccaccctgccccgcccctgaactactcggcggcccctccgtcttcctctttcccccgaaaccgaaagacacactaatctcccgcacacccgaagtaacctgcgtcgtcgtagacgtcagccacgaagaccccgaagtcaaattcaactggtacgtagacggcgtcgaagtccacaacgccaaaaccaaaccacgagaagaacaatacaattcaacataccgtgtcgtctccgttctcaccgtcttacaccaagactggctcaacgggaaagaatacaaatgcaaagtttcaaacaaagccctccccgcccccatcgaaaagacaatctccaaggccaagggccaaccccgtgaaccccaagtctacaccctcccaccttcccgtgacgaactcaccaaaaaccaagtctcactaacctgcctggtcaaaggcttctacccttctgacatagctgtcgaatgggaatccaacggccaacccgaaaacaactacaaaaccaccccacccgtcctcgactcggacggatccttcttcttatactccaaactcacggtcgacaaatcccgctggcaacaaggcaatgtcttctcctgctccgtccacgaagccctccacaaccactacactcaaaaatccctctcactatcccccggcaaa

SEQ ID NO: 53835 - RNA, 639 nt, synthetic construct
  misc_feature 1..639: note = derived and/or modified sequence opt11 from Goilixiab_LightChain1
  source 1..639: mol_type = other RNA
gacatccaaacccaatcaccctcctccctctccgcctccgtaggtgaccgcgtcaccatcacctgccgcgcctcccaagacatccgctactacctcaactggtaccaacaaaaacccggcaaagcacccaaactcctaatctacgtcgcctcctcactccaatccggcgtacccagccgcttctcaggctcaggctccggcaccgaattcaccctaaccgtctcctcactccaacccgaagacttcgccacctactactgcctccaagtctactcaaccccccgcaccttcggccaaggcaccaaagtcgaaatcaaacgcaccgtcgccgccccctccgtcttcatattccccccctccgacgaacaactaaaatccggcacagcctccgtcgtatgcctcctcaacaacttctacccccgcgaagccaaagtccaatggaaagtcgacaacgccctccaatccggcaactcacaagaatccgtgaccgaacaagactccaaagactccacctactccctatcctcaaccctcaccctctccaaagccgactacgaaaaacacaaagtatacgcatgcgaagtcacccaccaaggcctatcctcccccgtcaccaaatccttcaaccgcggcgaatgc

SEQ ID NO: 53836 - RNA, 1338 nt, synthetic construct
  misc_feature 1..1338: note = derived and/or modified sequence opt11 from Guselkumab_HeavyChain1
  source 1..1338: mol_type = other RNA
gaagtccaactcgtccaatcaggcgcggaagtcaagaaacccggcgaatcactcaaaatctcatgcaaaggctctggctactccttctccaactactggatcggctgggtacgccaaatgccaggcaaaggcctagaatggatgggaataatagaccccagcaactcctacacacgctactcaccctccttccaaggccaagtcaccatctccgccgacaaaagcatatccaccgcctacctccaatggtcctccctaaaagcatcagacaccgccatgtactactgtgcccgctggtactacaaacccttcgacgtctggggacaaggaacccttgtcaccgtctcaagcgcctccaccaaaggcccctcagtcttccccctcgcgccatcatcaaaatccacctccggcggcaccgcagcactcggctgcctcgtaaaagactacttccccgaacccgtcacagtatcatggaactcaggcgcactcacctcaggcgtccacaccttcccagccgtcctccaatcctcaggcctctattccctatcatccgtcgttaccgtaccatcatcctccctaggaactcaaacatacatatgcaacgtcaaccacaaaccctccaacactaaagttgacaagaaagtagaacccaaatcctgcgacaaaacccacacttgcccaccctgccccgcccccgaactcctcggcggcccttcagtattcctattcccacccaaacccaaagacactctaatgatatcccgcacccccgaagtaacctgcgtcgtcgtcgacgtctcacacgaagaccccgaagtcaaattcaactggtacgtcgacggcgtcgaagtccacaacgccaaaaccaaaccccgcgaagaacaatacaactccacataccgcgtcgtatcggtcctcacggtcctccaccaagattggctcaacggcaaagaatacaaatgcaaagtatccaacaaagccctccccgcccccatcgagaaaaccatctcaaaagccaaaggtcagccccgcgaaccccaggtatacaccctcccaccgtcacgcgacgaacttaccaaaaaccaagtctctctcacatgcctcgtcaaaggattctacccatcagacatcgctgtcgaatgggaaagcaacggccaacccgaaaacaactacaaaaccaccccacccgtcctagacagcgacggatccttcttcctctactctaaactgaccgtcgacaaatcccgctggcaacaaggcaacgtcttcagctgctcagtcatgcacgaagccctacacaaccactacacccagaaaagcctgtctctctcacccgga

SEQ ID NO: 53837 - RNA, 651 nt, synthetic construct
  misc_feature 1..651: note = derived and/or modified sequence opt11 from Guselkumab_LightChain1
  source 1..651: mol_type = other RNA
caatcagtcctcacccaacccccctcagtatccggcgcccccggccaacgcgtaaccatctcatgcaccggctcctcctctaacataggctccggctacgacgtccactggtaccaacaactccccggcaccgcccccaaactcctcatctacggcaactccaaacgcccctccggcgtccccgaccgcttctccggctccaaatccggaacttccgcatccctcgccatcaccggactccaatccgaagacgaagcagactactactgcgcctcctggacagacggcctctcactcgtcgtcttcggaggcggaaccaaactcaccgtcctcggccaacccaaagccgccccatccgtcaccctcttcccccccagctcagaagaactccaagccaacaaagccaccctcgtctgcctaatctccgacttctaccccggcgccgtcaccgtcgcctggaaagccgactcatcccccgtcaaagccggcgtcgaaaccaccaccccatccaaacaatccaacaacaaatacgccgcctcctcctacctctccctcacccccgaacaatggaaatcccaccgatcctactcctgccaagtcacccacgaaggatccaccgtcgaaaaaaccgtcgcccccaccgaatgctcc

SEQ ID NO: 53838 - RNA, 360 nt, synthetic construct
  misc_feature 1..360: note = derived and/or modified sequence opt11 from HuMab-001_HeavyChain_VDJ-Region
  source 1..360: mol_type = other RNA
caagtccaactccaacaatggggcgccggcctcctcaaaccctccgaaaccctctccctcacctgcgccgtctacggcggctccttctccggctactactggaactggatccgccaaccccccggcaaaggcctagaatggatcggcgaaatcaaccactccggctccaccaactacaacccctccctcaaatcccgcgtcaccatctccgtcgacacctccaaaaaccaattctccctcaaactctcctccgtcaccgccgccgacaccgccgtctactactgcgcccgcggcaactacggctccggctactactacttcgacctctggggccgcggcacccaagtcaccgtctcctcc

SEQ ID NO: 53839 - RNA, 321 nt, synthetic construct
  misc_feature 1..321: note = derived and/or modified sequence opt11 from HuMab-001_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatcttcgccgcctcctccctccaatccggcgtcccctcccgcttctccggctccggctccggcaccgacttcaccctcaccatctcctccctccaaccagaagacttcgccacctactactgccaacaatacatctccttcccaatcaccttcggccaaggcacccgcctcgaaatcaaa

SEQ ID NO: 53840 - RNA, 366 nt, synthetic construct
  misc_feature 1..366: note = derived and/or modified sequence opt11 from HuMab-005_HeavyChain_gamma-Chain_VDJ-Region
  source 1..366: mol_type = other RNA
gaagtgcaattggtccagagcggggccgaggtcaagaaaccgggcgagagcttgaaaataagctgtaaagcgagcgggtactcgttccatttctattggataggctgggtcaggcaaatgcccgggaaagggctcgagtggatgggctcgatctatcccggggactcggacacgcgctatcgcccgagctttcaagggcaagtgaccataagcgcggacaagagcataagcacggcctatctccagtggacgagcttgaaagcgagcgataccgcgatctattactgtgccaggcaaaggggcgattactattacttttacgggatggatgtctggggccagggcacgaccgtgaccgtgagctcg

SEQ ID NO: 53841 - RNA, 321 nt, synthetic construct
  misc_feature 1..321: note = derived and/or modified sequence opt11 from HuMab-005_LightChain_VJ-Region
  source 1..321: mol_type = other RNA
gaaatcgtcctcacccaatcccccggcaccctctccctctcccccggcgaacgcgccaccctctcctgccgcgcctcccaatccgtatcctcctcctacctcgcatggtaccaacaaaaacccggccaagtcccccgcctcctcatctacggcgcctcctcccgcgccaccggcatccccgaccgcttctccggctccggctccggcaccgacttcaccctcacaatctcccgcctcgaacccgaagacttcgccgtctactactgccaacaatacggatcttccctcaccttcggcggcggcaccaaagtcgaaatcaaa

SEQ ID NO: 53842 - RNA, 357 nt, synthetic construct
  misc_feature 1..357: note = derived and/or modified sequence opt11 from HuMab-006_HeavyChain_VDJ-Region
  source 1..357: mol_type = other RNA
gaggtccagctcttggaatcgggcgggggcttggtccagcccgggggctcgctcaggctctcgtgcgcggcctcgggctttacctttagcaattacgcgctcatatgggtgcgccaggccccgggaaagggcttggaatgggtctcgatcatacgcgggggcgcgggctcgacctattacgcggactcggtcaagggcaggttcacaatctcgcgcgataactcgaaaaataccttgtacttgcaaatgaactcgctcagggccgaggacacggccgtgtactattgcgcgaaagcgcgcatatgggggcccttgttcgattactggggccagggcacgctcgtgaccgtgagctcg

SEQ ID NO: 53843 - RNA, 324 nt, synthetic construct
  misc_feature 1..324: note = derived and/or modified sequence opt11 from HuMab-006_LightChain_VJ-Region
  source 1..324: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctcctcatctacgacgcctccaaccgcgccaccggcatccccgcccgcttctccggctccggctccggcaccgacttcaccctcaccatctcctccctcgaacccgaagacttcgccgtctactactgccaacaacgctccaactggccccccctcaccttcggcggcggcaccaaagtcgaaatcaaa

SEQ ID NO: 53844 - RNA, 360 nt, synthetic construct
  misc_feature 1..360: note = derived and/or modified sequence opt11 from HuMab-019_HeavyChain_VDJ-Region
  source 1..360: mol_type = other RNA
caagtccaactccaacaatggggcgccggcctcctcaaaccctccgaaaccctctccctaacctgcgccgtctacggcggctccttctccgactactactggaactggatccgccaaccccccggcaaaggcctcgaatggatcggcgaaatccaccacgtcggctccaccaactacaacccctccctcaaatcccgcgtcaccatctccgtcgacacctccaaatcccaattctccctcaaactatcctccgtcaccgccgccgacaccgccgtctactactgcgcccgcggctactacgactccggcgtctactacttcgactactgggcccaaggcaccctcgtcaccgtctcctcc

SEQ ID NO: 53845 - RNA, 360 nt, synthetic construct
  misc_feature 1..360: note = derived and/or modified sequence opt11 from HuMab-021_HeavyChain_VDJ-Region
  source 1..360: mol_type = other RNA
caagtccaactccaacaatggggcgccggcctcctcaaaccctccgaaaccctctccctcacctgcgccgtctacggcggctccttctccgactactactggaactggatccgccaaccccccggcaaaggcctcgaatggatcggcgaaatccaccactcaggctccaccaactacaacccctccctcaaatcccgagtcaccatctccgtcgacacctccaaaaaccaattctccctcaaactctcctcagtcaccgccgccgacaccgccgtctactactgcgcccgcggctactacgcctccggcgtctactacttcgactactggggccaaggcaccctcgtcaccgtctcctcc

SEQ ID NO: 53846 - RNA, 321 nt, synthetic construct
  misc_feature 1..321: note = derived and/or modified sequence opt11 from HuMab-021_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcatccctccaacccgaagacttcgccacctactactgccaacaatacaactcctaccccatcaccttcggccaaggcacccgcctcgaaatcaaa

SEQ ID NO: 53847 - RNA, 360 nt, synthetic construct
  misc_feature 1..360: note = derived and/or modified sequence opt11 from HuMab-025_HeavyChain_VDJ-Region
  source 1..360: mol_type = other RNA
caagtccaactccaacaatggggcgccggcctcctcaaaccctccgaaaccctctccctcacctgcgccgtctacggcggctccttctccgactactactggaactggatccgccaaccccccggcaaaggactcgaatggatcggcgaaatccaccactccggctccaccaactacaacccctccctaaaatcccgcgtcaccatctccgtcgacacctccaaaaaccaattctcactcaaactctcctccgtcaccgccgccgacaccgccgtctactactgcgcacgcggctactacgactccggcgtctactacttcgactactgggcccaaggcaccctcgtcaccgtctcctcc

SEQ ID NO: 53848 - RNA, 321 nt, synthetic construct
  misc_feature 1..321: note = derived and/or modified sequence opt11 from HuMab-025_LightChain_VJ-Region
  source 1..321: mol_type = other RNA
gacatccaaatgacccaatccccctcatccctctccgcctccgtcggcgaccgcgtcaccatcacctgccgcgcctcccaaggcatctcccgctggctcgcctggtaccaacaaaaacccgaaaaagcccccaaatccctcatctacgccgcctcctccctccgctccggcgtcccctcccgcttctccggctccggctccggcaccgacttcaccctcaccatctcctccctccaacccgaagacttcgccacctactactgccaacaatacaactcctaccccatcaccttcggccaaggcacccgcctcgaaatcaaa

SEQ ID NO: 53849 - RNA, 360 nt, synthetic construct
  misc_feature 1..360: note = derived and/or modified sequence opt11 from HuMab-027_HeavyChain_VDJ-Region
  source 1..360: mol_type = other RNA
caagtccaactccaacaatggggcgccggcctcctcaaaccctccgaaaccctctccctcacctgcgccgtctacggcggctccttctccgactacttctggaactggatccgccaaccccccggcaaaggcctcgaatggatcggcgaaatccaccactccggctccaccaactacaacccctccctcaaatcccgcgtcaccatctccgtcgacacctccaaaaaccaattctccctcaacctctcctccgtcaccgccgccgacaccgccgtctactactgcgcccgcggcctcatcggctccggctactactacttcgactactgggaccaaggcaccctcgtcaccgtctcctcc

SEQ ID NO: 53850 - RNA, 360 nt, synthetic construct
  misc_feature 1..360: note = derived and/or modified sequence opt11 from HuMab-032_HeavyChain_VDJ-Region
  source 1..360: mol_type = other RNA
caagtccaactccaacaatggggcgccggcctcctaaaaccctccgaaaccctctccctcacctgcgccgtctacggcggctccttctccggctactactggtcctggatccgccaaccccccggcaaaggcctcgaatggatcggcgaaatcaaccactccggcgacaccaactacaacccctcactcacctcccgcgtcaccatctccgtcgacacctccaaaaaccaattctccctcaaactctcctccgtcaccgccgccgacaccgccgtctactactgcgcccgcctcttctacggctcaggcatctactacttcgactactggggccaaggcaccctcgtcaccgtctcctcc

SEQ ID NO: 53851 - RNA, 321 nt, synthetic construct
  misc_feature 1..321: note = derived and/or modified sequence opt11 from HuMab-032_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccaccttccgcctccaatcaggcgtcccctcccgcttctccggctccggctccggcaccgacttcaccctcaccatctcctccctccaacccgaagacttcgccacctactactgccaacaatacaactccttcccccccaccttcggccaaggcaccaaagtcgaaatcaaa

SEQ ID NO: 53852 - RNA, 363 nt, synthetic construct
  misc_feature 1..363: note = derived and/or modified sequence opt11 from HuMab-033_HeavyChain_VDJ-Region
  source 1..363: mol_type = other RNA
caggtccagctcgtggaatcgggcgggggcgtggtccagaccgggcgctcgctcaggctctcgtgcgcggcctcgggctttacctttagctcgcacgcgatgcattgggtgcgccaggccccgggcaagggcttggaatgggtcgcggccataagctatgacgggagcaataaatattacgcggactcggtcaagggcaggttcacgatctcgcgcgataactcgaaaaataccttgtacttgcaaatgaactcgctcagggccgaggacacggccgtgtactattgcgcgcgcggggactatatctcgagctcaggcgtgttcgattactggggccagggcacgctcgtgaccgtgagctcg

SEQ ID NO: 53853 - RNA, 360 nt, synthetic construct
  misc_feature 1..360: note = derived and/or modified sequence opt11 from HuMab-035_HeavyChain_VDJ-Region
  source 1..360: mol_type = other RNA
caagtacaactacaacaatggggcgccggcctactcaaaccctccgaaaccctctccctcacctgcgccatctacggcggctccttctcaggctactactggtcctggatccgccaaccccccggcaaaggcctcgaatggatcggcgaaatcaaccactccggcgacaccaactacaacccctccctcacctcacgcgtcaccatctccgtcgacacctccaaaaaccaattctccctcaaactctcctccgtcaccgccgccgacaccgccgtctactactgcgcccgcctcttctacggctccggcatctactacttcgactactggggccaaggcaccctcgtcaccgtctcctcc

SEQ ID NO: 53854 - RNA, 360 nt, synthetic construct
  misc_feature 1..360: note = derived and/or modified sequence opt11 from HuMab-036_HeavyChain_VDJ-Region
  source 1..360: mol_type = other RNA
caagtccaactccaacaatggggcgccggcctcctcaaaccctccgaaaccctctccctcacctgcgccgtctacggcggctccttctccgactactactggtcctggatccgccaaccccccggcaaaggcctcgaatggatcggcgaaatcaaccactccggctccaccaactacaacccctccctcaaatcccgcgtcaccatctccgtcgacacctccaaaaaccaattctccctcaaactctcctccgtcacagccgccgacaccgccgtctactactgcgcccgcctctactacggctccggcacctactacttcgactactggggccaaggcaccctcgtcaccgtctcctca

SEQ ID NO: 53855 - RNA, 321 nt, synthetic construct
  misc_feature 1..321: note = derived and/or modified sequence opt11 from HuMab-036_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcacctggtaccaacaaaaacccgaaaaagcccccaaatccctcatctacgccgcctcccgcctccaatccggcgtcccctcccgcttctccggctccggctcaggcaccgacttcaccctcaccatctcctccctccaacccgaagacttcgccacctactactgccaacaatacaactccttcccccccaccttcggccaaggcaccaaagtcgaaatcaaa

SEQ ID NO: 53856 - RNA, 366 nt, synthetic construct
  misc_feature 1..366: note = derived and/or modified sequence opt11 from HuMab-041_HeavyChain_VDJ-Region
  source 1..366: mol_type = other RNA
gaagtccaactcgtccaatccggcgccgaagtcaaaaaacccggcgaatccctcaaaatctcctgcaaaggctccggctactccttcacctcctactggatcggctgggtccgccaaatgcccggcaaaggcctcgaatggatgggctcaatctaccccggcgactcccacacccgctaccgcccctccttccaaggccaagtcaccatctccgccgacaaatcaatctccaccgcctacctccaatggtcctccctcaaagcctccgacaccgccatgtactactgcgcccgccaaaaaggcgacttctactacttcttcggcctcgacgtctggggccaaggcaccgccatcaccgtctcctcc

SEQ ID NO: 53857 - RNA, 366 nt, synthetic construct
  misc_feature 1..366: note = derived and/or modified sequence opt11 from HuMab-044_HeavyChain_VDJ-Region
  source 1..366: mol_type = other RNA
gaggtccagctagtgcaatcgggcgcggaagtgaaaaagcccggggaatcgctcaagatctcgtgcaagggctcgggctatcgctttagctcgtactggatcgggtgggtgcgccagatgccgggcaagggattggaatggatggggagcatattcccgggcgatagcgataccaggtactcgccctcgttccagggccaggtcacgatctcggccgataaatcgatcacgaccgcgtacttgcaatggagctcgctcaaggcctcggacacggccatgtactattgcgcgcgccaggccggggactattactattacaatggcatggacgtgtgggggcaagggaccacggtaacggtctcgagc

SEQ ID NO: 53858 - RNA, 357 nt, synthetic construct
  misc_feature 1..357: note = derived and/or modified sequence opt11 from HuMab-049_HeavyChain_VDJ-Region
  source 1..357: mol_type = other RNA
gaggtccagctattggaatcgggcggggacttggtccagcccgggggctcgctcaggctctcgtgcgcggcctcgggctttacctttagctcgtacgcgatgtcgtgggtgcgccaggccccgggcaagggcctggaatgggtctcggccataagcgggcgcgggggcacgacctattacgcggactcggtcaagggcaggttcacgatctcgcgcgataactcgaaatcgaccttgtgcttgcaaatgaactcgctcagggccgaggacacggccgtgtactattgcgcgaaagcgcgcgcgaactgggactatttcgattactggggccagggcacgctcgtgaccgtgagctcg

SEQ ID NO: 53859 - RNA, 321 nt, synthetic construct
  misc_feature 1..321: note = derived and/or modified sequence opt11 from HuMab-049_LightChain_VJ-Region
  source 1..321: mol_type = other RNA
gacatccaaatgacccaatccccctcctccgtctccgcctccgtcggcgaccgcgtcaccatcacctgccgcgcctcccaaggcatctcctcctggctcgcctggtaccaacacaaacccggcaaagcccccaaactcctcatctacgccgcctccatcctccaatccggcgtcccctcccgcttctccggctccggctccggcaccgacttcaccctcaccatctcctccctccgccccgaagacttcgccacctactactgccaacaagccaactccttccccatcaccttcggccaaggcacccgcctcgaaatcaaa

SEQ ID NO: 53860 - RNA, 357 nt, synthetic construct
  misc_feature 1..357: note = derived and/or modified sequence opt11 from HuMab-050_HeavyChain_VDJ-Region
  source 1..357: mol_type = other RNA
gaggtccagctcttggaatcgggcgggggcttggtccagcccgggggctcactcaggctctcgtgcgcggcctcgggctttacctttagctcgtacgcgatgaattgggtgcgccaggccccgggcaagggcctggaatgggtctcggccataagcgggcgcgggggcacgacctattacgcggactcggtcaagggcaggttcacgatctcgcgcgataactcgaaaaataccttgtacctgcaaatgagctcgctcagggccgaggacacggccgtgtactattgcgcgaaagcgcgcgcgaactgggactatttcgattactggggccagggcacgctcgtgacagtgagctcg

SEQ ID NO: 53861 - RNA, 321 nt, synthetic construct
  misc_feature 1..321: note = derived and/or modified sequence opt11 from HuMab-050_LightChain_VJ-Region
  source 1..321: mol_type = other RNA
gacatccaaatgacccaatccccctcctccgtctccgcctccgtcggcgaccgcgtcaccatcacctgccgcgcctcccaaggcatctcctcctggctcgcctggtaccaacacaaacccggcaaagcccccaaactcctcatctacgccgcctccatcctccaatccggcgtcccctcccgcttctccggctccggctccggcaccgacttcaccctcaccatctcctcactccaacccgaagacttcgccacctactactgccaacaagccaactccttccccatcaccttcggccaaggcacccgcctcgaaatcaaa

SEQ ID NO: 53862 - RNA, 360 nt, synthetic construct
  misc_feature 1..360: note = derived and/or modified sequence opt11 from HuMab-054_HeavyChain_VDJ-Region
  source 1..360: mol_type = other RNA
caagtccaactccaacaatggggcgccggcctcctcaaaccctccgaaaccctctcccttacctgcgccgtctacggcggctccttctccggctactactggtcctggatccgccaacccccaggcaaaggcctcgaatggatcggcgaaatccaccactcaggctccaccaactacaacccctccctcaaatcccgcgtcaccatctccgtcgacacctccaaaaaccaattctcactcaaactctcctccgtcaccgccgccgacaccgccgtctactactgcgcccgcctctggtacggctccggctcctactacttcgactactggggccaaggcaccctcgtcaccgtatcctcc

SEQ ID NO: 53863 - RNA, 321 nt, synthetic construct
  misc_feature 1..321: note = derived and/or modified sequence opt11 from HuMab-054_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactccttcccccccaccttcggcggcggcaccaaagtcgaaatcaaa

SEQ ID NO: 53864 - RNA, 357 nt, synthetic construct
  misc_feature 1..357: note = derived and/or modified sequence opt11 from HuMab-055_HeavyChain_VDJ-Region
  source 1..357: mol_type = other RNA
gaggtccagctcttggaatcgggcgggggcttggtccagcccgggggctcactcaggctctcgtgcgcggcctcgggctttacatttagctcgtacgcgatgaattgggtgcgccaggccccgggcaagggcttggaatgggtctcggccataagcgggcgcgggggcacgacctattacgcggactcggtcaagggcaggttcacgatctcgcgcgataactcgaaatcgacattgtgcttgcaaatgaactcgctcagggccgaggacacggccgtgtactattgcgcgaaagcgcgcgcgaactgggactatttcgattactggggccagggcacgctcgtgaccgtgagctcg

SEQ ID NO: 53865 - RNA, 366 nt, synthetic construct
  misc_feature 1..366: note = derived and/or modified sequence opt11 from HuMab-059_HeavyChain_VDJ-Region
  source 1..366: mol_type = other RNA
caagtgcaattggtccagagcggggccgaggtcaagaaaccgggcgcgagcgtgcgcgtgccctgtaaagcgagcgggtacacgttcacgcgctatggcataagctgggtcaggcaagcgccagggcaagggctcgagtggatgggctggatctcggcctataacgggaaaacgtactatgcccagaaattgcaagggcgcgtgaccatgaccacggacacgagcacgagcacggcctatatggagctcaggagcttgcgctcggacgataccgcggtctattactgtgccaggagcccgctcttgtggtttgaggaactctatttcgattactggggccagggcacgctcgtgaccgtgagctcg

SEQ ID NO: 53866 - RNA, 324 nt, synthetic construct
  misc_feature 1..324: note = derived and/or modified sequence opt11 from HuMab-059_LightChain_VJ-Region
  source 1..324: mol_type = other RNA
gaaatcgtcctcacccaatcccccggcaccctctccctctcccccggcgaacgcgccaccctctcctgccgcgcctcccaatccgtctcctccacctacctcgcctggtaccaacaaaaacccggccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggcacctccctcttcaccttcggccccggcaccaaagtcgacatcaaa

SEQ ID NO: 53867 - RNA, 366 nt, synthetic construct
  misc_feature 1..366: note = derived and/or modified sequence opt11 from HuMab-060_HeavyChain_VDJ-Region
  source 1..366: mol_type = other RNA
gaggtccagctcgtgcaatcgggcgcggaagtgaaaaagcccggggaatcgctcaagatctcgtgcaagggctcgggctatcgctttacctcatactggatcgggtgggtacgccagatgccgggcaagggcttggaatggatggggagcatatacccgggcgatagctataccaggaactcgccctcgttccagggccaggtcacgatctcggccgataaatcgatcgcgaccgcgtacctgcaatggaactcgctcaaggcctcggacacggccatgtactattgcgcgcgccatgccggggacttttactatttcgatggcttggacgtgtgggggcaaggaaccacggtcacggtctcgagc

SEQ ID NO: 53868 - RNA, 327 nt, synthetic construct
  misc_feature 1..327: note = derived and/or modified sequence opt11 from HuMab-060_LightChain_VJ-Region
  source 1..327: mol_type = other RNA
gaaatcgtcctcacccaatcccccggcaccctctccctctcccccggcgaacgcgccaccctctcctgccgcgcctcccaatccgtctcctcctcctacctcgcctggtaccaacaaaaacccggccaagccccccgcctcctcatctacggcgcctcctcccgcgccacaggcatccccgaccgcttctccggctccggctccggcaccgacttcaccctcaccatctcccgcctcgaacccgaagacttcgccgtctactactgccaacaatacggctcctccccccccatcaccttcggccaaggcacccgcctcgaaatcaaa

SEQ ID NO: 53869 - RNA, 366 nt, synthetic construct
  misc_feature 1..366: note = derived and/or modified sequence opt11 from HuMab-067_HeavyChain_VDJ-Region
  source 1..366: mol_type = other RNA
gaagtgcaattggtccagagcggggccgaggtcaagaaaccgggcgagagcttgaaaataagctgtaaagggagcgggtactcgttcacgagctattggataggctgggtcaggcaaatgcccgggaaagggctcgagtggatgggaataatctatcccggggactcggacacgcgctatagcccgagctttcaagggcaagtgaccataagcgtggacaagagcataagcacggcctatctccagtggtcgagcttgaaagcgagcgataccgcgatgtattactgtgccaggcaaaagggcgattactattaccattacgggctcgatgtctggggccagggcacgaccgtgaccgtgagctcg

SEQ ID NO: 53870 - RNA, 366 nt, synthetic construct
  misc_feature 1..366: note = derived and/or modified sequence opt11 from HuMab-072_HeavyChain_VDJ-Region
  source 1..366: mol_type = other RNA
gaagtgcaattggtccagagcggagccgaggtcaagaaaccgggcgagagcttgaaaataagctgtaaagggagcgggtactcgttcacgagctattggataggctgggtcaggcaaatgcccgggaaagggctcgagtggatgggaataatctatcccggggactcggacacgcgctatagcccgagctttcaaggacaagtgaccataagcgcggacaagagcataagcacggcctatctccagtggtcgagcttgaaagcgagcgataccgcgatgtattactgtgccaggcaaaagggcgattactattactttaacgggctcgatgtctggggccagggcacgaccgtgaccgtgagctcg

SEQ ID NO: 53871 - RNA, 327 nt, synthetic construct
  misc_feature 1..327: note = derived and/or modified sequence opt11 from HuMab-072_LightChain_VJ-Region
  source 1..327: mol_type = other RNA
gaaatcgtcctcacccaatcccccggcaccctctccctctcccccggcgaacgcgccaccctctcctgccgcgcctcccaatccgtctcctcctcctacctcgcctggtaccaacaaaaacccggccaagccccacgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggctcctccccccgcctcaccttcggcggcggcaccaaagtcgaaatcaaa

SEQ ID NO: 53872 - RNA, 363 nt, synthetic construct
  misc_feature 1..363: note = derived and/or modified sequence opt11 from HuMab-084_HeavyChain_VDJ-Region
  source 1..363: mol_type = other RNA
caggtccagctcgtacaatcgggcgcggaagtgaaaaagcccgggagctcggtcaaggtctcgtgcaaggcctcgggcgggacctttcgcacgtacgcgatcaattgggtgcgccaggccccgggccagggcttggaatggatggggcgcataaacacggtcttgggcatagtcaatcacgcgcaaaagttccagggcagggtaacgatcacggccgataaatcgaccaataccgcgtacatggaattgaactcgctcaggagcgaggacacggccgtgtactattgcgcgcgcgagaaaggggtcgattactattacgggatcgaggtctggggccagggcacgaccgtgaccgtgagctcg

SEQ ID NO: 53873 - RNA, 321 nt, synthetic construct
  misc_feature 1..321: note = derived and/or modified sequence opt11 from HuMab-084_LightChain_VJ-Region
  source 1..321: mol_type = other RNA
gacatccaaatgacccaatccccctcctccgtctccgcctccgtcggcgaccgcgtcaccatcacctgccgcgcctcccaaggcatctcctcctggctcgcctggtaccaacacaaacccggcaaagcccccaaactcctcatctacgtcgcctccaccctccaatccggcgtcccctcccgcttctccggctccggctcaggcaccgacttcaccctcaccatctcctccctccaacccgaagacttcgccacctactactgccaacaagccaactccttccccctcaccttcggcggcggcaccaaagtcgaaatcaaa

SEQ ID NO: 53874 - RNA, 360 nt, synthetic construct
  misc_feature 1..360: note = derived and/or modified sequence opt11 from HuMab-091_HeavyChain_VDJ-Region
  source 1..360: mol_type = other RNA
caagtacaactccaacaatggggcgcaggcctcctcaaaccctccgaaaccctctccctcacctgcgccgtctcaggcggctccttctccggctactactggacctggatccgccaaccccccggcaaaggcctagaatggatcggcgaaatctaccactccggcgacaccaactacaacccctccctcaaatcccgcgtcaccatctccgtcgacacctccaaaaaccaattctccctcaaactctactccgtcaccgccgccgacaccgccgtctactactgcgcccgcctctacttcggctccggcatctactacctcgactactggggccaaggcaccctcgtcaccgtctcctcc

SEQ ID NO: 53875 - RNA, 321 nt, synthetic construct
  misc_feature 1..321: note = derived and/or modified sequence opt11 from HuMab-091_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgtctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactccttcccccccaccttcggccaaggcaccaaagtcgaaatcaaa

SEQ ID NO: 53876 - RNA, 366 nt, synthetic construct
  misc_feature 1..366: note = derived and/or modified sequence opt11 from HuMab-093_HeavyChain_VDJ-Region
  source 1..366: mol_type = other RNA
gaagtgcaattggtccagagcggggccgaggtcaagaaaccgggcgagagcttgaaaataagctgtaaagggagcgggtactcgttcacgagctattggataggctgggtcaggcaaatgcccgggaaagggctcgagtggatgggcaggatctatcccggggactcggacacgcgctatagcccgagctttcaagggcaagtgaccataagcgcggacaagagcataaccacggcctatctccagtggtcgagcttgcgcgcgagcgataccgcgatgtattactgtgccaggcaaaggggcgattactattactttttcgggctcgatatctggggccaaggcacgaccgtgaccgtgagcttg

SEQ ID NO: 53877 - RNA, 372 nt, synthetic construct
  misc_feature 1..372: note = derived and/or modified sequence opt11 from HuMab-098_HeavyChain_VDJ-Region
  source 1..372: mol_type = other RNA
gaagtccaactcctcgaatccggcggcggcctcgtccaacccggcggctccctccgcctctcatgcgccgcctccggcttcaccttctccaactacggcatgtcctgggtccgccaagcccccggcaaaggcctcgaatgggtctccgccatctccggctccgcctactccacctactacgccgactccgtaaaaggacgcttcaccatctcccgcgacaactccaaaaacaccctctggctccaaatgaactccctccgcgccgaagacaccgcagtctactactgcgccaaagcccactaccacggctccggctcctactacaccctcttcgactactggggccaaggcaccctcgtcaccgtctcctcc

SEQ ID NO: 53878 - RNA, 321 nt, synthetic construct
  misc_feature 1..321: note = derived and/or modified sequence opt11 from HuMab-098_LightChain_VJ-Region
  source 1..321: mol_type = other RNA
gacatccaaatgacccaatccccctcctccctctccgcctccgtcggcgaccgcgtcaccatcacctgccgcgcatcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctacccctacaccttcggccaaggcaccaaactcgaaatcaaa

SEQ ID NO: 53879 - RNA, 372 nt, synthetic construct
  misc_feature 1..372: note = derived and/or modified sequence opt11 from HuMab-100_HeavyChain_VDJ-Region
  source 1..372: mol_type = other RNA
gaagtccaactcctcgaatccggcggcggcctcgtccaaccaggcggatccctccgcctctcctgcgccgcctccggcttcaccttcaacaactacggcatgaactgggtccgccaagcccccggcaaaggcctcgaatgggtctccgccatctccggaacaggctactccacctactacgccgactccgtcaaaggccgcttcaccatctcccgcgacaactccaaaaacaccctatacctccaaatgaactccctccgcgccgaagacaccgccgtctactactgcgccaaagcccactacttcggctccggctcctactacaccctcttcgactactggggccaaggcaccctcgtcaccgtctcctcc

SEQ ID NO: 53880 - RNA, 372 nt, synthetic construct
  misc_feature 1..372: note = derived and/or modified sequence opt11 from HuMab-106_HeavyChain_VDJ-Region
  source 1..372: mol_type = other RNA
gaagtgcaattggtccagagcggggccgaggtcaagaaaccgggcgagagcttgaaaataagctgtaaagggagcgggtactcgttcacgcgatattggataggctgggtcaggcaaatgcccgggaaagggctcgagtggatgggcataatctatcccggggactcggacacgcgatatagcccgagctttcaagggcaagtgacaataagcgcggacaagagcataagcacggcctatctccagtggtcgagcttgaaagcgagcgatacagcgatgtattactgtgccaggctcacgggcgatcgcgggttcgattactatagcgggatggatgtctggggccagggcacgaccgtgaccgtgagctcg

SEQ ID NO: 53881 - RNA, 321 nt, synthetic construct
  misc_feature 1..321: note = derived and/or modified sequence opt11 from HuMab-106_LightChain_VJ-Region
  source 1..321: mol_type = other RNA
gaaatcgtcctcacccaatcccccggcaccctctccctctcccccggcgaacgcgccaccctctcctgccgcgcctcccaatccgtctcatcctcctacctcgcctggtaccaacaaaaacccggccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggctcctccttcaccttcggccccggcaccaaagtcgacatcaaa

SEQ ID NO: 53882 - RNA, 351 nt, synthetic construct
  misc_feature 1..351: note = derived and/or modified sequence opt11 from HuMab_10F8_HeavyChain_V-Region
  source 1..351: mol_type = other RNA
caagtgcaattggtcgagagcgggggcggggtcgtgcaaccgggcaggagcttgcgcttgagctgtaccgcgagcgggttcacgttctcgcactatggcatgtactgggtcaggcaagcgcccgggaaagggctcgagtgggtggccgtgatctggtacgatggctcgtacgagtacaatgaagatagcgtgaaagggcgctttaccataagcagggacaatagcaagaacacgctctatctccagatgaatagcttgcgcgcggaagataccgcggtctattactgtgccagggacagggtcgggctctttgactattgggggcaagggaccttggtcacggtctcgagc

SEQ ID NO: 53883 - RNA, 408 nt, synthetic construct
  misc_feature 1..408: note = derived and/or modified sequence opt11 from HuMab_10F8_HeavyChain_V-Region_Precursor
  source 1..408: mol_type = other RNA
atggagttcgggctctcatgggtgttcttggtcgcgctcctgcgcggggtccagtgccaggtccagctcgtggaatcgggcgggggcgtggtccagcccgggcgatcgctcagactctcatgcacggcctcgggctttacctttagccattacgggatgtattgggtgcgccaggccccgggcaagggcttggaatgggtcgcggtcatatggtatgacgggagctatgaatataacgcggactcggtcaagggcaggttcacgatctcgcgcgataactcgaaaaataccttgtacttgcaaatgaactcgctcagggccgaggacacggccgtgtactattgcgcgcgcgatcgcgtgggcttgttcgattactggggccagggcacgctagtgaccgtgagctcg

SEQ ID NO: 53884 - RNA, 321 nt, synthetic construct
  misc_feature 1..321: note = derived and/or modified sequence opt11 from HuMab_10F8_LightChain_V-Region
  source 1..321: mol_type = other RNA
gaaatcgtcctcacccaatcacccggcaccctctccctctcccccggcgaacgcgccaccctctcctgccgcgcctcccaatccatctcctcctcctacctcgcctggtaccaacaaaaacccggccaagccccccgcctcctcatctacggcccctcctcccgcgccaccggcatccccgaccgcttctccggctccggctccggcaccgacttcaccctcaccatctcccgcctcgaacccgaagacttcgccgtctactactgccaacaatacgccggctccctcaccttcggccccggcaccaaagtcgacatcaaa

SEQ ID NO: 53885 - RNA, 381 nt, synthetic construct
  misc_feature 1..381: note = derived and/or modified sequence opt11 from HuMab_10F8_LightChain_V-Region_Precursor
  source 1..381: mol_type = other RNA
atggaaacccccgcccaactcctcttcctcctcctcctctggctccccgacaccaccggcgaaatcgtcctcacccaatcccccggcaccctctccctctcccccggcgaacgcgccaccctatcctgccgcgcctcccaatccatctcctcctcctacctcgcctggtaccaacaaaaacccggccaagcaccccgcctcctcatctacggcccctcctcccgcgccaccggcatccccgaccgcttctccggctccggctccggcaccgacttcacactcaccatctcacgcctcgaacccgaagacttcgccgtctactactgccaacaatacgccggctcactcaccttcggccccggcaccaaagtcgacatcaaa

SEQ ID NO: 53886 - RNA, 357 nt, synthetic construct
  misc_feature 1..357: note = derived and/or modified sequence opt11 from HuMab-111_HeavyChain_VDJ-Region
  source 1..357: mol_type = other RNA
caagtacaactcgtccaatccggagccgaagtcaaaaaacccggcagctcagtcaaagtctcctgcaaagcctccggcggcaccttcagcagctacggcatcagctgggtccgccaagccccaggccccggcctagaatggatgggccgcataatcccaatactcggcatagcaaactacgcccaaaaattccaaggccgagtcacaatcacagccgacaaaagcaccaacaccgcctacatggaactcagcagcctccgcagcgaagacaccgcagtatactactgcgcccgcgaccaagaatactccagcaactggtactactggggccaaggcacactagtaacagtcagctcc

SEQ ID NO: 53887 - RNA, 321 nt, synthetic construct
  misc_feature 1..321: note = derived and/or modified sequence opt11 from HuMab-111_LightChain_VJ-Region
  source 1..321: mol_type = other RNA
gaaatcgtcctcacccaatcacccggcaccctctccctctcccccggcgaacgcgccaccctctcctgccgcgcctcccaatccgtccgctcatcctacctcgcctggtaccaacaaaaacccggccaagccccacgcctcctcatctacggagcctcctcccgcgccaccggcatccccgaccgcttctccggctccggctccggcaccgacttcaccctcaccatctcccgcctcgaacccgaagacttcgccgtctactactgccaactctacggctcctcccccaccttcggccccggcaccaaagtcgacatcaaa

SEQ ID NO: 53888 - RNA, 363 nt, synthetic construct
  misc_feature 1..363: note = derived and/or modified sequence opt11 from HuMab-123_HeavyChain_VDJ-Region
  source 1..363: mol_type = other RNA
caagtccaactcgtccaatccggcgccgaagtcaaaaaacccggcgcctccgtcaaagtctcctgcaaagccgccggctacaccttcaccaactacggcatctcctgggtccgccaagcccccggccaagccctcgaatggatgggctggatcaccacctactcatccaacaccatctacgcccaaaaactccaaggacgcgtcaccatgaccaccgacacctccacctccaccgcatacatggaactccgctcactccgctccgacgacaccgccgtctactactgcgcccgcgaccgcgtcgtcgtccgccccgactacttcgactactggggccaaggcaccctagtcaccgtctcctcc

SEQ ID NO: 53889 - RNA, 321 nt, synthetic construct
  misc_feature 1..321: note = derived and/or modified sequence opt11 from HuMab-123_LightChain_VJ-Region
  source 1..321: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctcctcatctacgacacctccaaccgcgccaccggcatccccgcccgcttctccggctccggctccggcaccgacttcaccctaaccatctcctccctcgaacccgaagacttcgccgtctactactgccaacaacgctcccactggccccgaaccttcggccaaggcaccaaagtcgaaatcaaa

SEQ ID NO: 53890 - RNA, 363 nt, synthetic construct
  misc_feature 1..363: note = derived and/or modified sequence opt11 from HuMab-124_HeavyChain_VDJ-Region
  source 1..363: mol_type = other RNA
caagtccaactcgtccaatccggcgccgaagtcaaaaaacccggcgcctccgtcaaagtctcctgcaaagccgccggctacaccttcaccaactacggcatctcctgggtccgccaagcccccggccaaggcctcgaatggatgggctggatcatcacctacaacggcaacaccatctacgcccaacgcttccaagaccgcgtcacaatgaccaccgacacctccacctccaccgcctacatggaactccgctccctccgatccgacgacaccgccgtctactactgcgcccgcgaccgcatcatcgtccgccccgactacttcgactactggggccaaggcaccctcgtcaccgtctcatca

SEQ ID NO: 53891 - RNA, 372 nt, synthetic construct
  misc_feature 1..372: note = derived and/or modified sequence opt11 from HuMab-125_HeavyChain_VDJ-Region
  source 1..372: mol_type = other RNA
gaagtacaactcctcgaatccggcggcggcctcgtccaacccggcggctccctccgcctctcctgcgccgcctccggcttcaccttcaccgactacgccatgaactgggtccgccaagcccccggcaaaggcctcgaatgggtctccaccatctccggctccggctacgccacctactacgccgactccgtcaaaggccgcttcaccatctcccgcgacaactccaaaaccaccctctacctccaaatgaactccctccgcgccgaagacaccgccgtctactactgcgccaaaggccacacactcggctccggctcctactacaccctcttcgactactggggccaaggaaccctcgtcaccgtctcctcc

SEQ ID NO: 53892 - RNA, 321 nt, synthetic construct
  misc_feature 1..321: note = derived and/or modified sequence opt11 from HuMab-125_LightChain_VJ-Region
  source 1..321: mol_type = other RNA
gacatccaaatgacccaatccccctcctccctctccgcctccgtcggcgaccgcgtcaccatcacctgccgcgcctcccaaggcatcaactcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcatacccctacaccttcggccaaggcaccaaactcgaaatcaaa

SEQ ID NO: 53893 - RNA, 369 nt, synthetic construct
  misc_feature 1..369: note = derived and/or modified sequence opt11 from HuMab-127_HeavyChain_VDJ-Region
  source 1..369: mol_type = other RNA
gaggtccagctcgtgcaatcgggcgcggaagtgaaaaagcccggggaatcgctcacgatctcatgcaagggctcaggctatagctttagcatatactggatcgggtgggtgcgccagatgccgggcaagggcttggaatggatggggatcatattcccgggcgatagcgatatcaggtactcaccctcgttccagggccaggtcacgatctcggccgataaatcgatctcgaccgcgtacttgcaatggagctcactcaaggcctcggacacggccatgtactattgcgcgcgccagcccggggactggagcccgcgccattggtatttcgatctctggggcagaggcacgctcgtgaccgtgagctcg

SEQ ID NO: 53894 - RNA, 321 nt, synthetic construct
  misc_feature 1..321: note = derived and/or modified sequence opt11 from HuMab-127_LightChain_VJ-Region
  source 1..321: mol_type = other RNA
gtcatctggatgacccaatccccctccctcctctccgcctccaccggcgaccgcgtcaccatctcctgccgcatgtcccaaggcatctcctcctacctcgcctggtaccaacaaaaacccggcaaagcccccgaactcctcatctacgccgcctccaccctacaatccggcgtcccctcccgcttctccggctccggctccggcaccgacttcaccctcaccatctcctacctccaatccgaagacttcgccacctactactgccaacaatactactccttccccctcaccttcggcggcggcaccaaagtcgaaatcaaa

SEQ ID NO: 53895 - RNA, 357 nt, synthetic construct
  misc_feature 1..357: note = derived and/or modified sequence opt11 from HuMab-129_HeavyChain_VDJ-Region
  source 1..357: mol_type = other RNA
caggtccagctcgtggaatcgggcgggggcgtggtccagcccgggcgctcgctcaggctctcgtgcgcggcctcgggctttacctttagcacgttcgcgatccattgggtgcgccaggccccgggcaagggcttggaatgggtcgcggtcataagctatgacgggggccataaattttacgcggactcggtcaagggcaggttcacgatctcgcgagataactcgaaaaataccttgtacttgcaaatgaactcgctcagggccgaggacacggcaatgtactattgcgcgcgcgggctcggggtctggggcgcgttcgattactggggccagggcacgctcgtgaccgtgagctcg

SEQ ID NO: 53896 - RNA, 318 nt, synthetic construct
  misc_feature 1..318: note = derived and/or modified sequence opt11 from HuMab-129_LightChain_VJ-Region
  source 1..318: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctactcatctacgacgcctccaaccgcgccaccggcatccccgcccgcttctccggctccggctccggcaccgacttcaccctcaccatctcctccctcgaacccgaagacttcgccgtctactactgccaacaacgctccaactggtggaccttcggccaaggcaccaaagtcgaaatcaaa

SEQ ID NO: 53897 - RNA, 375 nt, synthetic construct
  misc_feature 1..375: note = derived and/or modified sequence opt11 from HuMab-132_HeavyChain_VDJ-Region
  source 1..375: mol_type = other RNA
caagtccaactcgtccaatccggcgccgaagtaaaaaaacccggcgcctccgtcaaagtctcatgcaaagcctccggctacaccttcacctcctacggcatctcctgggtccgccaagcccccggccaaggcctcgaatggatgggctggatctccgcatacaacggcaactccaactacgtccaaaaattccaaggccgcgtcaccatgacaaccgacaccaccacctccaccgcctacatggaactccgctccctcaccagcgacgacaccgccgtctactactgcgcccgcgaatactcctacgactccggcacctacttctactacggcatggacgtctggggccaaggcaccaccgtcaccgtctcctcc

SEQ ID NO: 53898 - RNA, 324 nt, synthetic construct
  misc_feature 1..324: note = derived and/or modified sequence opt11 from HuMab-132_LightChain_VJ-Region
  source 1..324: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctcctcatctacgacgcctccaaccgcgccaccggcatccccgcccgcttctccggctccggctccggcaccgacttcaccctaaccatctcctccctcgaacccgaagacttcgccgtctactactgccaacaacgctcaaactggcccatgtacaccttcggccaaggcaccaaactcgaaatcaaa

SEQ ID NO: 53899 - RNA, 360 nt, synthetic construct
  misc_feature 1..360: note = derived and/or modified sequence opt11 from HuMab-143_HeavyChain_VDJ-Region
  source 1..360: mol_type = other RNA
caagtccaactccaacaatggggcgccggcctcctcaaaccctccgaaaccctctccctcacctgcgccgtctacggcggctccttctccggctactactggaactggatccgacaaccccccggcaaaggcctcgaatggatcggcgaaatccaccactcaggctccgccaactacaacccctccctcatgtcccgcgtcaccatctccgtcgacacctccaaaaaccaattctccctccaactctcctccgtcaccgccgccgacaccgccgtctactactgcgcccgcggctactacggctccggctactactacttcgactactggggccaaggcaccctcgtaaccgtctcctcc

SEQ ID NO: 53900 - RNA, 321 nt, synthetic construct
  misc_feature 1..321: note = derived and/or modified sequence opt11 from HuMab-143_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcccgcctccaatccggcgtcccctcccgcttctccggctccggctccggcaccgacttcaccctcaccatctcctccctccaacccgaagacttcgccacctactactgccaacaatacaactcataccccatcaccttcggccaaggcacccgactcgaaatcaaa

SEQ ID NO: 53901 - RNA, 366 nt, synthetic construct
  misc_feature 1..366: note = derived and/or modified sequence opt11 from HuMab-150_HeavyChain_VDJ-Region
  source 1..366: mol_type = other RNA
gaggtccagctagtgcaatcgggcgcggaagtgaaaaagcccggggaatcgctaaagatctcgtgcaagggctcgggctatagctttacctcgtactggatcgggtgggtacgccagatgccgggcaagggcctggaatggatggggagcatatacccgggcgacagccataccaggtacaggccctcgttccagggccaggtcacgatctcggccgataaatcgatctcgaccgcgtacttgcaatggagctcgctaaaggcctcggacacggccatgtactattgcgcgcgacaggccggggactattactattacaatggcatggacgtgtgggggcaagggaccacggtcacggtctcgagc

SEQ ID NO: 53902 - RNA, 321 nt, synthetic construct
  misc_feature 1..321: note = derived and/or modified sequence opt11 from HuMab-150_LightChain_VJ-Region
  source 1..321: mol_type = other RNA
gaaatcgtcctcacccaatcccccggcaccctctccctctcccccggcgaacgcgccaccctctcctgccgcgcctcccaatccgtctcctcctcctacctcacctggtaccaacaaaaacccggccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggctcctccctcaccttcggcggcggcaccaaagtcgaaatcaaa

SEQ ID NO: 53903 - RNA, 363 nt, synthetic construct
  misc_feature 1..363: note = derived and/or modified sequence opt11 from HuMab-152_HeavyChain_VDJ-Region
  source 1..363: mol_type = other RNA
caggtccaggtcgtggaatcgggcgggggcgtggtccagcccgggcgctcgctcaggctctcgtgcgcggcctcgggctttacctttagctcgtacgcgatgcattgggtgcgccaggccccgggcaagggcttggaatgggtcgcggtcataagctatgacgggagctataaatattacgcggactcggtcaagggcaggttcacgatctcgcgcgataactcgaaaaataccttgtacttgcaaatgaactcgctcagagccgaggacacggccgtgtactattgcgcgcgcgggagcataaccgggagcacgggcgtgttcgattactggggccagggcacgctagtgaccgtgagctcg

SEQ ID NO: 53904 - RNA, 321 nt, synthetic construct
  misc_feature 1..321: note = derived and/or modified sequence opt11 from HuMab-152_LightChain_VJ-Region
  source 1..321: mol_type = other RNA
gacatccaaatgacccaatccccctcctccctctccgcctccgtcggcgaccgcgtcaccatcacatgccgcgcctcccaaggcatcaactcctggctcgcctggtaccaacaaaaacccgaaaaagcccccaaatccctcatctacgacgcctcctccctccaatccggcgtcccctcccgcttctccggctccggctccggcaccgacttcaccctcaccatctcctccctccaacccgaaaacttcgccacctactactgccaacaatacaactcctaccccatcaccttcggccaaggcacccgcctcgaaatcaaa

SEQ ID NO: 53905 - RNA, 363 nt, synthetic construct
  misc_feature 1..363: note = derived and/or modified sequence opt11 from HuMab-153_HeavyChain_VDJ-Region
  source 1..363: mol_type = other RNA
caggtccagctcgtggaatcgggcgggggcgtggtccagcccgggcgctcgctcaggctctcgtgcgcggcctcaggctttacctttagcgattacgtgatccattgggtgcgccaggccccgggcaagggcctggaatgggtcacggtcataagctatgacgggagcaataaatattacgcggactcggtcaagggcaggttcacgatctcacgcgataactcgaaaaataccttgtacctgcaaatgaactcgctctcggccgaggacacggccatgtactattgcgcgcgcgggggcataaccgggaccacgggcgtgttcgattactggggccagggcacgctcgtgaccgtgagctcg

SEQ ID NO: 53906 - RNA, 321 nt, synthetic construct
  misc_feature 1..321: note = derived and/or modified sequence opt11 from HuMab-153_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgacgcctcctccctccaatccggcgtcccctcccgcttctccggctccggctacggcaccgacttctccctcaccatctcctccctccaacccgaagacttcgccatctactactgccaacaatacaaatcctaccccatcaccttcggccaaggcacccgcctcgaaatcaaa

SEQ ID NO: 53907 - RNA, 378 nt, synthetic construct
  misc_feature 1..378: note = derived and/or modified sequence opt11 from HuMab-159_HeavyChain_VDJ-Region
  source 1..378: mol_type = other RNA
gaagtccaactagtccaatccggcgccgaagtcaaaaaacccggcgaatccctcaaaatctcctgcaaaggctccggctacaacttcacctcctactggatcggctgggtccgccaaatgcccggcaaaggcctcgaatggatgggcatcatctaccccggcgactccgacacccgctactccccctccttccaaggccaagtcaccatctccgccgacaaatccatctccaccgcctacctccaatggtcatccctcaaagcctccgacaccgccatgtactactgcgcccgctggggcacctactacgacatcctcaccggctacttcaactggttcgacccctggggccaaggcaccctcgtcaccgtctcctca

SEQ ID NO: 53908 - RNA, 321 nt, synthetic construct
  misc_feature 1..321: note = derived and/or modified sequence opt11 from HuMab-159_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatactacatctacccctggaccttcggccaaggcaccaaagtcgaaatcaaa

SEQ ID NO: 53909 - RNA, 363 nt, synthetic construct
  misc_feature 1..363: note = derived and/or modified sequence opt11 from HuMab-160_HeavyChain_VDJ-Region
  source 1..363: mol_type = other RNA
caggtccagctcgtggaatcaggcgggggcgtggtccagcccgggcgctcgctaaggctctcatgcgcggcctcgggctttacctttagctcgcacgcgatgcattgggtgcgccaggccccgggcaagggcttggaatgggtcgcggccataagctatgacgggagcaataaatattacgcggactcggtcaagggcaggttcacgatctcgcgcgataactcgaaaaataccatgtacttgcaaatgaactcgctcagggccgaggacacggccatgtgctattgcgcgcgcggaagcataaccgggagcacgggcgtgttcgattactggggccagggcacgctcgtgaccgtgagctcg

SEQ ID NO: 53910 - RNA, 321 nt, synthetic construct
  misc_feature 1..321: note = derived and/or modified sequence opt11 from HuMab-160_LightChain_VJ-Region
  source 1..321: mol_type = other RNA
gacatccaaatgacccaatccccctcctccctctccgcctccgtcggcgaccgcgtcaccatcacctgccgcgcctcccaagacatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctaccccatcaccttcggccaaggcacccgcctcgaaatcaaa

SEQ ID NO: 53911 - RNA, 372 nt, synthetic construct
  misc_feature 1..372: note = derived and/or modified sequence opt11 from HuMab-162_HeavyChain_VDJ-Region
  source 1..372: mol_type = other RNA
gaagtgcaattgtgggagagcgggggcgggagcgtgcaaccgggcgggagcttgcgcctgagctgtgccgcgagcgggttcacgttctcgagctatggcatgagctgggtaaggcaagcgcccgggaaagggctcgagtgggtgagcgggatctcgggctcgggctatagcacgtactatgccgatagcgtgaaagggcgctttaccataagcagggacaatagcaagaacacgctctatctccagatgaatagcttgcgcgcggaagataccgcggtctattactgtgccaagggctattaccatggctcgggctcgtactatacctcattcgattactggggccagggcacgctcgtgaccgtgagctcg

SEQ ID NO: 53912 - RNA, 321 nt, synthetic construct
  misc_feature 1..321: note = derived and/or modified sequence opt11 from HuMab-162_LightChain_VJ-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctaccccctcaccttcggcggcggcaccaaagtcgaaatcaaa

SEQ ID NO: 53913 - RNA, 366 nt, synthetic construct
  misc_feature 1..366: note = derived and/or modified sequence opt11 from HuMab-163_HeavyChain_VDJ-Region
  source 1..366: mol_type = other RNA
gaggtccagctcgtgcaatcgggcgcggaagtgaaaaagcccggggaatcgctcaagatctcgtgccagggctcgggctatcgcttcatctcgtactggatcgggtgggtgcgccagatgccgggcaagggcttggaatggatggggcgcatatacccgggcgatagcgataccaggtactcgccctcattccagggccaggtcacgatctcggtcgataaatcgatctcgaccgcgtacttgcaatggagctcgctcaaggcctcggacacggccatgtactattgcgcgcgccagcgcggggactattactatttcaatggcttggacgtgtgggggcaagggaccacggtcacggtctcgagc

SEQ ID NO: 53914 - RNA, 321 nt, synthetic construct
  misc_feature 1..321: note = derived and/or modified sequence opt11 from HuMab-163_LightChain_VJ-Region
  source 1..321: mol_type = other RNA
gagatcgtgctcacgcaatcgcccgggaccttgagcttgagcccgggcgagcgcgcgaccttgagctgtcgcgcgagccagagcgtgagctcgagctatctagcgtggtatcaacagaaaccgggccaggccccgcgcttgctcatatacggagcctcgagcagggccacgggcatacccgatcgctttagcgggagcgggagcgggaccgatttcacgctcacgatctcgcgcttggaaccggaagatttcgcggtctattactgtcaacagtacggaagctcgctcacgttcgggggcgggaccaaggtcgagatcaag

SEQ ID NO: 53915 - RNA, 363 nt, synthetic construct
  misc_feature 1..363: note = derived and/or modified sequence opt11 from HuMab-166_HeavyChain_VDJ-Region
  source 1..363: mol_type = other RNA
caggtccagctcgtggaatcgggcgggggcgtggtccagcccgggcgctcgctcaggctctcgtgcgcggcctcgggctttacctttagctcgtacgcgatgcattgggtgcgccaggccccgggcaagggcctggaatgggtcgcggtcataagctatgacgggagcaatgaatattacgcggactcggtcaagggcaggttcacgatctcgcgcgataactcgaaaaataccttgtacttgcaaatgaactcgctcagggccgaggacacggccgtgtactattgcgcgcgagggagcataatcgggagcacgggcgtattcgattactggggccagggcacgctagtgaccgtgagctcg

SEQ ID NO: 53916 - RNA, 321 nt, synthetic construct
  misc_feature 1..321: note = derived and/or modified sequence opt11 from HuMab-166_LightChain_VJ-Region
  source 1..321: mol_type = other RNA
gacatccaaatgacccaatccccctcctccctctccgcctccgtcggcgaccgcgtcaccatcacctgccgcgcctcccaaggcatctccaactggctcgcctggtaccaacaaaaacccgaaaaagcccccaaatccctcatctacgacgcctcctccctccaatccggcgtcccctcccgcttctccggctccggctccggcaccgacttcaccctcaccatctcctccctccaacccgaagacttcgccacctactactgccaacaatacaactcctaccccatcaccttcggccaaggaacccgcctcgaaatcaaa

SEQ ID NO: 53917 - RNA, 363 nt, synthetic construct
  misc_feature 1..363: note = derived and/or modified sequence opt11 from HuMab-167_HeavyChain_VDJ-Region
  source 1..363: mol_type = other RNA
caagtgcaattggtcgagagcgggggcggggtcgtgcaaccgggcaggagcttgcgcttgagctgtgccgcgagcgggttcacgttctcgagctatgccatacactgggtcaggcaagcgcccggaaaagggctcgagtgggtggccgtgatctcgtacgatggctcgaacaagtactatgccgatagcgtgaaagggcgctttaccataagcagggacaatagcaagaacacgctctatctacagatgaatagcctgcgcgcggaagataccgcggtctattactgtgccaggggctcgatcacgggctcgaccggggtctttgactattgggggcaagggaccttggtaacggtctcgagc

SEQ ID NO: 53918 - RNA, 363 nt, synthetic construct
  misc_feature 1..363: note = derived and/or modified sequence opt11 from HuMab-169_HeavyChain_VDJ-Region
  source 1..363: mol_type = other RNA
caagtgcaattggtccagagcggagccgaggtcaagaaaccgggcgcgagcgtgaaagtgagctgtaaagcgagcgggtacacgttcacgaactatggaataagctgggtcaggcaagcgcccgggcaagggctcgagtggatgggctggctctcggcctatagcgggaacacgatctatgcacagaaattgcaagggcgcgtgaccatgacaacggacacgagcacgaccacggcctatatggagctcaggagcttgcgctcggacgataccgcggtctattactgtgccagggacaggatcgtggtcaggcccgattactttgactattgggggcaagggaccctggtcacagtctcaagc

SEQ ID NO: 53919 - RNA, 321 nt, synthetic construct
  misc_feature 1..321: note = derived and/or modified sequence opt11 from HuMab-169_LightChain_VJ-Region
  source 1..321: mol_type = other RNA
gaaatcgtcctcacccaatcccccgccaccctctccctatcccccggcgaacgcgccaccctctcctgccgcgcctcccaatccgtctcctcctacctcgcctggtaccaacaaaaacccggccaagccccccgcctcctcatctacgacgcctccaaccgcgccaccggcatccccgcccgcttctccggctcaggctccggcaccgacttcaccctcaccatctcctccctcgaacccgaagacttcgccgtctactactgccaacaacgctccaactggccccgcaccttcggccaaggcaccaaagtcgaaatcaaa

SEQ ID NO: 53920 - RNA, 366 nt, synthetic construct
  misc_feature 1..366: note = derived and/or modified sequence opt11 from HuMab-7D8_HeavyChain_VH-Region
  source 1..366: mol_type = other RNA
gaggtccagctcgtggaatcaggcgggggcttggtccagccagatcgctcgctaaggctctcgtgcgcggcctcgggctttacctttcacgattacgcgatgcattgggtgcgccaggccccgggcaagggcttggaatgggtctcgaccataagctggaactcgggcacgatcgggtacgcggactcggtcaagggaaggttcacgatctcgcgagataacgcgaaaaatagcttgtacttgcaaatgaactcgctcagggccgaggacacagccttgtactattgcgcgaaagatatccagtacgggaactattactatggcatggacgtgtgggggcaagggaccacggtcacggtctcgagc

SEQ ID NO: 53921 - RNA, 366 nt, synthetic construct
  misc_feature 1..366: note = derived and/or modified sequence opt11 from HuMab-7D8_HeavyChain_V-Region
  source 1..366: mol_type = other RNA
gaggtccagctcgtggaatcgggcgggggcttggtccagcccgatcgctcgctcaggctctcgtgcgcggcctcgggctttacctttcacgattacgcgatgcattgggtgcgccaggccccgggcaagggcttggaatgggtctcgaccataagctggaactcgggcacgatcgggtacgcggactcagtcaagggcaggttcacgatctcgcgcgataacgcgaaaaatagcttgtacttgcaaatgaactcgctcagggccgaggacacggccctgtactattgcgcgaaagatatccagtacgggaactattactatggcatggacgtgtgggggcaagggaccacggtcacggtctcaagc

SEQ ID NO: 53922 - RNA, 321 nt, synthetic construct
  misc_feature 1..321: note = derived and/or modified sequence opt11 from HuMab-7D8_LightChain_VL-Region
  source 1..321: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctcctcatctacgacgcctccaaccgcgccaccggcatccccgcccgcttctccggctccggctcaggcaccgacttcaccctcaccatctcctccctcgaacccgaagacttcgccgtctactactgccaacaacgctccaactggcccatcaccttcggccaaggcacccgcctcgaaatcaaa

SEQ ID NO: 53923 - RNA, 321 nt, synthetic construct
  misc_feature 1..321: note = derived and/or modified sequence opt11 from HuMab-7D8_LightChain_V-Region
  source 1..321: mol_type = other RNA
gaaatcgtcctcacccaatcccccgccaccctctccctctcccccggcgaacgcgccaccctctcctgccgcgcctcccaatccgtctcctcctacctcgcctggtaccaacaaaaacccggccaagccccccgcctcctaatctacgacgcctccaaccgcgccaccggcatccccgcccgcttctccggctccggctccggcaccgacttcaccctaaccatctcctccctcgaacccgaagacttcgccgtctactactgccaacaacgctccaactggcccatcaccttcggccaaggcacccgcctcgaaatcaaa

SEQ ID NO: 53924 - RNA, 324 nt, synthetic construct
  misc_feature 1..324: note = derived and/or modified sequence opt11 from huMAb-anti-MSP10.1_LightChain_VJ-Region
  source 1..324: mol_type = other RNA
gaaatcgtcctcacccaatcccccgacatcctctccctctccccaggcgaacgcgccaccctctcctgccgcgcctcccaagccctcaccgccaaatacctcgcctggtaccaacaaaaacccggccaagtcccccgcctcctcatctacggctcctccacccgcgccaccggcatccccgaccgcttccgcggctccggctccggcaccgacttcaccctcaccatctcccgcctcgaacccgccgactccgccgtctactactgccaacaatacgaagactccccctggaccttcggccaaggcaccaaactcgaaatcaaa

SEQ ID NO: 53925 - RNA, 324 nt, synthetic construct
  misc_feature 1..324: note = derived and/or modified sequence opt11 from huMAb-anti-MSP10.2_LightChain_VJ-Region
  source 1..324: mol_type = other RNA
gaaatcgtcctcacccaatcccccgacaccctctccctctcccccggcgaaaccgccaccctctcctgccgcgcctcccaaaccgtccgccgcaactccctcgcctggtaccaacaaaaacccggccaagccccccgcctcctcatctacggcgcctccgaccgcgccaccggcatccccgaccgattctccggctccggcttcggcaccgacttcaccctcaccgtctccggcctcgaacccgaagacttcgccgtctactactgccaacaatacggcacctccccccgcaccttcggccaaggcaccaaactcgaaatcaaa

SEQ ID NO: 53926 - RNA, 324 nt, synthetic construct
  misc_feature 1..324: note = derived and/or modified sequence opt11 from HUMAB-Clone_18_VJ-Region
  source 1..324: mol_type = other RNA
gaaatcgtcctcacccaatcccccgccaccctctccctctcccccggcgaacgcgccacactctcctgccgcgcctcccaatccgtctcctcctacctcgcctggtaccaacaaaaacccggccaagccccccgcctcctcatctacgacgcctcaaaacgcgccaccggcatccccgcccgcttctccggctccggctccggcaccgacttcaccctcaccatctcctccctcgaacccgaagacttcgccgtctactactgccaacaacgctccaaatggcccccctggaccttcggccaaggcaccaaagtcgaatccaaa

SEQ ID NO: 53927 - RNA, 324 nt, synthetic construct
  misc_feature 1..324: note = derived and/or modified sequence opt11 from HUMAB-Clone_22_VJ-Region
  source 1..324: mol_type = other RNA
gaaatcgtcctaacccaatcccccgccaccctctccctctcccccggcgaacgcgccaccctctcctgccgcgcctcccaatccgtctcctcctacctcgcctggtaccaacaaaaacccggccaagccccccgcctcctcatctacgacgcctccaaccgagccaccggcatccccgcccgcttctcaggctccggctccggcaccgacttcaccctcaccatctcctccctcgaacccgaagacttcgccgtctactactgccaacaacgctccaaatggcccccctggaccttcggccaaggcaccaaagtcgaaatcaaa

SEQ ID NO: 53928 - RNA, 432 nt, synthetic construct
  misc_feature 1..432: note = derived and/or modified sequence opt11 from HuMab-L612_Chain_VDJ-Region_Precursor
  source 1..432: mol_type = other RNA
atggagttcgggctaacgtggctgttcttggtcgcgaacttgaaaggggtacagtgcgaggtccagctcttggactcgggcgggggcttggtccagcccgggggctgtctcaggctatcgtgcgcggcctcgggctttacctttagctcgtgcgcgatgtcgtgggtgcgccaggccccgggaaagggcttggaatgggtctcggccataagcgggagcgggggctcgacctattacgcggactcggtcaagggcaggttcacgatctcgcgcgataaatcgaaaaataccttgtacttgcaaatgaactcgctcagggccgaggacacggcagtgtactattgcgcgaaagggggcaatgacatactcacgggctattacgcgtgggggcaagggaccctggtcacggtctcgagcgggagcgcgagcgcg

SEQ ID NO: 53929 - RNA, 321 nt, synthetic construct
  misc_feature 1..321: note = derived and/or modified sequence opt11 from HuMab_LC5002-002_LightChain_V-Region
  source 1..321: mol_type = other RNA
gacatccaaatgacccaatccccctcctccctctccgcctccgtcggcgaccgcgtcaccatcacctgccgcgcctcccaaggcatctcccgctgggtcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctacccctggaccttcggccaaggcaccaaagtcgaaatcaaa

SEQ ID NO: 53930 - RNA, 357 nt, synthetic construct
  misc_feature 1..357: note = derived and/or modified sequence opt11 from HuMab_LC5002-002_gamma1-Chain_V-Region
  source 1..357: mol_type = other RNA
gaagtgcaattgctcgagagcgggggcgggctcgtgcaaccgggcgggagcttgcgcttgagctgtgccgcgagcgggttcacgttcaatatatatgccatgaactgggtcaggcaagcacccgggaaagggctcgagtgggtgagcgtgatctcgggcaggggcataaccacgtactatgccgatagcgtgaaagggcgctttaccataagcagggacaatagcaagaacacgctctatctccagatgaatagcttgcgcgcggacgataccgcggtctattactgtgccaagggctcgagctcgtggacggactttgactattgggggcaagggaccttggtcacggtctcgagc

SEQ ID NO: 53931 - RNA, 321 nt, synthetic construct
  misc_feature 1..321: note = derived and/or modified sequence opt11 from HuMab_LC5002-003_LightChain_V-Region
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctaatctacgccgcctcctccctccaatccggcgtcccctcccgcttctccggctccggctccggcaccgacttcaccctcaccatctcctccctccaacccgaagacttcgccacctactactgccaacaatacaactcctacccctggaccttcggacaaggcaccaaagtcgaaatcaaa

SEQ ID NO: 53932 - RNA, 357 nt, synthetic construct
  misc_feature 1..357: note = derived and/or modified sequence opt11 from HuMab_LC5002-003_gamma1-Chain_V-Region
  source 1..357: mol_type = other RNA
gaggtccagctcttggaatcgggcggggacttgatccagcccgggggctcgctcaggctctcgtgcgcggcctcgggctttacctttaacatatacgcgatgaattgggtgcgccaggccccgggcaagggcttggaatgggtatcggtcataagcgggcgcgggatcacgacctattacgcggactcggtcaagggcaggttcacgatctcgcgcgataactcgaaaaataccttgtacttgcaaatggactcgctcagggccgaggacacggccgtgtactattgcgcgaaagggagctcgtactggaccgatttcgattactggggccagggaacgctcgtgaccgtgagctcg

SEQ ID NO: 53933 - RNA, 321 nt, synthetic construct
  misc_feature 1..321: note = derived and/or modified sequence opt11 from HuMab_LC5002-005_LightChain_V-Region
  source 1..321: mol_type = other RNA
gacatccaaatgacccaatccccctcctcactctccgcatccgtcggcgaccgcgtcaccatcacctgccgcgcctcccaaggcatctcctcctggctcgcctggtaccaacaaaaacccgaaaaagcccccaaatccctcatctacgccgcctcctcactccaatccggcgtcccctcccgcttctccggctccggctccggcaccgacttcaccctcaccatctcctccctccaacccgaagacttcgccacctactactgccaacaatacaactcccacccccccaccttcggccaaggcaccaaactcgaaatcaaa

SEQ ID NO: 53934 - RNA, 354 nt, synthetic construct
  misc_feature 1..354: note = derived and/or modified sequence opt11 from HuMab_LC5002-005_gamma1-Chain_V-Region
  source 1..354: mol_type = other RNA
gaagtgcaagtgctcgatagcgggggcgggctcgtgcaaccgggcgggagcttgcgcttgagctgtaccgcgagcgggttcacgttcaggctctataccatgagctgggtcaggcaaacgcccgggcgagggctcgagtgggtgagcgggatctcgggctcgggcttgagcacgtactttgccgatagcgtgaaagggcgatttaccataagcagggacaatagcaagaacacggtctatctccagatgaatagcttgcgcgcggaagataccgcggtctattactgtgccaaggaaggggactggatctatttcgatagctggggccagggcacgctcgtgatcgtgagctcg

SEQ ID NO: 53935 - RNA, 321 nt, synthetic construct
  misc_feature 1..321: note = derived and/or modified sequence opt11 from HuMab_LC5002-007_LightChain_V-Region
  source 1..321: mol_type = other RNA
gaaatcgtcctcacacaatcccccggcaccctctccctctcccccggcgaacgcgccaccctctcctgccgcgcctcccaatccgtctcctcctcctacctcgcctggtaccaacaaaaacccggccaagcaccccgcctcctcatctacggcgcctcctcccgcgccatcggcatccccgaccgcttctccggctccggctccggcaccgacttcaccctcaccatctcacgcctcgaacccgaagacttcgccgtctactactgccaacactacggctcctccctcaccttcggcggcggcaccaaagtcgaaatcaaa

SEQ ID NO: 53936 - RNA, 369 nt, synthetic construct
  misc_feature 1..369: note = derived and/or modified sequence opt11 from HuMab_LC5002-007__gamma1-Chain_V-Region
  source 1..369: mol_type = other RNA
caagtgcaattggtccagagcggggccgaggtcaagaaaccgggctcgagcgtgaaagtgagctgtaaagtgagcgggggcacgttctcgagctatgcctttagctgggtcaggcaagcgcccgggcaagggctagagtggatgggcaggataataccaatactcgggcgaacgaactatgcccagaaatttcaagggcgcgtgaccataaccgcggacaagagcacgagcacggcctatatggaggtctcgagcttgagatcggaagataccgcggtctattactgtgccagggaaggggaaacgctcgattacttttactatggcatggacgtgtgggggcaagggaccacggtcacggtctcgagc

SEQ ID NO: 53937 - RNA, 357 nt, synthetic construct
  misc_feature 1..357: note = derived and/or modified sequence opt11 from HuMab_LC5002-018_gamma1-Chain_V-Region
  source 1..357: mol_type = other RNA
gaggtccagctcttggaatcgggcgggggcttggtccagcccgggggctcgctcaggctctcgtgcgcggcctcgggctttacctttaacatatacgcgatgaattgggtgcgccaggccccgggcaagggcttggaatgggtctcggtaataagcgggagcggggtcacgacctattacgcggactcggtcaagggcaggttcacgatctcgcgcgataactcgaaaaataccttgtacctgcaaatgaactcgctaagggccgaggacacggccgtgtactattgcgcgaaagggagctcgtggtatgtcgatttcgattactggggccagggcacgctcgtgaccgtgagctcg

SEQ ID NO: 53938 - RNA, 1347 nt, synthetic construct
  misc_feature 1..1347: note = derived and/or modified sequence opt11 from Ibalizumab_HeavyChain1
  source 1..1347: mol_type = other RNA
caagtccaactccaacaatctggacccgaagtcgtaaaaccaggcgcgtccgtaaaaatgagctgcaaagcaagcggctacaccttcaccagctacgtcatccattgggtccgccaaaaacccggccaaggcctagactggattggctacatcaatccatacaacgacggaaccgactacgacgaaaaattcaaaggcaaagccaccctgacatccgacacatcaacctcaaccgcctacatggaactctcctccctccgatccgaagacacagcagtctactactgcgcccgtgaaaaagacaactacgccaccggagcctggttcgcctattggggacagggaaccctcgtcaccgtatcctccgcctctaccaagggtccgtcagtattcccactcgccccctgcagcagatccacctccgaatccaccgccgccctcggttgcctcgtaaaagactacttccccgagcccgtcaccgtctcatggaacagcggcgcactcacctcaggcgtacacaccttccccgccgtccttcaatcaagtggcctctactcactctcctcagtcgtcaccgtcccatcctcctccctaggcaccaaaacctatacctgcaacgtcgaccataaaccatcaaacaccaaagtagacaagcgagtcgaatccaaatacgggcccccatgcccctcctgccccgcccccgagtttctcggcggcccatcagtcttcctattcccacccaaacccaaagacaccctcatgatctcacgaacccccgaagtaacctgcgtcgtcgtagacgtctcccaagaagaccccgaagtccaattcaactggtacgtagacggtgtagaagtacacaacgctaaaacaaaaccccgcgaagaacaattcaactcaacctaccgagttgtatccgtcttaaccgtactccaccaagactggctcaacggcaaagaatacaaatgcaaagtctccaacaaaggcctaccctcctccatagagaaaaccatctccaaagccaaaggccaaccccgcgaaccccaagtctacaccctcccaccctcccaagaagaaatgaccaaaaaccaagtatccctgacctgcctagtcaaaggtttttacccctccgacatcgccgtcgaatgggaaagcaacggccaaccagaaaacaactacaaaaccacacctcccgtcctcgactcagacggctccttcttcctatactcacgactcaccgtcgacaagagccgatggcaagaaggcaacgtcttctcttgctctgtaatgcatgaagccctacacaaccactacacacagaaaagcctaagcctcagcttaggaaaa

SEQ ID NO: 53939 - RNA, 657 nt, synthetic construct
  misc_feature 1..657: note = derived and/or modified sequence opt11 from Ibalizumab_LightChain1
  source 1..657: mol_type = other RNA
gacatcgtcatgacccaatcacccgactccctcgccgtctcactcggcgaacgcgtcaccatgaactgcaaatcatcccaatccctcctatattccaccaatcagaaaaactacctagcatggtaccaacaaaaaccaggccaatcccccaaactcctcatctactgggcctcaacccgagaatccggcgtccccgaccgcttctccggctccggctccggcaccgacttcaccctcaccatctcgtccgtacaagccgaagacgtcgccgtctactactgccaacaatactactcctaccgcaccttcggcggcggcaccaaactcgaaatcaaacgcacagtcgccgcaccaagcgtcttcatattcccaccctctgacgaacaactcaaatccggcaccgcctccgtcgtctgcctcctcaacaacttctacccccgcgaagccaaagtccaatggaaagtcgacaacgccctccaatcaggaaactcccaagaaagcgtcaccgaacaagactcaaaagactcaacctactccctatcctcaaccctcaccctctccaaagccgactacgaaaaacacaaagtctacgcctgcgaagtcacccaccaaggcctctcctcccccgtcaccaaatccttcaaccgaggcgaatgc

SEQ ID NO: 53940 - RNA, 1329 nt, synthetic construct
  misc_feature 1..1329: note = derived and/or modified sequence opt11 from Ibritumomab_tiuxetan_HeavyChain
  source 1..1329: mol_type = other RNA
caagcctacctacaacaatccggcgcagaactcgtgcgacccggcgcctccgtcaaaatgtcctgcaaagcctcaggctacaccttcacctcctacaacatgcactgggtcaaacaaacaccccgccaaggcctcgaatggatcggcgccatataccccggcaacggagacacctcctacaatcaaaaattcaaaggcaaagccaccctaaccgtcgacaaatcctcctccaccgcctacatgcaactatcatctctaacctccgaagacagcgcagtctacttctgcgccagagtcgtctactactccaattcctactggtacttcgacgtctggggcaccggaaccaccgtcaccgtctccgccccctccgtctacccactagcccctgtctgcggcgacaccacaggctcgtccgtaaccctaggctgcctagtcaaaggctacttcccagaacctgtcacactaacctggaactcgggctcactctccagcggcgtccacaccttccccgccgtcctccaatctgacctgtacaccctttcgtcttcagtcacagtaacttcctcaacctggccctcccaaagcataacctgtaacgtagcacacccagcctcctccaccaaagtagacaagaaaatcgaaccacgcggccccactatcaaaccatgcccaccctgcaaatgccccgcacccaatctcctcggaggtccctcagtcttcatattcccacccaaaatcaaagatgtactcatgatcagcctatcccccatcgttacctgcgtcgtcgtggacgtctcagaagacgaccccgacgtccaaatctcctggttcgtcaacaacgtagaagtccacaccgcccaaactcagacccaccgcgaagactacaactcaacccttcgcgtagtatcggccctgcccatacaacaccaagactggatgtcaggcaaagaatttaaatgcaaagtcaacaataaagacctccccgcacccatcgaacgaactatctctaaacccaaaggctcagtccgagcaccccaagtctacgtcctgcccccacccgaagaagaaatgaccaagaaacaagtaactctaacctgcatggtcaccgacttcatgccagaagacatttacgtagaatggacaaacaacggaaaaaccgaactcaactacaaaaacaccgaacctgtcctcgacagcgacggatcatacttcatgtacagcaaactccgagtcgaaaagaaaaactgggtcgaaagaaactcctacagctgctctgtagtccacgaaggcctccacaaccaccacacaactaaatccttctcacga

SEQ ID NO: 53941 - RNA, 627 nt, synthetic construct
  misc_feature 1..627: note = derived and/or modified sequence opt11 from Ibritumomab_tiuxetan_LightChain
  source 1..627: mol_type = other RNA
caaatcgtcctatcccaatcccccgccatcctctccgcctcccccggcgaaaaagtcaccatgacctgccgcgcctcctcctccgtctcatacatgcactggtaccaacaaaaacccggctcatcccccaaaccctggatctacgccccctccaacctcgcctccggcgtccccgcccgcttctccggctccggctccggcacatcctactccctcaccatctcccgagtcgaagccgaagacgccgccacatactactgccaacaatggtcattcaacccccccaccttcggcgccggcaccaaactcgaactcaaacgcgccgacgccgcacccaccgtcttcatcttccccccctcagacgaacaactcaaatccggcaccgcctctgtcgtctgcctcctcaacaatttctacccccgcgaagccaaagtacaatggaaagtcgacaacgccctccaatccggcaactcccaagaatccgtcaccgaacaagactccaaagactcaacctactcactatcctccaccctcaccctctccaaagcagactacgaaaaacacaaagtctacgcctgcgaagtcacacaccaaggcctatcctcccccgtaaccaaatccttcaac

SEQ ID NO: 53942 - RNA, 1368 nt, synthetic construct
  misc_feature 1..1368: note = derived and/or modified sequence opt11 from Icrucumab_HeavyChain1
  source 1..1368: mol_type = other RNA
caagcccaagtcgtcgaatccggcggcggcgtcgtccaatcaggacgcagcctccgcctatcctgcgccgcatccggcttcgcattctcatcatacggcatgcactgggtccgacaagcccccggaaaaggcctagaatgggtagccgtaatctggtacgacggatctaacaagtactatgcagactctgtacgcggccgctttacaatctcccgcgacaactctgaaaacaccctctacctccaaatgaactccctccgcgccgaagacaccgcagtttactactgcgcacgcgaccactacggctcaggagtccaccactacttctactacggacttgacgtctggggacaaggaacaaccgtcaccgtatcctccgcaagcaccaaaggcccctcagtcttccccctggctccctcttccaaaagtacctccgggggcaccgccgcactcggctgcctagtaaaagattacttccccgaacccgtcaccgtctcctggaactccggtgccctcacctccggggtacacacattccccgccgtcctccaatcctccggcctctactccctttcctctgtcgtaaccgtcccatcctcctccctcggcacccagacttacatctgcaacgtcaaccataaaccctcaaacaccaaagtcgacaaacgcgtcgaacccaaatcgtgcgacaaaacacatacctgtcccccatgcccagccccagaactcctaggcggcccatccgtcttcctcttcccacccaaacccaaagacaccctcatgatctcccgcacaccagaagtaacctgcgttgtcgtcgacgtctcacacgaagacccagaagtcaaattcaactggtacgtcgacggcgtagaagtacacaacgccaaaacaaaaccccgtgaagaacaatacaacagcacataccgagtcgtatctgtcctaaccgtcctccaccaagactggctcaacggcaaagaatacaaatgcaaagtctccaacaaagcccttcccgcacccatcgagaaaaccatctccaaagccaagggacaacccagagaaccccaagtctacaccctccctcccagccgcgaagaaatgaccaaaaaccaagtctccctcacatgcctagtaaaaggcttctacccctccgacatcgcagtcgaatgggaatccaacggccagcccgaaaacaactacaaaaccacaccacccgtcctcgactccgacggatccttcttcctatactcaaaactcacagtcgacaaatcccgatggcaacaaggcaacgtattcagctgctccgtaatgcacgaagcactacacaaccactacacccaaaaatccctctccctatcccccggaaaa

SEQ ID NO: 53943 - RNA, 645 nt, synthetic construct
  misc_feature 1..645: note = derived and/or modified sequence opt11 from Icrucumab_LightChain1
  source 1..645: mol_type = other RNA
gaaatcgtcctcacccaaagccccggaacactatcactctcacccggcgaacgcgccacactctcctgccgcgcctcccaatccgtctcctcctcctacctagcctggtaccaacaaaaacccggccaagccccccgcctcctcatctacggcgcctcctcccgcgccaccggcatccccgaccgcttctcaggctccggctccggcaccgacttcaccctaaccatctcacgcctcgaacccgaagacttcgccgtctactactgccaacaatacggctcctcccccctcaccttcggcggcggcaccaaagtagaaataaaacgcacagtcgccgccccctcagtcttcatcttccccccctcagacgaacaactaaaatccggcacagcctccgtagtctgcctactcaacaacttctacccccgcgaagccaaagtccaatggaaggtcgacaacgccctccaatcaggcaactcacaagaatcagtcaccgaacaagactccaaagactcaacctactccctctcatccaccctaacactctccaaagccgactacgaaaagcacaaagtctacgcctgcgaagtcacccaccaaggcctctcctcccccgtcacaaaatccttcaaccgaggagaatgc

SEQ ID NO: 53944 - RNA, 675 nt, synthetic construct
  misc_feature 1..675: note = derived and/or modified sequence opt11 from Idarucizumab_HeavyChain1
  source 1..675: mol_type = other RNA
caagtccaacttcaagaatccggccccggcctcgtcaaaccatccgaaaccctatccctcacctgcacagtctccggcttctccctaacctcctacatcgtcgactggatccgacaaccacccggcaaaggcctcgaatggatcggcgtcatctgggccggcggctcaaccggctacaactccgcccttcgatcccgcgtatccatcactaaagacacctccaaaaaccaattctccctcaaactctcctcagtcaccgcagccgacaccgccgtctactactgcgccagcgcagcctactactcctactacaactacgacggcttcgcctactggggccaaggcacactcgtcaccgtctcctccgcctccaccaaaggcccctccgtcttccccctcgccccctcctcaaaatccacatccggcggcaccgccgccctcggctgcctcgtcaaagactacttccccgaacccgtcaccgtctcctggaactccggcgccctcacctccggcgtccacaccttcccagccgtcctccaatcctctggcctctactccctctcctccgtcgttacagtcccctcatcatctctcggcacccaaacatacatatgcaacgtcaaccacaaaccctccaacaccaaagtcgacaaaaaagtcgaacccaaatcctgc

SEQ ID NO: 53945 - RNA, 657 nt, synthetic construct
  misc_feature 1..657: note = derived and/or modified sequence opt11 from Idarucizumab_LightChain1
  source 1..657: mol_type = other RNA
gacgtcgtcatgacccaaagccccctctcactccccgtcacactcggacaacccgcctcaatctcatgcaaatcctcccaatccctcctatataccgacggcaaaacctacctctactggttcctacaacgccccggccaatccccacgccgcctcatctacctcgtctccaaactcgactccggcgtccccgaccgattctcaggctccggctccggcaccgacttcaccctcaaaatctcacgagtcgaagccgaagacgtcggcgtctactactgcctccaatccacccacttcccacacacattcggcggcggcaccaaagtcgaaatcaaacgcacagtcgccgccccatccgtattcatcttcccaccctcagacgaacaactcaaatcaggcaccgcctccgtcgtctgcctactcaacaacttctacccccgcgaagccaaagtccaatggaaagtcgacaacgccctccaaagcggcaactcccaagagagcgtcaccgaacaagactccaaagactcaacctactccctctcctccaccctcaccctctccaaagccgactacgaaaaacacaaagtatacgcatgcgaagtcacacaccaaggcctctcctcccccgtcaccaaatccttcaaccgaggcgaatgc

SEQ ID NO: 53946 - RNA, 1332 nt, synthetic construct
  misc_feature 1..1332: note = derived and/or modified sequence opt11 from Igatuzuab_HeavyChain1
  source 1..1332: mol_type = other RNA
caagtacaactcgtccaatcaggcgccgaagtcaagaaacccggcagctccgtcaaagtatcctgcaaagcctcaggattcaccttcaccgactacaaaatccactgggtccgacaagcccccggccaaggcctcgaatggggctacttcaaccccaatagcggctacagcacctacgcccagaaattccaaggccgcgtcacaatcaccgccgacaaatccacctcaaccgcctacgaactcagctccctccgatccgaagacacagcagtatactactgcgcacgcttatccccaggcggctattacgtcgatgcctggggacaaggcaccacagtcaccgtctcctccgcctcgactaaaggcccctccgtcttccccctagccccctcctcaaaatccacctccggaggcaccgcagccctagggtgcctcgtaaaagactacttcccagaacccgtcacagtctcctggaactccggagccctcacctcaggtgtccacaccttcccagccgtactacaaagctcagggctctactctctctcgtccgtagtcactgtgccttcatcctcactcggcacgcaaacatacatctgcaatgtcaatcacaaaccctccaacaccaaagtcgacaagaaagtcgaacccaaaagttgcgataaaacacatacctgcccaccctgccccgccccagaactcctaggcggacccagcgtcttcctcttcccaccgaaacccaaagacacactcatctcacgcacccctgaagtaacctgcgtcgtcgtcgacgtatcccacgaggacccagaagtcaaatttaactggtacgtagacggcgtcgaagtccacaacgcaaaaaccaaaccccgcgaagaacaatacaactccacctaccgagtagtctccgtcctcaccgtcctccaccaagactggctcaacggcaaagaatacaaatgcaaagtctccaacaaagcactccccgcacccattgagaaaaccatatcaaaagcaaaaggacaaccccgcgaaccccaagtgtacaccctcccaccctcacgcgacgaactcaccaaaaaccaagtctccctaacctgcctcgtcaaaggcttctacccaagcgacatcgccgtcgaatgggaatccaacggccaaccagaaaacaactataaaacaacaccacccgtactcgactctgacggctcattcttcctctactccaaactgaccgtcgacaagtcccggtggcaacaaggcaacgtcttctcctgctccgtacacgaagcacttcacaaccattacacccaaaaatccctctccctatcccccggc

SEQ ID NO: 53947 - RNA, 636 nt, synthetic construct
  misc_feature 1..636: note = derived and/or modified sequence opt11 from Igatuzuab_LightChain1
  source 1..636: mol_type = other RNA
gacatccaaacccaatcaccctcctccctctccgcctccgtcggagaccgcgtcaccatcacctgccgcgcctcccaaggcatcaacaactacctcaactggtaccaacaaaaacccggcaaagcccccaaacgcctcatctacaacaccaacaacctccaaaccggcgtcccctcccgattctccggctccggatcaggcaccgaattcaccctcacaatctcctccctccaacccgaagacttcgccacctactactgcctccaacacaactccttccccaccttcggtcaaggaaccaaactcgaaatcaaacgcaccgtcgcagccccctccgtcttcatcttccccccctccgacgaacaactcaaatcaggcaccgcctccgtcgtatgcctactcaacaacttctacccccgcgaagccaaagtccaatggaaagtcgacaacgccctccaatccggcaactctcaagaatccgtaaccgaacaagactctaaagactccacctactccctctcctccaccctaaccctctccaaagccgactacgaaaaacacaaagtctacgcctgcgaagtcacccaccaaggcctctcctccccagtaaccaaatccttcaaccgaggcgaatgc

SEQ ID NO: 53948 - RNA, 357 nt, synthetic construct
  misc_feature 1..357: note = derived and/or modified sequence opt11 from IGF-IR_HUMAB-1A_HeavyChain
  source 1..357: mol_type = other RNA
gaagtgcaattggtccagagcgggggagggctcgtgcacccgggcgggagcttgcgcttgagctgtgccgggagcgggttcacgttcaggaactatgccatgtactgggtcaggcaagcgcccgggaaagggctcgagtgggtgagcgcgatcgggagcgggggcgggacctattacgcggactcggtcaagggcaggttcacgatctcgcgcgataacgcgaaaaatagcttgtacttgcaaatgaactcgctcagggccgaggacatggccgtgtactattgcgcgcgcgcgcccaattgggggagcgatgcctttgacatatgggggcaagggaccatggtcacggtctcgagc

SEQ ID NO: 53949 - RNA, 357 nt, synthetic construct
  misc_feature 1..357: note = derived and/or modified sequence opt11 from IGF-IR_HUMAB-23_HeavyChain
  source 1..357: mol_type = other RNA
gaagtgcaattggtccagagcgggggcgggctcgtgcacccgggcgggagcttgcgcttgagctgtgccgggagcgggttcacgttctcgaactatgccatgtactgggtcaggcaagcgcccgggaaagggctcgagtgggtgagcgcgatcgggagcgggggcgggacctattacgcggactcggtcaagggcaggttcacgatctcgcgcgataacgcgaaaaatagcttgtacttgcaaatgaactcgctaagggccgaggacatggccgtgtaccattgcgcgcgagcgcccaattgggggagcgaggcctttgacatatgggggcaagggaccatggtcacggtctcgagc

SEQ ID NO: 53950 - RNA, 321 nt, synthetic construct
  misc_feature 1..321: note = derived and/or modified sequence opt11 from IGF-IR_HUMAB-23_LightChain
  source 1..321: mol_type = other RNA
gacatccaaatgacccaatccccctcatccctctccgcctccgtcggcgaccgcgtcaccataacctgccgcgcctcccaaggcatctcatcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctaccccatcaccttcggccaaggcacccgcctcgaaatcaaa

SEQ ID NO: 53951 - RNA, 357 nt, synthetic construct
  misc_feature 1..357: note = derived and/or modified sequence opt11 from IGF-IR_HUMAB-8_HeavyChain
  source 1..357: mol_type = other RNA
gaagtgcaattggtccagagcgggggcgggctcgtgcacccgggcgggagcttgcgcttgagctgtgccgggagcgggttcacgttcaggagctatgccatgtactgggtcaggcaagcgcccgggaaagggctcgagtgggtgagcgcgatcgggagcgggggcgggacctattacgcggactcggtaaagggcaggttcacgatctcgcgcgataacgcgaaaaatagcttgtacttgcaaatgaactcgctcagggccgaggacatggccgtgtactattgcgcgcgcgcgcccaattgggggagcgatgcctttgacatatgggggcaagggaccatggtcacggtctcgagc

SEQ ID NO: 53952 - RNA, 321 nt, synthetic construct
  misc_feature 1..321: note = derived and/or modified sequence opt11 from IGF-IR_HUMAB-8_LightChain
  source 1..321: mol_type = other RNA
gacatccaaatgacccaatccccctcctcactctccgcctccgtcggcgaccgcgtcaccatcacctgccgcgcctcccaaggcatctcctcctggctcgcctggtaccaacaaaaacccgaaaaagcccccaaatccctcatctacgccgcctcctccctccaatccggcgtcccctcccgcttctccggctccggctccggcaccgacttcaccctcaccatctcctccctccaacccgaagacttcgccacctactactgccaacaatacaactcctacccccccaccttcggccccggcaccaaagtcgacatcaaa

SEQ ID NO: 53953 - RNA, 708 nt, synthetic construct
  misc_feature 1..708: note = derived and/or modified sequence opt11 from ImAb1_LightChain
  source 1..708: mol_type = other RNA
atggacatgcgcgcccccgcccaattcttcggcatcctcctcctatggttccccggcatacgctgcgacatcaaaatgacacaatccccctcaagcatgtacgccagcctcggcgaacgcgtaaccataacctgcaaagcatcccaagacatcaaatcctacctctcctggtaccaacaaaaaccctggaaatcccccaaaatcctaatctactacgcgacctcactcgcggacggagtcccaagccgaatctccggctccggctcaggccaagactactccctcaccataagctccctcgaatccgacgacacagccacatactactgcctacaacacggcgaaagcccctacaccttcggcggaggaaccaagctcgaaatcaaacgcgcagacgcagccccaaccgtcagcatcttcccaccctcatccgaacaactaacctccggcggggcctcggtcgtatgcttcctcaacaacttctaccccaaagacatcaacgtcaaatggaaaatagacggctccgaaagacaaaacggcgtcctcaactcctggaccgaccaagactccaaagactcgacttacagcatgagctcaaccctaaccctcaccaaggacgaatacgaacgccacaactcctacacatgcgaagccacccacaaaacctccacctcgcccatcgtcaaatccttcaacagaaacgaatgc

SEQ ID NO: 53954 - RNA, 681 nt, synthetic construct
  misc_feature 1..681: note = derived and/or modified sequence opt11 from ImAb1_gamma1-Chain
  source 1..681: mol_type = other RNA
atgaacttcggcttctcactaatcttcctcgtcctcgtcctcaaaggcgttcaatgcgaagtcaaactcgtcgaatccggcggcggcctcgtcaaacccggcggctccctcaaactctcctgcgccgcatccggcttcaccttctccaactacgccatgagctgggtccgccaaacccccgaaaaacgcctcgaatgggtcgcctccatctcatccgacggcgacacctatttccccgacaacgtcaaaggccgcttcaccatctcccgagaaaacgccggcaacatcctattcctacaaatgtcctccctccgatccgaagacaccgccatgtactactgcgcccgcggcttcatgatcaccttctggggccaaggcaccctcgtcaccgtctccgccgccaaaaccacacccccttccgtctaccccctcgcacccggatgcggagacaccaccggatcttccgtcaccctcggctgcctcgtcaaaggctacttccccgaatccgtcaccgttacctggaactccggctcactctcctcctccgttcacaccttccccgccctcctccaatccggcctctacaccatgtcctcctccgtcaccgtcccctcatccacctggccttcccaaaccgtaacctgctccgtcgcccacccagcgtcctccaccaccgtcgac

SEQ ID NO: 53955 - RNA, 1344 nt, synthetic construct
  misc_feature 1..1344: note = derived and/or modified sequence opt11 from Imalumab_HeavyChain1
  source 1..1344: mol_type = other RNA
gaagtccagttactagaatccggcggaggactcgtccaacccggcggctccctccggctatcctgtgccgccagcgggttcaccttctccatctactccatgaactgggtccgccaagcccccggcaaaggcctagaatgggtatcatcaatcggctccagcggcggcaccacctactacgcagacagcgtcaaaggccgattcaccatcagccgcgacaactccaaaaacaccctatacctccaaatgaactccctccgcgccgaagacaccgcagtctactactgcgccgggtcccaatggctctacggaatggacgtctggggccaaggcaccacagtcaccgtcagctccgcctccaccaaaggcccatccgttttcccactagccccctcgtcaaaatccacgtccggcggcacagccgcactaggctgcttagtaaaagactacttccccgaacccgtcactgtctcctggaactcaggtgccctcacctccggcgtccacaccttcccagcagtcctacagtcatccggactatactcactatcctccgtagtcacagtaccttcttcatcactcggcacccaaacatacatctgcaacgtcaaccataaaccttccaacaccaaagtcgacaaacgcgtcgaaccaaaaagctgcgacaaaacccacacatgcccaccctgtccagcccccgaactcctaggcggcccatcagtcttcctatttcccccaaaacccaaggacacactaatgatctcccgcacccccgaagtaacctgcgtcgtagttgacgtcagccacgaggaccccgaagtcaaattcaactggtacgtagacggcgtcgaagtacacaacgctaaaaccaaacccagagaagaacagtacaactccacataccgagtcgtctccgtccttaccgtacttcatcaagactggctaaacggcaaagaatacaaatgcaaggtttccaacaaagccctcccagctcccatcgagaaaaccatatccaaagccaaaggccaaccccgcgaaccacaagtctataccctcccaccctcccgagaagaaatgaccaaaaaccaagtatcccttacctgcctcgtaaaaggattctaccccagcgacatcgccgtagaatgggagagcaacggccaacccgaaaacaactacaagaccaccccacccgtactcgactcagacggctccttcttcctctactccaaacttacagtagacaaatcacggtggcaacagggcaacgtcttctcctgctcagtaatgcacgaggcactccacaaccactacacacaaaaatccctctctctctcacccgggaaa

SEQ ID NO: 53956 - RNA, 642 nt, synthetic construct
  misc_feature 1..642: note = derived and/or modified sequence opt11 from Imalumab_LightChain1
  source 1..642: mol_type = other RNA
gacatccaaatgacacaatccccctcctcactctccgcctccgtaggcgaccgcgtcaccatcacatgccgatcctcccaacgcatcatgacctacctcaactggtaccaacaaaaacccggcaaagcccccaaactcctcatcttcgtcgcctcccactcccaatccggcgtcccctcccgattccgtggctccggctcagaaaccgacttcaccctcaccatctccggactccaacccgaagactcagccacctactactgccaacaatccttctggacaccactcacattcggcggcggcaccaaagtcgaaatcaaacgcaccgtagcagccccctccgtcttcatcttcccaccctccgacgaacaactcaaatccggcaccgcctcagtcgtctgcctcctcaacaacttctacccccgtgaagccaaagtccaatggaaagtcgacaacgccctccaatccggcaactcccaagaatccgtcaccgaacaagactccaaagactccacctactccctctcctcaacactaaccctctccaaagccgactacgaaaaacacaaagtctacgcatgcgaagtcacccaccaaggcctctcctcccccgtcaccaaatccttcaaccgaggcgaatgc

SEQ ID NO: 53957 - RNA, 1347 nt, synthetic construct
  misc_feature 1..1347: note = derived and/or modified sequence opt11 from Imgatuzumab_HeavyChain1
  source 1..1347: mol_type = other RNA
caagtacaactcgtccaatcaggcgccgaagtcaagaaaccaggctcgtcagtcaaagtctcctgcaaagcctccggcttcacattcaccgactacaaaatccactgggtccgccaagcccccggacaaggcctcgaatggatgggatacttcaatcccaactcaggatactccacctacgcacagaaatttcaaggccgcgtcaccatcacagccgacaagtccacaagtactgcctacatggaactctcctccctccgcagtgaagataccgccgtatactactgcgcccgcctttccccaggcggctactacgtaatggacgcctggggacaaggaacaacagtcaccgtctcctccgcaagcaccaaaggaccatccgtcttccccctcgccccaagctcaaaaagcacaagcggcggaaccgccgcactaggctgccttgtaaaagactacttccccgaacccgtcaccgtctcatggaactccggcgccttaacctcaggcgtccacaccttccccgccgttcttcaatcctccggcctatactccctctcaagcgtcgtcaccgtcccctcctcctccctcggcacccaaacctacatatgcaacgtcaaccacaaaccatcaaacaccaaagtcgacaagaaagtagaacccaaatcatgcgacaaaacccacacgtgtccaccatgccccgcccccgaactcctcggcggcccctccgttttcctcttcccacccaaaccaaaagacaccctaatgatctcccgaacccccgaagtaacctgcgtcgtcgtcgacgtctcccacgaagaccccgaagtcaaattcaactggtacgtcgacggcgtagaagtccacaacgcaaaaaccaaacccagagaagaacaatacaactcaacctaccgcgtcgtatccgtcctcacagtcctccaccaagactggctcaacggcaaagaatacaaatgcaaagtgtccaataaagcactccccgcacccatcgagaaaactatttcaaaagcaaaaggccaaccccgagaaccccaagtctataccctcccaccctcccgagacgaactcaccaaaaaccaagtatcgctcacatgtctcgtcaaaggcttctacccctccgacatcgccgtagaatgggaatccaacggacaacccgaaaacaactataagaccacaccacccgtcctcgactccgacggctccttctttctctacagcaaactaaccgtcgataaatcccgctggcaacaaggcaacgtcttctcatgctccgtaatgcacgaagccctacacaaccactatacccaaaaatccctctccctcagccccggc

SEQ ID NO: 53958 - RNA, 639 nt, synthetic construct
  misc_feature 1..639: note = derived and/or modified sequence opt11 from Imgatuzumab_LightChain1
  source 1..639: mol_type = other RNA
gacatccaaatgacccaatccccctcctccctctccgcctccgtcggcgaccgcgtcaccatcacctgccgagcctcccaaggcatcaacaactacctcaactggtaccaacaaaaacccggcaaagcccccaaacgcctaatctacaacaccaacaacctccaaaccggcgtcccctcccgcttctccggctccggctccggcaccgaattcaccctcaccatctcctccctccaacccgaagacttcgccacctactactgcctccaacacaactccttccccaccttcggccaaggcaccaaactcgaaatcaaacgcaccgtagccgcaccctccgtattcatattccccccctccgacgaacaactcaaatccggcaccgcctccgtcgtctgcctcctcaacaacttctacccacgcgaagccaaagtccaatggaaagtcgacaacgccctccaatccggcaactcacaagaatccgtaaccgaacaagactccaaagactcaacctactccctctcatccaccctcaccctttccaaagccgactacgaaaaacacaaagtctacgcctgcgaagtcacccaccaaggcctatcctcccccgtcaccaaatccttcaaccgcggcgaatgc

SEQ ID NO: 53959 - RNA, 1353 nt, synthetic construct
  misc_feature 1..1353: note = derived and/or modified sequence opt11 from Inclacumab_HeavyChain1
  source 1..1353: mol_type = other RNA
gaagtgcagctagtagaaagcggcggaggactcgtgcgtcccggcggtagtctccgactcagctgcgccgcctccggcttcactttctcgaactacgacatgcactgggtccggcaagccacagggaaaggcctcgaatgggtctccgcaatcacagccgcaggcgacatctactaccccggctcggtaaaaggccgcttcaccatctcccgcgagaacgccaaaaactccctttacctacaaatgaactcactacgagccggagacacagcagtctactactgcgcccgcggccgctattccggcagcgggtcctactacaacgactggttcgacccctggggccaaggcaccctagtcaccgtctcatccgcctcaaccaagggcccaagcgtcttccccctcgcgccctgcagccgatccacaagcgaatccactgccgcactcggctgcctcgtcaaggactacttccccgaacccgtcaccgtctcctggaactccggcgccctaacctcaggagtacacacattcccagccgtactccaatcatcaggcctctattccctctccagcgtagtcacagtccccagctcatccctaggcacaaaaacctatacctgcaatgtcgaccacaagccctcaaacacaaaagtcgacaagcgagtggaatccaaatacggtccgccctgcccaccctgccccgcccccgagttcgaaggcggcccatccgtcttcttattccctcccaagcccaaagacacgctaatgatcagccgcacgcccgaagtcacatgcgtcgtcgtggacgtctcccaagaagatcccgaagtccaattcaactggtacgtcgacggcgtcgaagtccacaacgccaaaaccaaaccccgcgaagaacaattcaactcaacctaccgcgtagtctccgtcctcaccgtcctacaccaagactggctcaacggaaaagaatacaaatgcaaagtctctaacaaaggcctaccctcgtccattgagaaaaccatcagcaaagcaaaaggccaaccacgcgaaccacaagtctacaccctcccgccctcccaagaagaaatgaccaagaaccaagtatcactcacatgcctcgtcaaaggcttttaccccagcgacatcgcagtcgaatgggaatccaacggccaacccgaaaacaactacaaaacaacaccacccgtcctagactcagatgggagcttcttcctctactcacgcctcaccgtggacaaatccaggtggcaagaaggaaacgtattctcctgctccgttatgcacgaagccttgcacaaccactacacccaaaaatccctctctctctccctcggaaaa

SEQ ID NO: 53960 - RNA, 642 nt, synthetic construct
  misc_feature 1..642: note = derived and/or modified sequence opt11 from Inclacumab_LightChain1
  source 1..642: mol_type = other RNA
gaaatcgtcctcacacaatcacccgccaccctcagcctatcccccggtgaacgcgccaccctatcctgccgcgcctcccaatccgtctcatcctacctcgcctggtaccaacaaaaacccggccaagccccccgcctcctcatctacgacgcatccaaccgcgccaccggcatccccgcccgcttctccggctcaggctccggcacagacttcaccctcaccatctcctccctagaacccgaagacttcgccgtctactactgccaacaacgatcaaactggcccctaacattcggaggcggcaccaaagtcgaaatcaaacgcaccgtcgccgccccctccgtcttcatcttccccccctccgacgaacaactcaaatccggcaccgcctccgtcgtatgcctcctcaacaacttctacccccgcgaagccaaagtacaatggaaagtcgacaacgccctccaatcaggcaactcacaagaatccgtcaccgaacaagactccaaagactccacctactccctctcctccaccctaaccctatccaaagccgactacgaaaaacacaaagtctacgcctgcgaagtcacccaccaaggcctcagctcacccgtcaccaaatcattcaaccgaggcgaatgc

SEQ ID NO: 53961 - RNA, 1347 nt, synthetic construct
  misc_feature 1..1347: note = derived and/or modified sequence opt11 from Indatuximab_ravtansine_HeavyChain1
  source 1..1347: mol_type = other RNA
caagtccaactccaacaatcaggtagcgaacttatgatgcccggcgcctccgtcaagatatcctgcaaagccactggctacacattctcaaactactggatcgaatgggtcaaacaaagaccaggccacggactagaatggatcggcgaaatactgccaggcaccggccgcaccatctacaacgaaaaattcaaaggaaaagcaacattcacagccgacatctcctccaataccgtccaaatgcaactgtcctcactcacatccgaagatagcgcagtatactactgcgcccgccgcgattactacggaaacttctactacgccatggactactggggccaaggcaccagcgtcaccgtatcctccgccagcaccaaaggcccatccgtcttcccactcgccccctgctcccgctctaccagcgaatcgaccgccgcactcggctgcctagtcaaagactacttccccgagcctgtaaccgtcagctggaactccggcgcgctcacgtccggcgtccacacattccccgccgtcctccaatcgtccggactctactccctctcaagcgtcgtaaccgtcccctcatcctcattaggaaccaaaacatacacatgcaacgttgaccacaaacccagcaacaccaaagtcgacaaacgcgtcgaaagcaaatacggacccccatgcccctcctgcccagcccccgagttcctaggcggcccctcagtcttcctcttcccaccaaaacccaaagacaccctcatgattagccgtacccccgaagtaacctgcgtcgtcgtcgacgtatcacaagaggaccctgaagtccaattcaactggtacgtcgacggcgtcgaagtccacaacgccaaaacaaaaccccgcgaagaacaattcaactccacataccgcgtagtttccgtactcaccgtgcttcaccaagactggctaaacggcaaagaatacaaatgcaaagtctcaaacaaaggcctaccctcatccatcgagaaaaccatctcaaaagccaagggccaacctcgcgaaccccaagtatacaccctcccaccatctcaagaagaaatgaccaaaaaccaagtatccctaacctgcctcgtgaaaggcttctacccctctgacatcgccgtagaatgggaatccaacggccaacccgaaaacaactacaagaccaccccacccgtcctcgactcagacggctccttcttcctttactcccgcctaaccgtagacaaatccaggtggcaagaaggcaacgtcttctcctgctccgtcatgcacgaagcgctccacaaccactacacacagaaatccctcagcctctccctcggaaaa

SEQ ID NO: 53962 - RNA, 642 nt, synthetic construct
  misc_feature 1..642: note = derived and/or modified sequence opt11 from Indatuximab_ravtansine_LightChain1
  source 1..642: mol_type = other RNA
gacatccaaatgacacaatcaacctcctccctctcagcctccctcggcgaccgagtcaccatctcctgctccgccagccaaggcatcaacaactacctcaactggtaccaacaaaaacccgacggcaccgtcgaactcctcatctactacacctccaccctccaatcaggtgtcccctccagattctcaggctccggctccggcaccgactactccctcaccatcagcaacctcgaacccgaagacatcggcacatactactgccaacaatactccaaactcccccgcaccttcggcggcggaaccaaactcgaaatcaaacgcaccgtcgccgccccctccgtcttcatcttcccaccctccgacgaacaactcaaatccggcaccgcctcagtcgtctgcctcctcaacaacttctacccccgcgaagccaaagtccaatggaaagtcgacaacgccctacaaagcggcaactcccaagaatccgtcaccgaacaagactccaaagactccacctacagcctctcctctaccctcaccctcagcaaagccgactacgaaaaacacaaagtctacgcctgcgaagtaacccaccaaggcctcagctcacccgtaacaaagagcttcaaccgcggcgaatgc

SEQ ID NO: 53963 - RNA, 1347 nt, synthetic construct
  misc_feature 1..1347: note = derived and/or modified sequence opt11 from Indusatumab_vedotin_HeavyChain1
  source 1..1347: mol_type = other RNA
caagtccaactccaacaatggggcgccggcctactcaaaccatctgaaacactatcactcacctgcgccgtcttcggcggttccttctcaggctactattggagctggatccgccaaccccccggaaaaggactcgaatggatcggcgaaatcaaccaccgtggaaacacaaacgacaacccctccctcaaatccagagttacaatatccgtcgacacctccaaaaaccagttcgccctaaaactgtcctccgtcacagcagcagacaccgcagtatactactgcgcccgtgaaagaggctacacctacggaaactttgaccactggggccaaggcactctcgtcaccgtctcctcagcctccaccaaaggcccctccgtcttcccccttgccccttcctcgaaatccaccagcggcggcacagccgccctaggatgcctagtcaaagactacttcccagaacccgtcaccgtctcctggaactccggcgctctcacctccggcgtgcacacattccccgccgtgctccaatccagcggcctatactccctctcctcagtcgtcacagtcccgtccagctcactcggcacccaaacctacatctgtaacgtcaaccacaaaccctccaacaccaaagtcgataaaaaagtcgaacccaaatcctgcgacaaaacccatacatgcccaccctgccccgcccccgaactactcggcggcccctcagtatttctcttcccccccaaacccaaagacactctcatgatctcaagaacccccgaagtaacttgcgtcgtagtcgacgtctcacacgaagaccccgaagtcaaattcaactggtacgtagacggcgtcgaagtccacaacgccaaaaccaaacctcgagaagaacaatacaactccacctaccgcgtcgtctctgtactcaccgtactccaccaagactggctcaacggcaaagaatataaatgcaaagtatccaacaaagcactccccgcccccatagaaaaaaccatcagcaaagccaaaggacaaccaagagaaccccaagtatacaccctcccaccatcccgcgacgaactcaccaaaaaccaagtctcactcacctgcctcgtcaaaggcttctatccctcagacatcgcagtagaatgggaatcgaacggccaacccgaaaacaactacaaaaccaccccacccgtcctggacagcgacggctccttcttcctctactccaaactcaccgtagacaagtcccgctggcaacaaggcaacgtcttcagctgctcagtcatgcacgaagccctccacaaccactacacccaaaaatccctctccctctcccccggcaaa

SEQ ID NO: 53964 - RNA, 642 nt, synthetic construct
  misc_feature 1..642: note = derived and/or modified sequence opt11 from Indusatumab_vedotin_LightChain1
  source 1..642: mol_type = other RNA
gaaattgtaatgacacaatcccccgcaaccctctccgtatcccctggcgaacgcgccaccctatcctgccgcgcctcccaatccgtctcccgcaacctcgcctggtaccaacaaaaacccggccaagccccccgcctcctcatctacggcgcctccacacgcgccaccggcatacccgcccgattctccggctcaggctccggcacagaattcaccctaaccataggctccctccaatccgaagacttcgccgtctactactgccaacaatacaaaacctggccccgcacattcggccaaggaaccaacgtcgaaatcaaacgcaccgtcgccgccccctccgtcttcatcttccccccctccgacgaacaactcaaatccggcaccgcctccgtcgtatgcctcctcaacaacttctacccacgcgaagccaaagtccaatggaaagtcgacaacgccctccaatccggaaactcacaagaatccgtaaccgaacaagattcaaaagactcaacctactccctctcctccaccctcaccctctccaaagccgactacgaaaaacacaaagtctacgcctgcgaagtcacccaccaaggcctctcatcccccgtcaccaaatccttcaaccgcggcgaatgc

SEQ ID NO: 53965 - RNA, 1353 nt, synthetic construct
  misc_feature 1..1353: note = derived and/or modified sequence opt11 from Inebilizumab_HeavyChain1
  source 1..1353: mol_type = other RNA
gaagtccaactcgtcgaatccggcggcggcctcgtccaacccggaggctccctccgcctctcctgcgcagcctccggcttcacattctcctcaagctggatgaactgggtacgccaagcccccggcaaaggactcgaatgggtaggccgcatatacccaggcgatggcgacaccaactacaacgtaaagttcaaaggacgcttcaccatctcacgggacgacagcaaaaactcactctacctacaaatgaactcactcaaaaccgaagacacagcagtctactactgcgcacgatcgggcttcatcaccaccgtccgcgacttcgattactggggccaaggcaccctcgtcacagtcagcagcgcatccaccaaaggcccgtccgtcttccccctcgcaccatcatcaaagtccacctccggcggcaccgctgccctcggctgcctcgtcaaggactacttcccagaacccgtaaccgtctcatggaacagcggtgccctaacctccggagtccacacattccccgcagtgctccaaagctccggcctctactccctctcatccgtcgttaccgtcccatcctcaagcctcggcactcaaacctacatctgcaacgtcaaccacaaaccaagcaacacaaaagtcgacaaacgcgtcgaaccgaaatcatgcgacaaaacccacacctgtccaccctgccccgcccccgaactattaggagggccctcagtctttctctttcccccaaaacccaaagacacacttatgatctcccgcacaccagaggtcacttgcgtcgtcgtcgacgtatcccacgaagatcccgaagtaaaattcaactggtacgtcgacggcgtcgaggtccacaacgctaaaaccaaacctcgcgaagaacaatacaactccacataccgagtcgtaagcgtcctcactgtcctccaccaagactggctaaacggcaaagaatacaagtgcaaagtaagcaacaaagccctcccagcccccatcgagaaaaccatatccaaagcaaagggacaaccacgagaaccccaagtctacacactacccccaagcagagaggaaatgaccaaaaaccaagtaagccttacatgcctcgtcaaaggattctacccatcggacatagccgtagaatgggaatccaacggacaacccgaaaacaactacaaaaccactccacccgtcctcgactccgacggatccttcttcctctacagcaagctcaccgtagacaaatcccgctggcaacaaggcaatgtctttagctgcagtgtcatgcacgaagccctccacaaccactacacccagaaaagcctctccctctcacccggaaaa

SEQ ID NO: 53966 - RNA, 654 nt, synthetic construct
  misc_feature 1..654: note = derived and/or modified sequence opt11 from Inebilizumab_LightChain1
  source 1..654: mol_type = other RNA
gaaatcgtactcacacaatcacccgacttccaaagcgtgaccccaaaagaaaaagtaaccataacctgccgcgcaagcgagagcgtagacacattcgggatctccttcatgaactggttccaacaaaaacccgaccaatcacccaaactcctcatccacgaagccagcaaccaaggaagcggagtcccaagcaggttctcaggctcaggctcgggcacagacttcaccctgaccataaactcactcgaagccgaagacgcagccacatactactgccaacaatcgaaagaagtcccgttcacattcggaggcggaaccaaagtcgaaatcaaacgcacagtcgcggccccaagcgtgttcatattcccaccctcggacgaacaactaaaatcaggcacagcctcagtcgtatgcctgctcaacaacttctacccacgagaagccaaagtccaatggaaagtcgacaacgcactccagagcggaaactcacaagaaagcgtaaccgaacaagacagcaaagactcaacctacagcctaagctcaaccctaaccctaagcaaagccgactacgagaaacacaaagtatacgcatgcgaagtcacacaccaaggcctcagctcgcccgtaaccaagagcttcaacaggggcgagtgc

SEQ ID NO: 53967 - RNA, 90 nt, synthetic construct
  misc_feature 1..90: note = derived and/or modified sequence opt11 from Insulin_peglispro_Fragment1
  source 1..90: mol_type = other RNA
ttcgtcaaccaacacctctgcggctcccacctcgtcgaagccctctacctcgtctgcggcgaacgcggcttcttctacaccaaacccacc

SEQ ID NO: 53968 - RNA, 63 nt, synthetic construct
  misc_feature 1..63: note = derived and/or modified sequence opt11 from Insulin_peglispro_Fragment2
  source 1..63: mol_type = other RNA
ggcatcgtcgaacaatgctgcacctccatctgctccctctaccaactcgaaaactactgcaac

SEQ ID NO: 53969 - RNA, 495 nt, synthetic construct
  misc_feature 1..495: note = derived and/or modified sequence opt11 from Interferon_beta-1b_chain1
  source 1..495: mol_type = other RNA
tcctacaacctcctcggattcctccaacgctcctccaacttccaatcccaaaaactactatggcaactcaacggccgactcgaatactgcctcaaagaccgcatgaacttcgacatccccgaagaaatcaaacaactccaacaattccaaaaagaagacgccgccctcaccatctacgaaatgctccaaaacatcttcgccatcttccgccaagactcctcctccaccggctggaacgaaaccatcgtcgaaaacctcctcgccaacgtctaccaccaaatcaaccacctcaaaaccgtcctcgaagaaaaactcgaaaaagaagacttcacccgcggcaaactcatgtcctccctccacctcaaacgctactacggccgcatcctacactacctaaaagccaaagaatactcccactgcgcctggaccatcgtccgcgtcgaaatcctacgcaacttctacttcatcaaccgcctcaccggctacctccgcaac

SEQ ID NO: 53970 - RNA, 1347 nt, synthetic construct
  misc_feature 1..1347: note = derived and/or modified sequence opt11 from Intetumumab_HeavyChain1
  source 1..1347: mol_type = other RNA
caagtccaactcgtcgaatccggcggcggagtcgtacaacccggacgatcccgacgcctctcatgcgcagccagcggattcacattctcccgctacacaatgcactgggtccgacaagcccccggcaaaggcttagaatgggtcgcagtaatctccttcgacggctcaaacaagtactacgtggattccgtcaaaggccgcttcaccatctccagggacaacagcgaaaacaccctctacctccaagtcaacatcctccgcgccgaagacacagccgtatactactgcgcccgcgaagcacgcggatcatatgccttcgacatctggggacaaggaaccatggtcaccgtttcatccgcctcaacaaagggacccagcgtctttcctttagcacccagctccaaatcaacatccggaggcacagccgcactcggttgcctcgtcaaagactacttccccgaacccgtcaccgtcagctggaactcaggtgctctcacctcaggagtccacacattcccagcagtcctccaatccagcggcctctactccctatcctctgtcgtcacagtcccctcctcatccctcggcacccaaacatacatctgcaacgtcaaccacaaaccctccaacaccaaagtagataagaaagtcgaaccaaaatcctgcgacaaaacacacacatgcccaccctgcccagcaccagaactcctcggcggcccctccgtcttcctattcccacccaaacccaaagacacccttatgatctcccgcacccccgaagtaacctgcgtcgtcgtcgacgtaagccacgaagaccccgaagtcaaattcaactggtacgtcgacggcgtcgaagtccacaacgccaaaaccaaaccccgagaagaacaatacaactccacctaccgagtcgtatctgtcctaaccgtcctacaccaagactggctcaacggtaaagaatacaaatgcaaagtatctaacaaagccctccccgcccccatagagaaaaccatatccaaagccaaaggccaaccccgcgaaccccaagtctacaccctcccaccctcccgcgacgaactcaccaaaaaccaggtctcactgacatgcctagtcaagggcttctacccctctgacatagccgtcgaatgggaatcaaacggccaacccgaaaacaactacaaaaccaccccacccgtactagactctgacggttcattcttcctctactcaaaactcaccgtcgacaaaagccgatggcaacaaggcaacgtcttttcctgctcagtcatgcacgaagctctacacaaccactacacccaaaaatcactctccctaagccccggcaaa

SEQ ID NO: 53971 - RNA, 645 nt, synthetic construct
  misc_feature 1..645: note = derived and/or modified sequence opt11 from Intetumumab_LightChain1
  source 1..645: mol_type = other RNA
gaaatcgtcctcacccaatcccccgccaccctctccctatcccccggagaacgcgccaccctctcctgccgagcctcacaatcagtctcctcctacctcgcctggtaccaacaaaaacccggccaagcaccccgcctcctcatctacgacgcctccaaccgcgccacaggcatccccgcccgcttctcaggctccggctcaggaacagacttcacccttaccatctcctccctcgaacccgaagacttcgccgtctattactgccaacaacgatccaactggccacccttcacattcggccccggcaccaaagtcgacatcaaacgcaccgtagccgccccctccgtcttcatcttcccaccctccgacgaacaactcaaatccggcaccgcctcagtcgtctgcctcctcaacaacttctacccccgcgaagccaaagtccaatggaaagtcgacaacgccctccaatccggaaactcccaagaatccgtcaccgaacaagactccaaagactcaacctactccctctcctccacacttaccctctccaaagccgactacgaaaaacacaaagtctacgcctgcgaagtaacccaccaaggactctcctcccccgtcaccaaatccttcaaccgcggcgaatgc

SEQ ID NO: 53972 - RNA, 1347 nt, synthetic construct
  misc_feature 1..1347: note = derived and/or modified sequence opt11 from Iodine_(124I)_Girentuximab_HeavyChain1
  source 1..1347: mol_type = other RNA
gacgtaaaactcgtggaaagcggcggaggcctcgtcaaactcggcggctccctcaaactcagctgcgccgcctcaggctttacattctccaactactacatgtcctgggtccgccaaacccccgaaaaacgcctcgagctagtcgccgccatcaactccgacggaggcataacctactacctcgacaccgtcaaaggcagattcaccatctctcgagacaacgccaaaaacaccctctacctccaaatgtcctcacttaaatccgaggacaccgccctcttctactgcgcacgccaccgctcaggctacttctccatggactactggggccagggcacctccgtcaccgtctcctccgcctccaccaaaggcccctccgtcttccctctcgcaccatcatccaaaagcacctccggtggaaccgcagccctgggctgcctagtcaaagactacttccccgaaccagtcacagtctcctggaacagcggcgccctaacttcaggcgtacacacattccccgccgtattacagtcgtccggcctctactcattatcctccgtagttaccgtcccctcatcctcgctaggcacccaaacctacatctgcaacgtcaaccacaaaccatctaacaccaaagtcgacaagaaagtcgaacccaaatcctgtgataaaacgcacacatgcccaccctgcccagcacccgaactcctcggaggaccctctgtcttcctattcccacccaaacccaaagacacactaatgatctcccgaacccccgaagtaacctgcgtagtcgtcgacgtatctcacgaagaccccgaagtaaaattcaactggtacgtcgacggagtcgaagtccacaacgccaaaaccaaaccccgcgaagaacaatacaactccacctaccgcgtcgtatccgtcttaaccgtcctccaccaagactggctcaacggcaaagaatataaatgtaaagtcagcaacaaagcccttcccgcccccatcgaaaagaccatctccaaagccaaaggccaaccccgcgaaccccaagtctacaccctaccaccctcacgcgacgaactcaccaaaaaccaggtatccctaacctgcctcgttaaaggattctacccctccgatatagccgtcgaatgggaatctaacggccaaccagaaaacaactacaaaacaaccccaccagtcctagactctgacggttccttcttcctctactccaaactcaccgtcgacaaatcacgttggcaacagggcaacgtcttcagctgctcagtcatgcacgaagcacttcacaaccactacacacaaaaatcactctccctctcaccaggcaaa

SEQ ID NO: 53973 - RNA, 642 nt, synthetic construct
  misc_feature 1..642: note = derived and/or modified sequence opt11 from Iodine_(124I)_Girentuximab_LightChain1
  source 1..642: mol_type = other RNA
gacatcgtaatgacccaatcccaacgcttcatgtccacaaccgtcggcgaccgcgtatccatcacctgcaaagcctcccaaaacgtcgtctcagccgtcgcctggtaccaacaaaaacccggccaatcccccaaactcctcatctactcagcctccaaccgctacaccggcgtccccgaccgattcacaggctccggctccggcaccgacttcaccctaaccatatccaacatgcaatccgaagacctcgccgacttcttctgccagcaatactccaactacccctggaccttcggcggcggcaccaaactcgaaatcaaacgcaccgtcgcagccccctccgtcttcatcttccccccctccgacgaacaactcaaatccggcactgcctcagtcgtctgccttctcaacaacttctacccccgcgaagccaaagtacaatggaaagtcgacaacgccctccaatccggtaactcacaagaatccgtaaccgaacaagactccaaagactccacatactccctctcatccacccttaccctctccaaagccgactacgaaaaacacaaagtctacgcctgcgaagtcacacaccaaggcctctcctcccccgtcaccaagtccttcaacagaggcgaatgc

SEQ ID NO: 53974 - RNA, 1335 nt, synthetic construct
  misc_feature 1..1335: note = derived and/or modified sequence opt11 from Iodine_(131I)_derlotuxiab_biotin_HeavyChain1
  source 1..1335: mol_type = other RNA
caagtccaactcaaagaatccggcccgggcctcgttgccccctcccaatccctcagcataacctgcaccgtaagcggcttctccctcaccgactacggcgtacgctggatccgtcaaccacccggcaaaggcctcgaatggcttggagtcatctggggcggaggatccacctactacaactcagccctaaaatcccgcctaagcatcagcaaagacaactccaaatcccaagtcttcctcaaaaacagcctccaaaccgacgatactgcctactactgcgccaaagaaaaacgccgcggctattactacgcagactactggggtcaagggacctccgtaacagtctcatccgcctcaaccaaaggaccctccgtcttcccgctcgcaccatcaagcaagagcacctctggcggaaccgccgccctaggctgcctagtcaaagactacttcccagaacccgtaaccgtctcatggaactccggagcactaacctccggagtccacaccttccccgcagtcctccaatcctccggtctctactccctatcaagcgtcgtcaccgtcccctcaagctccctgggaacccaaacctacatctgcaacgttaatcacaagccctccaacacgaaagtcgacaagaaagccgaacccaaatcctgcgacaaaacacacacatgcccgccctgccccgccccagaactcctcggcggccccagcgtattcctctttccacccaaacccaaagacaccctaatctccagaacccccgaagtcacttgcgtcgttgtagacgtctcccacgaagaccccgaagtcaaattcaactggtacgtagacggagtcgaagtccacaacgcaaaaaccaaaccccgcgaagaacaatacaactcaacctaccgcgtcgtctccgtcctcaccgtactccaccaggactggctaaacggcaaagaatacaaatgcaaagtctccaacaaagcactgcctgcccccatagagaaaaccatcagcaaagccaaaggtcaaccccgcgaacctcaagtatacaccctcccaccctcccgagacgaactcaccaaaaaccaagtctcactaacctgcctcgtcaaaggcttctaccccagcgacatcgcagtcgaatgggaatcgaacggccaacccgaaaacaactacaaaaccacaccgccagtcctcgactccgacggcagcttcttcctctactccaaactcaccgtcgacaaatctcgctggcagcaaggcaacgtcttctcctgcagcgtccacgaagctctccacaaccactacacccaaaaatccctgtccctatcccccggcaaa

SEQ ID NO: 53975 - RNA, 639 nt, synthetic construct
  misc_feature 1..639: note = derived and/or modified sequence opt11 from Iodine_(131I)_derlotuxiab_biotin_LightChain1
  source 1..639: mol_type = other RNA
gaaaacgtccttacccagtcccccgccatatccgcctcccccggcgaaaaagtcacaacctgccgagcctcctcctccgtctcctcctcctacctccactggtaccaacaaaaatccggagcctcccccaaactctggatctactccacctctaacctagcctccggagtcccagccagattctccggctccggctccggaacatcctactccctcaccatctcctccgtcgaagccgaagacgccgccacctactactgccaacaatactccggatacccccttaccttcggcggcggcaccaaactcgaaatcaaacgaacagtcgccgccccctccgtcttcatattcccaccctccgacgaacaactaaaatccggcaccgcctccgtcgtctgcctcctcaacaacttctacccccgagaagccaaagtacaatggaaagtcgacaacgccctacaatccggcaactcccaagaatccgtaaccgaacaagactccaaagactccacctactccctatcctcaacactcaccctatccaaagccgactacgaaaaacacaaagtctacgcctgcgaagtcacccaccaaggcctctcctcccccgtcaccaaatccttcaacagaggcgaatgc

SEQ ID NO: 53976 - RNA, 1350 nt, synthetic construct
  misc_feature 1..1350: note = derived and/or modified sequence opt11 from Iodine_(131I)_Derlotuximab_biotin_HeavyChain1
  source 1..1350: mol_type = other RNA
caagtccaacttaaagaatccggccccggactcgtcgcacccagccaatccctgtcaatcacatgcaccgtatccggcttcagcctcaccgactacggagtacgctggatccgccaaccacccggaaaaggcctcgaatggctcggcgtaatatggggcgggggctcaacctactacaactccgccctcaaatcacgcctctccatatccaaagacaactcaaaatcccaggtattcctcaaaatgaactccctccaaaccgatgacaccgccatgtactactgcgccaaagaaaaacgacgtggatactactacgccatggactactggggccaaggcacctccgtaacagtctcctccgcctccaccaaaggcccatcagtcttcccactcgctccatcctcaaaaagcacctcaggcggcaccgccgccctgggctgcctagtcaaagactacttcccagaacccgtcaccgtatcatggaacagcggcgcactcacctccggagtccacaccttcccagccgtccttcaatcctccggcctttacagcctctcgtccgtcgtcaccgtcccctcatcctccctcggcacacaaacttacatctgcaacgtaaaccacaagccctcaaacaccaaagtagacaagaaagctgaacccaaatcctgcgacaaaacccacacctgtcccccatgccccgcccccgaacttctcggaggtccctcagtattcctctttcctcccaaacccaaagacaccctaatgatatcccgaacccccgaagtaacctgcgtagtcgtcgacgtctcccacgaagaccccgaagtaaaattcaactggtacgtcgacggcgtcgaagtacacaacgccaaaaccaaacctcgcgaagaacaatacaactccacctacagagtcgtcagcgtcctaacagtccttcaccaagactggctaaacggcaaagaatacaaatgcaaagtatccaacaaagcacttcccgcccccatagaaaagaccatatccaaagccaaaggacagccccgcgaaccccaagtctacaccctaccaccctcaagggacgaactaaccaaaaaccaagtgtccctaacctgcctcgtaaaaggcttctacccaagcgacatagctgtagaatgggaatccaacggacaaccagaaaacaactacaaaacaacccctcccgtactcgactccgacggctcattcttcctctattcgaaactcaccgtagacaaatcacgctggcagcaaggcaatgtattcagctgctccgtaatgcacgaagccctccacaaccactacacccaaaaatcgctctccctaagccccggcaaa

SEQ ID NO: 53977 - RNA, 645 nt, synthetic construct
  misc_feature 1..645: note = derived and/or modified sequence opt11 from Iodine_(131I)_Derlotuximab_biotin_LightChain1
  source 1..645: mol_type = other RNA
gaaaacgtcctcacccaatcccccgccatcatgtcagccagccccggcgaaaaagtcaccatgacatgccgagcctcatcatccgtctcctcttcatacctacactggtaccaacaaaaatccggcgcctcccccaaactttggatctactccacctccaacctcgcctccggagtacccgcccgcttctccggctccggctccggcacctcctactccctcaccatctcctcagtagaagccgaagacgccgccacctactactgccaacaatactccggctaccccctcaccttcggcggcggcaccaaactcgaaatcaaacgcaccgtcgccgccccttccgtcttcatcttccctccctccgacgaacaactcaaatccggcaccgcctccgtcgtctgcctcctaaacaacttctacccccgcgaagccaaagtccaatggaaagtcgacaacgccctccaatcaggcaactcccaagaatccgtcaccgaacaagactccaaagactcaacctactccctatcctccaccctcaccctctccaaagccgactacgaaaaacacaaagtctacgcctgtgaagtcacccaccaaggcctatcttcccccgtgaccaaatccttcaaccgaggcgaatgc

SEQ ID NO: 53978 - RNA, 1344 nt, synthetic construct
  misc_feature 1..1344: note = derived and/or modified sequence opt11 from Ipilimumab_HeavyChain
  source 1..1344: mol_type = other RNA
caagtacaactcgtcgaaagcggaggcggcgtcgtacaacccggccgctccctacgactttcctgcgccgcaagcggcttcacattcagctcatatacaatgcactgggtccgacaagcccccggcaaaggacttgaatgggtaaccttcatctcatacgacggaaacaacaaatactacgctgactccgtcaaaggacgcttcaccatctcccgagacaactccaaaaacaccctctacctacaaatgaatagcctccgggccgaagacacagccatatactactgcgcccgaaccggatggctaggtcccttcgactattggggccaaggcaccctagtcaccgtctcaagcgcatctacgaaaggcccctccgtattccccctagccccatccagcaaaagcacctccggcggcacagcagcactaggctgcctcgtaaaagactacttccccgaacccgtcaccgtctcatggaactcaggcgcactcacttccggggtccacacattccctgccgtcctacaaagctcaggcctatactcactctccagcgtcgtcaccgtcccaagctcctccctcggtacccaaacctacatctgcaatgtcaaccacaaaccctccaacaccaaagtagacaaacgagtcgaaccgaaatcatgcgacaaaacccacacatgcccaccctgccccgcccccgaactcctcggcggccccagcgtcttcctattcccacccaaacccaaagacaccctcatgatctctcgcaccccagaagttacctgcgtcgtcgtcgacgtctcccacgaagaccccgaagttaaatttaactggtacgtcgacggcgtagaagtccacaacgcaaaaaccaaaccccgcgaagaacaatacaactccacctaccgcgtcgtatccgtcctcaccgtcctacaccaagactggctaaacggtaaagaatacaaatgcaaggtatccaacaaagcccttcccgcccccatcgagaaaaccatctccaaagccaaaggccaaccaagagaaccacaagtatacactctcccaccctcccgagacgaactcaccaaaaatcaagtctccctaacctgcctcgttaaaggcttctatccctcagacatcgccgtggaatgggaatcaaacggccaacccgaaaacaactacaaaacaacaccacccgtactcgactccgacggatccttcttcctctactctaaactcaccgtcgacaaatccagatggcaacaaggaaacgtcttcagctgctccgtaatgcacgaagcccttcacaaccactacacccaaaaatccctatccctctcacccggtaaa

SEQ ID NO: 53979 - RNA, 645 nt, synthetic construct
  misc_feature 1..645: note = derived and/or modified sequence opt11 from Ipilimumab_LightChain
  source 1..645: mol_type = other RNA
gaaatcgtcctcacccaatcccccggcaccctatccctctcccccggcgaacgcgcaaccctctcctgccgcgcctcccaatccgtcggctcctcctacctagcctggtaccaacaaaaacccggccaagccccccggctcctcatctacggcgctttctcccgcgccaccggcatccccgaccgcttctccggctccggctccggcaccgacttcacactaaccatatcccgcctcgaacccgaagacttcgccgtatactactgccaacaatacggctcatccccctggaccttcggccaaggcaccaaagtcgaaatcaaacgcacagttgccgcaccctcagtcttcatcttccccccctccgacgaacaactcaaatccggcacagcctccgtcgtctgcctcctaaacaacttctacccccgcgaagccaaagtccaatggaaagtcgacaacgcccttcaatccggaaactcacaagaatcagtcaccgaacaagactccaaagactccacctactccctctcctccaccctaaccctctccaaagccgactacgaaaaacacaaagtatacgcctgtgaagtcacccaccaaggactctcctcacccgtcacaaaatccttcaaccgaggtgaatgc

SEQ ID NO: 53980 - RNA, 186 nt, synthetic construct
  misc_feature 1..186: note = derived and/or modified sequence opt11 from Iratumumab_HeavyChain1
  source 1..186: mol_type = other RNA
caggtgcagttgcagcagtggggggcggggttgttgaagccgagtgagacgttgagtttgacgtgtgcggtgtatggggggagttttagtgcgtattattggagttggataaggcagccgccggggaaggggttggagtggataggggattattgggggcaggggagtttggtgacggtgagtagt

SEQ ID NO: 53981 - RNA, 321 nt, synthetic construct
  misc_feature 1..321: note = derived and/or modified sequence opt11 from Iratumumab_LightChain1
  source 1..321: mol_type = other RNA
gacatccaaatgacccaatcccccacctcactctccgcctccgtcggcgaccgcgtcaccatcacctgccgcgcctcccaaggcatctcctcctggctcacctggtaccaacaaaaacccgaaaaagcccccaaatccctcatctacgccgcctcctccctccaatccggcgtcccctcccgcttctcaggctccggctccggcaccgacttcaccctcaccatctcctccctccaacccgaagacttcgccacctactactgccaacaatacgactcctaccccatcaccttcggccaaggcacccgcctcgaaatcaaa

SEQ ID NO: 53982 - RNA, 1350 nt, synthetic construct
  misc_feature 1..1350: note = derived and/or modified sequence opt11 from Isatuximab_HeavyChain1
  source 1..1350: mol_type = other RNA
caagtacagctggtccaatccggagccgaagtcgcaaaaccaggaacatcagtcaaactctcatgcaaagcctccggctacaccttcaccgactactggatgcaatgggtgaagcaacgacccggccaaggcctcgaatggataggaacaatatatcccggggacggagataccggctacgcacaaaagttccaaggcaaagccaccctcaccgcagacaaatcatccaaaaccgtctacatgcacctctcctcactagcctccgaagactcagccgtatactactgcgcccgcggcgactactacggatccaactccctagactattggggacaaggcacctcagtcacagtttcttcagcatccaccaaaggaccgtcggtcttccctctagccccctcttctaaatcaacctcaggtggaaccgcagcactcggctgcctcgtcaaagactacttccccgaacccgttacagtctcctggaacagcggagccctcaccagcggcgtccacacatttcccgccgtactacaaagcagtggactctactccctctcctccgtcgtcaccgtcccatcctcatccctcggcacacaaacatacatctgcaacgtcaaccacaaaccatccaacacaaaagtagacaagaaagttgaaccaaaatcctgcgacaaaacccacacatgcccaccctgccccgcccccgaactactcggcggcccctccgtcttcctattcccacccaagcccaaagacaccctcatgatatcccgcacacccgaagtaacctgcgtcgtggtcgacgtcagccacgaagaccccgaagtcaaattcaactggtacgtagacggcgtagaagttcacaacgccaaaacaaaaccccgcgaagaacaatacaactccacataccgcgtcgtcagcgtcctcaccgtccttcaccaagactggctaaacggcaaagaatacaaatgtaaggtctcaaacaaagcactccccgcccccatcgagaaaaccatctcaaaagccaaaggccaaccccgcgaaccccaagtctacactctacccccatcccgagacgaactcaccaaaaaccaagtctccctaacctgcctcgtcaaagggttttacccatccgacatcgcagtcgaatgggaatcaaacggccaaccagaaaacaactacaaaacaacacccccagtactagacagcgacggctccttcttcctatactctaaactaaccgtcgacaaatcccgatggcaacagggcaacgtattctcatgctccgtcatgcacgaagcactccacaaccactacacccaaaaatcactctccctaagcccaggaaag

SEQ ID NO: 53983 - RNA, 642 nt, synthetic construct
  misc_feature 1..642: note = derived and/or modified sequence opt11 from Isatuximab_LightChain1
  source 1..642: mol_type = other RNA
gacatcgtcatgacccaatcccacctctccatgtccacctccctcggcgaccccgtctccataacctgcaaagcctcccaagacgtctccaccgtagtcgcctggtaccaacaaaaacccggacaatcaccccgacgcctcatctactccgcatcctaccgttacatcggcgtccccgaccgattcaccggctcaggcgccggaaccgacttcaccttcaccatctcctcagtccaagccgaagacctagccgtctactactgccaacaacactactcacccccatacaccttcggcggcggcaccaaactcgaaatcaaacgcaccgtcgccgccccctccgtcttcatcttcccaccctccgacgaacaactcaaatccggcacagcctccgtcgtctgcctcctcaacaacttctacccccgcgaagccaaagtccaatggaaagtcgacaacgccctacaatccggcaactcccaagaatccgtcaccgaacaagactccaaagactccacctactccctctcctccactctcaccctctccaaagccgactacgaaaaacacaaagtctacgcatgcgaagtcacccaccaaggactctcctcccccgtcaccaaatccttcaaccgcggcgaatgc

SEQ ID NO: 53984 - RNA, 1347 nt, synthetic construct
  misc_feature 1..1347: note = derived and/or modified sequence opt11 from Itolizumab_HeavyChain1
  source 1..1347: mol_type = other RNA
gaagtccagctcgtagaatccggaggaggcctggtcaaaccaggcggctcactcaaactatcatgcgccgcttcaggcttcaaattctcccgatacgccatgtcatgggtccgtcaggctcccggcaaacgactggaatgggtcgctaccatcagctctggcggcagctacatctactacccagactccgtcaaaggacgattcaccatctcccgagacaacgtcaaaaacaccctatacctacaaatgtcatccctacgttccgaggacaccgccatgtactactgcgctcgcagagactacgacctcgactacttcgactcctggggacagggcaccttagtaaccgtctcttccgcttccaccaagggcccctccgtcttccccctcgcaccctcctccaaatccacatccggtggtaccgcagccctcggatgcctcgtcaaagactacttcccagaacctgtcacagtgtcctggaacagcggcgcactaacatccggagtccacaccttccccgccgtactccaatcctccggcctctactccctctcctccgtcgtaactgtaccctcctcctctctcggcacccaaacttacatctgcaacgtcaaccacaaaccttccaacaccaaagtcgacaagaaagtcgaacccaaatcgtgcgacaaaacacacacatgcccaccctgccccgccccagaactccttggcggcccctcagtcttcctcttcccacccaaacccaaagacaccctcatgatctcccgaacccccgaagtaacatgcgtcgttgtcgacgtctcccacgaagacccagaagtcaaattcaactggtatgtcgacggcgtagaagtccacaacgccaaaaccaaaccccgcgaagaacaatataactccacctaccgcgtcgtatccgtcctcacagtcctacaccaagactggctcaatggaaaagaatacaaatgcaaagtctccaacaaagcattacccgcccccatcgagaaaaccatatccaaagcaaaaggccaaccccgagaaccccaagtctacacactacctccctccagagacgagctcaccaaaaaccaagtctccctcacatgcctcgtcaaaggattctacccctccgacatcgcagttgaatgggaatctaatggccaacccgaaaacaattacaagaccaccccacccgtactcgactccgacggctccttcttcctctactccaaactcacagtagacaagtcccgctggcaacaaggcaatgtcttctcctgctccgtcatgcacgaagctctccacaaccactacacccaaaaatccctcagcctttcccccggcaaa

SEQ ID NO: 53985 - RNA, 642 nt, synthetic construct
  misc_feature 1..642: note = derived and/or modified sequence opt11 from Itolizumab_LightChain1
  source 1..642: mol_type = other RNA
gacatccaaatgacccaatccccctcctccctctccgcctccgtcggcgaccgagtaaccattacctgcaaagcctcccgagacatccgctcatacctcacctggtaccaacaaaaacccggaaaagcccccaaaaccctcatctactacgccacctcactcgccgacggagtcccctcccgattctccggctccggctccggccaagactactcactaaccatctcctccctcgaatccgacgacaccgccacctactactgcctccaacacggcgaatcccccttcacactcggctccggcaccaaactcgaaatcaaacgcaccgtcgccgccccctccgtcttcatcttcccaccctccgacgaacaactcaaatccggcaccgcctccgtcgtctgcctactcaacaacttctacccccgcgaagccaaagtccaatggaaagtcgacaacgccctccaatccggcaactcacaagaatccgtcaccgaacaagacagcaaagactccacctactccctctcctccaccctcaccctctccaaagccgactacgaaaaacataaagtctacgcctgcgaagtcacacaccaaggtctctcctcccccgtcaccaaatcctttaaccgcggcgaatgc

SEQ ID NO: 53986 - RNA, 1335 nt, synthetic construct
  misc_feature 1..1335: note = derived and/or modified sequence opt11 from Ixekizumab_HeavyChain1
  source 1..1335: mol_type = other RNA
caagtccagctcgtccaatccggagcagaagtcaaaaagcccggctcctcagtcaaagtatcctgcaaagcctcaggctactccttcaccgactaccacattcactgggttcgccaagcaccaggccaaggcctagaatggatgggtgtcatcaaccccatgtacggaaccacagactataaccagcgattcaaaggcagagtcaccatcacagccgacgaaagcacctccaccgcctacatggaactctcctcgctccgatcagaagacaccgcagtctactactgtgcccgatacgactacttcacaggcaccggagtctactggggccaaggcaccctcgtcaccgtcagctccgcatccaccaaaggaccctcggtcttccccctagccccctgctcccgatccacctccgaaagcaccgccgcccttggatgtctcgtcaaagactatttcccagaaccagtcacagtatcctggaacagcggcgcccttaccagcggcgtccacactttcccagccgtattacaatcctcaggcctatactccctctcctcagtcgtcacagtcccctcatcctcactgggaaccaaaacctacacatgcaacgtagaccacaagccctccaacacaaaagtagacaaacgcgtggaatccaaatacggcccaccctgcccaccatgccccgcccccgaatttcttggcggaccctccgtcttcctcttccctcccaaacccaaagataccctcatgatcagccgcacacccgaagttacctgcgtcgtagtagacgtctcccaagaagaccccgaagtccaattcaactggtatgtagacggcgtggaagtccacaacgccaagacaaaaccccgcgaagaacagttcaactccacctaccgagtcgtctccgtcctaaccgtactacaccaagactggctaaacggaaaagaatacaaatgcaaagtatccaacaaaggcctcccatcatccatcgaaaagaccatatcgaaagccaaaggccaaccccgagaaccccaagtctataccctaccaccatcccaagaagaaatgaccaaaaaccaagtctccctcacctgtcttgtcaaaggattctacccatcagacatagcagtcgaatgggaatccaacggccaaccagaaaacaactacaaaaccaccccacccgtactagacagcgacggctcctttttcctatactcacgactaaccgtcgacaaaagccgctggcaggaaggaaacgtcttctcctgctccgtaatgcacgaagcactccacaatcactacacccaaaaatcactatcgctctcactcgga

SEQ ID NO: 53987 - RNA, 657 nt, synthetic construct
  misc_feature 1..657: note = derived and/or modified sequence opt11 from Ixekizumab_LightChain1
  source 1..657: mol_type = other RNA
gacatagtcatgacacaaacccccctctccctctccgtaacccccggacaacccgcctccatctcctgccgcagctcccgctcactcgtccactcccgcggcaacacctacctccactggtacctccaaaaacccggacaatccccccaactcctaatctacaaagtctccaaccgattcatcggcgtccccgaccgcttctcaggctccggctcaggcaccgacttcaccctcaaaatctccagagtcgaagccgaagacgtcggcgtctactactgctcacaatcaacccacctccccttcaccttcggccaaggcacaaaactcgaaatcaaacgcaccgtcgccgcccccagcgtcttcatattccccccctccgacgaacaactcaaatccggcacagcctcagtcgtctgcctcctcaacaacttctacccccgagaagccaaagtccaatggaaagtcgacaacgccctccaatccggcaactcacaagaatccgtcaccgaacaagactccaaagactccacctactccctctcctccaccctcaccctctccaaagccgactacgaaaaacacaaagtctacgcctgcgaagtcacccaccaaggcctctcctcccccgtcaccaaatccttcaacagaggagaatgc

SEQ ID NO: 53988 - RNA, 1347 nt, synthetic construct
  misc_feature 1..1347: note = derived and/or modified sequence opt11 from Labetuzumab_govitecan_HeavyChain1
  source 1..1347: mol_type = other RNA
gaagtccaactcgtcgaatcaggaggaggcgtcgtccaacccggcagatcgctccgcctctcctgctccgcctcaggattcgacttcaccacctactggatgtcctgggtgcgacaagcccccggcaagggactagaatggatcggagaaatacaccccgactcctccaccataaactacgccccctccctaaaagaccgattcaccatctcccgcgataacgccaaaaacacattattcctccaaatggactccctccgccccgaagacaccggcgtctacttttgcgcctccctctatttcggcttcccctggttcgcctattggggtcaaggcaccccagtgaccgtctcttccgcctccactaaaggcccctccgtcttccccctagccccctcgtccaaatcaacctccggcggcacggccgcactaggatgcctagtcaaagactacttcccagaaccagttacagtctcctggaactcaggcgcccttacctccggagtacacaccttcccagccgtacttcaatcgtccggcctctactccctctcatccgtagtaacagtcccctcttcctccctcggcacccaaacctacatatgcaacgtcaaccacaaacccagcaacacaaaggtagacaaacgcgtcgaaccaaaatcttgcgacaaaacccacacatgcccgccgtgcccagcgccagaactcctcggcggcccatccgtcttcctcttcccacccaaacccaaagacaccctcatgatcagccgcacccccgaagttacctgcgtcgtcgtcgacgtctcccacgaagaccccgaagtcaaattcaattggtacgtcgacggggtcgaagtccacaacgccaaaaccaaaccccgcgaagaacaatacaattcaacctatcgcgtcgtctccgtcctcaccgttctccaccaagattggctaaacggcaaagagtacaaatgcaaagtaagcaacaaagccctccccgctcctatcgagaaaactatctccaaagcaaaaggtcaaccccgcgaaccccaagtctacaccctcccaccctcccgagaagaaatgaccaaaaaccaagtctccctaacctgcctcgtaaagggcttctacccctcagacatcgccgtcgaatgggaatctaacggacaacccgaaaacaactacaaaaccacaccacccgtcctcgactcagacgggtccttcttcttatactcaaaactcaccgtcgacaaatccagatggcaacaaggaaacgtcttctcctgctccgtcatgcacgaagccctgcacaaccactacacacaaaaatccctcagcctttcacccggaaaa

SEQ ID NO: 53989 - RNA, 639 nt, synthetic construct
  misc_feature 1..639: note = derived and/or modified sequence opt11 from Labetuzumab_govitecan_LightChain1
  source 1..639: mol_type = other RNA
gacatccaactcacccaatccccatcctccctatccgcctccgtcggcgaccgcgtcacaataacctgcaaagccagccaagacgtcggaacctcagtcgcctggtaccaacaaaaaccaggcaaagcccccaaactcctcatctactggacctccacccgccacacaggcgtaccctcacgcttctccggctccggatccggcaccgacttcacattcaccatctcctccctacaacccgaagacatcgccacatactactgccaacaatactccctctaccgctccttcggccaaggaaccaaagtcgaaatcaaacgaaccgtcgccgccccctccgtcttcatcttcccaccctccgacgaacaactaaaatccggcaccgcctccgtcgtatgcctcctcaacaacttctacccccgcgaagccaaagtccaatggaaagtcgacaacgccctccaatccggcaactcacaagaatccgtcaccgaacaagactccaaagactccacctactccctctcctccaccctaaccctctccaaagcagactacgaaaaacacaaagtatacgcctgcgaagtcacccaccaaggcctcagctcccccgtaaccaaatccttcaaccgcggcgagtgc

SEQ ID NO: 53990 - RNA, 1341 nt, synthetic construct
  misc_feature 1..1341: note = derived and/or modified sequence opt11 from Lambrolizumab_HeavyChain1
  source 1..1341: mol_type = other RNA
caagtccaactcgtacaatccggcgtcgaagtcaagaaacccggcgcctcagtcaaagtttcatgcaaagcctccggctataccttcaccaactactacatgtactgggtccgacaagcccccggccaaggcctcgaatggatgggaggcatcaacccctccaacggcggaaccaacttcaacgaaaaattcaaaaacagagtcacactcaccactgacagctccaccaccaccgcctatatggaactaaaatccctccaattcgacgacaccgccgtctactactgcgcccgccgcgactaccgcttcgacatgggcttcgactactggggccagggaaccaccgtaaccgtctcctccgcctccacaaaaggcccatccgtattccccctagctccctgctcaagatcaacatccgaatccaccgcagcccttggctgcctcgtcaaagactacttcccagaacctgtcacagtcagctggaactcaggcgccctcacatccggagtccacacctttccagccgtactccaatcttccggcctctactcactcagctctgtcgtcacggtcccatcatcctccctcggcacaaaaacgtatacctgcaacgtagaccacaaacccagcaacactaaagtcgacaaacgcgtcgaatcaaaatacggcccaccatgcccaccctgccccgcacctgagttcctaggaggccccagcgtcttcctcttcccaccaaaacctaaggacaccctcatgatctcacggaccccagaagtaacctgcgtcgtcgtcgatgtctcccaagaagacccagaagtccaatttaactggtacgtcgacggcgtcgaagtacacaacgccaaaaccaagccccgagaagaacaattcaactccacataccgcgtcgtctcagtactcaccgtcctacaccaagactggctaaacggaaaagaatacaaatgcaaagtctccaacaaaggcctcccttcctccatcgagaaaacaattagcaaagcaaagggccaaccccgagaaccccaagtctacacactaccacccagtcaagaagaaatgaccaaaaaccaagtttccctcacgtgcctagtcaaaggcttctaccccagcgacatcgcggttgaatgggaatccaacggacaaccagaaaacaactacaagacaacacccccagtcctcgactcagacggctctttcttcctatactcgcgcctcaccgtcgacaaatcacgatggcaagaaggcaacgtattctcctgcagcgtcatgcacgaggccctccacaaccactacacccaaaaatccctcagcctaagcctaggaaaa

SEQ ID NO: 53991 - RNA, 654 nt, synthetic construct
  misc_feature 1..654: note = derived and/or modified sequence opt11 from Lambrolizumab_LightChain1
  source 1..654: mol_type = other RNA
gaaatcgtactcacccaaagccccgccaccctcagcctcagcccaggcgaacgcgccaccctcagctgccgcgcatccaaaggcgtgtccacatccggatactcctacctacactggtaccaacaaaaacccgggcaagcaccccggctcctcatctacctagccagctacctcgaatccggagtcccagccagattctccggctccggctccggcacagacttcaccctaaccataagctcactcgaacccgaagacttcgccgtatactactgccaacactcccgcgacctccccctcaccttcggaggcggcaccaaagtcgaaatcaaacgcacagtagccgccccctccgtattcatattcccaccctcggacgaacaactcaaatcaggcacagcatcagtcgtctgcctgctcaacaacttctacccacgcgaagccaaagtccaatggaaagtcgacaacgcactccaaagcgggaactcacaagaaagcgtgaccgaacaagactccaaagactcaacctacagcctcagctcaaccctaaccctgtccaaagccgactacgaaaaacacaaagtatacgcctgcgaagtcacacaccaaggcctcagctcacccgtaacaaaatcattcaacagaggcgaatgc

SEQ ID NO: 53992 - RNA, 669 nt, synthetic construct
  misc_feature 1..669: note = derived and/or modified sequence opt11 from Lampalizumab_HeavyChain1
  source 1..669: mol_type = other RNA
gaagtccaactcgtacaatccggccccgaactcaaaaaacccggcgcctccgtcaaagtctcctgcaaagcctccggctacaccttcaccaactacggcatgaactgggtccgccaagccccaggccaaggcctagaatggatgggctggatcaacacctacaccggcgaaaccacctacgccgacgacttcaaaggccgctttgtcttctccctcgacacctcagtctcaaccgcctacctccaaatctcctccctcaaagccgaagacaccgccgtctactactgcgaaagagaaggcggcgtcaacaactggggacaaggaaccctagtcaccgtctcatccgcctccaccaaaggcccatccgtcttccccctcgcaccctcctccaaatccacatccggcggaaccgccgccctcggctgcctcgtcaaagactacttcccagaaccagtcaccgtatcctggaactctggcgccctaacctccggagtacataccttccccgccgtactccaatcctccggcttatactccctatcctccgtagtcacagtcccctcctcctccctcggcacccaaacctacatctgcaacgtcaaccacaaaccctccaacaccaaagtcgacaaaaaagtagaacccaaatcctgcgacaaaacccacacc

SEQ ID NO: 53993 - RNA, 642 nt, synthetic construct
  misc_feature 1..642: note = derived and/or modified sequence opt11 from Lampalizumab_LightChain1
  source 1..642: mol_type = other RNA
gacatccaagtaacacaatcaccctcctccctatccgcctccgtcggcgaccgcgtcaccataacctgcatcacctccaccgacatcgacgacgacatgaactggtaccaacaaaaacccggcaaagtccccaaactactaatctcaggcggcaacaccctccgccccggcgtcccctcacgcttctcaggctccggctccggcaccgacttcacactcacaatctcctccctacaaccagaagacgtcgcaacctactactgcctccaatccgactccctcccctacaccttcggccaaggcaccaaagtcgaaatcaaacgcaccgtagccgccccctccgtcttcatcttcccaccctccgacgaacaactcaaatccggcacagcctccgtcgtctgcctcctaaacaacttctacccacgcgaagccaaagtccaatggaaagtcgacaacgcactccaatccggcaactcccaagaatcagtcaccgaacaagactccaaagactccacatactccctttcctcaaccctcaccctcagcaaagccgactacgaaaaacacaaagtatacgcctgcgaagtcacccaccaaggcctctcctcacccgtcaccaaatccttcaaccgaggcgaatgc

SEQ ID NO: 53994 - RNA, 1353 nt, synthetic construct
  misc_feature 1..1353: note = derived and/or modified sequence opt11 from Lanadelumab_HeavyChain1
  source 1..1353: mol_type = other RNA
gaagtccaactactcgaaagcggtggcggactcgtacaacccggcggatccctccgcctaagctgcgccgctagcggcttcaccttctcccactacatcatgatgtgggtccgacaagcccccggtaaaggactcgaatgggtaagcggcatatactcctcaggcggtatcaccgtctacgccgactccgtcaaaggacgctttaccatctcccgcgacaacagcaaaaacaccctctacttacaaatgaactcactccgcgccgaagacaccgcagtatactattgcgcgtaccgacgcatcggggtccccagacgagacgagttcgatatctggggccaaggcaccatggtaaccgtcagctccgcctcaacaaaaggcccctcagtattccccctagccccctcctcaaaatcaacctccggcggcaccgcagccctcggctgcctcgtcaaagactacttccccgaacccgtcaccgtcagctggaactccggcgccctcacatccggcgtccacaccttccccgccgtccttcaatcctccggcctctactcactctcatcagttgtcaccgtccccagctcatccctcggcacacaaacctacatctgtaacgtcaaccacaaaccctccaacactaaggtcgacaaacgagtagaacccaaatcttgcgacaaaacacacacatgcccaccctgccccgcacccgaactcctcggcggcccctccgtctttcttttcccacccaaacccaaagacaccctcatgatctcccgaacccccgaagtcacatgcgtcgttgtagacgtttcccacgaagaccccgaagtaaaattcaactggtacgtagacggcgtcgaagtccacaacgccaaaaccaagccccgcgaagaacaatacaatagcacctaccgcgtcgtttccgtcctcaccgtacttcaccaagactggctcaacggaaaagaatacaaatgcaaagtctcaaacaaagccctccccgcacccatcgagaaaaccatctcaaaagccaaaggccagccccgcgaaccccaggtctacacacttccaccctcccgcgaagaaatgactaaaaatcaggttagcctaacctgcctcgtaaaaggcttctacccctcagacatcgccgtagaatgggaatcaaacggccaacccgaaaacaactacaaaactaccccgcccgtcctcgacagcgatggttccttctttctctactccaaactcaccgtagacaaatcccgctggcaacaaggcaacgtattcagctgctccgttatgcacgaagccctccacaaccactacacccagaaaagcctgtccctctcccccggc

SEQ ID NO: 53995 - RNA, 639 nt, synthetic construct
  misc_feature 1..639: note = derived and/or modified sequence opt11 from Lanadelumab_LightChain1
  source 1..639: mol_type = other RNA
gacatccaaatgacccaatcaccctccaccctctccgccagcgtcggcgaccgcgtcaccatcacctgccgcgcctcccaatccatctcctcctggctagcatggtaccaacaaaaacccggcaaagcccccaaactactcatctacaaagcctccaccctcgaatcaggcgtcccctcccgcttctccggctcaggctccggcaccgaattcaccctcaccatctcctccctccaacccgacgacttcgcaacctactactgccaacaatacaacacctactggacctttggccaaggcaccaaagtcgaaatcaaacgcaccgtcgccgccccctccgtcttcatattccccccctctgacgaacaactcaaatcaggcaccgcctcagtcgtctgcctcctcaacaacttctacccccgcgaagccaaagtccaatggaaagtcgacaacgccctccagtccggcaactcacaagaatccgtcaccgaacaagactccaaagactccacatactccctctcctccaccctcaccctatccaaagccgactacgaaaaacacaaagtctacgcctgcgaagtcacccaccaaggcctctcctcccccgtcaccaaatccttcaaccgcggcgaatgc

SEQ ID NO: 53996 - RNA, 1317 nt, synthetic construct
  misc_feature 1..1317: note = derived and/or modified sequence opt11 from Landogrozumab_HeavyChain1
  source 1..1317: mol_type = other RNA
gaagtccaactcgtcgaatcaggcggaggcctcgtacaacccggcggttcactacgcctatcttgcgcagcctcaggactcaccttctcccgctaccccatgtcctgggtacgccaagcccccggcaaaggcctcgtctgggtctccgccatcacctcctcaggcggatcaacctattactccgacaccgtcaaaggcagatttacaataagccgcgacaatgccaaaaacaccctatacctccaaatgaacagccttcgagcagaagacacagccgtatactactgcgcccgactccccgactactggggccaaggtaccctcgtcacagtctcatccgcctctactaagggcccctccgtcttccccctcgccccatgctcaaggagcacatcagaatccaccgccgccctaggatgcctcgtcaaagactacttccccgaacccgtcaccgtctcctggaactcaggagcactcacctctggtgtacacacattccccgccgtacttcaaagctcaggcctatactccctaagctcagtcgtcaccgtcccctcctcatcactaggcaccaagacatatacctgcaacgtcgaccacaaaccctcaaacacaaaagtcgacaaacgcgtagaatccaaatacggcccaccctgcccaccctgccccgcccccgagttcctcggaggcccctccgtattcctcttcccacccaaacccaaagacacactaatgatctcccgcacccccgaagtcacatgcgttgtagtcgacgtctcccaagaagaccccgaagttcaattcaactggtacgtcgacggcgtcgaagtccacaacgccaaaaccaaaccccgggaagaacaattcaactcaacataccgcgtcgtatcagtcctcacagtcctccaccaagactggctcaacggcaaagaatacaaatgcaaagtctccaacaaaggactcccctcttccatcgagaaaaccatctcgaaagccaaaggccaaccccgcgaaccccaagtatacacactcccaccttcgcaagaagaaatgaccaaaaaccaagtatccctcacatgcctcgtcaaaggcttttacccatccgacatcgcagtcgaatgggaatcaaacggtcagcccgaaaacaactataaaaccaccccacccgtcctggactccgacggctcattctttctctactcacgactaaccgtagacaaatcccgctggcaagaagggaacgttttctcctgctccgtaatgcacgaagccctccataaccactacacacaaaaatccctcagcctctccctcggc

SEQ ID NO: 53997 - RNA, 645 nt, synthetic construct
  misc_feature 1..645: note = derived and/or modified sequence opt11 from Landogrozumab_LightChain1
  source 1..645: mol_type = other RNA
gaaatcgtcctcacccaatcccccggcaccctctccctctcccccggcgaacgcgccaccctctcctgccgagcatcctcctccgtctcctcctcttacctacactggtaccaacaaaaacccggtcaagccccccgcctcctcatctactccacctccaacctcgtagccggcatccccgaccgcttctcaggctccggctccggcaccgacttcaccctaaccatctcccgcctcgaacccgaagacttcgccgtctactactgccaacaccactccggctaccactttaccttcggcggcggcaccaaagtcgaaatcaaacgcaccgtcgccgccccctcagtcttcatcttccccccctccgacgaacaactcaaatctggcaccgcatcagtcgtctgcctcctcaacaacttctacccccgcgaagccaaagtccaatggaaagtcgacaacgccctccaatccggcaactcccaagaatccgtcaccgaacaagactcaaaagactccacctactccctctcatcaaccctcaccctatccaaagccgactacgaaaaacacaaagtatacgcctgcgaagtaacccaccaaggcctctcctcccccgtcaccaaatccttcaaccgcggcgaatgc

SEQ ID NO: 53998 - RNA, 1344 nt, synthetic construct
  misc_feature 1..1344: note = derived and/or modified sequence opt11 from Laprituximab_emtansine_HeavyChain1
  source 1..1344: mol_type = other RNA
caagtccaactcgtccaatccggcgcagaagtcgccaaacccggcgcctccgtcaaactatcctgcaaagcaagtggatacaccttcacctcttactggatgcaatgggtcaaacaacgccccggccaaggcctagaatgcatcggcacaatctaccccggcgacggcgacacaacatacacacaaaaattccaaggaaaagccacactaaccgccgacaaatccagctccacggcatacatgcaactcagcagccttcgatccgaggactcagccgtctactactgcgcccgctacgacgcccccggctacgcaatggactactggggccaaggaaccctcgtcaccgtctcatcggccagcaccaagggcccctccgtgttccccctcgcaccatcctctaaatcaacatcaggcggaaccgccgccctaggatgcctcgtaaaagactacttcccagaaccagtcaccgtatcctggaactcaggagccctcacctcaggcgtacacaccttcccagccgtcttacaatcctccggcctatactccctctcctccgtcgtcaccgtaccctcctcctccctcggaacccaaacctacatatgcaacgtcaatcacaaaccgtccaacaccaaagtagacaagaaagtcgaacccaaatcatgcgacaagacccacacctgtcccccatgccccgcacccgagctcctaggaggaccttccgtcttcctcttcccaccaaagccaaaagacaccctcatgatatcacgaaccccggaagtcacatgcgtagttgtcgacgtatcccacgaagaccccgaagtcaaattcaactggtacgtcgacggcgtagaagtacacaacgccaaaaccaaaccccgcgaagaacaatacaacagcacataccgcgtagtctccgtcctcaccgtcctccaccaagactggcttaacggcaaagaatacaaatgcaaagtgtccaacaaagcactaccagcacctatagaaaagacaatatcaaaagccaaaggccaaccccgcgaaccccaagtgtacaccctccctccaagccgcgacgagctcaccaaaaaccaagtctctctaacatgcctagtcaaaggcttctacccttccgacatcgccgtagaatgggaatctaacggccaacccgaaaacaactacaaaaccactcctcccgttctcgactccgacggctccttcttcctatacagcaaacttacagttgacaaatcccgatggcaacaaggcaacgtattctcctgctcagtaatgcacgaagccctccacaaccactacacacaaaaatcactctccctatcccccggc

SEQ ID NO: 53999 - RNA, 642 nt, synthetic construct
  misc_feature 1..642: note = derived and/or modified sequence opt11 from Laprituximab_emtansine_LightChain1
  source 1..642: mol_type = other RNA
gacatccagatgactcaatcaccctcatccctatccgcctcagttggcgaccgcgtcaccatcacatgccgcgcctcacaagacatcaacaactacctagcctggtaccaacacaaacccggcaaaggccccaaactcctcatccactacacctccacactccaccccggcatcccctcccgattctccggctccggctcaggccgcgactactccttctccatctcctccctcgaacccgaagacatcgccacatactactgcctgcaatacgacaacctcctatacaccttcggccaaggaaccaaactcgaaatcaaacgcacagtcgcagccccctccgtcttcatcttcccaccctccgacgaacaactaaaatcaggcacagcatccgtcgtctgcctcctcaacaacttctacccccgcgaagccaaagtccaatggaaggtcgacaacgccctccaatccggcaactcccaagaatctgtcaccgaacaagactccaaagactccacctactccctctcctcaacactcaccctctccaaagccgactacgaaaaacacaaagtttacgcatgcgaagtcacccatcaaggcctaagctcccccgtaaccaaatccttcaacagaggcgaatgc

SEQ ID NO: 54000 - RNA, 1314 nt, synthetic construct
  misc_feature 1..1314: note = derived and/or modified sequence opt11 from Lealesoab_HeavyChain1
  source 1..1314: mol_type = other RNA
caagtccagctccaagaatctggtcccgaactcaagaaacccggtgaaaccgtcaaaatctcctgcaaagcatccggctacacattccgcaactacggcaactgggtcaaacaagcaccagggaaaggactcaaatggggctggatcaacacctacacaggcgaacccacctacgccgacgacttcaaaggacgcttcgccttctccctcgaaacatccgcctccacggcatacctacaaatcaacaacgtcaaaaacgaagacaccgccacctacttctgcgcccgaaagggctgggacttcaacggctcctccctagactattggggacaaggcactaccgtcactgtatcctcagccaaaacaacacccccgtccgtctacccccttgccccaggatcagccgcccagaccaactccgtcaccctcggctgcctagtcaaaggctacttccccgaaccagtaaccgtaacttggaactctggctcgctctcctcaggcgtccacaccttcccagccgtcctccaatccgacctctacacgctctcttcatcagtcaccgtaccatcctctccccgcccctcagaaaccgttacctgcaacgtcgcacaccccgcctcctccaccaaagtcgacaagaaaatcgtccctcgagactgcggctgcaaaccctgcatatgcaccgtcccagaagtctcatccgtcttcatcttcccacccaaacccaaagacgtcctaacaataacactaacgcctaaagttacctgcgtcgtcgtcgacatctcaaaagacgatcccgaagtacagttctcctggttcgtcgacgacgttgaagttcacaccgcccaaacccaaccccgcgaagaacaattcaactccaccttccgctcagtctccgaacttcccatccaccaagactggctcaacggcaaagagttcaaatgccgcgtcaactccgcagccttccctgctcccatagagaaaaccatctcaaaaacaaaaggccgacccaaagctccccaagtctacaccatcccacctcccaaagaacaggccaaagacaaagtatcactaacctgcatcaccgacttcttccccgaagacataaccgtcgaatggcaatggaacggacaacccgcagaaaactacaaaaacacccaacccatcaacaccaacggcagctacttcgtatactccaaactcaacgtccaaaaatccaactgggaagccggaaacacctttacctgctctgtcctccacgaaggactgcacaaccaccacaccgaaaaatccctcagccactcccccggcaaa

SEQ ID NO: 54001 - RNA, 654 nt, synthetic construct
  misc_feature 1..654: note = derived and/or modified sequence opt11 from Lealesoab_LightChain1
  source 1..654: mol_type = other RNA
gacatccaactcacccaaacccccctatccctccccgtctcactcggcgaccaagcatccatctcctgccgatcctcccaatcaatcgtccactccaacggcaacacctacctcgaatggtacctccaaaaacccggccaatcccccaacctcctcatctacaaagtctccaaccgattctccggcgtccccgaccgattctccggatccggctccggcaccgacttcaccctcaaaatctcccgcgtcgaagccgaagacctcggagtctactactgcttccaaggctctcacgtcccccccaccttcggcggcggcaccaaactcgaaatcaaacgcgcagacgccgcccccacggtctccatcttccccccatcatccgaacaactcacctccggcggcgcctccgtcgtctgcttcctcaacaacttctaccccaaagacataaacgtcaaatggaaaatcgacggctccgaacgccaaaacggcgtactaaattcctggaccgaccaagattcaaaagactccacctactcaagctcaacactcaccctcaccaaagacgaatacgaacgccacaactcctacacctgcgaagccacccacaaaacctccacctcccccatagtcaaatccttcaaccgcaacgaatgc

SEQ ID NO: 54002 - RNA, 1335 nt, synthetic construct
  misc_feature 1..1335: note = derived and/or modified sequence opt11 from Lebrikizumab_HeavyChain1
  source 1..1335: mol_type = other RNA
caagtcaccctccgtgaaagcggtcccgcactcgtcaaaccaacccaaactctaaccctcacatgcaccgtcagcggattctcgctctctgcctactccgtaaactggatccgacaaccacccggcaaagctctcgaatggctggcaatgatctggggcgacggcaaaatcgtctacaacagcgccctaaagagcagactcaccatctccaaagacacctccaaaaaccaagtagtcctaaccatgaccaacatggaccccgtcgacaccgccacctactactgcgcaggcgacggatactacccctacgcgatggacaactggggccaaggctctctcgtcacagtgagctccgcctcaaccaaaggccccagcgtattccccctcgccccctgctcccgatccaccagcgaaagcacagccgccctcggctgcctagtcaaagactacttccccgaacccgtaacagtctcctggaactccggagccctcacatccggcgtccacactttccccgcagtcctccaatcctcaggcctctactcactatcatccgtcgtcaccgtcccatcctcctccctcggcaccaaaacatatacctgcaacgttgaccacaagccttccaacaccaaagtagacaaacgagtagaatcaaaatacggcccgccctgtccgccctgtcccgcccccgagttcctcggcggcccctccgtcttccttttccctcccaaacccaaagacactctcatgatctcaagaacccccgaagtcacatgcgtcgtggtcgacgtctcccaagaagaccccgaagtccaattcaactggtacgtcgacggcgtcgaagtacacaacgccaaaactaaaccccgagaagaacaattcaactcgacctaccgagtcgtctctgtcctcaccgtcctccaccaagactggctgaacggcaaagaatacaaatgcaaagtctccaacaaaggcctgccctcaagcatcgaaaagaccatcagcaaagccaaaggccagcccagagaaccccaggtatacacactcccaccctcccaagaagaaatgaccaaaaaccaagtctcactaacctgcctcgtcaaaggcttctaccccagcgatatcgcagtagaatgggaatccaacggccaacccgaaaacaactacaaaaccacaccacccgtcctagattccgacggcagcttcttcctttactcacgcctcacagttgacaaaagcagatggcaggaaggcaacgtcttctcatgctccgtcatgcacgaagccctacacaaccactacacccaaaaatcactttcactctccctcggcaaa

SEQ ID NO: 54003 - RNA, 654 nt, synthetic construct
  misc_feature 1..654: note = derived and/or modified sequence opt11 from Lebrikizumab_LightChain1
  source 1..654: mol_type = other RNA
gatatcgtgatgacgcaatcgcccgacagcctgagcgtgagcctgggcgaacgcgcgaccataaactgtcgcgcgagcaagagcgtagactcgtacgggaactcattcatgcactggtaccagcaaaagcccgggcaaccgcccaagctattgatctatctcgcgagcaatctcgagagcggggtcccggaccgattctcgggctcaggctcgggcacggactttaccttgaccataagctcgctccaggccgaggacgtggccgtgtactattgccagcaaaataacgaggacccgcgcacgttcgggggagggaccaaggtcgagatcaagcgcacggtcgcggccccgagcgtgttcatattcccaccctcggacgagcaattgaaatcgggcacagcctcggtcgtgtgcttgctcaacaacttttacccgcgcgaggccaaggtccagtggaaggtcgataacgcactccagagcgggaactcacaagagagcgtgaccgagcaagatagcaaggactcaacctatagcttgagctcgaccctgaccttgagcaaggccgattacgagaaacataaagtatacgcatgcgaggtcacgcaccagggcttaagctcgcccgtgaccaagagctttaacaggggcgagtgc

SEQ ID NO: 54004 - RNA, 1227 nt, synthetic construct
  misc_feature 1..1227: note = derived and/or modified sequence opt11 from Lenercept_chain1
  source 1..1227: mol_type = other RNA
ctcgtcccccacctcggcgaccgcgaaaaacgcgacagcgtatgcccccaaggcaaatacatccacccacaaaacaactcaatatgctgcacaaaatgccacaaagggacatacctctacaacgactgccccggacccggccaggacaccgactgccgagaatgcgaatccggctccttcaccgcctcagaaaaccacctacgacactgcctcagctgctccaaatgccgcaaagaaatgggccaagtcgaaatctcctcctgcaccgttgaccgagacacagtctgcgggtgccgcaaaaaccagtaccgacactactggtccgagaacctcttccaatgcttcaactgctccctatgcctcaacggaaccgtccacctctcatgccaagaaaaacaaaacaccgtctgtacctgccacgcaggcttcttcctccgcgaaaacgaatgcgtatcctgctccaactgcaagaaatcactcgaatgcaccaaactctgcctcccacaaatcgaaaacgtcaaaggaaccgaagactccggcaccaccgacaaaacccacacctgtcccccttgccccgcccccgaactcctcggcggaccctccgtcttcctatttccacccaaacctaaagataccctcatgatctcccgcacccccgaggtcacatgcgtcgtcgtcgacgtatcccacgaggaccccgaagtcaaattcaactggtacgtcgacggcgttgaagtccacaacgccaaaaccaaaccacgcgaagaacaatacaactcaacttaccgagtagtctctgtcctcaccgtcctccaccaagactggctcaacggcaaagaatacaaatgcaaagtctccaacaaagccctcccagccccaatagagaaaacaatctccaaagccaaaggccaacctcgagagccgcaggtctacaccctacccccatcccgcgaagaaatgactaaaaaccaagtctccctaacctgcctcgtaaaaggattctacccatcagacatcgccgtagaatgggaatcaaacggccaacccgaaaacaactataaaacaacaccacccgtactcgactccgacggctctttcttcctctacagcaaactcaccgtcgacaaatcccgctggcaacaaggcaacgtgttcagctgctccgtcatgcacgaggcactccacaaccattacacccaaaaatccctctcactttcccccggcaaa

SEQ ID NO: 54005 - RNA, 1347 nt, synthetic construct
  misc_feature 1..1347: note = derived and/or modified sequence opt11 from Lenzilumab_HeavyChain1
  source 1..1347: mol_type = other RNA
caagtacaactcgtccaatccggcgcagaagtaaagaaacccggcgcatccgtaaaagtaagctgcaaagcctccggctactccttcacaaactactacatccactgggtccgacaagcccccggccaacgccttgaatggatgggatggattaacgccggcaacggaaacaccaaatactcacaaaaattccaaggacgagttaccataacccgtgacacctcagcatccactgcctacatggagctctcctcactacgttccgaagacaccgctgtctactactgcgtacgtcgccaacgcttcccatactacttcgactactggggccaaggcacactcgtcaccgtctcctccgcctcaaccaaaggcccctcagtcttccccctagcaccctcctccaaatcaacctcaggcggtacagcagccctaggttgcctcgtaaaagactatttcccagaacccgtaaccgtatcctggaactcaggcgcactcacctctggagttcacaccttccccgctgtcctccaatccagcggcctctactcactgtcatccgtcgtcaccgtaccttcctcctccctcggaacccaaacctacatatgcaacgtaaaccacaaaccctcaaacaccaaagtcgacaaacgagtcgaaccaaaatcctgtgacaaaacacatacctgccctccctgccccgccccagaactcctcggtggaccctccgtattcctcttcccacccaagcccaaggacacattaatgatctcccgaacacccgaggtaacctgcgtcgtcgtcgacgtctcccatgaagaccctgaagtaaaattcaactggtacgtcgacggcgtcgaagtacacaacgctaaaaccaaaccccgcgaggaacaatacaactccacctaccgcgtagtctccgtcctcaccgtcctccaccaggactggctaaacggcaaagaatataaatgcaaagtctccaacaaagccctacctgcccccatcgagaaaaccatctccaaagccaaaggacagccccgtgaaccccaagtctacaccctcccaccctcccgcgaagaaatgaccaaaaaccaagtttccctcacatgcctcgtaaaaggcttctatccctccgacatagccgtagaatgggaatccaacggccagcccgaaaacaactacaaaaccacaccacccgtccttgactcagacggctccttcttcctgtactcaaagctgaccgtcgacaagtccagatggcaacaaggaaacgtcttctcctgctctgtcatgcacgaagcactgcacaaccactacacccaaaaatccctctcactctcgcccggaaaa

SEQ ID NO: 54006 - RNA, 642 nt, synthetic construct
  misc_feature 1..642: note = derived and/or modified sequence opt11 from Lenzilumab_LightChain1
  source 1..642: mol_type = other RNA
gaaatcgtactcacgcaatcacccgcgaccctaagcgtaagcccaggagaacgcgcaaccctaagctgccgcgcaagccagtccgtaggaacaaacgtagcatggtaccaacaaaaacccggacaagcacccagggtcctaatctactccacaagctcacgcgcaaccggaatcacggacaggttctcaggctcgggctcaggcacagacttcaccctgaccataagcagactcgaacccgaagacttcgccgtgtactactgccaacaattcaacaaaagcccactcacattcggaggcggaaccaaggtcgaaatcaaacgaacggtcgcagccccaagcgtgttcatattcccaccctcagacgaacaactcaaatcaggcacggcctcagtcgtgtgcctactcaacaacttttacccccgcgaagccaaagtccagtggaaagtcgacaacgcactccaaagcggaaactcacaagaaagcgtaaccgaacaagacagcaaggactcgacctacagcctaagctcaaccctaaccctgagcaaagccgactacgaaaaacacaaagtatacgcatgcgaagtcacacaccaaggcctaagctcacccgtaaccaagagcttcaaccgcggcgaatgc

SEQ ID NO: 54007 - RNA, 1326 nt, synthetic construct
  misc_feature 1..1326: note = derived and/or modified sequence opt11 from Lerdelimumab_HeavyChain1
  source 1..1326: mol_type = other RNA
gaggtacaacttgtggaatccggcggcggcgtcgtccaaccaggccgctcactcagactatcatgcgcggcgagcggattcacattcagcagctacggaatgcactgggtccgccaagcaccgggcaaaggactagaatgggtagccgtcatatggtacgacggctcaaacaaatactacgcagactccgtaaagggccgattcactatctcacgagacaactccaaaaacacactctacctccaaatggactcactccgagcagaggacaccgccgtttactactgcggccgcacactcgaaagctcactatggggccaaggcaccctggtaaccgtatcctcagcctccaccaaaggcccctcagtcttccccctagcgccctgctcacgatcaacctcagaatcaaccgccgctctagggtgcctcgtcaaggattacttcccagagcccgtaacagtatcatggaactccggcgccctcacctcaggcgttcacactttccccgccgtcctacaatcatccggactctacagtctttcatccgtcgtcaccgtcccatcatcatccctcggaaccaaaacctatacctgcaacgtagaccacaaaccctccaacacaaaagtcgacaaacgagtcgaatccaaatacggcccaccttgcccttcctgcccagccccggagttcctaggcggcccatccgtcttcctcttcccacccaagcccaaagacacactcatgatctcccgtaccccagaagtaacctgcgtcgtcgtcgacgtctctcaagaagaccccgaagtccaattcaactggtacgtcgacggcgtagaagtgcacaacgccaaaaccaaaccccgcgaagaacaattcaacagcacctacagagtagtatcagtcctaaccgtactccaccaagactggctcaacggcaaagaatacaaatgcaaggtatccaacaaaggcctaccatcatcaatcgagaaaaccatcagtaaagccaaaggccaaccccgcgaaccccaagtctacacgctcccaccctcccaagaagaaatgaccaaaaaccaagtctcactaacctgcctagtcaagggcttctacccctcagacatagccgtcgaatgggaaagcaacggccaacccgaaaacaactacaaaaccacacccccagtcctagactcagacggatctttcttcctctactcacgcctcaccgtcgacaaatcccgctggcaagaaggaaacgtcttctcctgctccgtaatgcacgaagccctccacaaccactacacccagaaaagcctctctctctccctcggcaaa

SEQ ID NO: 54008 - RNA, 645 nt, synthetic construct
  misc_feature 1..645: note = derived and/or modified sequence opt11 from Lerdelimumab_LightChain1
  source 1..645: mol_type = other RNA
tcctccgaacttacccaagaccccgccgtctccgtcgcactcggccaaaccgtccgcatcacctgccaaggcgactccctacgatcctactacgcatcatggtaccaacaaaaacccggccaagcaccagtcctcgtcatctacggcaaaaacaaccgcccctccggcatccccgaccgcttctccggatcctcctccggcaacacagcctccctaaccatcacaggagcccaagccgaagacgaagcagactactactgcaactcccgcgactcctcatccacacaccgcggagtcttcggcggcggcaccaaactcaccgtactcggacaaccaaaagccgccccctcagtaaccctcttccccccctcctccgaagaactccaagccaacaaagcaacccttgtctgcctcatatccgacttctaccccggcgccgtcaccgtagcctggaaagccgactcctcccccgtcaaagccggcgtcgaaaccaccacaccctccaaacaatccaacaacaaatacgccgcatcctcctacctctcactcactcccgaacaatggaaatcccaccgctcctactcctgccaagtaacccacgaaggctccacagtcgaaaaaaccgtcgccccaaccgaatgctcc

SEQ ID NO: 54009 - RNA, 1353 nt, synthetic construct
  misc_feature 1..1353: note = derived and/or modified sequence opt11 from Lexatumumab_HeavyChain1
  source 1..1353: mol_type = other RNA
gaagttcaactcgtccaatcaggcggcggagtcgaacgccccgggggttcacttcgcctaagctgcgcagcctccggattcaccttcgacgactacggaatgagctgggtccgccaagcaccaggaaaagggctcgagtgggtgtccggaatcaactggaacggcggcagtacaggatacgccgactccgtcaaaggcagagtcaccatatcccgagacaacgccaaaaactcactctacctccaaatgaactcactccgagcagaagacaccgcagtctactactgcgctaaaatacttggagccggccgaggctggtacttcgacctgtggggcaaaggaaccacagtcacagtctcctccgccagtaccaaaggcccctcagtcttccccctcgcccccagctcgaaatcaacctcaggcggaacagcagccctaggctgcctagtaaaagactactttcccgaacccgtaaccgtatcctggaactccggcgccctgacaagcggagtccacaccttccctgccgttctgcaatcctccggactctactccctcagctccgtcgtgaccgttccctcttcatcacttggcacacaaacctacatctgcaacgtcaaccacaaacccagcaacaccaaagtcgacaagcgggtcgaacccaaatcatgtgataaaactcacacttgcccaccctgccccgccccggaactccttggtggaccatcagtcttcctattccctcccaaacccaaagacacattaatgatctcccgcacacccgaggtaacctgcgtcgtcgtcgacgtcagccacgaagaccccgaggtcaaattcaactggtacgtggacggcgtcgaagtccacaacgccaaaaccaaaccccgcgaagaacaatacaactccacctaccgcgtcgtctccgtcctaaccgtcctacaccaagactggctaaacggcaaagaatacaaatgcaaagtctccaacaaagctctaccagcaccaatcgagaaaaccatttccaaagcaaaaggccaaccccgcgaaccacaagtatacacactcccaccctctcgcgaagaaatgaccaaaaaccaagtatcccttacatgcctcgtcaaaggcttctaccccagcgacatagcagtcgaatgggaaagcaacggacaacccgaaaacaactacaaaaccacaccacccgtcctcgactccgacggctccttcttcctctactccaaactcaccgtcgacaagtcccgttggcaacaaggtaacgtgttctcctgctcagtcatgcacgaagcccttcacaaccactacacccagaaatcactctctctctcccccggtaaa

SEQ ID NO: 54010 - RNA, 1353 nt, synthetic construct
  misc_feature 1..1353: note = derived and/or modified sequence opt11 from Lexatumumab_HeavyChain
  source 1..1353: mol_type = other RNA
gaagtccaactcgtccaatccggaggaggcgtcgaacgccccggaggctccctacgcctctcctgcgcagcctccggattcaccttcgacgactacggaatgtcctgggtccgccaagcccccggcaaaggactagaatgggtatccggaatcaactggaacggaggctccaccggctacgccgactccgtcaaaggccgagtaaccatatcacgcgacaacgccaaaaactcgctctacctccaaatgaatagcctccgcgcagaagacacagccgtctactactgcgcaaagatcctgggcgccggtcgaggctggtacttcgacctctggggcaagggcaccaccgtcacagtctcctccgcctccaccaaaggaccctccgtcttccccctagcaccctcctcaaaatccacctcgggaggcaccgcagccctcggatgcctggtcaaagactacttccccgaacccgtcacagtatcctggaactccggcgccctgaccagcggcgtccacaccttccccgcagttctccaatcatcaggattatattcactcagctccgtggtcaccgtcccctcatcctcactaggaacccaaacctacatctgcaacgtcaaccacaagccctccaacaccaaagtcgacaaacgcgtcgaacccaaaagctgcgacaaaacccatacctgcccaccgtgccccgcccccgaactactaggcggcccatcagtcttcctatttcccccaaaacccaaagacactctcatgatatcacgcactcccgaagtaacctgcgtcgtagtagacgtctcccacgaagaccccgaagtcaaattcaactggtacgtcgacggcgtcgaagtccacaacgccaagaccaaaccccgcgaagaacagtacaattcaacctaccgagtcgtctccgtattaaccgtacttcaccaagactggctaaacggcaaagaatacaaatgcaaagtctcaaacaaggcactccccgcaccaatcgagaaaaccatatccaaagccaaaggacaaccacgagaaccccaagtatataccctacctccctcgcgagaagaaatgaccaagaaccaagtctccctcacatgcctcgtcaaaggattctacccatccgatatcgccgttgaatgggaatcaaacggccaaccagaaaacaactacaaaaccacaccgcccgtcctagactccgacggatccttcttcctatactccaaactcaccgtcgacaagtccagatggcaacaaggcaacgtcttctcctgcagcgtaatgcacgaagcactccacaaccactacactcaaaaatccctatccctttcacccggcaaa

SEQ ID NO: 54011 - RNA, 642 nt, synthetic construct
  misc_feature 1..642: note = derived and/or modified sequence opt11 from Lexatumumab_LightChain1
  source 1..642: mol_type = other RNA
tcatccgaactcacccaagaccccgccgtctccgtcgccctcggccaaaccgtccgtatcacctgccaaggcgactcactccgctcctactacgcttcctggtaccaacaaaaacccggccaagcccccgtcctcgtcatctacggcaaaaacaaccgcccctctggcatccccgaccgattctccggctcctcatccggcaacaccgcctcactaactatcaccggcgcccaagccgaagacgaagccgactactactgcaactcccgcgactcctccggcaaccacgtcgtcttcggcggcggcaccaaactaacagtactcggccaacccaaagccgccccctcagtcacactcttccccccctcctccgaagaactccaagccaacaaagccaccctcgtctgcctaatctccgacttctaccccggcgccgtaaccgtcgcctggaaagccgactcatcacccgtcaaagccggcgtcgaaaccaccaccccctccaaacaatccaacaacaaatacgcagcctcctcctacctctcactcaccccagaacaatggaaatcccaccgctcctactcctgccaagtcacacacgaaggctccaccgtcgaaaaaaccgtcgcccccaccgaatgctcc

SEQ ID NO: 54012 - RNA, 642 nt, synthetic construct
  misc_feature 1..642: note = derived and/or modified sequence opt11 from Lexatumumab_LightChain
  source 1..642: mol_type = other RNA
tcatcagaactaacccaagaccccgccgtctccgtcgccctcggacaaaccgtccgcatcacctgccaaggcgactccctccgctcctactacgcctcctggtaccaacaaaaacccggccaagcccccgtccttgtcatctacggcaaaaacaaccgcccctccggcatccccgaccgcttcagcggctcatcctccggcaacaccgcctcactcacaatcaccggcgcccaagccgaagacgaagcagactactactgcaactcccgagactcctccggcaaccacgtcgtattcggcggcggcaccaaactcaccgtcctcggacaaccaaaagccgccccatccgtcaccctcttccctccctcctccgaagaactccaagccaacaaagccaccctagtatgcctcatctcagacttctaccccggcgccgtcacagtcgcctggaaagcagactcctcccccgtaaaagcaggcgtagaaaccaccaccccctccaaacaatccaacaacaaatacgccgcctcaagctacctctccctcacccccgaacaatggaaatcacaccgctcatactcctgccaagtcacacacgaaggctccacagtagaaaaaaccgtcgcccccaccgaatgctca

SEQ ID NO: 54013 - RNA, 1377 nt, synthetic construct
  misc_feature 1..1377: note = derived and/or modified sequence opt11 from Libivirumab_HeavyChain1
  source 1..1377: mol_type = other RNA
caagtccaactcgtagaatccggcggcggcgtagtccgccccggccgatccctccgcctctcttgcgccgcatcaggcttcgccttctccgactactccatcaactgggtccgtcaagcacccggaaaaggtctagaatgggtagccatcatctcctacgacggccgcatcacctactaccgagattctgtcaaaggccgattcaccataagccgcgacgactccaagaacacactatacctacaaatgaacagcctgcgcacagaagacactgccgtatattactgcgcccgccaatactacgacttctggtccggctcctccgtcggccgcaactacgacggcatggacgtctggggcctgggaaccaccgtcaccgtatcaagcgcatccaccaaaggcccctccgtcttccccctcgcaccctcctccaagtccacatcaggcggaaccgctgccctcggctgcctcgttaaagactacttccccgaaccagtaacagtcagctggaacagcggagctctcacatccggcgtccacacctttcccgccgtcctccaatcatccggactctactcactatcctccgtagtcacagtcccctccagctccctcggcacacaaacctatatctgcaacgtcaaccataaaccctccaacaccaaagtcgacaaacgagtagaacccaaaagctgcgacaaaacacatacctgcccaccctgccccgcccccgaacttctcggaggaccctccgttttcctattccctccaaaaccaaaagacaccctcatgatctcaagaaccccagaagtaacctgcgtcgtcgttgacgtaagccacgaagaccccgaggtcaaattcaactggtacgtcgacggcgtagaagtacacaacgccaaaaccaaacccagagaagaacaatacaactccacataccgagtagtttcagtcctcaccgtcctccatcaagactggctcaacggaaaagaatacaaatgcaaggtctccaataaagcactcccagcacccatcgagaaaaccatcagcaaagccaagggccaacccagagaaccccaagtatacaccctcccgccatcacgtgaagaaatgaccaaaaaccaagtctccctaacctgcctcgtcaaaggcttctacccctcagacatcgccgtcgaatgggaatcgaacggccaacccgaaaacaactacaaaaccacaccacccgtcctcgactcagacggatcattctttctctactcaaaactcaccgtcgacaaatcccgctggcaacaaggaaacgtcttctcctgctcagtaatgcacgaagccctacacaaccactacacccaaaaatccctctctctttcacccggcaaa

SEQ ID NO: 54014 - RNA, 657 nt, synthetic construct
  misc_feature 1..657: note = derived and/or modified sequence opt11 from Libivirumab_LightChain1
  source 1..657: mol_type = other RNA
gacatcgtaatgacccaatcacccctctccctctccgtcacccccggcgaacccgcctccatctcctgccgctcctcacaatcactactacaccgatcaggcaacaactacctcgactggtacctccaaaaacccggacactcaccccaactcctcatctacgtcggctccaaccgcgcatccggcgtccccgaccgcttctccggctccggatccggcaccgaatacaccctcaaaatctcccgcgtcgaagccgaagacgtcggcgtctactactgcatgcaagcccttcaaacaccccgcaccttcggccaaggaaccaaactcgaaatcaaacgcaccgtcgcggcccccagcgtattcatattcccaccctccgacgaacaactcaaatcaggcaccgcctccgtcgtctgcctcctcaacaacttctacccccgagaagccaaagtccaatggaaagtcgacaacgccctccaatccggcaactcccaagaatccgtcaccgaacaagactccaaagactcaacctactctctctcctccaccctcaccctatcaaaagccgactatgaaaaacacaaagtctacgcctgcgaagtcacccaccaaggcctatcctcccccgtcaccaaatccttcaaccgcggcgaatgc

SEQ ID NO: 54015 - RNA, 1350 nt, synthetic construct
  misc_feature 1..1350: note = derived and/or modified sequence opt11 from Lifastuzumab_HeavyChain
  source 1..1350: mol_type = other RNA
gaagtacaactcgtcgaatcaggcggcggcctagtacaaccaggcggatcacttcgactatcatgcgccgcctccggcttctccttcagcgacttcgcgatgagctgggtccgacaagccccaggaaaaggcctagaatgggtcgccaccatcggccgcgtcgccttccacacctactaccccgactcaatgaagggccgattcaccatctcacgcgacaactccaaaaacaccctctacctccaaatgaactccctcagagcagaagacaccgcagtatactactgcgcccgccaccgcggattcgacgtcggccacttcgacttctggggacaaggcaccctcgttaccgtctcatcagcctcaaccaaaggcccctccgtcttccccctcgcacccagcagcaaaagcaccagcggcggaaccgccgcactcggctgcctcgtaaaagactacttccccgaaccagtaacagtatcctggaactcaggcgccctcacaagcggcgtccacaccttcccagctgtcctacaatcctcgggcctgtactcactcagcagcgtcgtcactgtcccctcctcctccctgggcacccaaacatacatctgcaacgtgaaccacaaaccatcaaacacaaaagtagataagaaagtagaacccaaatcctgcgataaaacacacacctgtccaccctgccccgcccccgaactactaggcggcccctccgtcttcctcttcccacccaaacccaaagacacattaatgatctcgcgcacccccgaagtaacctgcgtcgtcgtcgacgtctcccatgaagaccccgaagtcaaattcaactggtacgtcgacggcgttgaggtacacaacgccaaaaccaaaccccgcgaagaacaatacaactccacataccgagtcgtctccgtcctcacagtactacaccaagactggctcaacggcaaagaatacaaatgcaaagtatccaacaaagcactacccgcacccatagagaaaacaatctcgaaggccaaaggccaaccccgagaaccacaagtctacaccctacccccttcacgtgaagaaatgaccaaaaaccaagtctccctaacctgcctcgtcaaaggcttctacccctcggacatcgccgtcgaatgggaatcaaacggccaacccgaaaataattacaaaacaacacccccagtactcgactctgacggatccttcttcctctattccaagctaaccgtagacaaatcccgttggcaacaaggaaacgtcttctcctgcagcgtcatgcacgaagccctacacaaccactacacccaaaaatcactatccctcagccccggaaag

SEQ ID NO: 54016 - RNA, 657 nt, synthetic construct
  misc_feature 1..657: note = derived and/or modified sequence opt11 from Lifastuzumab_LightChain
  source 1..657: mol_type = other RNA
gacatccaaatgacccaatcaccctcctcactctcagcctccgtaggcgaccgcgtcaccattacctgccgctcctccgaaaccctcgtccactcctccggcaacacctacctcgaatggtaccaacaaaaacccggcaaagcccccaaactcctcatctaccgcgtctcaaaccgcttctcaggagtcccctcacgcttctccggctccggctccggcacagacttcaccctaacaatctcctcactccaacccgaagacttcgccacctactactgcttccaaggctccttcaaccccctcacattcggccaaggcactaaagtcgaaatcaaacgcaccgtcgccgccccatccgtcttcatcttcccaccctccgacgaacaactcaaatccggcacagcctccgtcgtctgcctcctcaacaacttctacccacgcgaagccaaagtccaatggaaagtcgacaacgccctccaatccggcaactcccaagaatccgtcaccgaacaagactccaaagactcaacctactcactctcctccaccctcaccctctccaaagccgactacgaaaaacacaaagtctacgcctgcgaagtcacccaccaaggcctctcatcccccgtcaccaaatccttcaacagaggcgaatgc

SEQ ID NO: 54017 - RNA, 1347 nt, synthetic construct
  misc_feature 1..1347: note = derived and/or modified sequence opt11 from Lifastuzumab_vedotin_HeavyChain1
  source 1..1347: mol_type = other RNA
gtacaactcgtcgaatcaggcggaggccttgtccaacccggcggctctctccgcctttcatgcgccgcctccggattctccttctccgacttcgccatgtcctgggtgcgacaagcccccggtaaaggactagaatgggtcgccaccataggcagagtcgccttccacacctactaccccgactccatgaaaggccgattcaccatctcccgcgacaactccaaaaataccctatacctccaaatgaactccctccgagccgaagacacagcagtctactactgcgcacgccaccgcggcttcgacgtaggccacttcgacttctggggacaaggcacactcgtaaccgtatcaagcgcatccaccaaaggcccttccgtattccccctcgccccctcctcaaaatcaacctccggcggaaccgcagccctcggatgcctcgtcaaagactacttcccagaaccagtcaccgtctcctggaactccggcgcactcacctccggcgtccatactttccccgccgtcctccaatcgtctggcctctactcactctcctccgtagtcaccgtcccatcctcctccctcggcacccaaacctacatctgcaacgtcaaccacaagccctcaaacacaaaagtcgacaagaaagtcgaacccaaatcctgcgacaaaacccatacatgcccaccctgccccgccccagaactcctcggcggcccctccgtcttcctcttcccacccaaacccaaagacacactcatgatctcacgcactcccgaagtaacttgcgtcgtagtcgacgtctcccacgaagaccccgaagtgaaattcaactggtacgtcgacggagtcgaagtccacaacgccaaaaccaaaccacgcgaagaacaatacaacagcacgtatcgtgtcgtctccgtcctcacagtcctccaccaagactggctcaacggaaaagaatataaatgcaaagtctccaacaaagcactacccgcacccatagagaaaaccatatctaaagctaaaggtcaaccaagagaaccacaagtctataccctaccaccctcacgcgaagaaatgactaagaaccaagtcagcctaacctgcctcgtaaaaggattttaccccagcgacatcgccgtagaatgggaatccaacggccaacccgaaaacaactacaaaacgacacctcccgtcctcgactccgacggatccttctttctctactccaaactcacagtcgataaatccagatggcagcaaggcaacgtattctcctgttcagtcatgcacgaagccctccacaaccactacacacagaaatccctatccctatcccccggcaaa

SEQ ID NO: 54018 - RNA, 657 nt, synthetic construct
  misc_feature 1..657: note = derived and/or modified sequence opt11 from Lifastuzumab_vedotin_LightChain1
  source 1..657: mol_type = other RNA
gacatccaaatgacccaatccccctcctcactctccgcctccgtcggcgaccgcgtcaccataacctgccgttcttcagaaacacttgtccactcctccggcaacacctacctcgaatggtaccaacaaaaacccggcaaagcccccaaactcctcatctaccgcgtatcaaaccgcttcagcggcgtcccctcccgcttctccggctcaggctccggcaccgacttcaccctcaccatctcctcactccaacccgaagacttcgccacctactactgcttccaaggctccttcaaccccctcaccttcggacaaggcaccaaagtcgaaatcaaacgcaccgtcgccgcaccctccgtcttcatcttcccaccctccgacgaacaacttaaatcaggcaccgcctccgtcgtatgcctactcaacaacttctacccccgcgaagccaaggtccaatggaaagtcgacaacgccctccaatccggcaactcccaagaatccgtaaccgaacaagactctaaagactccacctactccctctcctccaccctcaccctctccaaagccgactacgaaaaacacaaagtctacgcctgcgaagtcacccaccaaggcctctcctcccccgtcaccaaatccttcaaccgcggcgaatgc

SEQ ID NO: 54019 - RNA, 1359 nt, synthetic construct
  misc_feature 1..1359: note = derived and/or modified sequence opt11 from Ligelizumab_HeavyChain1
  source 1..1359: mol_type = other RNA
caagtacaactcgtccaatccggtgcagaagtaatgaaacccggatcatccgtcaaagtcagctgcaaagcatcaggatacacctttagctggtactggctagaatgggtcagacaagccccaggacacggcctagaatggatgggcgaaatagacccaggcacattcaccacaaactacaacgaaaaattcaaggcccgcgtcacctttaccgccgacacttcaacctccaccgcctacatggaactctcatccctacgctccgaagacactgccgtctactactgcgcccgcttctcacacttctcaggctcaaactacgactacttcgactactggggccaaggcaccctcgtcaccgtatccagcgcctcaaccaaaggcccctcagtattccccctagccccatcctcaaaatccaccagcggcggcaccgccgcactcggctgcctcgtaaaagactacttccccgaacccgtcaccgtatcatggaactcaggagccctaacctccggcgtccacaccttccccgccgtccttcaatctagcggactctactccctttcatctgtggtcacagtcccctcctcatccctcggcacacaaacctacatctgcaacgtcaaccacaaaccatccaacacaaaagtggacaagaaagtcgaaccaaaatcctgcgacaaaacccacacatgcccaccctgccccgcccccgaactcctaggcggcccctcggtcttccttttcccacccaaacccaaagacaccctcatgatctcccggaccccggaagttacctgcgtcgtagtcgacgtctcccacgaagacccagaagtcaaattcaactggtacgtcgacggcgtcgaagttcacaatgcgaaaaccaaaccacgagaagaacaatacaactcaacctaccgagtcgtctcagtcctaaccgtcctgcaccaagattggctcaacggcaaagaatacaaatgcaaagtctccaacaaagcactccccgccccaatagagaaaaccatctcaaaagccaaaggccaaccccgagaaccccaagtatacactctccctccctcccgagacgaactcactaaaaaccaagtatccctcacatgcctcgtcaaaggcttctacccctccgacatagccgtagaatgggaatccaacggccaacccgaaaacaactacaaaacgacaccacccgtcctcgactccgacggctccttcttcctctactcaaaactaacggtcgacaaatcacgctggcaacaaggtaacgtcttttcatgctccgtcatgcacgaagcgctccacaaccactacacccaaaagagcctaagcctatcccccggcaaa

SEQ ID NO: 54020 - RNA, 642 nt, synthetic construct
  misc_feature 1..642: note = derived and/or modified sequence opt11 from Ligelizumab_LightChain1
  source 1..642: mol_type = other RNA
gaaatcgtaatgacacaatcgcccgcaaccctaagcgtaagcccaggagaacgcgcaaccctgtcctgccgcgcaagccaatccataggcacaaacatacactggtaccaacaaaaacccggacaagcacccagactcctaatctactacgcaagcgagagcataagcgggatcccagccagattctcaggctcgggctcaggcacagagttcaccctaaccataagctcgctccaaagcgaagacttcgcagtgtactactgccaacaatcatggtcgtggccaaccacattcgggggcggaaccaaagtcgaaatcaagcgcacagtcgcggccccatccgtattcatattcccaccctcggacgaacaactaaaatcaggcacggcctcagtcgtatgcctactcaacaacttctacccacgcgaagccaaagtccaatggaaagtcgacaacgcgctccaaagcggaaactcacaagaaagcgtaaccgaacaagatagcaaagactcgacctacagcctaagctcgaccctcaccctgagcaaagccgactacgaaaaacacaaagtatacgcatgcgaagtcacacaccaaggcctaagctcacccgtaaccaagagcttcaacagaggcgaatgc

SEQ ID NO: 54021 - RNA, 1329 nt, synthetic construct
  misc_feature 1..1329: note = derived and/or modified sequence opt11 from Lilotomab_HeavyChain1
  source 1..1329: mol_type = other RNA
gaaatccaactacaacaaagcggacccgaactcgtcaaacccggcgcatctgtcaaagtctcctgcaaagcctcaggatacagcttcacggactacaacatgtactgggtcaaacaatcacacggcaaatccctcgaatggatcggctacatagacccatacaacggcgacacaacctacaaccaaaaattcaaaggcaaagccacactcactgtcgacaaaagctcatccacagccttcatacacctcaactccctaaccagcgaagactccgccgtctactactgcgctagatccccatacggccactacgccatggattactggggccaaggaacatctgtaacagtctcctctgccaaaaccacacccccatctgtctaccccctcgcccccggctccgccgcccaaaccaactccatggtaacactaggttgcctagtcaaaggatatttccccgaacccgtcaccgtcacatggaactccggctcactctcgtccggagtacataccttccccgccgtcttacaatctgacctatacaccctcagctcatccgtaacagtcccctcctcaacctggccctccgaaactgtaacctgcaacgtcgcccaccccgcctcatccacaaaagtcgacaagaaaatcgtcccacgtgactgcggctgcaaaccctgcatctgcacagtccccgaagtctcatcagtcttcatctttccacccaaacccaaagacgtcctcaccatcaccctcacacctaaagtcacatgcgtggttgtcgacatctccaaagacgacccagaagtacaattctcgtggttcgtcgacgacgtagaagtccacacagcacaaacacagcctcgagaagaacaattcaactcaaccttccgatccgtctccgaacttcccatcatgcaccaagactggctcaacggcaaagagttcaaatgccgagtcaactccgccgccttccccgcccccatagagaaaacaatctcaaaaaccaaaggccgacccaaagccccacaagtctacactatcccgccacccaaagaacaaatggcaaaagacaaggtatctctaacctgcatgatcaccgacttctttcccgaagacatcactgtcgaatggcaatggaacggccaacccgcagaaaactacaaaaacacccaacccatcatggacacagacggctcctacttcgtctactcaaaactcaacgtacaaaagtccaactgggaagccggaaataccttcacgtgctccgtactccacgaaggcctccacaaccaccacacagaaaaatccttgtcacactccccaggaaaa

SEQ ID NO: 54022 - RNA, 642 nt, synthetic construct
  misc_feature 1..642: note = derived and/or modified sequence opt11 from Lilotomab_LightChain1
  source 1..642: mol_type = other RNA
gacatcgtcatgacccaatcacacaaactcctctccacctccgtcggcgaccgcgtctccatcacctgcaaagcctcccaagacgtctccaccgccgtcgactggtaccaacaaaaacccggccaatcccccaaactcctcataaactgggcctcaacccgacacaccggcgtccccgaccgcttcaccggatccggctccggcaccgactacaccctcaccatctcatcaatgcaagccgaagacctagccctatactactgccgccaacactactcaacccccttcaccttcggctccggcaccaaactagaaatcaaacgcgccgacgccgcacccaccgtctcaatcttccccccctcctccgaacaactcacctccggcggagcctccgtcgtctgcttcctcaacaacttctaccccaaagacatcaacgtcaaatggaaaatcgacggctccgaacgtcaaaacggcgtcctcaactcctggaccgaccaagactccaaagactcaacctactctatgtcatccaccctcaccctcaccaaagacgaatacgaacgacacaactcctacacctgcgaagccacccacaaaacctctacctcccccatcgtcaaatccttcaaccgcaacgaatgc

SEQ ID NO: 54023 - RNA, 1338 nt, synthetic construct
  misc_feature 1..1338: note = derived and/or modified sequence opt11 from Lintuzumab_HeavyChain1
  source 1..1338: mol_type = other RNA
caagtacaactcgtccaaagcggcgctgaggtcaagaaacccggctcctccgtcaaagtctcctgcaaagcatccggatacaccttcaccgactacaacatgcactgggtccgccaagctccaggccaaggtctcgaatggatcggctacatctacccctacaacggaggcaccggctacaaccaaaaattcaaatctaaagccacgatcacagccgacgaatctaccaacaccgcctacatggaactctcaagcctgcggtctgaagacaccgccgtctactactgcgcccgcggtcgaccagccatggactactggggacaaggcaccctagttaccgtctcctccgcctcaaccaaaggaccctccgtctttcctcttgccccctcatcgaaatcaacctcaggcggaactgccgccctcggttgcctcgtcaaagactacttccctgaacccgtcaccgtatcatggaactccggagctctcacctccggagtccacacattccccgccgtcctccagagctccggcctctactccctctcctccgtcgtaactgtcccctcatcatcactcggcacacaaacgtacatctgcaacgtaaaccataaaccctccaacactaaagtcgacaagaaagtagaacccaaatcttgcgacaaaacacacacatgcccaccctgccccgcacccgaactactcggcggcccctcagtcttcctcttcccaccaaaacccaaagacacactaatgatcagccgcacccccgaagtgacatgcgtcgtagtcgatgtctcccacgaagaccccgaagtcaaattcaactggtacgtcgacggcgtcgaggtacacaacgccaaaaccaaacctcgcgaagaacaatacaactccacttaccgtgtcgtctccgtcctcacagtcctacatcaagactggctaaacggtaaagaatacaaatgcaaagtctccaacaaagcactccccgccccaatcgagaaaaccatctccaaagccaaaggacaaccccgagaaccacaagtctacaccctacccccgtcccgagacgaactcaccaaaaaccaagtctcccttacctgcctcgtaaaaggattttacccctctgacatagccgtcgagtgggaatccaacggccaacccgaaaacaactacaaaaccacacctcccgtcctcgactccgacggctccttcttcctctactccaaactaacagtagacaaatcacgctggcaacaaggaaacgtcttttcctgctccgtcatgcacgaagcactacataaccactacacccaaaaatccctatccctctcccccggcaaa

SEQ ID NO: 54024 - RNA, 654 nt, synthetic construct
  misc_feature 1..654: note = derived and/or modified sequence opt11 from Lintuzumab_LightChain1
  source 1..654: mol_type = other RNA
gacatccaaatgacacaatccccctcaagcctcagcgcaagcgtcggcgaccgcgtaaccataacctgccgcgcaagcgaaagcgtagacaactacgggatctcgttcatgaactggttccaacaaaaacccggaaaagcccccaaactcctaatctacgccgcgagcaaccaaggatccggcgtcccaagcagattctcaggctcaggctcaggcacagacttcaccctaaccataagctcactccaacccgacgacttcgccacatactactgccaacaatccaaagaagtcccatggaccttcggacaaggaaccaaagtcgaaatcaaacgcacagtcgccgccccaagcgtcttcatattcccaccctcagacgaacaactcaaatcaggcaccgcctcagtcgtatgcctcctaaacaacttctacccccgcgaagccaaagtccagtggaaagtcgacaacgcactccaaagcggaaactcacaagaaagcgtaaccgaacaagacagcaaagactccacctacagcctaagctcaaccctcaccctcagcaaagccgattacgaaaaacacaaagtatacgcatgcgaagtcacccaccaaggcctaagctcccccgtcaccaagagcttcaacagaggcgaatgc

SEQ ID NO: 54025 - RNA, 1350 nt, synthetic construct
  misc_feature 1..1350: note = derived and/or modified sequence opt11 from Lirilumab_HeavyChain1
  source 1..1350: mol_type = other RNA
caagtccagctagtccaatccggagccgaagtcaagaaacccggctcctccgtcaaagtttcatgcaaagcatctggcggcacattctccttctacgcaatctcatgggtccgacaagccccaggccaaggactcgaatggatgggtggcttcatcccaatattcggcgccgccaactacgcccaaaaattccaaggccgcgtcacaataaccgccgacgaatccacatctaccgcctacatggaactctcatctctcaggtccgacgacaccgccgtctactactgcgcacgcatcccttcaggatcctactactacgactacgacatggacgtctggggccaaggcacaacagttacagtcagctccgcctccacaaaaggcccaagcgtcttccccctcgccccctgctcacgatccacctccgaatccacagccgcacttggttgtcttgtcaaagactacttccccgaacccgtcacggtatcatggaactccggagccctcacctccggtgtccacaccttccccgcagtcctccaatcctccggcctatactcactatcatccgtagtcaccgtcccctcctcctcactaggcacaaaaacatacacatgcaatgtcgaccacaaaccatcaaacaccaaagtcgacaaacgcgtcgaatccaaatacggaccaccctgcccaccctgccccgcccccgaatttctcggcggcccctccgtcttcctcttccctcccaaacccaaagacaccctcatgatcagccgaaccccagaagtcacatgcgtggtcgtcgacgtatctcaggaagatcccgaagtccaattcaactggtacgtcgacggcgtcgaagtccataatgctaaaacaaaaccaagagaagaacaattcaactcgacctaccgcgtcgtatccgtcctcaccgttcttcaccaagactggctcaacggcaaagaatacaaatgcaaagtctccaacaaaggcctcccaagctctatcgaaaagaccatctctaaagccaaaggccaaccccgagaaccacaagtctacaccctcccgcccagccaagaagaaatgaccaaaaaccaggtctccctcacgtgcctagtcaaaggcttctacccctccgacatcgccgtagaatgggaatccaacggccaacctgaaaacaactacaaaaccacacccccagtcctagacagtgacgggagcttcttcctctactcgcgcctcaccgtcgacaaatcccgctggcaagaaggcaacgttttcagctgctcagtcatgcacgaagccctccacaaccactacacccaaaaatccctctcattatccctcggaaaa

SEQ ID NO: 54026 - RNA, 642 nt, synthetic construct
  misc_feature 1..642: note = derived and/or modified sequence opt11 from Lirilumab_LightChain1
  source 1..642: mol_type = other RNA
gaaatcgtactcacacaatcccccgtaactctctccctctcccccggagaacgagcaaccctctcctgccgcgcatcccaatccgtctcctcctacctggcctggtaccaacaaaaacccggccaagcaccccgactcctcatctacgacgcctccaaccgcgccaccggcatccccgcccgcttctccggctccggctccggcacagacttcaccctcaccatctcctcactcgaacccgaagacttcgccgtctactactgccaacaacgctccaactggatgtacaccttcggccaaggcaccaaactcgaaatcaaacgcacagtcgcagccccatccgtcttcatcttcccaccatccgacgaacaacttaaatccggcaccgcctccgtcgtctgcctcctcaacaacttctacccccgcgaagccaaagtccaatggaaagtcgacaacgccctacaatccggcaactcccaagaatccgtcaccgaacaagactccaaagactcaacctactccctttcatccaccctaaccctatccaaagccgactacgaaaaacacaaagtctacgcctgcgaagtcacccaccaaggcctctcctcccccgtaaccaaatccttcaaccgaggcgaatgc

SEQ ID NO: 54027 - RNA, 1344 nt, synthetic construct
  misc_feature 1..1344: note = derived and/or modified sequence opt11 from Lodelcizumab_HeavyChain1
  source 1..1344: mol_type = other RNA
caagtccaactcgtccaatccggagccgaagtcaagaaacccggcgcatccgtcaaagtctcctgcaaagcatcaggatacacattctcgaccatgtatatgtcctgggtacgccaagcccccggacaaggcctcgaatggatgggacgaatcgaccccgcaaatgaacacaccaactacgcccaaaaattccaaggccgagtcaccatgactcgcgacacatccatcagcaccgcatacatggaactaagccgccttacctcagacgatactgccgtctactactgcgcccgctcctactattactacaacatggactactggggccaaggaacactcgtcaccgtctcctccgccagcaccaaaggaccctctgtattccccctcgccccctcctcgaaatccacctccggaggcaccgccgccctaggatgcctcgtcaaagactacttccccgaacccgtcaccgtctcctggaactcaggcgcactcacctcaggcgtccacacattcccagccgtccttcaatcatccggcctctattccctctcatcagtagtcactgtaccctcatcctcactcggcacccaaacgtacatctgcaacgtgaaccacaaaccctctaacaccaaagtagacaaacgagtcgaaccaaaatcatgcgataaaacccacacatgcccaccctgccccgcccccgaagccgccggaggccccagcgtcttcctcttcccacccaaacccaaagacacactcatgatctcccgcacccccgaagttacatgcgtcgtcgtcgatgtctcacacgaagaccccgaagtaaaattcaactggtacgtagacggagtcgaagtccacaacgcaaaaaccaaaccccgcgaagaacaatacaactcaacataccgcgtcgtatctgtactcacagtcctacaccaagactggctcaacggcaaagaatacaaatgcaaagtctccaacaaagccctcccagcccccatcgaaaagaccatctccaaagcaaaaggccaaccccgcgaaccccaagtctacaccctacccccttcccgcgaagaaatgaccaaaaaccaagtctccctaacatgcctagtcaaaggcttctacccctcagacatagcagtcgaatgggaatccaacggccaaccggaaaacaactacaaaaccaccccacccgtcctagactcagacggctccttcttcctctactccaaactcaccgtcgataaatcccgatggcaacaaggaaacgtattctcctgctccgtcatgcacgaagccctccacaaccactacacccaaaaatcactctccctctcgcccggcaaa

SEQ ID NO: 54028 - RNA, 639 nt, synthetic construct
  misc_feature 1..639: note = derived and/or modified sequence opt11 from Lodelcizumab_LightChain1
  source 1..639: mol_type = other RNA
caaatagtcctaacccaatcccccgcaaccctctccgtctcccccggcgaacgcgccaccctctcctgccgagcctcccaatccgtctcctacatgcactggtaccaacaaaaacccggacaagcaccccgtctcctcatctacggcgtcttccgccgcgccaccggaatccccgaccgcttctccggctccggctccggcaccgacttcaccctaaccatcggccgcctcgaacccgaggacttcgccgtctactactgcctccaatggtcctccgacccacccactttcggccaaggcaccaaactcgaaatcaaacgaacagtagccgccccctccgtcttcatcttcccaccctctgacgaacaactcaaatccggaaccgcctccgtagtctgcctcctcaacaacttctacccccgagaagccaaagtccaatggaaagtcgacaacgccctccaatccggcaactcccaagaatccgtcaccgaacaagactccaaagactccacctactccctctcctccaccctcaccctctccaaagccgactacgaaaaacacaaagtctacgcctgcgaagtaacccaccaaggcctctcctcccccgtcaccaaatccttcaaccgcggagaatgc

SEQ ID NO: 54029 - RNA, 1356 nt, synthetic construct
  misc_feature 1..1356: note = derived and/or modified sequence opt11 from Lokivetmab_HeavyChain1
  source 1..1356: mol_type = other RNA
gaagtccagctagtcgaaagcggcggcgacctagtaaaacccggaggatccctcagactatcctgcgtagcctccggcttcaccttctctaactacggtatgtcatgggtacgccaagcccccggaaaaggactccaatgggtagccaccatctcctacggcggctcttacacctactatcccgacaacatcaaaggccgcttcaccatctccagagacaatgccaaaaacaccctctacctccaaatgaactccctgcgagcagaagacaccgcaatgtactactgcgtccgaggctacggatacgacaccatggactactggggacaaggcaccctagtcaccgtctcatcagcctccactaccgcccccagcgtcttcccactcgcaccctcttgcggctccacctccggctctacagtcgccctcgcctgcctcgtctcaggctacttcccagaacccgtcacagtctcatggaactccggctcactcacttccggagtacacaccttcccctccgtcctccaatcatccggcctctactcactctctagcatggtcacagtcccgagctcacgttggccctcagaaacattcacgtgcaacgtcgcccaccccgcctccaaaaccaaagtcgacaaacccgtaccaaaaagagagaacggccgagtacccagaccacccgactgccccaaatgccccgcccccgaaatgctcgggggcccctccgtcttcatcttcccacccaaacccaaagacaccctcctcatagccagaacccccgaagtaacctgcgtcgtagtcgacctcgaccccgaagaccccgaagtccagatatcgtggttcgtcgacggtaagcaaatgcaaacagccaaaacccaacccagagaagaacaattcaacggaacatatcgcgtcgtctcagttctacccatcggccaccaggactggctgaaaggcaaacaattcacatgcaaagtcaataacaaagccctaccctcccccatcgaaagaaccatctccaaagcacgcggccaagcccaccaaccatccgtatacgttcttcctccctcccgcgaagaactaagcaagaacaccgtctcactaacctgcctcatcaaagacttcttcccacccgatatcgacgtcgaatggcaaagcaacggccaacaagaaccagaatcaaaataccgaaccaccccaccccaactcgacgaagacggcagctacttcctctactcaaaactttccgtcgacaaatcaagatggcagcgaggcgacaccttcatatgcgctgtcatgcacgaagcactgcacaaccactacacccaagaatccctctcccactcacccggc

SEQ ID NO: 54030 - RNA, 651 nt, synthetic construct
  misc_feature 1..651: note = derived and/or modified sequence opt11 from Lokivetmab_LightChain1
  source 1..651: mol_type = other RNA
gaaatcgtaatgacccaatcccccgcctccctctccctcagccaagaagaaaaagtcaccataacctgcaaagccagccaaagcgtctccttcgcaggcaccggtctaatgcactggtaccaacaaaaacccggccaagcacccaagctcctcatctaccgcgcaagcaacctagaagccggagtacccagccgcttctccggctcaggctcaggcaccgacttctccttcaccatctcctcactagaacccgaagacgtcgccgtatactactgccaacaatcccgagaatacccctggacattcggacaaggcaccaaactcgaaatcaaacgcaacgacgcccaacccgccgtctacctattccaaccctcccccgaccaactccacaccggctcagcctccgtcgtatgcctactaaacagcttctaccccaaagacatcaacgtcaaatggaaagtcgacggcgtcatccaagacaccggcatccaagaatccgtcaccgaacaagacaaagactcaacctactcactatcaagcaccctcaccatgtcctccacagaatacctctcccacgaactctactcctgcgaaatcacccacaaatcactcccctccaccctcatcaaatccttccaacgctcagaatgc

SEQ ID NO: 54031 - RNA, 1344 nt, synthetic construct
  misc_feature 1..1344: note = derived and/or modified sequence opt11 from Lorvotuzumab_mertansine_HeavyChain1
  source 1..1344: mol_type = other RNA
caagtccaactcgtggaatccggcggcggcgttgtccaacccggccgctcactacgcctctcctgcgccgcctccggcttcaccttctcatcattcggaatgcattgggtccgccaagcgcctggcaaaggcctcgaatgggtagcctacatatcctcgggctccttcaccatctactacgcagactccgtcaaaggccgattcacaatctcccgcgacaactccaaaaacactctgtacctacaaatgaactccctacgagccgaggacaccgccgtctactactgtgctcgaatgcgcaaaggctacgccatggactactggggacaaggaacactcgtcacagtctcctccgcctccaccaaaggcccatccgtattcccactcgctccctcatccaaatcaacatccggcggaaccgccgccctaggctgcctggtcaaagactacttcccagaacccgtaaccgtcagctggaactccggcgcccttacctccggggtacacaccttcccagccgtcctgcaatcttccggcctttactcacttagctccgtcgttacagtaccatcatcctcactcggcactcaaacctacatctgcaacgtcaaccacaaaccatctaacacaaaagttgacaagaaagtagaaccgaaatcctgcgacaaaacccatacatgcccaccctgccccgcaccagaactcctcggcggcccctccgtcttccttttcccacccaagcccaaagacacactcatgatctcccgaacccccgaagttacctgcgtcgtcgtagatgtttcccacgaagaccccgaagtcaaattcaactggtacgtcgacggcgtagaagtacacaacgcaaaaaccaaaccccgagaagaacaatacaactccacctaccgcgtcgtctcagtcctcaccgtcctccaccaagattggctcaacggcaaagaatacaaatgcaaagtctcaaacaaagccctccccgcccccatcgaaaagaccatatccaaggctaagggccaacccagagaaccacaagtctacaccctacccccatcacgagacgaactaaccaagaaccaagtatccctaacctgcctagtcaaaggcttctacccatccgacatagccgtcgaatgggagtccaacggacaacccgaaaacaactacaaaaccaccccacccgtcctagactccgacggctccttctttctatactccaaactcaccgtcgacaagagccgctggcaacaaggaaacgtattttcctgctctgtcatgcacgaagcactccacaaccactatacccaaaaatccctctcgctctcccccggcaaa

SEQ ID NO: 54032 - RNA, 657 nt, synthetic construct
  misc_feature 1..657: note = derived and/or modified sequence opt11 from Lorvotuzumab_mertansine_LightChain1
  source 1..657: mol_type = other RNA
gacgtcgtcatgacacaaagccccctatccctccccgtcaccctcggccaacccgcctccatctcctgccgctcctcacaaatcatcatccactccgacggcaacacctacctcgaatggttccaacaacgccccggccaatctccccgccgcctgatctacaaagtatccaaccgcttctccggcgtccccgaccgcttctccggctccggctccggcaccgacttcaccctaaaaatctcccgcgtcgaagccgaagacgtcggcgtatactactgcttccaaggatcccacgtcccccacaccttcggccaaggaaccaaagtcgaaatcaaacgcaccgtcgccgccccatctgtcttcatcttcccaccctccgacgaacaactcaaatccggcaccgcctccgtagtctgcctcctcaacaacttctacccccgcgaagctaaagtccaatggaaagtagacaacgccctccaatccggcaactcacaagaatccgtcaccgaacaagactccaaagactccacctactccctctcatccacactcaccctctccaaagccgactacgaaaaacacaaagtctacgcctgcgaagtcacccaccaaggcctctcatcccccgtaaccaaatccttcaaccgcggagagtgc

SEQ ID NO: 54033 - RNA, 336 nt, synthetic construct
  misc_feature 1..336: note = derived and/or modified sequence opt11 from Lpathomab_VL
  source 1..336: mol_type = other RNA
gacgtcgtcatgacccaaacccccctctccctccccgtctccctcggcgaccaagcctccatctcctgcacctccggccaatccctcgtccacatcaacggcaacacctacctccactggtacctccaaaaacccggccaatcccccaaactcctcatctacaaagtctccaacctcttctccggcgtccccgaccgcttctccggctccggctccggcaccgacttcaccctcaaaatctcacgcgtcgaagcagaagacctcggcgtctacttctgctcccaatccacccacttccccttcaccttcggcaccggcaccaaactcgaaatcaaa

SEQ ID NO: 54034 - RNA, 366 nt, synthetic construct
  misc_feature 1..366: note = derived and/or modified sequence opt11 from Lpathomab_gamma1-Chain_VDJ-Region
  source 1..366: mol_type = other RNA
caagtccaactccaacaatccggcgccgaactcgtccgccccggcacctccgtcaaagtatcctgcaaagcctccggctacggcttcatcaactacctcatcgaatggatcaaacaacgccccggccaaggcctcgaatggatcggcctcatcaaccccggctccgactacaccaactacaacgaaaacttcaaaggcaaagccaccctcaccgccgacaaatcctcctccaccgcctacatgcacctctcctccctcacctccgaagactccgccgtctacttctgcgcccgccgcttcggctactacggctccggcaactacttcgactactggggccaaggcaccaccctaaccgtctcatcc

SEQ ID NO: 54035 - RNA, 1350 nt, synthetic construct
  misc_feature 1..1350: note = derived and/or modified sequence opt11 from Lucatumumab_HeavyChain1
  source 1..1350: mol_type = other RNA
caagtccaactcgtcgaatcgggcggcggagtcgtacaaccgggccgatcccttcgcctttcatgcgccgcctccggcttcaccttctcctcgtacggtatgcactgggtccgccaagcacccggcaaaggcctagaatgggtcgccgtcatatcatacgaagaatctaaccgctaccacgccgactcagtcaaaggccgattcaccatctcccgggacaactccaaaatcaccctatacctacaaatgaacagccttcgtaccgaagacaccgccgtctactattgcgcaagagacggtggcatcgcagcccccggcccagactactggggccaaggcacgctagtcaccgtctcatccgcctccaccaaaggcccctccgtcttcccactggcccccgcctctaaatcaacctcaggcggcaccgccgctctcggttgcctcgtcaaagactacttccccgaaccagtaaccgtctcatggaactccggcgccctcacatctggcgtccacacctttccagccgtcctccagtccagcggcctatattccctatcctctgttgtcaccgtcccctcctcctcgctcggaacacaaacctatatctgcaacgtaaaccacaaaccctccaacaccaaagtcgacaaacgcgtcgaacccaaatcgtgcgacaaaacacacacatgcccaccctgccccgcccccgaactcctgggaggcccctccgtcttccttttccctcccaaacccaaagatacactcatgatctcacgcacccccgaagtaacatgcgttgtcgtcgacgtttcccacgaagaccccgaagtcaaatttaactggtacgtagacggcgtcgaagtccacaacgctaaaacgaaaccccgcgaggaacaatacaactccacctaccgcgtcgtctctgtcctaaccgtactccaccaagactggctcaacggcaaagaatacaagtgcaaagtctccaacaaagccctacccgcacccatcgagaaaaccatctcaaaagccaaaggccaaccccgcgaaccccaagtctacaccctcccaccctcacgcgaagaaatgaccaaaaaccaggtctcattaacctgcctcgtcaaaggcttctaccccagcgacatcgccgtagaatgggaatccaacggccaacccgaaaacaactacaaaactactcccccggtactagactccgacggcagcttctttctctactccaaactaaccgtcgacaaatcaagatggcaacaaggaaacgtcttctcctgctccgtaatgcacgaagcactccacaaccactatacccaaaaatccctctccctatcccccggaaaa

SEQ ID NO: 54036 - RNA, 657 nt, synthetic construct
  misc_feature 1..657: note = derived and/or modified sequence opt11 from Lucatumumab_LightChain1
  source 1..657: mol_type = other RNA
gacatcgtcatgacccaatctcccctatccctcaccgtcaccccaggcgaacccgcctccatctcctgccgatcctcccaatcactcctttactccaacggctacaactacctcgactggtacctacaaaaacccggacaatcaccccaagtcctcatctccctcggcagcaaccgagcctccggagtccccgaccgcttctccggctccggctccggcacagacttcaccctcaaaatctcacgcgtcgaagccgaagacgtcggcgtctactactgcatgcaagcccgccaaaccccattcaccttcggccccggcaccaaagtcgacatccgccgcaccgtagccgccccatccgtcttcatcttcccaccctcagacgaacaactcaaatccggcaccgcatccgtcgtctgcctactcaacaacttctacccccgcgaagccaaagtccaatggaaggtcgacaacgcactccaatccggcaactcacaagaatccgtcaccgaacaagactccaaagactccacctactcactctcctccacccttaccctctccaaagccgactacgaaaaacacaaagtctacgcctgcgaagtcacccaccaaggcctctcctcccccgtcaccaaatccttcaaccgaggcgaatgc

SEQ ID NO: 54037 - RNA, 324 nt, synthetic construct
  misc_feature 1..324: note = derived and/or modified sequence opt11 from Lulizumab_pegol_LightChain1
  source 1..324: mol_type = other RNA
gacatccaaatgacccaatccccctcctccctctccgcctccgtcggcgaccgcgtcaccatcacctgccgcgcctcccgccccatctggcccttcctcgaatggtaccaacaaaaacccggcaaagcccccaaactcctcatctacttcacctcccgcctccgccacggcgtcccctcccgcttctccggctccggctccggcacctgcttcaccctcaccatctcctccctccaacccgaagacttcgccacctactactgcctccaaaacgtcgccaaccccgccaccttctcccaaggcaccaaagtcgaaatcaaacgc

SEQ ID NO: 54038 - RNA, 324 nt, synthetic construct
  misc_feature 1..324: note = derived and/or modified sequence opt11 from Lulizumab_pegol_LightChain
  source 1..324: mol_type = other RNA
gacatccaaatgacccaatccccctcctccctctccgcctccgtcggcgaccgcgtcaccatcacctgccgagcctcccgccccatctggcccttcctcgaatggtaccaacaaaaacccggcaaagcccccaaactcctcatctacttcacctcccgcctccgccacggcgtcccctcccgcttctccggctccggctccggcacctgcttcaccctcaccatctcctccctccaacccgaagacttcgccacctactactgcctccaaaacgtcgccaaccccgccaccttctcccaaggcaccaaagtcgaaatcaaacgc

SEQ ID NO: 54039 - RNA, 1194 nt, synthetic construct
  misc_feature 1..1194: note = derived and/or modified sequence opt11 from Lumiliximab_HeavyChain1
  source 1..1194: mol_type = other RNA
gaagtccaacttgtcgaaagcggcggcggactcgccaaacccggcggctcactccgcctttcatgcgccgcctccggcttcagattcaccttcaacaactactacatggactgggtcagacaagctcccggccaaggactagaatgggtcttaaccaccggcagcgattcctggggccaaggtgttctagtaaccgtctcctccgcatccaccaaaggcccctccgtatttcccctagccccctcttcaaagtccacctccggcggaacagccgccctcggatgcctcgtcaaagactacttccccgaaccagtcacagtatcttggaactccggagccctaacctccggcgtccacaccttccccgccgtgctccaatcctctggactctactccctctcatcagtcgtcacagtcccatcctcaagcctcggcacccaaacctacatctgcaacgtcaatcacaaaccctccaacaccaaagtagacaagaaagtagaaccaaaatcctgcgacaaaacccacacatgcccaccctgtcccgccccagaactcctcggaggaccatcagtcttcctattcccacccaaacctaaagacaccctcatgatttctcgaacccccgaagtcacatgcgtcgtcgtcgacgtctcacatgaagaccccgaagtcaaattcaactggtatgtcgacggagtcgaagtacacaacgccaaaaccaaaccccgagaagaacaatacaactccacctatcgcgtcgtctccgtcctcaccgtcctccaccaagactggctcaacggcaaagaatacaaatgcaaagtctccaacaaagctctacccgccccaattgagaaaacaatctccaaagccaaaggccaaccccgtgaaccccaagtatacaccctcccaccctctcgagacgaactcaccaaaaaccaagtcagcctaacctgcctcgtaaaaggattctacccctcagacatagccgtcgaatgggaatcaaacggacaacccgaaaacaactacaaaaccacaccacccgtcctcgactccgacggctccttcttcctctattccaaactcaccgtagacaaatcacgatggcaacaaggcaacgtcttctcctgctccgtaatgcacgaagccctccacaaccattacacacaaaaatcactctccctctcccccggaaaa

SEQ ID NO: 54040 - RNA, 642 nt, synthetic construct
  misc_feature 1..642: note = derived and/or modified sequence opt11 from Lumiliximab_LightChain1
  source 1..642: mol_type = other RNA
gacatccaaatgacacaatcaccctcctcactatccgcctccgtcggagaccgcgtcaccatcacctgccgcgcctcacaagacattcgctactacctcaactggtaccaacaaaaacccggaaaagcccccaaactcctcatctacgtcgcatcctcactccaatccggagtcccctcccgcttctccggcagcggctccggcaccgaattcacactaaccgtctcctcactccaacccgaagacttcgccacctactactgcctccaagtctactccaccccccgcaccttcggccaaggcaccaaagtcgaaatcaaacgaacagtcgccgccccatccgtcttcatcttcccaccctccgacgaacaactcaaatccggcaccgcctcagtcgtctgcctcctcaacaacttctacccacgcgaagccaaagtccaatggaaagtagacaacgccctccaatccggcaactcacaagaatccgtcaccgaacaagactccaaagactccacctacagcctctcctcaaccctcaccctatccaaagccgactacgaaaaacacaaagtctacgcctgcgaagtcacccaccaaggcctctcatctcccgtcaccaaatccttcaaccgcggcgaatgc

SEQ ID NO: 54041 - RNA, 1347 nt, synthetic construct
  misc_feature 1..1347: note = derived and/or modified sequence opt11 from Lumretuzumab_HeavyChain1
  source 1..1347: mol_type = other RNA
caagtccaactcgtccaatccggcgccgaagtcaaaaaacccggcgcatccgtaaaagtctcctgtaaggcaagcgggtacacattccgctcatcctacatctcctgggtccgccaagccccaggccaaggcctcgaatggatgggttggatctacgccggcaccggcagcccgagctacaaccaaaaactacaaggtcgcgtaaccatgaccaccgacacctcaacatccaccgcctacatggaactacgcagcctacgatccgacgacaccgccgtctactactgtgcacggcaccgagactactactctaactcactcacctactggggccaaggcacactagtcacagtctcctctgcctcaaccaaaggcccctctgtattccccctcgccccctcctcaaaatccacatccggcggaaccgctgctctcggctgcctagtcaaagactacttcccagagccagtaaccgtctcatggaactccggagccctcacctcaggcgtccacacattccccgccgtactccaatcatctggcctctactctctctcgtccgtagtcaccgtcccctcctcaagcctcggcacccaaacctacatctgcaacgtcaaccacaaaccctcaaacaccaaagtcgacaaaaaagtcgaacctaaatcctgcgacaaaacccatacctgccccccctgccctgctccagaactcctaggcggcccctcagtcttcctattccccccaaaacccaaagacaccctcatgatctcacgcacccccgaagtaacctgcgtcgtagtagacgtctcccacgaagaccccgaagtcaaattcaactggtacgtagacggagtcgaagtacacaacgcaaaaaccaaaccacgcgaagaacaatacaactccacctaccgagtcgtctccgtcctaaccgtcctacaccaagactggctcaacggcaaagaatacaaatgcaaagtcagcaacaaagccctccccgccccaatcgagaaaacaatcagcaaagccaaaggtcaacccagagagccacaagtctacaccctccccccctcacgagacgaactcaccaaaaaccaagtatcactaacctgcctcgtcaaaggattttacccctccgacatagccgtcgaatgggaaagcaacggccaacccgaaaacaactacaaaaccaccccccccgtcctagacagcgacggctccttcttcctatactccaaactcaccgtcgataaatctcgctggcaacagggaaatgtcttctcctgctccgtaatgcacgaagcgctgcacaatcactacacccaaaaatccctatccctctccccagga

SEQ ID NO: 54042 - RNA, 660 nt, synthetic construct
  misc_feature 1..660: note = derived and/or modified sequence opt11 from Lumretuzumab_LightChain1
  source 1..660: mol_type = other RNA
gacatcgtaatgacacaatcacccgacagcctcgccgtaagtctaggcgaacgcgcgaccataaactgcaaatcaagccaaagcgtactcaacagcggaaaccaaaaaaactacctaacctggtaccaacaaaaacccggccaaccacccaaactcctgatctactgggcaagcacccgcgaaagcggagtccccgaccgattctcaggctcaggctcaggcaccgacttcaccctaaccataagctcactccaagccgaagacgtagccgtatactactgccaaagcgattactcatacccatatacattcggacaagggaccaaactcgaaatcaaacgcacagtcgccgccccaagcgtattcatattccccccctcagacgaacaactaaaatccggcacagcctccgtcgtctgcctactaaacaacttctacccacgcgaagccaaagtccaatggaaagtcgacaacgccctccaaagcggaaactcacaagaaagcgtcacagaacaagacagcaaagactcaacctacagcctcagctcaaccctgacactaagcaaagccgactacgaaaaacacaaagtatacgcatgcgaagtcacccaccaaggcctatcctcacccgtgaccaaaagcttcaacagaggcgaatgc

SEQ ID NO: 54043 - RNA, 1329 nt, synthetic construct
  misc_feature 1..1329: note = derived and/or modified sequence opt11 from Lutetium_(177Lu)_lilotomab_satetraxetan_HeavyChain1
  source 1..1329: mol_type = other RNA
gaaatccaactccaacaatccggccccgagctagtcaaacccggcgcctctgtcaaagtttcctgcaaagcctccggatactcattcacagactacaatatgtactgggttaaacaaagccatggcaaatccctcgaatggatcggctacatcgacccctacaacggcgacaccacctacaaccaaaaattcaaaggaaaagccacgctcacagttgacaaatcatcctccaccgcattcatccacctcaactctcttacctcagaagactccgcagtatactactgcgcccgctccccctacggccactacgccatggactactggggccaaggcacctccgtcaccgtctcctccgccaaaacgaccccaccctctgtctaccccctagcccccggctctgccgcccaaaccaactccatggtcaccctcggctgtctcgtaaaaggctacttccccgaacccgtaaccgtaacatggaactccggatccctatcctccggcgtccacaccttccccgccgtactccaatctgacctctacaccctatcctcctccgtaacagtcccatcttccacctggccatccgaaacagtcacctgtaacgtagcacacccagcatcctctaccaaagtcgacaagaaaatcgtcccccgcgactgtggctgcaaaccctgcatctgcactgtccctgaagtctcctcagtcttcatattcccgcccaaacccaaagacgtcctcacaatcacactcacacccaaagtcacctgtgtcgtcgttgacatctccaaagacgaccccgaagtccaattctcctggttcgtcgacgacgtagaagtccacaccgcccaaacccaaccccgcgaagaacaattcaactccaccttccgctccgtctccgaactacccatcatgcaccaagactggctcaacggaaaagagttcaaatgccgcgttaactccgcagccttccccgcacccatcgagaaaaccatatccaaaacaaaaggacggccaaaagcgccccaagtatacaccatccctccacccaaagaacaaatggccaaagacaaagtctcactaacctgcatgataacggacttcttccccgaagacatcaccgttgaatggcaatggaacggccaacccgccgaaaactacaaaaacacccaaccaatcatggacacagacggctcatacttcgtatactccaaactcaacgtacaaaaatcgaactgggaagccggcaacacctttacctgctcagtcctccacgaaggactccacaaccaccacaccgagaagtcactttcccactcacccggtaaa

SEQ ID NO: 54044 - RNA, 642 nt, synthetic construct
  misc_feature 1..642: note = derived and/or modified sequence opt11 from Lutetium_(177Lu)_lilotomab_satetraxetan_LightChain1
  source 1..642: mol_type = other RNA
gacatcgtcatgacccaatcccacaaactactatccacatccgtcggagaccgcgtctccatcacatgcaaagcctcccaagacgtctccaccgccgtcgactggtaccaacaaaaaccaggccaatccccaaaactcctaatcaactgggcctccacccgccacaccggcgtccccgaccgcttcaccggctccggctccggcaccgactacaccctcaccatctcctccatgcaagccgaagacctcgccctctactactgccgccaacactactcaacccccttcaccttcggctcaggcaccaaactcgaaatcaaacgcgccgacgccgccccaaccgtctctatcttccctccctcctccgaacaactcacctccggcggcgcatccgtcgtctgcttcctcaacaacttctacccaaaagacatcaacgtcaaatggaaaatcgacggctcagaacgacaaaacggcgtcctcaactcatggaccgaccaagactccaaagactccacctactcaatgtcctccaccctcaccctcaccaaagacgaatacgaacgccacaactcctacacatgcgaagccacccacaaaacctccacctcccccatagtcaaatccttcaaccgcaacgaatgc

SEQ ID NO: 54045 - RNA, 1350 nt, synthetic construct
  misc_feature 1..1350: note = derived and/or modified sequence opt11 from Margetuximab_HeavyChain1
  source 1..1350: mol_type = other RNA
caagtacaactccaacaatccggacccgagctagtaaaacccggcgcctccctcaaactctcatgcaccgcctcaggtttcaacatcaaagacacatacatacactgggttaaacaaagacccgaacaaggccttgaatggatcggccgcatataccccaccaacggctacacccgatacgaccccaaattccaggacaaagccaccatcacagcagacacgtcctcaaacaccgcctatctccaagtctcacgcctcacatccgaagacaccgcagtatactactgttcacgctggggcggcgacggattctacgccatggactactggggccaaggagcgtccgtcaccgttagctccgcctctacaaaaggcccctccgtattcccactcgccccctcctccaaatccacctccggcggaaccgccgccctcggatgcctagtcaaagactacttccccgaacccgtaaccgtgtcctggaactcaggcgcactcacctcaggtgtgcacaccttccccgccgtgctacaatcctccggactctactcactatccagcgtcgtcaccgtcccctcatcatccctaggcacccaaacctacatctgcaacgtcaaccacaaaccctccaacacaaaagtcgacaaacgagtagaaccaaaatcctgcgacaaaacacacacatgccctccctgccccgcccccgaactcgtcggaggcccctcagtattcctcctacccccaaaacccaaagacaccctaatgatctctcgcaccccagaagtaacatgcgtagtagtcgacgtctcccacgaggacccggaagtcaaatttaactggtacgtcgacggtgtagaagtccacaacgccaaaaccaaaccacccgaagaacaatacaactccacactacgcgtagtctccgtcctcaccgtcctacaccaagactggctcaacggcaaagaatacaaatgcaaagtctccaacaaagccctccccgcacccatagagaaaaccatctccaaagccaaaggccaaccccgagaaccccaagtctacaccctccctccctcccgcgacgaactcaccaaaaaccaagtcagccttacttgcctcgtcaaaggcttctacccctcagacatagccgtcgaatgggaaagcaacggacaacccgaaaacaactacaaaaccacacccctcgttctcgactccgacggctcattcttcctctattccaaactaaccgtcgacaaatcacgatggcaacaaggcaacgtcttctcatgctccgtcatgcacgaagcactccacaaccactacacccaaaaatccctttccctatcacccggcaaa

SEQ ID NO: 54046 - RNA, 642 nt, synthetic construct
  misc_feature 1..642: note = derived and/or modified sequence opt11 from Margetuximab_LightChain1
  source 1..642: mol_type = other RNA
gacatcgtcatgacccaatcccacaaattcatgtccacctccgtcggcgaccgcgtctccataacctgcaaagcctcccaagacgtaaacaccgccgtcgcctggtaccaacaaaaacccggccactcccccaaactcctcatctactccgcctccttccgctacaccggcgtccccgaccgcttcaccggctcccgctccggcaccgacttcaccttcacaatctcctcagtccaagccgaagacctcgccgtctactactgccaacaacactacaccaccccacccaccttcggcggcggcaccaaagtcgaaatcaaacgcaccgtcgccgccccatccgtcttcatcttcccaccctccgacgaacaactcaaatccggcaccgcctccgtcgtctgcctactcaacaacttctacccccgcgaagccaaagtccaatggaaagtcgacaacgccctccaatccggcaactcacaagaatccgtcaccgaacaagactccaaagactcaacctactcactatcctccaccctcaccctctccaaagcagactacgaaaaacacaaagtctacgcctgcgaagtcacccaccaaggcctcagctcacccgtcaccaaatccttcaaccgtggcgaatgc

SEQ ID NO: 54047 - RNA, 762 nt, synthetic construct
  misc_feature 1..762: note = derived and/or modified sequence opt11 from Marzeptacog_alfa_HeavyChain1
  source 1..762: mol_type = other RNA
atcgtcggaggcaaagtctgccccaaaggcgaatgcccctggcaagtcctcctcctagtcaacggcgcacaactctgcggcggcaccctcatcaacaccatctgggtcgtcagcgccgcccactgcttcgacaaaatcaaaaactggcgcaacctcatagccgtcctcggagaacacgacctctccgaacacgacggcgacgaacaatcacgacgcgtcgcccaagtcataatcccgtctacatacgtccccggcaccaccaaccacgacatcgccctactccgcttacaccaaccagtagtactcaccgaccacgtcgtccccctatgcctccccgaacgcaccttctccgaacgcaccctcgccttcgtccgcttctccctagtctcaggctggggccgcctactagaccgcggcgccaccgccctcgaactccaagtactcaacgtcccccgcctcatgacccaagactgcctccaacaatcccgaaaagtcggcgactcccccaacatcaccgaatacatgttctgcgccggctactccgatggctcaaaagactcatgcaaaggcgactccggcggcccccacgctacccactaccgcggcacctggtacctcaccggcatcgtctcctggggccaaggctgcgccaccgtcggccacttcggcgtctacacccgcgtctcacaatacatcgaatggctacaaaaacttatgcgctccgaaccacgcccaggcgtcctcctccgcgcccccttcccc

SEQ ID NO: 54048 - RNA, 456 nt, synthetic construct
  misc_feature 1..456: note = derived and/or modified sequence opt11 from Marzeptacog_alfa_LightChain1
  source 1..456: mol_type = other RNA
gccaacgccttcctcgaagaactccgccccggctccctcgaacgcgaatgcaaagaagaacaatgctccttcgaagaagcccgcgaaatcttcaaagacgccgaacgcaccaaactcttctggatctcctactccgacggcgaccaatgcgcctcctcaccctgccaaaacggcggctcctgcaaagaccaactccaatcctacatctgcttctgcctccccgccttcgaaggccgcaactgcgaaacacacaaagacgaccaactcatctgcgtcaacgaaaacggcggatgcgaacaatactgctccgaccacaccggcaccaaacgctcctgccgctgccacgaaggctactccctcctcgccgacggcgtctcatgcaacgccaccgtcgaatacccctgcggcaaaatccccatcctcgaaaaacgcaacgcctccaaaccccaaggccgc

SEQ ID NO: 54049 - RNA, 669 nt, synthetic construct
  misc_feature 1..669: note = derived and/or modified sequence opt11 from Matuzumab_HeavyChain1_variant_3c08_H
  source 1..669: mol_type = other RNA
caagtccaactcgtccaatccggtgccgaagtcaaaaaacccggcgcctccgtaaaagtctcctgcaaagcctcaggctacaccttcacctcccactggatgcactgggtccgccaagcccccggccaaggcctcgaatggatcggagaattcaacccctccaacggccgaaccaactacaacgaaaaattcaaatccaaagccaccatgaccgtcgacacctccaccaacacagcctacatggaactctcctcactccgatccgaagacaccgccgtctactactgcgcctcccgcgactacgactacgacggccgatacttcgactactggggccaaggaaccctcgtcaccgtctcctccgcctcaaccaaaggcccctccgtcttccccctcgccccctcctcaaaatcaacctccggcggcaccgcagccctcggctgcctcgtcaaagactacttcccagaacccgtcaccgtatcctggaactccggcgcactcacctccggcgtccacaccttccccgccgtcctccaatcctccggcctctactccctctcatccgtcgtcaccgtcccctcaagctccctcggcacccaaacctacatctgcaacgtcaaccacaaaccctccaacaccaaagtcgacaaaaaagtcgaacccaaatcc

SEQ ID NO: 54050 - RNA, 669 nt, synthetic construct
  misc_feature 1..669: note = derived and/or modified sequence opt11 from Matuzumab_HeavyChain1_variant_3c09_C
  source 1..669: mol_type = other RNA
caagtacaactagtccaatccggcgccgaagtcaaaaaacccggcgcctccgtcaaagtctcctgcaaagcctccggctacaccttcacctcccactggatgcactgggtccgccaagcccccggccaaggcctcgaatggatcggcgaattcaacccctccaacggacgcaccaactacaacgaaaaattcaaatccaaagccacaatgaccgtagacacctccaccaacaccgcctacatggaactctcttccctccgctccgaagacaccgccgtatactactgcgcctcccgcgactacgactacgccggccgctacttcgactactggggccaaggcaccctcgtcaccgtctcctccgccagcaccaaaggcccatcagtcttccccctcgcaccctcctcaaaatcaacctccggcggcaccgcagccctcggctgcctcgtcaaagactacttcccagaacccgtcaccgtctcctggaactccggcgccctcacctcaggagtccacaccttccccgcagtcctccaatcctccggcctatactcactctcctcagtcgtcaccgtcccctcctcctcccttggcacccaaacctacatctgcaacgtcaaccacaaaccatccaacaccaaagtcgacaaaaaagtcgaaccaaaatcc

SEQ ID NO: 54051 - RNA, 636 nt, synthetic construct
  misc_feature 1..636: note = derived and/or modified sequence opt11 from Matuzumab_LightChain1_variant_3c08_L
  source 1..636: mol_type = other RNA
gacatccaaatgacccaatccccctcctctctctccgcctccgtcggagaccgagtcacaataacctgctcagcatcctcctccgtaacctacatgtactggtaccaacaaaaacccggcaaagcaccaaaactcctcatctacgacacctcaaacctcgcatcaggcgtcccctcacgcttctccggctccggctccggcactgactacaccttcaccatctcatccctccaacccgaagacatcgccacctactactgccaacaatggtcctcccacatcttcacattcggccaaggcaccaaagtcgaaatcaaacgcaccgtagccgccccctccgtcttcatcttcccaccctccgacgaacaactcaaatccggcactgcctccgtcgtctgcctcctcaacaacttctacccccgtgaagccaaagtccaatggaaagtcgacaacgcactccaatcaggcaactcccaagaatccgtcaccgaacaagactccaaagactccacatactccctatcctccaccctcaccctctccaaagcagactacgaaaaacacaaagtctacgcctgcgaagtcacacaccaaggcctctcctccccagtcaccaaatccttcaaccgcggcgaa

SEQ ID NO: 54052 - RNA, 636 nt, synthetic construct
  misc_feature 1..636: note = derived and/or modified sequence opt11 from Matuzumab_LightChain1_variant_3c09_B
  source 1..636: mol_type = other RNA
gacatacaaatgacccaatccccctcctcactctcagcctccgtcggcgaccgcgtcaccataacctgctccgcctcctcctccgtcacctacatgtactggtaccaacaaaaacccggcaaagcccccaaactactcatctacgacacctccaacctcgcatccggcgtcccctcccgcttctccggctccggctccggcaccgactacaccttcaccatctcctccctccaacccgaagacatcgccacctactactgccaacaatggtcctcccacatcttcaccttcggccaaggcaccaaagtcgaaatcaaacgcaccgtcgctgccccctccgtcttcatcttcccaccctccgacgaacaactcaaatccggcacagcctccgtcgtctgcctcctcaacaacttctacccccgcgaagccaaagtccaatggaaagtcgacaacgccctccaatccggaaactcccaagaatccgtcaccgaacaagactccaaagactccacctactccctctcctcaaccctcaccctctccaaagccgactacgaaaaacacaaagtctacgcctgcgaagtcacccaccaaggcctctcctcccccgtcacaaaatctttcaaccgcggcgaa

SEQ ID NO: 54053 - RNA, 1341 nt, synthetic construct
  misc_feature 1..1341: note = derived and/or modified sequence opt11 from Mavrilimumab_HeavyChain1
  source 1..1341: mol_type = other RNA
caagtccaactcgtccaatccggcgccgaagtcaagaaacccggcgcctccgtaaaagtgagctgcaaagtaagcggctacaccctgaccgaactaagcatacactgggtccgccaagcccccggcaaaggcctcgaatggatgggaggcttcgaccccgaagaaaacgaaatcgtatacgcccagcgattccaaggacgcgtcaccatgaccgaagacaccagcacggacaccgcctacatggaactctccagcctcagaagtgaagacactgccgtctactactgcgccatcgtaggcagcttcagcccactcacactcggcctctggggccaaggcaccatggtaaccgtgagctccgcctccactaaaggaccctccgtcttccccctcgccccctgctcacgctccacctccgaatccacagccgcattaggctgcctcgtcaaagactactttccagaaccagtcaccgtaagctggaactccggagcacttacatccggcgtacacaccttccccgccgtactacaaagctccggcctctactcactctcctccgtcgtaacagtcccctcctcttccctcggcacaaaaacctacacgtgcaacgtcgaccacaaaccctccaacacgaaagtcgacaaacgcgtagaatccaaatacggcccaccctgtccctcgtgccccgcccccgaatttctcggcggcccctccgtcttcctcttcccacccaaacccaaagacacacttatgatttcaaggacacccgaagtaacctgcgtcgtcgtagacgtttcccaagaagaccccgaagtacaattcaactggtacgtagacggcgtagaagtacacaacgccaaaacaaaaccaagagaagaacaattcaactcaacctaccgagtcgtctccgtcctcacagtccttcaccaagactggctaaacggcaaagaatacaaatgcaaagtatccaacaaaggcctaccctcaagcatcgaaaagaccataagcaaagccaaaggccagccccgcgaacctcaagtctacaccctcccacccagccaagaagaaatgaccaaaaaccaggtctccctaacatgcctcgtcaaaggattctacccctccgacatagccgtagaatgggaaagcaacggacaacccgaaaacaactacaaaactacacccccagtcctcgactcggacggatccttcttcctctactcacgcctcaccgtcgacaaatcccgctggcaagaaggcaacgtattcagctgctctgtcatgcacgaagccctccacaaccactacacccagaaaagtctcagccttagcctaggcaaa

SEQ ID NO: 54054 - RNA, 651 nt, synthetic construct
  misc_feature 1..651: note = derived and/or modified sequence opt11 from Mavrilimumab_LightChain1
  source 1..651: mol_type = other RNA
caatccgtccttacccaaccaccctccgtctccggcgcacccggccaacgcgtcaccatctcctgcaccggctccggctcaaacatcggcgccccatacgacgtctcctggtaccaacaactccccggcacagcccccaaactcctcatctaccacaacaacaaacgaccctccggcgtccccgaccgcttctcaggctccaaatccggcacatccgcctccctcgccatcaccggcctccaagccgaagacgaagccgactactactgcgcaaccgtcgaagcaggactctccggctccgtcttcggcggaggcacaaaactcaccgtcctcggccaacccaaagccgccccctcagtaaccctcttccccccctcatccgaagaactccaagcaaacaaagccaccctcgtctgcctcatctccgacttctaccccggcgccgtaaccgtcgcctggaaagccgactcctcccccgtcaaagcaggcgtcgaaaccaccaccccctctaaacaatccaacaacaaatacgccgcctcctcctacctatccctaacccccgaacaatggaaatcccaccgatcctactcctgccaagtcacccacgaaggctccaccgtcgaaaaaacagtcgccccaaccgaatgctcc

SEQ ID NO: 54055 - RNA, 1359 nt, synthetic construct
  misc_feature 1..1359: note = derived and/or modified sequence opt11 from MDX-1303_HeavyChain1
  source 1..1359: mol_type = other RNA
caagtacaactcgtagaatccggcggcggcgtcgtccaacccggacgatccctccgcctctcctgcgccgcatcaggcttcacattctcatactacggaatgcactgggtccgccaagcacccggtaaaggcctcgaatgggtagccgtcatctggcacgacgaatccatagtctactacgccgacagcgttaagggccgcttcactatctcgcgagacaactccaaaaacaccctctacctccagatgaactccctccgagccgaggacaccgccgtctactactgcacacgtgaccccggcgacccctactactactactacggcctcgacgtctggggccaaggcaccaccgtcactgtctcctccgccagtacaaaaggcccctccgtcttccccctagcaccatcctccaaatctacctcaggcggcacagccgcactcggctgcctagtcaaagactacttcccagaaccagtcactgtatcctggaactccggcgcactcacctctggcgtccacacattccccgccgtgctccaatcatcaggcctctactccctctcctccgtcgtaaccgtaccatcatcatcgctaggcacccaaacttatatctgtaatgtcaatcacaaaccatccaacaccaaagtagacaagcgagtagagcctaagtcctgcgacaaaacacacacctgtcctccctgccccgcccccgaactccttggcggcccctccgtcttcttattccctcccaaacccaaagacaccctaatgatctcacgcacccccgaagtaacctgcgtcgtagtagacgtatcacacgaagaccccgaagtcaaattcaactggtacgtcgacggcgtagaagtccacaacgccaaaactaaaccccgcgaagaacagtataactcaacctaccgcgtcgtttccgtcctcacagtcctccaccaagactggctcaacggcaaagaatacaagtgcaaagtatcaaacaaagccctccccgcccccatcgagaaaacaatcagcaaagccaaaggccaaccacgcgaaccacaggtatacacactcccaccctcccgcgaagaaatgaccaaaaaccaagtctcacttacctgcctcgtcaaaggcttctacccctccgatatcgcagtcgaatgggaaagcaacggccagccagaaaacaattacaaaacaacaccaccagtcctcgacagcgacggatcattcttcctctactccaaactcacagtcgacaaatcacgctggcaacaaggcaacgtgttctcctgctcagtcatgcacgaagccttacacaaccactacacccaaaaatccctctccctgtcacccggcaaa

SEQ ID NO: 54056 - RNA, 645 nt, synthetic construct
  misc_feature 1..645: note = derived and/or modified sequence opt11 from MDX-1303_LightChain1
  source 1..645: mol_type = other RNA
gaaatcgtcctcacccaatccccaggcaccctctccctctcaccaggagaacgcgccaccctctcctgccgcgcctcccaatccgtctcctcctcctacctcgcctggtaccaacaaaagcccggccaagcccctcgcctcctcatctacggagcctcatcacgagccaccggcatccccgacagattctccggatccggctccggcacagacttcaccctcaccatctcccgcctcgaacccgaagacttcgccgtatactactgccaacaatacggctcatccatgtacaccttcggccaaggaaccaaactcgaaatcaaacgcaccgtagccgccccctccgtcttcatcttcccaccctcagacgaacaacttaaatcaggcaccgcctcagtcgtctgcctcctcaacaacttctacccccgcgaagccaaagtccaatggaaagtcgacaacgccctccaatccggcaactcacaagaatcagtaaccgaacaagacagcaaagactccacctactccctatcctccaccctcaccctctccaaagccgactacgaaaaacacaaagtctacgcctgcgaagtcacccaccagggcctctcctcccccgtcacaaaatccttcaaccgaggcgaatgc

SEQ ID NO: 54057 - RNA, 1347 nt, synthetic construct
  misc_feature 1..1347: note = derived and/or modified sequence opt11 from Mepolizumab_HeavyChain1
  source 1..1347: mol_type = other RNA
caagtaacccttcgcgaatcgggccccgctctcgtcaaaccaacccagaccctcacactcacatgcacagtcagcggcttctccctcacctcctactcagtccactgggtacggcaacctccaggcaaaggactcgaatggctcggcgtcatctgggcttccggcggcacagactacaattctgccctaatgtcacgcctctctatctcaaaagatacatccagaaaccaagtcgtcctaaccatgaccaacatggaccccgtcgacacagccacctactactgcgcccgcgacccaccctcatcactcctccgcctggactactggggacgcggcacccccgtcaccgtatcctcagcctccacaaaaggcccctccgtattccccctcgcccccagctccaaatcgacctccggaggcacagccgccctcggatgcctcgtcaaagactacttccccgaacccgtaaccgtctcctggaactcaggagccctaacctccggcgtccacaccttccccgcagtcctccaatccagcggactatattcactatcctccgttgtcaccgtcccctcctcatctcttggcacacaaacctacatctgcaacgtcaaccacaaaccatccaacacaaaggtcgacaaacgcgtagaaccaaaatcctgcgacaaaacccatacctgcccaccctgccccgcccccgaactcctaggcggaccctcagtattcctattcccacccaaaccaaaggacacgcttatgatctcccgcacacccgaagtaacatgcgtagtcgtagacgtaagccacgaagaccccgaagtcaaattcaactggtacgtagacggcgtcgaagtccacaacgcgaagaccaaacccagagaagaacaatacaactcaacctaccgcgtcgtatccgtcctcaccgtcctccaccaagactggctaaacggcaaagaatacaaatgcaaagtcagcaataaagcactacccgcacccatcgagaagacaatctccaaagccaaaggacaacctcgcgaaccacaagtatacacactcccaccctcacgcgaagaaatgaccaagaaccaagtatcactaacctgcctcgtcaaaggcttttacccctccgacatcgccgtagagtgggaatcaaatggccaacccgaaaacaattacaaaaccactcccccagtcctcgacagcgacggctccttcttcctctactccaaactaaccgtcgacaagtccagatggcaacaaggcaacgtgttctcatgctccgtcatgcacgaagcactccacaaccactacacccaaaaatctctctccctctcacccggaaag

SEQ ID NO: 54058 - RNA, 660 nt, synthetic construct
  misc_feature 1..660: note = derived and/or modified sequence opt11 from Mepolizumab_LightChain1
  source 1..660: mol_type = other RNA
gacatcgtgatgacacaatcacccgacagcctggccgtgtccctgggcgaacgcgcaaccataaactgcaaatcgagccaatccctcctcaacagcggaaaccagaaaaactacttagcctggtaccaacaaaaacccggacaaccacccaaactcctaatctacggcgcaagcacacgagaaagcggagtcccagaccggttctcaggctcaggctccggcacagacttcaccctaaccataagctcactccaagccgaagacgtagccgtatactactgccaaaacgtacactcattcccattcacattcggaggcggaaccaaactcgaaatcaaacgcacagtcgcagcaccaagcgtgttcatattcccaccctcagacgaacaactaaaatcaggcacggcctcggtcgtatgcctactcaacaacttctacccgcgcgaggccaaagtccaatggaaagtcgacaacgcactacagagcgggaactcacaagaaagcgtaaccgaacaagacagcaaagactcaacctacagcctgagctcaaccctaaccctaagcaaagccgactacgaaaaacacaaagtatacgcatgcgaagtcacgcaccaaggcctaagctcgcccgtaaccaagagcttcaacaggggcgaatgc

SEQ ID NO: 54059 - RNA, 1350 nt, synthetic construct
  misc_feature 1..1350: note = derived and/or modified sequence opt11 from Metelimumab_HeavyChain1
  source 1..1350: mol_type = other RNA
gaagtccaactcgtcgaaagcggaggcggcgtagtccaacccggccgctccctacgtctctcctgcgcagccagcggcttcaccttctcctcctacggaatgcactgggtccgtcaagcccccggaaaagaactcgaatgggtcgccgttatctcctatgacggcagcatcaaatactacgccgacagcgtaaaaggccgattcaccatctcccgcgacaactccaaaaacacactctacctccaaatgaactcactccgcgccgaagacacggcagtctactactgcgcacgcacaggcgaatactcaggctacgacaccgacccccaatacagctggggccagggcaccaccgtaactgtctcatccgcctccaccaaaggcccttccgtattcccactcgccccatgctcccgatccacctccgaatcgaccgcagccctcggctgcctagtaaaagactacttccccgaacccgtaaccgtctcatggaactccggcgcactgacctcaggcgtccacaccttccccgccgtcctccaaagctcaggcctatactccctctcatccgtcgtaacagtcccttcatcctctctaggaacaaaaacctacacatgcaacgtcgaccacaaaccatccaataccaaagtcgacaaacgtgtcgaatcaaaatacggacccccatgcccctcctgcccagcccccgagttccttggcggcccctccgtattcctgttcccacccaaacccaaacccacacttatgatctcaagaacacccgaagtaacctgcgtcgtcgtcgacgtctcacaagaagaccccgaagtccaattcaattggtacgttgacggcgtcgaagtccacaacgccaaaaccaaaccacgtgaagaacaatttaactccacctaccgcgtcgtcagcgtcctcacagtcctccaccaagactggctcaatggcaaagaatacaaatgcaaggtcagcaataaaggcctaccctcttccatcgaaaagactatctcaaaagccaaaggccaaccccgagaaccccaagtctacaccctacccccttcacaagaagaaatgaccaaaaaccaagtatccctcacatgcctagtaaaaggcttctatccctcagacatcgcagtcgaatgggaatccaacggccaaccagaaaacaactacaaaaccacaccaccagtactcgactctgacggatcatttttcctctactcccgcctcactgtcgacaaatcaagatggcaagaaggaaacgtattctcctgctcggttatgcacgaagccctacacaaccactacacgcaaaaatccctttcactaagccttggcaaa

SEQ ID NO: 54060 - RNA, 639 nt, synthetic construct
  misc_feature 1..639: note = derived and/or modified sequence opt11 from Metelimumab_LightChain1
  source 1..639: mol_type = other RNA
gaaatcgtcctcactcaatccccctcctccctctccgcctccgtcggcgaccgcgtcaccatcacctgccgagcctcccaaggcatcggcgacgacctcggatggtaccaacaaaaacccggcaaagcccccatcctcctcatctacggcacctccaccctccaatcaggagtcccctcccgcttctccggctcaggatcaggcacagacttcaccctcaccatcaactcactccaacccgaagacttcgccacctactactgcctccaagactccaactaccccctcacattcggcggcggcacccgcctcgaaatcaaacgcaccgtcgccgccccctcagtcttcatcttccccccctccgacgaacaactcaaatccggcaccgcctccgtcgtatgcctcctaaacaacttctacccccgcgaagccaaagtacaatggaaagtcgacaacgccctacaatccggcaactcccaagaatccgtaaccgaacaagactccaaagactctacctactccctctcctccaccctaaccctcagcaaagcagactacgaaaaacacaaagtctacgcctgcgaagtcacccaccaaggcttatcacccgtcaccaaatcattcaaccgcggagaatgc

SEQ ID NO: 54061 - RNA, 1350 nt, synthetic construct
  misc_feature 1..1350: note = derived and/or modified sequence opt11 from Milatuzumab_HeavyChain1
  source 1..1350: mol_type = other RNA
caagtccaactccaacaatccggcagcgaactcaagaaacccggagcctcagtcaaagtctcctgcaaagcatcaggctacaccttcaccaactacggagtcaattggatcaaacaagcccccggccaaggcctccagtggatgggctggatcaaccccaacaccggcgaacccaccttcgacgacgactttaaaggtcgcttcgccttctccctcgacacctccgtttccaccgcctacctccaaatatccagtctcaaagccgacgacaccgcagtctacttttgctcccgctcccgcggcaaaaacgaagcctggttcgcctactggggccaaggtacccttgtaacagtatcatctgcctccaccaaaggcccgtcagttttccccctcgccccctcctccaaatccacctccggaggcaccgccgccctaggctgcctcgtcaaagactactttcctgaacccgtaaccgtatcctggaactccggcgcgctaacatcaggcgtacacaccttccctgcagtcctccaaagctcaggcctctattccctatcctcagtagtaacagtacccagctcctcactcggcacccaaacctacatatgcaacgtaaaccataaaccctccaacacaaaagtcgacaaacgcgtagaacccaaatcctgcgacaaaacccacacatgccctccctgccccgcccccgaactactcgggggcccctccgtcttcctatttcctccaaaacccaaagacaccctaatgatatcccgcacccccgaagtaacctgcgtagtcgtcgacgtctcccacgaagaccccgaagtcaaattcaattggtacgtcgacggcgtagaagtccacaacgcaaaaaccaaaccccgcgaagaacagtacaactcaacataccgcgtcgtctcagttctaactgtactccaccaagactggctcaacggaaaagaatacaaatgcaaagtctctaacaaagccctccccgcccccatagaaaagaccatctccaaagccaaaggccaaccccgcgaaccccaagtctacaccctcccaccctccagagaagaaatgaccaaaaaccaagtatcgctaacctgtctcgttaaaggattctacccctccgacatcgcagtagaatgggagtcaaacggacaacccgaaaacaactataaaaccaccccacccgtcctcgactctgatggctcattcttcctctactccaagctcaccgtcgacaaatcccgctggcaacaaggcaacgtcttctcatgctctgtaatgcacgaagccctacacaaccactacacccagaaaagcctttccctctcccccggcaaa

SEQ ID NO: 54062 - RNA, 657 nt, synthetic construct
  misc_feature 1..657: note = derived and/or modified sequence opt11 from Milatuzumab_LightChain1
  source 1..657: mol_type = other RNA
gacatccaactcacccaatcacccctctccctcccagtaaccctcggccaacccgcctccatctcatgccgctcctcccaatccctcgtccaccgaaacggcaacacctacctccactggttccaacaacgccccggccaatctccccgcctactcatatacaccgtctccaaccgcttctccggcgtccccgaccgtttctccggctccggctccggaaccgacttcactctcaaaatctcccgcgtcgaagccgaagacgtcggcgtctacttctgctcccaatcatcacacgtcccccccaccttcggcgccggcacccgtctcgaaatcaaacgcaccgtcgccgccccctccgtattcatcttccccccctccgacgaacaactcaaatccggcaccgcctccgtcgtatgccttctaaacaacttctacccccgcgaagccaaagtccaatggaaagtcgacaacgccctccaatcaggcaattcccaagaatccgtcaccgaacaagactccaaagactccacctactccctatcctccaccctcaccctatccaaagccgattacgaaaaacacaaagtatacgcctgcgaagtcacccaccaaggcctctcatcacccgtcaccaaatccttcaaccgcggcgaatgc

SEQ ID NO: 54063 - RNA, 1341 nt, synthetic construct
  misc_feature 1..1341: note = derived and/or modified sequence opt11 from Mirvetuximab_HeavyChain1
  source 1..1341: mol_type = other RNA
caggtccaactcgtccaatccggcgccgaagtagttaaacccggcgcatccgtcaaaatctcatgcaaagcatcaggatacaccttcaccggctacttcatgaactgggtcaaacaatcccccggacaatcactcgaatggatcggacgaatccacccctacgacggagacacattctacaaccagaagtttcaaggaaaagccaccctcaccgtcgacaaatcaagcaacaccgcccacatggaactattatcactaacctccgaagacttcgctgtctactactgcaccagatacgacggctcccgagcaatggactactggggccaaggcaccaccgttaccgtatcatccgcatccaccaaaggcccctccgtgttccccctagccccctcctccaaatccacaagcggcggcacagccgccctcggatgcctagtcaaggactacttccccgaacccgtcaccgtctcctggaactccggcgccctcacctccggggtacacaccttccccgccgtactacaatcctcaggactctattccctatcaagcgtagtcaccgtcccctcttcttctctaggtacccaaacctacatctgcaacgtcaaccacaaaccctctaacacaaaagtcgacaagaaagtcgaacccaaatcatgcgacaaaacacacacctgtcccccatgccccgcccccgaactcctaggcggcccttccgtcttcctattcccacccaaacccaaagacaccctcatgatatcccggacccccgaagtcacatgcgtcgtcgtagacgtcagccacgaagaccccgaggtcaaattcaactggtacgtcgacggcgtcgaagtccacaacgccaaaacaaaaccccgcgaagaacaatacaactccacttaccgcgtcgtatcagtactaaccgtccttcaccaagactggctaaacggaaaagaatacaaatgcaaagtctccaacaaagccctccccgcccccatagagaaaacaatctccaaagccaaaggccaacccagagaaccccaggtatacaccctacccccatcccgcgacgaactcaccaaaaaccaagtctccctaacctgcctcgtcaaaggcttctacccctccgacatagccgtcgaatgggaatccaacggccaaccagaaaacaactacaaaaccacaccacccgtcctcgactcagacggctccttcttcctctactcaaaactcacagtcgacaaatcccgatggcaacaaggcaacgtcttcagctgctcagtcatgcacgaagccctccacaaccactacacccaaaaatccctctctctctcccccggc

SEQ ID NO: 54064 - RNA, 654 nt, synthetic construct
  misc_feature 1..654: note = derived and/or modified sequence opt11 from Mirvetuximab_LightChain1
  source 1..654: mol_type = other RNA
gacatcgtcctcacccaatcacccctctccctcgccgtatccctaggccaacccgccatcatctcctgcaaagcatcccaatccgtctccttcgccggaacctccctcatgcactggtaccaccaaaaacccggccaacaaccccgcctcctcatctaccgcgcctccaacctcgaagccggcgtccccgaccgtttctccggctccggctccaaaacagacttcaccttaacaatctcaccagtcgaagccgaagacgcagccacctactactgccaacaatcccgagaatacccctacaccttcggaggcggcaccaagctcgaaatcaaacgcaccgtcgcagccccctccgtattcatcttcccgccatccgacgaacaactaaaatcaggcacagcatcggtcgtctgcctcctcaacaacttctacccccgcgaagccaaagtccaatggaaagtcgacaacgccctccaatccggcaactcccaagaatctgtcaccgaacaagactccaaagactccacctactccctctcatcaaccctaaccctctccaaagccgactacgaaaaacacaaagtctacgcatgcgaagtcacccaccaaggcctctcatcccccgtcaccaaatccttcaacagaggcgaatgc

SEQ ID NO: 54065 - RNA, 1344 nt, synthetic construct
  misc_feature 1..1344: note = derived and/or modified sequence opt11 from Modotuximab_HeavyChain1
  source 1..1344: mol_type = other RNA
caagtccaactccaacaacccggcgcagaactcgtcgaacccgggggctccgtcaaactaagctgcaaagcatctggctacaccttcacctcacactggatgcattgggtcaaacaacgccccggccaaggactagaatggatcggcgaaatcaacccatcctccggacgaaacaactacaacgaaaaattcaagtcaaaagccaccctaaccgtcgacaaatcctcttcaaccgcctacatgcagttctcatcactaacctcagaagactcagctgtctactactgcgtccgctactacggctacgacgaagccatggactactggggacaaggcacctcggtcaccgtatcctccgcatctaccaaaggcccatccgtgttccccctcgccccctcctcgaaatccacctcaggtggaaccgccgccctcggctgtctcgtcaaagactacttccccgaacctgtcacggtctcatggaactcaggcgcactcacctccggcgtacacaccttccccgccgtcctgcaatcatccggactctactccctctcaagcgttgtcaccgtcccctcatcctcactaggaacccagacgtacatctgcaacgtcaaccacaaaccctccaacaccaaggtcgacaaaagagtagaacccaaatcctgcgacaaaacacatacctgcccaccctgccccgcacccgaactccttggaggcccctccgtcttcctcttccctcccaaacccaaagacaccctcatgatctcacgcacacccgaagtaacctgcgtcgtcgtcgacgtctcccacgaagaccccgaagtcaaattcaattggtacgtcgacggagtcgaagtacacaacgccaaaaccaaaccccgagaagaacaatacaactcgacctaccgcgtcgtctccgtcctcaccgtcctccaccaagactggctcaacggaaaagaatacaaatgcaaagtatccaacaaagccctcccagctcccatagagaaaaccatttccaaagccaaaggccaaccacgcgaaccacaagtctacacccttcccccatcacgagaagaaatgaccaagaaccaagtctccctcacatgccttgtcaaaggcttctacccatcagacatcgcagtcgaatgggaatccaacggccaacccgaaaacaactacaaaaccacaccccctgtacttgactcagacggctccttcttcctctactccaaactaaccgtagacaaaagccgctggcaacaaggcaacgtcttctcatgctcagtcatgcacgaagccctacacaaccattacacccaaaaatcactctcactatcccccgga

SEQ ID NO: 54066 - RNA, 657 nt, synthetic construct
  misc_feature 1..657: note = derived and/or modified sequence opt11 from Modotuximab_LightChain1
  source 1..657: mol_type = other RNA
gacatcgtcatgacccaagccgcattctccaaccccgtcacactcggcacatccgcctccatctcatgccgatcctccaaatcactcctacactccaacggcatcacatacctctactggtacctccaaaaacccggccaatccccccaactactcatctaccaaatgtccaacctcgcctccggcgttcccgaccgcttctcctcctctggctccggcaccgacttcaccctccgcatctcccgcgtcgaagccgaagacgtcggcgtctactactgcgcccaaaacctcgaactcccctacaccttcggcggcggcaccaaactcgaaatcaaacgaaccgtcgccgccccctccgtcttcatcttccccccctccgacgaacaactcaaatccggcaccgcatcagtcgtctgcctcctcaacaacttctacccccgcgaagccaaagtccagtggaaagtcgacaacgccctccaatcaggaaactcccaagaatccgtcacagaacaagactccaaagactccacctactccctctcctccaccctaaccctctccaaagccgactacgaaaaacacaaagtctacgcctgcgaagtcacccaccaaggcctctcctcccccgtcaccaaatccttcaaccgcggcgagtgc

SEQ ID NO: 54067 - RNA, 1347 nt, synthetic construct
  misc_feature 1..1347: note = derived and/or modified sequence opt11 from Mogamulizumab_HeavyChain1
  source 1..1347: mol_type = other RNA
gaagtacaactcgtcgaatctggcggcgacctcgtccaaccaggccgatccctacgtctctcctgcgcagcatcaggcttcattttctccaactacggcatgtcctgggtccgacaagctcccggaaaaggcctcgaatgggtcgccaccatctcatcagcctccacttactcctactaccccgactccgtcaaaggtcgatttaccatctcccgcgataacgccaaaaactcactctacctccaaatgaactccctccgcgtagaagacaccgccctctattactgcggccgacactccgacggcaactttgccttcggctactggggtcaaggcaccctcgtgacagtatcctcagcaagcacaaagggcccctccgtcttcccactagccccctcatccaaatccacatccggaggcacagccgcccttggctgcctcgttaaagactacttccccgaacccgtcacagtcagctggaactccggcgctctcacctccggcgtccacacatttccagcagtactccaatcctccggcctgtactccctcagctccgtcgtcaccgtaccctcctcctcactcggcacccaaacatatatctgcaacgtcaaccacaaaccctccaatacaaaagtcgacaagaaagtcgaacccaaatcctgcgacaaaacgcacacatgcccaccctgccccgcccccgaactactcggcggtccctccgtcttcctcttcccacccaaacccaaagacaccctaatgatctcccgtacccccgaagtcacatgcgtagtcgtcgacgtcagccacgaagaccccgaagtcaaattcaattggtacgtcgacggtgtagaagtccacaacgccaaaaccaaacccagagaagaacaatataactctacctaccgcgttgtctcagtcctcaccgtcctacaccaagactggttaaatggcaaagaatacaaatgcaaagtctccaataaagctctccccgcccccatcgagaaaaccatctccaaagccaaaggccaaccccgcgaaccccaagtctacactctcccaccctcacgcgacgaactcaccaaaaaccaagtctccctaacttgcctcgtcaaaggattctacccctcagacatcgccgtcgaatgggaatccaacggccaacccgaaaacaactacaagaccacaccacccgtactcgactccgacggctccttcttcctatactcaaaactcaccgtcgacaaatcaagatggcaacaaggcaacgtcttctcctgctcagtcatgcacgaagccctccacaaccactacacccaaaaatccctctccctctcccccggcaaa

SEQ ID NO: 54068 - RNA, 657 nt, synthetic construct
  misc_feature 1..657: note = derived and/or modified sequence opt11 from Mogamulizumab_LightChain1
  source 1..657: mol_type = other RNA
gacgtcctcatgacccaatcacccctctccctccccgtcacccccggcgaacccgcctccatctcctgccgctcctcccgcaacatcgtacacatcaacggagacacctacctcgaatggtacctccaaaagcccggccaatcaccccaactcctcatctacaaagtctcaaaccgattctccggcgtaccagaccgcttctcaggctccggctcaggcaccgacttcaccctcaaaatctccagagtagaagcagaagacgtcggcgtctactactgcttccaaggctccctcctcccctggaccttcggccaaggcaccaaagtcgaaatcaaacgcaccgtcgccgccccctccgtcttcatcttcccaccctccgacgaacaactcaaatcaggcacagcctcagtcgtctgcctcctcaacaacttctacccccgagaagccaaagtccaatggaaagtcgacaacgcactccaatccggcaactcccaagaatcagtaaccgaacaagactccaaagactcaacctactccctctcctccaccctcaccctctcaaaagccgactacgaaaaacacaaagtctacgcctgcgaagtcacacaccaaggcctctcatcacccgtcaccaaatcattcaaccgaggcgaatgc

SEQ ID NO: 54069 - RNA, 1356 nt, synthetic construct
  misc_feature 1..1356: note = derived and/or modified sequence opt11 from Monalizumab_HeavyChain1
  source 1..1356: mol_type = other RNA
caagttcaactcgtacagtccggcgcagaagtaaagaaacccggcgcctccgtcaaagtatcttgcaaagcctccggttacaccttcaccagctactggatgaactgggtccgccaagcacccgggcaaggcctcgaatggatgggtcgaatagacccctacgactcagaaacccactacgcccaaaaactacaaggccgcgtaaccatgaccactgacacctcgacctccaccgcatacatggaactacgctccctccgcagtgatgacaccgccgtctactactgcgcacgcgggggttacgacttcgacgtaggcactctctactggttcttcgacgtctggggccagggcaccaccgttaccgtctcatccgcctccaccaaaggaccctccgtattcccgctagcaccctgttcccgcagcacctctgaatcaaccgccgcactcggctgcctcgtaaaagactacttccccgaacccgtcaccgtctcctggaacagcggagccctcacctccggcgtacacaccttccccgccgtcctccaatcctccggcctttactccctctcctccgttgtcacagtcccttcctcatcactaggcaccaaaacctacacctgtaacgtcgaccacaaaccctcaaacaccaaagtcgacaaacgcgtcgaatccaaatacggtccaccctgccctccatgccccgcacccgaatttctcggaggtccatccgtcttcctctttcccccaaaaccaaaggacaccctcatgatctcccgaaccccagaagtaacctgcgtcgtcgtcgacgtatcccaagaagatcccgaagtccagttcaactggtacgtcgacggagtagaagtacataacgctaaaaccaaaccccgagaagaacaattcaactcaacctaccgcgtcgtctccgtcctcacagtcctccaccaagactggctcaacggcaaagaatacaaatgcaaagtctccaacaaagggctcccctcatccatcgaaaagacaatctccaaagccaaaggccaacccagagaaccacaagtatacaccctcccgccctcccaagaagaaatgaccaaaaaccaagtctcacttacctgcctcgtaaaaggattctacccctcagacatcgccgtcgaatgggaatcaaacggccaacccgaaaacaactacaaaaccaccccacccgtactcgattcagacggcagcttcttcctctactcccgactcactgtcgacaaatcccgctggcaagaaggcaacgtcttctcatgctctgtcatgcacgaagcactccataaccactacacacaaaaatccctctccctctcactcggaaaa

SEQ ID NO: 54070 - RNA, 642 nt, synthetic construct
  misc_feature 1..642: note = derived and/or modified sequence opt11 from Monalizumab_LightChain1
  source 1..642: mol_type = other RNA
gacatccaaatgacccaatccccctcctccctatcagcctcagtcggcgaccgcgtcaccatcacctgccgcgcctccgaaaacatctactcctacctcgcctggtaccaacaaaaaccaggcaaagcccccaaactcctcatctacaacgccaaaaccctcgccgaaggcgttcccagccgcttctccggctccggctcaggaaccgacttcaccctcaccatctcctccctccaacccgaagacttcgccacctactactgccaacaccactacggcaccccccgcaccttcggcggcggcaccaaagtcgaaatcaaacgcaccgtcgccgcccccagcgtattcatattccccccctcagacgaacaactcaaatcaggcaccgcctccgtcgtctgcctcctcaacaacttctacccccgcgaagccaaagtccaatggaaagtagacaacgccctccaatcaggcaactcacaagaatccgtcaccgaacaagactctaaagactccacctactccctcagctccaccctcaccctctccaaagcagactacgaaaaacacaaagtctacgcctgcgaagtcacccaccaaggcctatcctcccccgtcaccaaatccttcaaccgaggcgaatgc

SEQ ID NO: 54071 - RNA, 1350 nt, synthetic construct
  misc_feature 1..1350: note = derived and/or modified sequence opt11 from Motavizumab_HeavyChain
  source 1..1350: mol_type = other RNA
caagtaacactacgagaatccggacccgccctcgtcaaacccacacaaaccctcacattaacctgcaccttctcaggattctccctctccaccgccggaatgtcagtcggctggatccgacaacctcccggcaaggctctcgaatggctcgccgatatctggtgggacgacaagaaacactacaacccctcactcaaagaccgcctcaccatatccaaagacacctccaaaaaccaagtagtactcaaagtcacaaacatggaccccgcagacaccgccacatactactgcgcccgcgacatgatcttcaacttctacttcgacgtctggggccaaggcaccacagtaacagtatcatccgcatccaccaaaggaccctccgtcttccccctcgccccatcctctaaatcgacctccggaggcaccgccgccctaggatgcctcgtaaaagactatttccccgaacccgtcacagtctcatggaactcaggcgccctaacatctggcgtacacaccttcccagccgtattacaatcctcaggcctctactcactctcaagcgtcgttaccgtccctagctccagcctcggcacacaaacctacatatgcaacgtcaaccacaaaccctcaaacaccaaagtcgacaaacgcgtcgaacccaaatcatgcgacaaaacacacacatgccctccctgtccagccccagaacttctaggaggaccctccgtattcctcttccctcccaagcccaaagacaccctcatgatctcgcgaacccccgaagtgacctgcgttgtagtcgacgtgagccacgaagaccccgaagtcaaattcaactggtacgtggatggcgtcgaagttcacaatgccaagaccaaaccccgagaagaacaatataactcaacctaccgcgtcgtcagcgtactcaccgtcctccaccaagactggctaaacggtaaggagtacaaatgcaaagtctccaacaaagcactacccgcccccatcgagaaaaccatctccaaagcaaaaggccaaccccgtgaaccccaagtttacaccctacctccctcccgcgaagaaatgaccaaaaaccaagtctcactaacctgtctcgtcaaaggcttctacccctccgacatcgccgtcgaatgggaatcaaacggccaacctgaaaataactacaaaaccacaccacccgtcctcgactcagacggatcatttttcctctactccaaactcaccgtcgacaaatcccgctggcaacagggcaacgtattctcctgctccgttatgcacgaagccctccacaaccactacacccaaaagtcactatccctatcacccggcaag

SEQ ID NO: 54072 - RNA, 1350 nt, synthetic construct
  misc_feature 1..1350: note = derived and/or modified sequence opt11 from Motavizumab_HeavyChain_variant
  source 1..1350: mol_type = other RNA
caagtaactctccgagaatccggtcccgccctcgtcaaacccacccaaacactcaccctgacctgcacattctccggcttttccctgtcaacagctggcatgtcagtaggatggatccgccagccccccggcaaagccctcgaatggctcgcagacatctggtgggacgataaaaaacactacaacccctccctcaaagaccgcctcacaatctcaaaagacacatcaaaaaaccaagtcgtcctaaaagtcaccaacatggaccccgccgacaccgccacctactactgcgcccgagacatgatcttcaacttctacttcgacgtctgggggcaaggcaccacagtcacagtatcatccgcctccaccaaaggcccctccgtcttccccctcgccccatcctccaaatccacctccggcggcacagccgccctcggatgcctcgtcaaagactacttccccgagcccgtcacagtctcatggaactccggcgccctaacctcaggcgtccacacattccccgccgtcctacaatcttccggactctactccctatcatccgtagtcaccgtcccatcctcctccctcggcacccagacctacatatgcaacgtcaaccacaaaccgtccaacaccaaagtcgataaacgcgtcgaacctaaatcctgcgacaaaacccacacatgccccccctgccccgcacccgaactcttaggcggcccctcggttttcctattccccccgaaacccaaagacaccctcatgatatcacgcacacccgaagtcacctgcgtcgtcgtagacgtctcccacgaagacccagaagtcaaattcaactggtacgtcgacggcgtcgaagtccacaacgctaaaaccaaaccgcgtgaagaacaatacaactcaacctacagagtcgtatccgtcctcacagtcctccaccaagactggctcaacggaaaagagtacaaatgcaaagtctcgaacaaagccctcccagcaccaatcgaaaaaactatctccaaagccaaaggccaacctcgtgaaccccaagtctacacattacccccctcccgcgaagaaatgaccaaaaaccaagtatcactaacatgcctcgtcaaaggcttctaccccagcgacatcgccgtcgagtgggaatccaacggccaacccgaaaacaactacaaaactactcctccggtactcgactctgacggctcattcttcctatactcaaaactaacagttgacaaatcccgctggcagcaaggcaacgtattctcatgctccgtaatgcacgaagccctccataaccattacacccaaaaatccctctccctcagccctggcaaa

SEQ ID NO: 54073 - RNA, 639 nt, synthetic construct
  misc_feature 1..639: note = derived and/or modified sequence opt11 from Motavizumab_LightChain
  source 1..639: mol_type = other RNA
gacatccaaatgacccaatccccctcaaccctctcagcctccgtcggcgaccgcgtcaccatcacctgctcagcctcttcccgagtcggctacatgcactggtaccaacaaaaacccggcaaagcccccaaactgctcatctacgacacctccaaactcgcctccggcgtcccctccagattctccggctccggctccggcaccgaattcaccctaaccatcagctccctccaacccgacgacttcgccacatactactgcttccaaggctccggctaccccttcaccttcggcggcggcaccaaagtcgaaatcaaacgcaccgtcgccgccccctccgtcttcatattccccccctccgatgaacaactcaaatccggcaccgcctcagtcgtctgcctcctcaacaacttctacccccgcgaagccaaagtacaatggaaagtcgacaacgccctccaatccggcaactcacaagaatccgtcaccgaacaagactccaaagactccacctactccctatcctccaccctcaccctctccaaagccgactacgaaaaacacaaagtctacgcctgcgaagtcacccaccaaggcctctcctcccccgtaaccaaatctttcaaccgcggcgaatgc

SEQ ID NO: 54074 - RNA, 639 nt, synthetic construct
  misc_feature 1..639: note = derived and/or modified sequence opt11 from Motavizumab_LightChain_variant
  source 1..639: mol_type = other RNA
gacatccaaatgacccaatccccctccaccctctccgcctccgtcggagaccgcgtcacaatcacctgctccgcatcctcccgcgtcggctacatgcactggtatcaacaaaaacccggcaaagcccccaaactactcatctacgacacctccaaactcgcctctggcgttccctcacgcttctccggctccggctcaggcaccgaattcaccctaactatctcctcactccaacccgacgacttcgccacctactactgcttccaaggctcaggatacccattcaccttcggcggcggcacaaaagtcgaaatcaaacgcaccgtcgccgccccatccgtcttcatcttccccccttcagacgaacaactaaaatctggcacagcctccgtcgtctgcctcctcaacaacttctacccccgcgaagccaaagtccaatggaaagtcgacaacgcccttcaatccggaaactcccaagaatccgtcaccgaacaagactccaaagactcaacctactccctctcctccaccctcacactctccaaagccgactacgaaaaacacaaagtctacgcatgcgaagtcacccaccaaggcctatcctcccccgtcaccaaatcattcaaccgaggcgaatgc

SEQ ID NO: 54075 - RNA, 1428 nt, synthetic construct
  misc_feature 1..1428: note = derived and/or modified sequence opt11 from Moxetumomab_pasudotox_HeavyChain1
  source 1..1428: mol_type = other RNA
atggaagtgcaactcgtcgaatccggcggaggtctggtcaagcccggaggctcactcaaactctcctgcgcagccagcggattcgccttcagcatatacgacatgtcgtgggtacgacaaaccccagaaaagtgcctagaatgggtagcctacatcagcagcggcggaggcacgacatactaccccgacacagtcaagggaagattcacaatatcccgcgacaacgccaaaaacaccctatacctgcaaatgagctcactcaagtccgaagacacagcaatgtactactgcgcgcgccacagcggatacggcacccactggggagtcctattcgcatactggggacaaggcacgctcgtgaccgtaagcgcaaaagctagcggcggcccagaaggaggatcactcgcagcactcaccgcacaccaagcctgccacctccccctagaaacattcacaagacaccgacaacctagaggctgggaacaactagaacaatgcggctaccccgtacaacgattagtggccctatacctagccgcaagactatcctggaaccaagtcgaccaagtcataagaaacgccctagcctccccgggctcaggaggagacctcggcgaagccatacgcgaacaaccagaacaagccagacttgccctcacactcgcagccgcagaatccgaaagattcgtccgacaaggcacaggaaacgacgaagcaggagccgccaacggccccgcagacagcggagacgccctactcgaacgcaactacccaacgggagccgagttcctcggagacggcggggacgtatccttctccacacgtgggacccaaaactggaccgtagaacgactactgcaagcgcaccgacaattagaagaacgcggatacgtcttcgtcggataccatggaacgttcctcgaagccgcacaatcgatcgtattcggaggcgtacgcgcaagatcacaagacctagacgccatatggcgaggcttctacatagcaggcgacccagcactagcatacggatatgcccaagaccaggaaccagacgcacgaggacgcataagaaacggcgcactcctaagagtgtacgtgcccagaagctccctaccaggattctaccgaacctcactcaccctcgccgccccagaagcggccggagaagtagaaagactaatcggccacccactacccctgcgactagacgcaatcacaggacccgaagaagaagggggcagactagaaaccatactcggctggccgctagcagaaagaactgtagtcatcccaagcgcaatcccaacggacccacggaatgtagggggagacctcgacccatcaagcatcccagacaaagaacaagcgatatccgccctacccgactacgcaagtcagcccggcaaaccacccagagaagacctaaaa

SEQ ID NO: 54076 - RNA, 324 nt, synthetic construct
  misc_feature 1..324: note = derived and/or modified sequence opt11 from Moxetumomab_pasudotox_LightChain1
  source 1..324: mol_type = other RNA
atggacatccaaatgacccaaaccacctcctccctctccgcctccctcggcgaccgcgtcaccatctcatgccgcgcctcccaagacatctccaactacctcaactggtaccaacaaaaacccgacggcaccgtcaaactcctcatctactacacctccatcctccactccggcgtcccctcccgcttctccggctccggctccggcaccgactactccctcaccatctccaacctcgaacaagaagacttcgccacctacttctgccaacaaggcaacaccctcccctggaccttcggctgcggcaccaaactagaaatcaaa

SEQ ID NO: 54077 - RNA, 1350 nt, synthetic construct
  misc_feature 1..1350: note = derived and/or modified sequence opt11 from Muromonab-CD3_HeavyChain
  source 1..1350: mol_type = other RNA
caagtccaacttcaacaatccggagccgaactagcacgacccggagcatcagtcaaaatgtcctgcaaagcctccggctatacctttacaagatacacaatgcactgggtcaaacaacgccccggacaaggcctagaatggataggctacatcaacccctcccgaggctacaccaactacaaccagaaattcaaagacaaagcaacactaaccaccgacaagtcctcctccaccgcatacatgcaactatccagcctcacatccgaagactctgcagtctactactgcgcccgatactacgacgaccactattgcctcgactactggggccaaggcaccacactcaccgtctcctccgccaagaccaccgccccatcagtatacccacttgctcctgtatgcggcggcacaaccggatcctcagtcaccctgggctgcctagtcaaaggctatttccccgaacccgttaccctcacctggaactccggcagcctctcatccggagtccacaccttccccgccgtcctccaatcagacctatacaccctatcctcatctgtaaccgtcacctcttccacctggccctcccagtccataacctgcaatgtagcccaccccgcctcctcaaccaaagtcgacaagaaaatcgaacccagacccaaatcctgcgacaaaactcacacctgtcccccatgccccgcccccgaactcctcggcggcccctcagtcttcctattcccacccaaacccaaagacacactcatgatctcccgtacacccgaagtaacctgcgtcgttgtcgacgtctctcacgaagaccccgaagtcaaattcaactggtacgtagacggtgtcgaagtccacaacgccaaaaccaaacccagagaagaacaatacaactccacctaccgtgtcgtctcagtcctcaccgtactccaccaagactggctcaacggtaaagaatacaaatgcaaggtttccaacaaggcgctccccgcacccatcgagaaaacaatatccaaagccaaaggtcaaccacgggaaccccaagtttacacgctcccaccctcacgcgacgaactcaccaaaaaccaagtaagcctaacctgcctcgtaaaaggcttctacccctcagacatagccgtcgaatgggaaagcaacggacaacccgaaaacaactacaaaaccacacccccagtccttgactcagacggctccttcttcctctactccaagctcactgtagataagtccagatggcaacaaggcaacgtcttctcctgctccgtcatgcacgaagcactacataaccactacactcaaaaatctctttcactatcccccggcaaa

SEQ ID NO: 54078 - RNA, 639 nt, synthetic construct
  misc_feature 1..639: note = derived and/or modified sequence opt11 from Muromonab-CD3_LightChain
  source 1..639: mol_type = other RNA
caaatagtccttacccaatctcccgccatcatgtcagcctcccccggagaaaaagtcaccatgacctgctccgcatcatcctcagtctcctacatgaactggtaccaacaaaaatccggcacatcccccaaacgctggatatacgacacctcaaaactcgcctccggagtccccgcccacttccgcggctccggctccggcacctcatactccctcaccatctccggcatggaagccgaagacgccgcaacatactactgccaacaatggtcttccaaccccttcaccttcggatccggcaccaaactcgaaatcaaccgcgcagacaccgcacccaccgtctccatcttccccccctcctcagaacaactcacctccggcggagcctccgtcgtctgcttcctcaacaatttctaccccaaagacatcaacgtcaaatggaaaatcgacggctccgaacgccaaaacggcgtactcaactcctggaccgaccaagactccaaagactccacctactcaatgtcctccacactcaccctcaccaaagacgaatacgaacgccacaactcatacacctgcgaagccacacacaaaacatccacctcccccatagtcaaatccttcaaccgcaacgaatgc

SEQ ID NO: 54079 - RNA, 1347 nt, synthetic construct
  misc_feature 1..1347: note = derived and/or modified sequence opt11 from Namilumab_HeavyChain1
  source 1..1347: mol_type = other RNA
caagtacagctagtccaatccggcgctgaagtaaagaaacccggcgcctccgtgaaagtatcctgcaaagccttcggctacccgttcaccgactacctcctgcactgggtccgacaagcccccggccaaggccttgaatgggtaggctggctcaacccctactctggcgacaccaactacgcacaaaaattccaaggtcgagtcaccatgacccgtgacacctccatctccaccgcctacatggaactctctcgactccgctcagacgacactgccgtctactactgcactcgcaccaccctaatctcagtctactttgactactggggacaaggaaccatggtaaccgtatcttcagcctccaccaaaggaccctccgtcttcccactcgccccatcctccaaatcaacttcaggcggcacagccgccctcggctgcctagtcaaagactacttccccgaacccgtcacagtatcctggaactcaggagccctaacctccggcgtccacaccttcccagcagtcctacaaagctcaggactctactccctctcctccgtcgtaaccgtcccctccagctctctcggcacccaaacttacatctgcaacgtcaaccacaaaccctcaaacaccaaagtcgacaagaaagtcgagcccaaatcctgcgacaaaacccacacatgcccaccctgccccgcccccgaacttctcggaggcccctccgtcttcctatttcccccaaaacccaaagacaccctcatgatctcccgaacccccgaagtaacctgcgtcgtcgtcgacgtatcccacgaagacccagaagtcaaattcaactggtacgtcgacggagtggaagtccacaacgccaaaaccaaaccccgcgaagaacagtacaactcaacctaccgagtcgtttccgtcctcaccgtcctccaccaagactggctcaacggcaaagaatacaaatgcaaagtatccaacaaggccctccccgcccccattgagaaaaccatttccaaagccaaaggccaaccccgcgagccacaagtctacaccctccctccctcccgcgacgaactcaccaaaaaccaagtctcccttacatgcctcgtcaaaggcttctacccctccgacatcgccgtcgaatgggaatctaatggccaacctgaaaacaactacaaaaccacacccccagtcctcgactcagacggatccttctttctctactccaaactcaccgttgacaaatcccgctggcagcaaggcaacgtcttctcatgctccgtaatgcacgaagccttacacaaccactacacccaaaagtcactctcgctctccccaggcaaa

SEQ ID NO: 54080 - RNA, 642 nt, synthetic construct
  misc_feature 1..642: note = derived and/or modified sequence opt11 from Namilumab_LightChain1
  source 1..642: mol_type = other RNA
gacatccaaatgacccaatccccctcctccgtttccgcatccgtcggcgaccgcgtcaccatcgcctgccgcgcctcccaaaacatccgaaacatcctcaactggtaccaacaacgccccggcaaagcaccccaactcctcatctacgccgcctccaacctccaatccggagtcccctcccgcttctccggctccggctccggcacagacttcaccctcaccataaactccctccaacccgaagacttcgccacctactactgccaacaatcatactccatgccccgtaccttcggcggcggcaccaaactcgaaatcaaacgcaccgtcgccgccccctccgtcttcatcttcccaccctcagacgaacaactcaaatccggcaccgcctccgtcgtatgcctactcaacaatttctacccccgcgaagccaaagtccaatggaaagtcgacaacgccctccaatcaggcaactcccaagaatccgtaaccgaacaagactccaaagactccacatactccctatcctccaccctaaccctctccaaagccgactacgaaaaacacaaagtctacgcctgcgaagtcacacaccaaggcctctcctcccccgtcaccaaatccttcaaccgcggcgaatgc

SEQ ID NO: 54081 - RNA, 1374 nt, synthetic construct
  misc_feature 1..1374: note = derived and/or modified sequence opt11 from Naptumomab_estafenatox_HeavyChain
  source 1..1374: mol_type = other RNA
gaagtacaactacaacaaagcgggccagacctagtcaaacccggcgcaagtgtcaaaatatcctgcaaagcctccggatactcattcaccggctactacatgcactgggtcaaacaatcacccgggaaaggcctcgaatggattggcagaatcaacccaaacaacggcgtcacactatacaaccaaaaattcaaggacaaagcaaccctcaccgtcgacaaatcctcaaccacggcctatatggagctccgctctctcacatcagaagactccgccgtctactactgcgcaagatccaccatgatcacaaactacgtgatggactattggggccagggaacttccgtcaccgtatcctcagccaaaacaactcccccatcagtataccccctcgcacccggctccgcagcccagaccaactccatggtcacccttggctgcctggtcaaaggctacttcccagaaccagtcaccgtaacatggaactccggatccctctcatccggcgtacacacattccccgccgtcctccaaagcgacctctacaccctctcatcaagcgtcaccgtcccctcgtcaacatggccgtcagaaaccgtaacctgcaacgtagcacaccccgcctcctccaccaaagtcgacaagaaaatagtcccacgcgactccggaggaccctcagaaaaatctgaggaaatcaacgagaaagacctccgaaagaaatccgaactccaaggaactgcccttggcaacttaaaacaaatatactactacaacagcaaagcaataacatcgtccgaaaaatcagccgaccaattcctaaccaacacactcctatttaaaggcttcttcaccggccacccctggtacaacgacctcctcgtcgacctgggcagcaccgccgccacctccgaatacgaaggctcgtccgtcgacctgtacggcgcctactacggctaccagtgcgcgggcggcacacccaacaaaaccgcatgcatgtacggaggagtaaccctacacgacaacaaccgcctaacagaagaaaagaaagtacccatcaacctatggatcgacggaaaacaaacaacagtaccaatcgacaaagtaaaaacatctaagaaagaggtcacggtccaagaactcgacctccaagcccgacactacctacacggcaaattcggcctctacaattccgactcattcggcggaaaagtacaacgaggcctaatcgtattccactcctcagaaggatccaccgtcagctacgacctcttcgacgcccaaggacaataccccgacaccctactcagaatctaccgcgacaacactaccatctcatccacctccctctcaatctcactatacctatacacaacc

SEQ ID NO: 54082 - RNA, 642 nt, synthetic construct
  misc_feature 1..642: note = derived and/or modified sequence opt11 from Naptumomab_estafenatox_LightChain
  source 1..642: mol_type = other RNA
tccatcgtcatgacccaaacccccacctccctcctcgtatccgccggcgaccgcgtcaccataacctgcaaagcctcccaatccgtctccaacgacgtcgcctggtaccaacaaaaacccggccaatcccccaaactcctcatctcctacacctcctcccgctacgccggcgtcccagaccgattctcaggttccggctacggcaccgacttcaccctaaccatctcctcagtccaagccgaagacgcagccgtctacttctgccaacaagactacaactcaccacccaccttcggaggcggcaccaaactcgaaatcaaacgcgcagacgccgcccccaccgtctccatattcccaccctcctccgaacaactcacctccggcggagcctccgtcgtatgcttcctcaacaacttctaccccaaagacatcaacgtcaaatggaaaatcgacggctcagaacgccaaaacggcgtcctcaactcatggaccgaccaagactccaaagactccacctactccatgtcctcaaccctcaccctcaccaaagacgaatacgaacgccacaactcctacacatgcgaagccacccacaaaacctccacctcccccatcgtcaaatccttcaaccgcaacgaatcc

SEQ ID NO: 54083 - RNA, 1356 nt, synthetic construct
  misc_feature 1..1356: note = derived and/or modified sequence opt11 from Narnatumab_HeavyChain1
  source 1..1356: mol_type = other RNA
gaggtccaactcgtcgaatccggaggcggcctcgtacagcccggaggctccctccgactcagctgcgccgcctcgggcttcaccttcagcagctacctaatgacctgggtcagacaagcccccggcaaaggcctcgaatgggtcgccaacatcaaacaggacggaagcgagaaatactacgtagactccgtcaagggccggttcaccatctcacgcgacaatgccaaaaacagcctcaacctccaaatgaactcattaagagcagaagacaccgcagtctactactgcacccgagacggatactccagcggccggcattacggcatggacgtatggggccaaggcaccacagtcatagtctcctccgcatcaacaaaaggcccctccgtctttcccctagcaccgtcctcaaaaagcacatccggcggcacagcagccctcggctgcctcgtcaaagactacttcccagaacccgtcaccgtctcctggaactcaggcgcactaacctccggagtacacaccttccccgcagtcctacaatcctccggactatactccctcagctcagtcgtaaccgttccttcctcctccctaggcacccaaacatacatctgcaacgtaaaccacaaaccgtccaacaccaaagtagacaaacgcgtcgaaccaaaatcctgcgacaaaacccatacctgccctccctgccccgcccccgaactgctcggaggccccagcgtcttcctgttcccacccaaacccaaagacacactcatgatatcacgaactcccgaagtaacctgcgtcgtcgtagacgtctcccacgaagaccccgaagtcaaattcaactggtacgtagatggagtcgaagtacacaacgccaaaaccaaaccccgagaagaacaatacaactcaacctaccgcgtcgtatcagttctcaccgtcctccaccaagactggctaaacggaaaagaatacaaatgcaaggtctcaaacaaagccctaccagcccccatagagaaaacaatctccaaagccaaaggacagcccagagaaccacaagtatacaccctacccccttctcgcgaagaaatgaccaaaaaccaggtctcgctaacctgcctcgtcaaaggcttctacccttccgacatcgcagtcgaatgggaatccaacggccaacccgaaaacaactacaaaacaacaccacccgtactcgactcagacggatctttcttcctctactccaaactcaccgtagacaagtcccgatggcaacaaggaaacgtcttctcctgctcagtcatgcatgaagccctccacaaccactacacccaaaaatccctctcactcagccccggcaaa

SEQ ID NO: 54084 - RNA, 642 nt, synthetic construct
  misc_feature 1..642: note = derived and/or modified sequence opt11 from Narnatumab_LightChain1
  source 1..642: mol_type = other RNA
gaaatcgtcctcacacaatcccccgcaaccctatccctctcccccggcgaacgcgccaccctctcctgccgcgcatcccaatccgtcagccgctacctcgcatggtaccaacaaaaacccggccaagcaccccgactactcatctacgacgcctccaaccgcgccaccggcatccccgcccgcttctccggctccggctccggcaccgacttcaccctcaccatctcctccctcgaacccgaagacttcgccgtctactactgccaacaaagatccaactggccccgcaccttcggacaaggaaccaaagtcgaaatcaaacgcaccgtcgccgccccctccgtcttcatcttcccaccatccgacgaacaactaaaatccggcaccgcctcagtcgtctgcctcctcaacaacttctacccacgcgaagccaaagtccaatggaaagtcgacaacgccctccaatccggaaactcccaagaatcagtcaccgaacaagactctaaagactccacctactccctctcctccaccctcaccctctccaaagccgactacgaaaaacataaagtatacgcctgcgaagtcacccaccaaggcctctcctcacccgtcacaaaatccttcaaccgaggcgaatgc

SEQ ID NO: 54085 - RNA, 1350 nt, synthetic construct
  misc_feature 1..1350: note = derived and/or modified sequence opt11 from Natalizumab_HeavyChain1
  source 1..1350: mol_type = other RNA
caagtccaactcgtacaatccggcgcagaagtaaagaaacccggcgcatccgtcaaagtctcctgcaaagcatccggattcaacataaaagacacctacatccactgggtacgacaggccccaggccagcgcctcgaatggatgggacgcattgacccagccaacggctacaccaaatacgatcctaaattccaaggaagagtcaccatcaccgccgacacctcagcctcaaccgcctacatggaactctcatccttacgtagcgaagacacagccgtctactactgcgcccgcgaaggatactacggaaactacggcgtatacgcgatggactactggggccaagggacactcgtcaccgtatcctccgcatccactaagggcccctccgtattcccccttgccccctgctcccgatccacaagcgaaagcacggccgcactcggatgcctcgttaaagactacttccctgaaccagtcaccgtctcctggaactccggcgccctgacatccggcgtccacactttcccagccgtcctacaaagcagcggcctatactccctatccagcgtagtcaccgtcccctcatcgagtctcggaacaaaaacatacacatgcaacgtcgaccacaaacccagcaacaccaaagtcgacaaacgagttgaatccaaatacggcccaccctgcccctcatgtcccgcccccgagttcctaggcggcccctccgtcttccttttcccacccaagcccaaagacaccctcatgatctcccgaacgcccgaagtaacttgtgtcgtagtagacgtatcccaagaagaccccgaagtccagtttaactggtatgtagacggcgtcgaagtccacaacgccaaaacaaaaccccgcgaagaacaattcaactccacctaccgtgttgtctcagtcctaaccgtcctacaccaagactggctcaacggcaaagaatacaaatgcaaagtctccaacaaaggcctaccctcctcaatcgaaaagaccatatccaaagccaaagggcaaccccgagaaccccaagtatacaccctaccaccctcacaagaagaaatgacaaagaaccaagtctccctcacgtgcctcgtcaagggcttctacccctccgacatcgccgtcgaatgggaatcaaacggccaacccgaaaacaactacaaaaccacacccccagtactcgactccgacggctccttcttcctatactctcgcctcaccgtcgacaaaagccggtggcaagaaggaaacgtcttctcatgctcagtcatgcacgaagccctacacaaccactacacccagaaatccctatccctctcactaggcaag

SEQ ID NO: 54086 - RNA, 639 nt, synthetic construct
  misc_feature 1..639: note = derived and/or modified sequence opt11 from Natalizumab_LightChain1
  source 1..639: mol_type = other RNA
gacatccaaatgacccaatccccctcctccctctccgcctccgtcggagaccgagtcaccataacctgcaaaacctcacaagacatcaacaaatacatggcctggtaccaacaaacccccggcaaagcaccccgcctcctcatccactacacctcagccctccaacccggcatcccatcccgcttctccggctccggctccggccgagactacaccttcaccatctcctccctccaacccgaagacatcgccacctactactgcctccaatacgacaacctctggaccttcggccaaggcaccaaagtcgaaatcaaacgcaccgtcgccgccccctcagtcttcatcttcccaccctccgacgaacaactaaaatcaggcaccgcctccgtagtctgcctcctcaacaacttctacccccgcgaagccaaagtccaatggaaagtcgacaacgccctacaatccggaaactcccaagaatccgtcaccgaacaagactccaaagactccacctactccctaagctcaacccttaccctctccaaagccgactacgaaaaacacaaagtctacgcctgcgaagtaacccaccaaggcctctcatcccccgtcaccaaatccttcaaccgcggcgaatgc

SEQ ID NO: 54087 - RNA, 1335 nt, synthetic construct
  misc_feature 1..1335: note = derived and/or modified sequence opt11 from Navicixizumab_HeavyChain1
  source 1..1335: mol_type = other RNA
caagtacaactcgtccaaagcggagccgaagtcaagaaacccggcgcctccgtcaaaatctcctgcaaagcctccggctacagcttcaccgcctactacatccactgggtcaaacaagccccaggccaaggcctagagtggatcggctacatatccaattacaaccgcgccacgaactataaccaaaaattcaaaggacgcgtcaccttcaccacagacacctccacctccacagcatacatggaactacgctcactgcgatcagacgatactgccgtctactactgcgcacgcgactacgactacgacgtaggaatggactactggggccaaggaaccctcgtcacagtgagctcagcttccaccaaaggaccctccgtattccccctcgctccctgctcacgaagcacatccgaaagcacagccgccctcggctgcctcgtaaaggactacttccccgaacccgtaacagtatcctggaactccggagcactcacctcaggcgtccacaccttccccgccgtcctccagtcctcaggactctactccctctcctccgtcgtaaccgtcccatcctccaatttcggaacccaaacctacacatgcaacgtcgaccacaaaccaagcaacaccaaagtcgacaaaacagtggaacgcaaatgctgcgtagaatgcccaccctgccccgccccacccgtagccggacccagcgtattcctcttcccacccaaacccaaagacaccctcatgatctcccgcacacccgaagtaacctgcgtcgtagtcgacgtatcacacgaagaccccgaagtccaattcaactggtacgtcgacggagtggaagtccacaacgccaaaaccaagcctcgagaagaacaattcaactccaccttccgagttgtctccgtcctcaccgtcgtacaccaagactggctaaacggtaaagaatacaaatgcaaagtctccaacaaaggcctcccagcccctatagagaaaaccatatccaaaactaaaggacaaccccgcgaaccccaagtctacactctaccaccctctcgagaagaaatgaccaaaaaccaagtatccctaacctgcctcgtcgaaggattttaccccagcgacatcgctgtcgagtgggagtccaacggccaacctgaaaacaactacaaaaccaccccacccatgctcgactcagacggctccttcttcctctactcagaattaaccgtcgacaaaagcagatggcagcaaggcaacgtattctcatgttcagtaatgcacgaagccctccacaaccactacacccagaaatccctctccctctcccccggaaaa

SEQ ID NO: 54088 - RNA, 1341 nt, synthetic construct
  misc_feature 1..1341: note = derived and/or modified sequence opt11 from Navicixizumab_HeavyChain2
  source 1..1341: mol_type = other RNA
caagtacaactcgtccaaagcggcgccgaagtaaaaaaaccaggcgcatccgtcaaagtctcctgcaaagccagcggatacaccttcacaaactactggatgcactgggtccgacaagcacccggccaaggcctcgaatggatgggcgacatcaacccgagcaacggacgcacctcctacaaagaaaaattcaaacgccgcgtcaccctctccgtcgacaaatcctcctcaaccgcatacatggaactctcctcactccgatcagaagataccgccgtctacttctgcaccatccactatgacgataaatactacccactcatggactattggggccaaggtactctcgtcacagtatcctccgcctccaccaaaggcccctcggtattccccctcgccccatgctcccgctcaacctccgaatccacagccgcactaggctgtctagtcaaagactacttcccagaacccgtcaccgtctcctggaattcaggcgccctcacctcaggcgtacacaccttcccagcagtactccaatcctccggactctactcccttagctccgtagtgaccgtcccctccagcaacttcggaacccaaacctacacctgcaacgtcgaccataagccctcaaacaccaaagtcgacaaaaccgtcgaacgaaaatgctgcgtcgaatgcccaccctgccccgccccccccgtcgccggcccatccgtcttcctattcccacccaaaccaaaagacactctcatgatctctcgaactcctgaagtcacctgcgtagtcgtcgacgtcagtcacgaagacccagaagtccaattcaactggtatgtcgacggcgtcgaagtccacaacgcaaaaaccaaaccacgcgaagaacaattcaactctacattccgcgtcgtctccgtactgaccgtcgtacaccaagactggctcaacggaaaagaatacaaatgcaaagtctccaacaaaggactgcccgcgcccatagaaaaaacaatctcaaaaacaaaaggccaaccccgcgaaccccaagtgtacaccctacccccgagccgagaaaaaatgaccaaaaaccaagtatccctaacgtgcctcgtcaaaggcttctacccctccgacatcgccgtcgaatgggaaagcaacggccaacccgaaaataactacaaaacaacaccccccatgctcaaatccgacggatccttcttcctttactccaaactcaccgttgacaaatcacgctggcaacaaggaaacgtcttctcctgctccgttatgcacgaagccctacacaaccactacacccaaaagtccctctcactctcccccggcaaa

SEQ ID NO: 54089 - RNA, 654 nt, synthetic construct
  misc_feature 1..654: note = derived and/or modified sequence opt11 from Navicixizumab_LightChain1
  source 1..654: mol_type = other RNA
gatatcgtgatgacgcaatcacccgacagcttagccgtgagcctgggcgaacgcgcgaccataagctgccgagcaagcgagagcgtagacaactacgggatctcattcatgaaatggttccagcaaaagcccggacaaccgcccaagctcttgatctatgccgcgagcaatcaagggagcggggtcccggacaggttctcaggctcaggctcgggcacggactttaccctgaccataagctcgctccaggccgaggacgtagccgtgtactactgccagcaatcgaaagaggtcccgtggacgttcggaggagggaccaaggtcgagataaagcgaacggtcgcggccccaagcgtgttcatattcccgccctcggacgagcaactgaaatcaggcacggcctcggtcgtgtgcctactcaataacttttacccgcgcgaggccaaggtccagtggaaagtcgacaacgcgctacagagcgggaactcgcaagaaagcgtaaccgagcaagacagcaaggactcgacctacagcttaagctcgaccctgaccttgagcaaggccgactacgaaaaacacaaagtgtacgcgtgcgaagtcacgcaccagggactgagctcacccgtgaccaagagcttcaacaggggagagtgc

SEQ ID NO: 54090 - RNA, 1368 nt, synthetic construct
  misc_feature 1..1368: note = derived and/or modified sequence opt11 from Navivumab_HeavyChain1
  source 1..1368: mol_type = other RNA
caagttcagctagtccaatcaggcgcagaagtaaagaaacccggcgcctccgtcaaagtatcctgcaaaacctccggctactctttctccacatacggcgtctcctgggtccgccaagccccaggccaaggtcccgaatgggtcggctggatatccgcctacaccggcatcaccgactacgcccaaaaattccaaggccgcgtcaccctcacaaccgacgccaccacagccaccgccttcctcgacctccgttcactccgcccagacgacacagccacctacttctgcgcacgtgacaaagtccaaggccgcgtcgaagtcggcagcggcggacgccacgactactggggtcaaggcacactcgtaatcgtatcctcagcctccaccaaaggcccctcagtattcccactcgcaccctcaagcaaatcgaccagcggcggcaccgccgccctaggatgccttgtaaaggactatttccccgaacccgtcaccgtctcctggaacagcggagccctcacatccggcgtccacacattcccggccgtcctccaaagctccggtctctactcactctcctcagtcgtcaccgtcccatcatcctcactaggcacccaaacctatatctgcaacgtaaaccacaaaccctcaaacaccaaagtcgacaagaaagtcgaacccaaatcctgcgacaaaacgcacacttgcccaccctgccccgcccccgaactcctcggcggcccctccgtgttcctatttccacccaaacccaaagacaccctaatgatctcacgcacccctgaagtaacctgcgtcgtcgtcgacgtctcacacgaagaccccgaagtcaaatttaactggtacgtcgacggcgtagaagtccacaacgcaaaaaccaaacccagagaagaacaatacaactccacttacagggtcgtatctgtactcaccgtcctccaccaagactggcttaacggcaaagaatacaaatgcaaagtcagcaacaaagccctccccgcccccatcgaaaagacaatatccaaagccaaaggacaaccccgggaaccacaggtctatacactacctccctcacgcgacgaactcactaaaaaccaagtctccctaacatgcctcgtcaaaggcttctatccatctgacatcgctgtcgaatgggaatctaacggccaacctgaaaacaactacaaaaccactcccccagtactagacagcgatggctcattcttcctctactccaaactcaccgtcgacaaatcacgctggcaacaaggaaacgtcttctcctgctcagtcatgcacgaaggcctccacaaccactatacacaaaaatccctttccctcagccccggaaaa

SEQ ID NO: 54091 - RNA, 645 nt, synthetic construct
  misc_feature 1..645: note = derived and/or modified sequence opt11 from Navivumab_LightChain1
  source 1..645: mol_type = other RNA
gaagtcgtcctaacccaaagccccggcaccctagcactcccacccggagaacgcgccaccctcagctgccgagcctcccaccgagtcggatcaacatacatagcctggtaccaacaaaaatccggccaagcaccccgccgcctaatctacggcgcctccaaccgcgccaccgacatccccgaccgcttctcaggctcaggctcaggcaccgacttcaccctcacaatccgccgactagaacccgaagactccgccgtctactactgccaacaattcagcgtcagcccctggacattcggccaaggaacccgcgtcgaaatcaaacgcacagtcgccgccccatccgtcttcatcttcccaccctcagacgaacaactcaaatccggcaccgcctccgtcgtctgcctactcaacaacttctacccccgcgaagccaaagtccaatggaaagtcgacaacgcactccaatccggcaactcacaagaatccgtaaccgaacaagactccaaagactcaacctactccctcagctcaaccctcaccctatccaaagccgactacgaaaaacacaaagtatacgcctgcgaagtcacccaccaaggcctgtcctcacccgtcaccaaatcattcaaccggggcgaatgc

SEQ ID NO: 54092 - RNA, 2172 nt, synthetic construct
  misc_feature 1..2172: note = derived and/or modified sequence opt11 from Ndimab-varB_HeavyChain
  source 1..2172: mol_type = other RNA
caggtacaactcgtagagtccggaggcggcgtcgtccaacccggccgttccctacgtctctcttgcgcagcaagcggattcatcttctccagctacgccatgcactgggtacgccaagccccaggaaacggcctagaatgggtcgccttcatgtcctacgacggatccaacaagaaatacgccgacagcgtaaaaggacgattcacaatttcccgagacaactccaaaaacacactctacctacaaatgaactcactccgcgctgaagacaccgctgtctactactgcgcccgcgacagaggcatctcagcaggcggaaactactactactacggaatggacgtttggggacaaggtaccaccgttaccgtatcatcagcgagcaccaaaggcccctctgttttccccctcgccccctcttccaaaagtacatcaggaggcacagccgctctagggtgcctcgtcaaagactacttccctgaaccagtaactgtgtcatggaactccggcgccctcaccagcggtgtccacacattccccgcagtcctgcaatccagcggcctctactccctaagctctgtcgtcaccgtgccaagctcctccctaggcactcaaacctacatatgtaacgtcaaccacaaacccagcaacacgaaagtggacaaacgagtagaaccaaaatcctgcgacaaaacccacacctgtcccccatgcccagcacccgaactcctaggcggtccaagcgtcttcctattccctccaaaacccaaggacacacttatgatcagccgcactcccgaggtcacttgcgtggtcgtggacgtcagccacgaagaccccgaagtaaaattcaactggtacgtagacggcgtagaagtccacaacgctaaaactaaaccccgcgaagaacagtacaattcaacgtaccgcgtcgtatctgtcctcactgtcctacaccaagactggctcaacggcaaagaatacaaatgcaaagtcagcaacaaagcgctacccgcaccaattgagaaaacaatctcaaaagcgaaaggtcaaccacgcgaaccacaagtctatacactacccccatcccgagaagaaatgactaaaaaccaagtatcactaacatgcctcgtcaaaggcttctacccctccgacatcgccgtcgaatgggaatctaacggacaacccgaaaacaactacaaaaccaccccacccgtccttgactcagacggatcattcttcctatactccaaactcacggtcgacaaatcacgatggcaacaaggtaacgtcttctcatgctccgttatgcacgaagccctacacaaccactacacccaaaaatccctctccctctcccccggaaagggcggaggcggcagcggaggcggcggtagccaggtccagctagtccaatccggggccgaagtcaagaaaccagggtcctcagtcaaagtctcatgcaaagcatctggaggaaccttctccacgtacggcataagctgggtgcgacaagcccccggccaatgtctcgagtggatgggcgggattatccccatcttcgacacgggcaactccgctcaatccttccaaggacgcgtcaccataaccgccgacgaatccacctcaaccgcctatatggagctatcgtccctccgatccgaagacacagctgtctactactgcgcccgctcatcacgaatctacgacctaaacccctccctcaccgcctactacgacatggacgtctggggccaaggcaccatggtcaccgtttcctcaggaggcggaggatccgggggaggcggctccggtggcggcggaagcggcggaggcggcagccaatccgtactaacacagccgccctcagtctccgccgctcccggccaaaaagtcacaatctcctgctccggcagcagctccaacatcggcaacaactacgtgtcatggtatcaacaactccccggcacagcccccaaactactcatctatgacaacaacaaaagaccctcagggatccccgaccgattctccggctccaaatccggcacctcagccaccttaggcatcacaggactacaaaccggcgacgaagcagactactactgcggcacctgggactcttccctctcagcctgggtattcggctgcggcacgaaactaaccgtccta

SEQ ID NO: 54093 - RNA, 645 nt, synthetic construct
  misc_feature 1..645: note = derived and/or modified sequence opt11 from Ndimab-varB_LightChain
  source 1..645: mol_type = other RNA
gaaatcgtcctcacccaatcccccgccaccctttccctctcccccggcgaacgcgccaccctctcctgccgcgcatcccaatccgtctactcctacctcgcctggtaccaacaaaaacccggccaagccccccgcctactaatctacgacgcctccaaccgcgccatcggcatccccgcccgcttctccggctcaggatccggcaccgacttcaccctcaccatctcctccctcgaacccgaagacttcgccgtctactactgccaacaacgctccaactggccccccttcacattcggccccggcaccaaagtcgacatcaaacgcaccgtcgccgccccctccgtcttcatcttccccccctccgacgaacaactaaaatccggcaccgcatccgtcgtctgcctcctcaacaacttttacccccgcgaagccaaagtccaatggaaagtcgacaacgcccttcaatccggcaactcacaagaatcagtcaccgaacaagactccaaagactccacttactccctctcctccaccctcaccctatccaaagccgactacgaaaaacacaaggtctacgcctgcgaagtaacccaccaaggcctctcctcccccgtaaccaaatcattcaacagaggcgaatgc

SEQ ID NO: 54094 - RNA, 1353 nt, synthetic construct
  misc_feature 1..1353: note = derived and/or modified sequence opt11 from Necitumumab_HeavyChain1
  source 1..1353: mol_type = other RNA
caagtccagttacaagaatccggccccggcctcgtaaaaccctcccaaacactctcattaacctgcaccgtctccggcggctcgatctcctcaggagactactactggtcatggatccgccaaccacccggcaaaggcctcgaatggatcggctacatctactactccggctccaccgactacaacccctccctcaaatcacgcgtaacgatgtccgtcgacacctcgaaaaaccaattttcattaaaagtcaactccgtcacagcagcagacaccgccgtctactactgcgcccgcgtatccatattcggagtcggcaccttcgactactgggggcaaggcacactcgtcaccgtctcctccgcctccaccaaaggcccatccgtcctccccctcgccccctcgtccaaatccacctcaggcggcaccgccgccctcggatgcctcgtcaaagactacttccccgaacccgtcaccgtctcctggaactccggcgccctcacctccggcgtccacaccttccccgccgtactccaatcctccggactctactccctctcctcagtcgtaactgtcccatcatcatccctcggcacccagacctacatatgcaacgtcaaccacaaaccctccaacaccaaagtagacaagagagtcgaacccaaaagctgcgacaaaacacacacctgtccaccctgccccgcccccgaactactcggcggcccatccgtattcctattccctccaaaaccaaaagacaccctcatgatctcccgaacccccgaagtcacatgcgtcgtcgtcgacgtaagccacgaagatccagaagtaaaattcaactggtacgtagacggagtcgaagttcacaacgccaaaaccaaaccccgagaagaacaatacaacagcacctaccgcgtcgtctccgtcctcacagtactccaccaagactggctaaacggcaaagaatacaaatgcaaagtctccaacaaagcactcccagctcccattgaaaagacaatatccaaagccaaaggccaaccaagagaacctcaagtatacaccctacccccatcacgcgaagaaatgaccaaaaaccaggtctccctcacatgcctcgtcaaaggattctatccctccgacatcgccgtcgagtgggaatccaatggccaaccagaaaacaattacaaaacaaccccacccgtactcgactcagacggatccttcttcctctactccaaactcaccgtcgacaaatcccgctggcaacaaggcaacgttttctcgtgctccgtaatgcacgaagccctacataaccactacacccaaaaatctctatccctctcccccggcaaa

SEQ ID NO: 54095 - RNA, 642 nt, synthetic construct
  misc_feature 1..642: note = derived and/or modified sequence opt11 from Necitumumab_LightChain1
  source 1..642: mol_type = other RNA
gaaatcgtcatgacacaatcccccgccaccctatccctctccccaggcgaacgcgccaccctatcctgccgcgcatcccaatcagtaagctcctacctcgcctggtaccaacaaaaacccggccaagcccccagactcctcatctacgacgcctccaaccgcgccacaggcatccccgcacgcttctccggctccggctccggcaccgacttcaccctcaccatctcctccctcgaacccgaagacttcgccgtatactactgccaccaatacggctccaccccactcaccttcggcggcggcaccaaggccgaaatcaaacgcaccgtcgccgccccctccgtcttcatcttcccaccctccgacgaacaactaaaatccggcaccgcctccgtcgtctgccttctaaacaacttctacccccgcgaagctaaagtccaatggaaagtcgacaacgccctccaatccggcaactcccaagaatccgtcactgaacaagactccaaagactccacctactccctctcctccaccctcaccctatccaaagccgactacgaaaaacacaaagtctacgcctgcgaagtcacccaccaaggcctatcctcccccgtaaccaaatccttcaaccgcggcgaatgc

SEQ ID NO: 54096 - RNA, 396 nt, synthetic construct
  misc_feature 1..396: note = derived and/or modified sequence opt11 from Neliximab_HeavyChain_VH-Region
  source 1..396: mol_type = other RNA
gaagtacaactacaacagagcgggcccgaactcgtaaaaccgggcgcaagcgtaaaaatgagctgcaaagcaagcggatacacattcacgacctacgtcatgcactgggtcaaacaaaagcccggacaaggactcgaatggataggctacatcaacccctacaacgacggcacaaactacaacgaaaaattcaaagggaaagcgaccctgacctcagacaaaagctcaagcacggcctacatggaactctcaaccctaacctcagaagacagcgcggtctactactgcgccgaattcataaccaagaccgtaggcggaagcaactggtacctcgacgtctggggcgcaggcacgaccgtgaccgtaagctcagccaagaccacacccccaaaactg

SEQ ID NO: 54097 - RNA, 372 nt, synthetic construct
  misc_feature 1..372: note = derived and/or modified sequence opt11 from Neliximab_HeavyChain_VH-Region_variant1
  source 1..372: mol_type = other RNA
caagtgcaattgaaacagagcgggcccgagctcgtgaaaccgggcgcgagcgtgaaaatgagctgtaaagcgagcgggtacacgttcacgacctatgtcatgcactgggtcaagcaaaagcccgggcaagggctcgagtggataggctatatcaatccctataacgatggcacgaactataacgagaaatttaaagggaaagcgaccttgacctcggacaagagctcgagcacggcctatatggagctctcgaccctgacctcggaagatagcgcggtctattactgtgccgagttcataaccaagaccgtgggcgggagcaattggtatctcgatgtctggggcgcgggcacgaccgtgaccgtgagctcg

SEQ ID NO: 54098 - RNA, 318 nt, synthetic construct
  misc_feature 1..318: note = derived and/or modified sequence opt11 from Neliximab_LightChain_VL-Region
  source 1..318: mol_type = other RNA
gacatcgtcctcacccaatcccccgccatcatgtccgcctcccccggcgaaaaagtcaccatgacctgctccgcctcctcctccatctcctacatccactggttccaacaaaaacccggcacctcccccaaacgctggatctacgacacctcaaaactcccctccggcgtccccgcacgcttctccggctccggctccggcacctcctactccctcaccatctcctccatggaagccgaagacgccgccacctactactgccaccaacgctcctcctacacctggaccttcggcggcggcaccaaactcgaaatcaaa

SEQ ID NO: 54099 - RNA, 354 nt, synthetic construct
  misc_feature 1..354: note = derived and/or modified sequence opt11 from Neliximab_LightChain_VL-Region_variant1
  source 1..354: mol_type = other RNA
caaatcgtcctcacccaatcccccgccatcatgtccgcctcccccggcgaaaaagtcaccatgacctgctccgcctcctcctccatctcctacatccactggttccaacaaaaacccggcacctcccccaaacgctggatctacgacacctccaaactcccctcaggcgtacccgcccgcttctcaggctccggctccggcacctcctactccctcaccatctcctccatggaagccgaagacgccgccacatactactgccaccaacgctcctcatacacctggaccttcggcggaggcaccaaactagaaatcaaacgcgccgacgccgcccccaccgtctccgccgccgcc

SEQ ID NO: 54100 - RNA, 1335 nt, synthetic construct
  misc_feature 1..1335: note = derived and/or modified sequence opt11 from Nemolizumab_HeavyChain1
  source 1..1335: mol_type = other RNA
caagtccaactcgtccaatcaggcgccgaagtcaagaaaccgggcgcaagcgtaaaagtaagctgtaaagctagcggatacacttttacgggttacatcatgaactgggtccgccaggctcctggccaaggtctagaatggatgggcttaatcaacccctacaacggcggcaccgactacaatccacaattccaggaccgagtaaccatcaccgcagacaaatcaacctccaccgcatacatggaactctcctcactaagaagcgaagacaccgccgtctactattgcgcccgggacggctacgacgatggcccctacaccctagaaacatggggccaaggaaccctcgtaaccgtctcctccgcctccaccaaagggccatccgtattcccccttgcaccatcaagcaaaagcacctccggaggcaccgccgccctcggctgcctcgtcaaagactactttcccgaacccgtcaccgtctcctggaactcaggcgcactaacctccggagtccacaccttccccgccgtcctacagtcctccggcctctactccctctcctccgtcgtcacagtcccctcatcaaacttcggcacccaaacatatacctgcaacgtcgaccacaaaccctccaacacaaaagtagacaaaaccgtcgaacgcaaatcctgcgtcgaatgcccaccatgccccgccccaccagtcgccggcccctccgtattcctcttcccacccaaacccaaagacaccctcatgatctcacgcacccccgaagtcacatgcgtggtcgtcgacgtatcacaggaagaccccgaagtccaattcaactggtacgtcgacggcgtcgaagtacataacgccaaaactaaaccccgagaagaacaattcaactccaccttccgagtagtatccgtcctcaccgtcgtacaccaagactggctaaacggtaaagaatacaaatgcaaagtctccaacaagggcctccccgctcccatcgagaaaaccatctccaaaacaaagggccaaccccgggaaccccaagtatacaccctcccaccctcccaagaagaaatgaccaaaaatcaagtatccctaacctgcctcgtaaaaggcttctacccctccgacatcgccgtcgaatgggaaagcaacggccaacccgaaaacaactacaaaaccacacccccaatgctcgactcagacggctccttcttcctttactcaaaactaaccgtcgacaaatcccgctggcaagaaggaaacgtattctcatgctccgtcatgcacgaagccctacacaatcactatacccaaaaatccctatccctgtccccc

SEQ ID NO: 54101 - RNA, 642 nt, synthetic construct
  misc_feature 1..642: note = derived and/or modified sequence opt11 from Nemolizumab_LightChain1
  source 1..642: mol_type = other RNA
gacatccaaatgacccaatcaccctcatccctctccgcctccgtcggcgaccgcgtcaccataacctgccaagcctccgaagacatctactcattcgtcgcctggtaccaacaaaaaccaggcaaagcacccaaactcctcatctacaacgcccaaaccgaagcccaaggagtcccctcccgcttctcaggctccggctcaggcaccgacttcaccctaaccatctcctcacttcaacccgaagacttcgccacatactactgccaacaccactacgactcacccctcactttcggcggcggaaccaaagtcgaaatcaaacgcaccgtcgccgccccctccgtcttcatcttcccaccctccgacgaacaactcaaatccggcaccgcctccgtcgtttgcctcctcaacaacttctacccccgcgaagccaaagtccaatggaaagtcgacaacgccctccaatccggcaactcccaagaatccgtcaccgaacaagacagcaaagactccacctacagcctctcatcaaccctcaccctatccaaagccgactacgaaaaacacaaagtctacgcctgcgaggtaacccaccaaggcctctcctctcccgtaaccaagtccttcaaccgcggcgaatgc

SEQ ID NO: 54102 - RNA, 1356 nt, synthetic construct
  misc_feature 1..1356: note = derived and/or modified sequence opt11 from Nesvacumab_HeavyChain1
  source 1..1356: mol_type = other RNA
gaagtacagctcgtcgaaagcggcggcggcctcgtacaacccggaggaagcctccgactcagctgcgcagccagcggcttcaccttctcctcctacgacatacactgggtccgccaagccactggaaaaggacttgaatgggtctccgcaataggccccgccggcgacacctactaccccggctcagtcaaaggccgcttcactatctcccgagaaaacgccaaaaactccctatacctacaaatgaactcgctacgcgccggagacaccgccgtctactactgcgcccgaggcctcatcaccttcggcggcctcatcgcccccttcgactactggggccaaggaaccctagtcaccgtatcctcagcctcgaccaaaggcccatccgtattcccactcgcaccctcatccaaatccactagcggtggaaccgccgcactcggctgcttagtcaaagactacttccccgaaccagtcacagtctcgtggaactcaggcgccctcaccagcggcgtccacaccttccccgcagttctccaatccagcggcctctactcactctcttcagtagtcacagtccccagctcctccctcggcacacaaacatacatctgcaacgtcaaccacaaaccctccaacacaaaagtcgacaagaaagtcgaacccaaatcatgcgacaaaacacatacatgcccaccctgccccgcccccgaactcctcggcggaccctccgtcttcctcttcccacctaaaccaaaagacaccctaatgataagtcgcacccccgaagttacttgcgtcgtagtcgatgtctcacacgaagaccccgaagttaaattcaactggtacgtcgacggcgtcgaagtccacaacgccaaaaccaaaccgcgcgaagaacagtacaattccacataccgcgtagtatccgtactcaccgtcctccaccaagactggctgaacggaaaagaatacaaatgcaaagtctccaacaaagcccttcccgccccaatagagaaaaccatctccaaagccaaaggccaaccccgcgaaccacaagtatataccctaccaccctccagagacgaactcaccaaaaaccaagtctcccttacctgcctagtaaaaggattctacccctccgacatcgccgtagaatgggaatccaacggccaaccagaaaataactacaaaaccacccctcccgtactcgactccgacggcagtttcttcctctattccaaactaaccgtcgacaaatctcgctggcagcaaggaaacgtattctcttgctccgtcatgcacgaagccctccacaaccactacacccaaaagagcctctccctatcccccggcaaa

SEQ ID NO: 54103 - RNA, 642 nt, synthetic construct
  misc_feature 1..642: note = derived and/or modified sequence opt11 from Nesvacumab_LightChain1
  source 1..642: mol_type = other RNA
gaaatcgtcctcacccaatcccccggaacactctccctcagcccaggcgaacgcgccaccctctcctgccgcgcctcccaatcagtctcctccacctacctcgcctggtaccaacaaaaacccggccaagcacctcgactcctaatctacggagcctcctcccgcgccaccggcatcccagaccgcttctccggctccggatccggaaccgacttcaccctcaccatctcccgcctcgaaccagaagacttcgccgtctactactgccaacactacgacaactcccaaacatttggacaaggcaccaaagtcgaaatcaaacgcaccgtcgcagccccctccgtcttcatcttcccaccctccgacgaacaactcaaatccggcaccgcctccgtcgtctgcctcctaaacaacttctacccccgcgaagccaaagtccaatggaaagtagacaacgccctccaatccggcaactcacaagaatccgtcaccgaacaagactccaaagactccacctactccctctcctccaccctcaccctttctaaagccgactacgaaaaacacaaagtctacgcctgcgaagtcacccaccaaggcctctcctcccccgtcaccaaatctttcaaccgcggcgaatgc

SEQ ID NO: 54104 - RNA, 1362 nt, synthetic construct
  misc_feature 1..1362: note = derived and/or modified sequence opt11 from Neuradiab_HeavyChain1
  source 1..1362: mol_type = other RNA
gaagtccaactccaacagtccggacccgaactcgttaagcccggcgcctcagtcaaaatgtcatgcaaagcctccggctacaccttcacctcatacgtcgtccactgggtcaaacagaaccctggccaaggactcgaatggatcggctacatcaaccccttcaacgacggaaccaaatataacgaaaacttcaaatgcaaagcaaccctcacttcggaccgctcctcctcaacagcctacatggaactatcatccctcaccagcgaagagtccgcagtctacttctgcgccagagacatgggccgtgagggcttcgcatactggggccaaggtaccctcgttaccgtatccgccgcaaaaacaaccccaccatccgtctaccccctagcccccggctgcggcgacaccaccggttcctccgtaaccctcggatgcctcgtaaaaggatacttcccagaatctgtcacagtcacctggaacagcggaagcctatcctcttcagtccacaccttccccgcactcctccaatccggcctatacaccatgtcctcctccgtgacagtcccctcgtccacatggccctctcaaatcgtcatctgctccgtcgcacaccccgcatcatcaaccaccgtcgacaaaaagctcgaaccctcaggtccaatctccaccatcaacccctgcccaccttgcaaagaatgccacaaatgtcccgccccaaacctcgaaggaggaccctcagttttcatctttcccccaaacatcaaagacgtcctcatgatctccctcaccccgaaagtaacctgcgtcgttgtagacgtctcggaagacgaccccgacgtccaaatctcctggttcgtcaacaacgtcgaagtccacactgcacaaacccaaacccaccgagaagactacaactccaccatccgtgtcgtgtcaaccctccccatacaacaccaagactggatgtccggcaaagaatttaaatgcaaagtcaacaacaaggacctaccctccccaatcgaacgcacaatctcaaaaatcaaaggcctagtccgcgcaccccaagtctacattctcccaccacccgctgaacaactctcccgtaaagacgtatccctaacttgcctagtcgtaggcttcaaccccggcgacatatccgtagaatggacatcaaacggacacacagaagaaaactacaaagacaccgcccccgtactcgactccgacggctcctacttcatctacagcaagctaaatatgaaaacctccaaatgggagaaaaccgactccttctcctgcaacgtccgccacgaaggcctcaaaaactactacctaaagaaaaccatctcacgctcacccggtaaa

SEQ ID NO: 54105 - RNA, 657 nt, synthetic construct
  misc_feature 1..657: note = derived and/or modified sequence opt11 from Neuradiab_LightChain1
  source 1..657: mol_type = other RNA
gacatcgtcatgacccaagccgccttcagcaaccccgtcaccctcggcacctccgcctccatctcctgccgctcctccaaatctctcctccactctaacggcatcacctacctctactggtacctccaaaaacccggccaatcaccccaactcctcatctaccaaatgtccaacctcgcatccggcgtcccagaccgcttctcctcctccggctcaggcaccgacttcaccctacgcatctcacgcgtcgaagccgaagacgtcggcgtctactactgcgcccaaaacctcgaacttccccgcaccttcggcggcggcaccaaactcgaaatcaaacgcgccgacgcagcccccaccgtctccatcttcccaccctcctccgaacaactcacctccggcggcgcctccgtagtctgcttcctcaacaacttctaccccaaagacatcaacgtcaaatggaaaatcgacggctccgaacgacaaaacggcgtcctcaactcctggacagaccaagactccaaagactccacctactccatgtcatccacactcaccctcaccaaagacgaatacgaacgacacaactcctacacatgcgaagccacccacaaaacctccacctcccccatcgtcaaatccttcaaccgaaacgagtgc

SEQ ID NO: 54106 - RNA, 369 nt, synthetic construct
  misc_feature 1..369: note = derived and/or modified sequence opt11 from Nimotuzumab_HeavyChain1
  source 1..369: mol_type = other RNA
caagtgcaactgcaacagagcggggccgaggtcaagaaaccgggctcgagcgtgaaagtgagctgtaaagcgagcgggtacacgttcacgaactattacatatactgggtcaggcaagcgcccgggcaagggctcgagtggataggcgggatcaatcccacgagcgggggctcgaactttaacgagaaatttaaaacgcgcgtgaccataaccgtggacgagagcacgaacacggcctatatggagctctcgagcttgcgctcggaagataccgcgttctatttctgtgccaggcaagggctctggttcgatagcgatggcaggggctttgacttttgggggcaagggagcacggtcacggtctcgagc

SEQ ID NO: 54107 - RNA, 342 nt, synthetic construct
  misc_feature 1..342: note = derived and/or modified sequence opt11 from Nimotuzumab_LightChain1
  source 1..342: mol_type = other RNA
gacatccaaatgacccaatccccctcctccctctccgcctccgtcggcgaccgcgtcaccatcacctgccgctcatcccaaaacatcgtccactccaacggcaacacctacctcgactggtaccaacaaacccccggcaaagcccccaaactcctcatctacaaagtctccaaccgcttctccggcgtaccctcccgcttctccggctccggctccggcaccgacttcaccttcaccatctcctccctccaacccgaagacatcgccacctactactgcttccaatactcccacgtaccctggaccttcggccaaggcaccaaactccaaatcacccgagaa

SEQ ID NO: 54108 - RNA, 1320 nt, synthetic construct
  misc_feature 1..1320: note = derived and/or modified sequence opt11 from Nivolumab_HeavyChain1
  source 1..1320: mol_type = other RNA
caagtccaactcgtcgaatcaggcggtggagtcgtccaaccaggccgctccctccgcctcgactgcaaagcctcaggcataaccttctccaacagcggcatgcactgggtccgccaagcccccggcaagggcctagaatgggtcgcagtcatctggtacgatggctcaaaacgatactacgcggactcagtcaaaggacgcttcaccatctcccgcgacaactccaaaaacaccctcttcctccaaatgaactcactacgcgccgaagacaccgcagtatactactgcgcaacaaatgacgactactggggccaaggaacgctcgtcaccgtctcctcagcctccacaaaaggcccctcagtattccctctggcgccatgctcacgctccaccagcgaatccaccgccgccctcggctgcctcgtcaaagactacttccccgagcccgtcaccgtcagctggaacagcggcgccctcacctctggagtacacacatttcccgccgtcctccaatcctcaggcctgtactcactctcatcagtcgtcacagtcccatccagcagcctcggaaccaaaacctacacgtgcaacgtcgatcacaaaccctcaaacaccaaagtcgacaaacgcgtcgaatccaaatacggaccaccctgtcccccatgccccgcccccgagttcctcggcggcccatccgtctttctcttcccaccaaaacccaaagacacactcatgatctcccgtacccccgaagtaacctgcgtcgtcgttgacgtatcacaagaagacccagaagtccaatttaactggtacgttgacggcgtcgaagtccacaatgccaaaaccaaaccacgcgaagaacaattcaactcaacctatagagtagtatccgtactaaccgtccttcaccaagactggctcaacggcaaagaatacaaatgcaaagtttccaacaaaggcctaccctcctcaatcgaaaagaccatatcaaaagccaaaggacaaccccgcgaaccccaagtctatacactacccccatcccaagaggaaatgaccaaaaaccaagtctccctaacctgcctcgtcaaaggcttctacccctcggacatagccgtcgaatgggaaagcaacggccaaccagaaaataactacaaaaccacacccccagtactcgacagcgacggctccttcttcctctactcacgactcaccgtcgacaaatcacgatggcaagaaggcaacgtattctcatgctccgtgatgcacgaagccctacacaaccactatacccaaaaatccctctccctcagcctaggcaaa

SEQ ID NO: 54109 - RNA, 642 nt, synthetic construct
  misc_feature 1..642: note = derived and/or modified sequence opt11 from Nivolumab_LightChain1
  source 1..642: mol_type = other RNA
gaaatcgtcctcacccaatcacccgccaccctatccctatccccaggcgaacgcgccaccctctcctgccgcgcctcccaaagcgtatcctcctacctagcctggtaccaacaaaaacccggccaagccccccgcctcctcatctacgacgccagcaaccgcgccaccggtatccccgcccgattctctggctccggctccggcaccgacttcaccctaaccatcagctccctcgaacccgaagacttcgccgtctactactgccaacaatcatccaactggccccgcaccttcggacaaggcaccaaagtcgaaatcaaacgcacagtcgccgccccctccgtcttcatcttccccccctccgacgaacaacttaaatcaggcaccgcctcagtcgtctgcctcctcaataacttctacccccgcgaagccaaagtccaatggaaagtagacaacgccctccaatccggaaactcccaagaatccgtcaccgaacaagactcaaaagactcaacctactccctaagctctaccctcaccctatccaaagccgactacgaaaaacacaaagtctacgcctgcgaagtcacccaccaaggcctttcctcccccgtaaccaaatccttcaaccgcggcgaatgc

SEQ ID NO: 54110 - RNA, 1347 nt, synthetic construct
  misc_feature 1..1347: note = derived and/or modified sequence opt11 from Obiltoxaximab_HeavyChain1
  source 1..1347: mol_type = other RNA
caagttcaactccaacaatcaggacccgaactcaagaaacccggcgcctccgtaaaagtctcctgcaaagactccggctacgccttctcttcatcgtggatgaactgggtccgacaagcccccggccaaggcctcgaatggatcggacgaatctaccccggagacggcgacaccaactacaacggaaaattccaaggcagagtcaccatcacagcagataaatcctcctccactgcctacatggaactctcctcactccgatccgaagacaccgcagtatacttctgcgctcgctccggcctgctccgttacgcaatggactactggggacaaggcacactcgtaaccgtctcctccgcatcaaccaaaggcccctccgtcttccccctggccccctcctcaaaaagcacttccggcggcaccgccgcactaggctgcctcgtaaaagactacttcccggaacccgtaacagtctcttggaactcgggagcactcacctccggcgtgcacaccttccccgccgtactacaatcctccggactctactccctatcctcagtcgtcaccgtcccaagctcctcccttggcacacaaacctacatctgcaacgtcaaccacaaaccatcgaacacaaaagtcgacaagaaagtagaacccaaatcctgcgacaaaacacatacctgcccaccctgccccgcacccgaactcctaggcggcccttccgtcttcctatttccacccaaaccaaaagacaccctcatgatatcccgcacccccgaagtaacctgcgtcgtcgtcgacgtcagccacgaagatcccgaagtcaaatttaattggtacgtcgacggcgtagaagtccacaacgccaaaacaaaaccacgagaagaacaatacaactccacatacagagtcgtatccgtactcactgtcctccaccaagactggctcaacggcaaagaatacaaatgcaaagtcagcaacaaagccctcccagccccaatagagaaaaccatctcaaaagccaaaggccaaccccgagaaccacaagtctacaccctcccaccctctcgagatgaactaactaagaaccaagtctccctaacctgcctcgtcaaaggattctacccctccgacatcgccgtcgaatgggaatcaaacggccaacccgagaacaactacaagaccacaccacccgtccttgacagtgacggctccttcttcctctactcaaaactcaccgtcgacaaatcccgctggcaacagggcaacgtcttctcatgctccgtaatgcacgaagccctacataaccactacacgcaaaaatcactatcactttcacccggaaaa

SEQ ID NO: 54111 - RNA, 642 nt, synthetic construct
  misc_feature 1..642: note = derived and/or modified sequence opt11 from Obiltoxaximab_LightChain1
  source 1..642: mol_type = other RNA
gacatccaaatgacccaatcaccctcctccctcagcgcctcagtcggcgaccgcgtcaccatcacatgccgcgcctcccaagacatccgcaactacctcaactggtaccaacaaaaacccggaaaagccgtcaaactcctaatctactacacctcacgcctcctccccggagtcccctcccgcttctccggctcaggctccggcaccgactactccctcaccatctcctcccaagaacaagaagacatcggcacatacttctgccaacaaggcaacacactcccctggaccttcggacaaggcaccaaagtcgaaatccgacgcaccgtcgccgccccctccgtattcatattcccaccctcagacgaacaactcaaatccggcaccgcctcagtcgtctgcctactcaacaacttctacccccgcgaagccaaagtccaatggaaagtcgacaacgcactccaatcaggaaactcgcaagaatccgtcaccgaacaagactctaaagactccacctactccctcagctcaaccctcaccctctccaaagccgactacgaaaaacacaaagtctacgcctgcgaagtcacccaccaaggcctatcatcccccgtcaccaaatccttcaaccgcggcgaatgc

SEQ ID NO: 54112 - RNA, 1347 nt, synthetic construct
  misc_feature 1..1347: note = derived and/or modified sequence opt11 from Obinutuzumab_HeavyChain1
  source 1..1347: mol_type = other RNA
caagtccaattagtacaatccggcgccgaagttaagaaacccggatcctcagtaaaagtttcctgcaaagcctccggctacgccttctcctactcctggatcaactgggtacgccaagcccccggccaaggcctcgaatggatgggacgtatcttcccaggcgacggagacaccgactacaatggtaaattcaaaggccgagtcaccatcaccgccgacaaatcaacctcaaccgcctacatggaactgtcctcccttagatccgaagacaccgcagtctattactgcgcccgcaacgtcttcgacggctactggctcgtctactggggccaaggaaccctcgtcaccgtgtcatccgcaagcaccaaaggcccatccgttttcccactcgccccctcctccaaatccacttccggcggcaccgccgccctcggctgcctcgtcaaagactacttcccagaaccagtaaccgtatcctggaacagcggcgccctcacatccggagtccacaccttccccgccgtcctgcaatccagcggcctctactccctcagctccgttgtcaccgtcccctcatcctcactcggcactcaaacatacatctgcaacgtcaaccacaagccctccaacaccaaggtagacaagaaagtcgaacccaaatcttgcgacaaaacccatacatgccctccctgtcccgcccccgaactcctcggagggccctcggtcttcctcttcccacccaaaccaaaagacaccctcatgatctcgagaactcccgaagttacctgcgtcgtcgtcgacgtctcacacgaagaccctgaagtcaaattcaactggtatgtcgacggcgtagaagtccacaacgctaaaacaaaaccccgcgaagaacaatacaactccacctaccgcgtcgtcagcgtacttaccgtactccaccaggactggctaaacggcaaagaatacaaatgcaaagtatccaacaaagccctccccgcccccatagaaaagaccataagcaaagcgaaaggtcaaccccgagaaccccaagtctataccctccctccttcccgcgacgaactcaccaaaaaccaagtctccctaacctgcctcgtcaaaggcttttacccctcagatatcgccgtcgaatgggaatccaacggccaaccagaaaacaactacaaaaccacacccccagtcctcgactccgacggctccttcttcctctactcaaaactcaccgtagacaaatcccgctggcaacaaggcaacgtcttttcctgctcagtcatgcacgaagcccttcacaaccactacacccagaaaagcctctccctctcccctggcaaa

SEQ ID NO: 54113 - RNA, 657 nt, synthetic construct
  misc_feature 1..657: note = derived and/or modified sequence opt11 from Obinutuzumab_LightChain1
  source 1..657: mol_type = other RNA
gacatcgtcatgacccaaacacccctctccctacccgtcacccccggcgaacccgcctccatctcatgccgctcctccaaatcactcctccactccaacggcatcacctacctctactggtacctccaaaaacccggtcaatcaccccaactcctcatctaccaaatgtccaacctcgtcagcggcgtccccgaccgattctccggctccggctccggcaccgacttcaccttaaaaataagccgcgtagaagccgaagacgtcggcgtatactactgcgcccaaaacctcgagctcccgtacaccttcggaggaggaaccaaagtcgaaatcaaacgcaccgtcgcagcccccagcgtgttcatattcccaccctccgacgaacaactaaaatcaggcaccgcctcagtcgtatgcctcctcaacaacttctacccccgcgaagccaaggtccagtggaaagtcgacaacgccctccaatccggaaactcccaagaaagcgtaaccgaacaagacagcaaagactccacatacagcctaagctcgaccctcaccctatccaaagccgactacgaaaaacacaaagtatacgcctgcgaagtcacacaccaaggcctatcctcccccgtaaccaagagcttcaacagaggcgaatgc

SEQ ID NO: 54114 - RNA, 1350 nt, synthetic construct
  misc_feature 1..1350: note = derived and/or modified sequence opt11 from Ocaratuzumab_HeavyChain1
  source 1..1350: mol_type = other RNA
gaagtacaactcgttcaatctggcgccgaagtaaagaaacccggcgaaagcctaaaaatctcctgcaaaggcagcggcagaaccttcacgtcatacaacatgcactgggtacgccaaatgcccggcaaaggcctcgaatggatgggcgccatctacccactcaccggcgacacatcctacaaccaaaaatcgaaactacaggtaaccatctcagccgacaaatcaatcagcaccgcatacctacaatggtcatcactcaaagcctccgacaccgccatgtactactgcgcacgctccacctacgtcggaggagactggcaattcgacgtctggggcaaaggaactaccgttaccgtctcctccgcttccacaaaaggacccagcgtattcccccttgccccctcttcaaaaagcacttccggcggaacagccgccctcggctgcctcgttaaagactactttcccgaacccgtcacggtctcctggaactccggagccctcacctcaggcgtccacaccttccctgccgtcctccaatcctcaggactttactcactatcctccgtcgtcacagtcccctcatcatccctcggcacacaaacctacatatgcaacgttaaccacaaaccctccaacaccaaagtcgacaagaaagttgaacccaaaagctgcgacaaaacccatacctgcccaccctgccccgcccccgaactccttggaggcccctcagtattcctcttcccacccaaaatcaaagacaccctgatgatctcccgcacacccgaagtaacctgcgtagttgtcgacgtcagccacgaagaccccgaagtcaaattcaattggtacgtagacggcgtagaagtccacaacgccaaaaccaaaccccgcgaggaacaatacaactccacctaccgcgtagtctcagtactcaccgttctccaccaagactggcttaacggcaaagaatacaaatgcaaagtcagcaacaaagcccttcccgcccccatcgagaagaccatctctaaacaaaaaggacaaccacgcgagccccaagtctacaccctacccccatcccgcgacgagctcaccaaaaaccaagtctctctcacatgcctcgtcaaaggtttctacccaagcgacatcgcagtcgaatgggaatccaacggccaacccgaaaacaactacaagaccacccctcccgtcctcgattccgacggctcgttcttcctatacagcaaactcacagtcgacaagagccgatggcaacaaggcaacgtcttctcctgctccgtcatgcacgaagccctacacaaccactacacccaaaaatccctatcactatcccccggc

SEQ ID NO: 54115 - RNA, 639 nt, synthetic construct
  misc_feature 1..639: note = derived and/or modified sequence opt11 from Ocaratuzumab_LightChain1
  source 1..639: mol_type = other RNA
gaaatcgtccttacccaatcccccggaaccctctccctctcacccggcgaacgcgccaccctctcctgccgcgcctcctcctccgtaccctacatccactggtaccaacaaaaacccggccaagcaccccgcctcctcatctacgccacctccgccctcgcatcaggcatccccgaccgcttctccggctccggctccggcaccgacttcaccctcaccatctcacgactcgaacccgaagacttcgccgtctactactgccaacaatggctctccaacccacccaccttcggccaaggaaccaaactcgaaataaaacgcacagtagccgccccctctgtcttcatcttcccaccctccgacgaacaactcaaatccggcaccgcctcagtcgtctgcctcctcaacaacttctacccccgcgaagccaaagtccaatggaaagtcgacaacgccctccaatccggcaactcccaagaatccgttaccgaacaagactccaaagactccacctactccctctcctccaccctcaccctctccaaagccgactacgaaaaacacaaagtctacgcctgcgaagtcacccaccaaggcctctcctcccccgtcaccaaatccttcaaccgcggcgaatgc

SEQ ID NO: 54116 - RNA, 1356 nt, synthetic construct
  misc_feature 1..1356: note = derived and/or modified sequence opt11 from Ocrelizumab_HeavyChain1
  source 1..1356: mol_type = other RNA
gaagtccaactcgtcgaatcaggcggcggcctcgtccaacccggaggctctctccgcctctcctgcgcagcatccggctacactttcacctcctacaacatgcactgggtacgacaagcccccggcaaaggactcgaatgggtcggagccatatatcccggcaacggagatacctcatacaaccaaaagttcaagggccgattcaccatctccgtagacaaatccaaaaacacattatacctccaaatgaactccctcagggcagaagacaccgccgtctactactgcgcccgagtcgtctactattccaattcctactggtactttgacgtctggggccaaggcaccctcgtcaccgtctcctccgcctccactaaaggcccctccgtcttccccctagccccctcctctaaatcgacctccggcggaaccgcagccctcggctgtctcgtcaaagactacttccccgaacccgtaaccgtttcatggaactcgggagccctcacctccggagtccacaccttcccagccgtcctccaatcctccggactatactcgctcagctcagtcgtcacagtcccctcctcctcactcggcacccaaacatacatctgcaacgtcaaccacaaaccttctaacaccaaagtcgacaagaaagtcgaacccaaatcctgcgacaaaacccatacctgccctccctgccccgctccggaactcctcggtggaccctccgtattcctattcccacccaaacccaaagacacactcatgatctctaggacccccgaagtaacctgcgtagtcgtcgacgtgtcacacgaagaccccgaagtaaaattcaactggtacgtcgacggcgttgaagtccacaacgcaaaaaccaaacccagggaggaacaatacaactccacctaccgcgtcgtctccgtcctaaccgttctacaccaagactggctcaacggaaaagagtacaaatgcaaagtatccaataaagcactacccgcacccatcgagaaaaccatctccaaagccaaaggccaacccagagaaccccaagtctacaccctccctccctcccgcgaagaaatgaccaagaaccaagtctcactaacctgcttagtcaaaggcttctacccatccgacatcgcagtcgaatgggaaagcaacggccaacccgaaaacaactacaaaacaaccccacccgtcctcgactccgacggctccttcttcctctactccaaactcaccgtcgacaaatcacgctggcaacaaggcaacgtcttcagctgctccgtcatgcacgaagcactccacaaccactacacccaaaaatcactatcgctcagccccggcaaa

SEQ ID NO: 54117 - RNA, 639 nt, synthetic construct
  misc_feature 1..639: note = derived and/or modified sequence opt11 from Ocrelizumab_LightChain1
  source 1..639: mol_type = other RNA
gacatccaaatgacccaatccccctcctccctctccgcctccgtcggcgaccgagtcacaatcacctgccgcgcctcctcatccgtctcctacatgcactggtaccaacaaaaacccggcaaagcccccaaacccctaatctacgccccctccaacctagcctccggcgtcccctcccgattctccggctccggctccggcaccgacttcacccttaccatctcctccctccaacccgaagacttcgccacctactactgccaacaatggtccttcaacccccccaccttcggccaaggaaccaaagtagaaatcaaacgcaccgtcgcagccccctccgtcttcatcttccccccctccgacgaacaactcaaatccggcacagcctccgtcgtctgccttctcaacaacttctacccccgcgaagccaaagtccaatggaaagtagacaacgccctccaatccggcaactcccaagaatcagtcacagaacaagactccaaagactccacctactccctatcatccaccctcaccctatccaaagcagactacgaaaaacacaaagtctacgcatgcgaagtaacccaccaaggactctcctcccccgtcaccaaatcattcaaccgcggcgaatgc

SEQ ID NO: 54118 - RNA, 1356 nt, synthetic construct
  misc_feature 1..1356: note = derived and/or modified sequence opt11 from Ofatumumab_HeavyChain1
  source 1..1356: mol_type = other RNA
gaagtccaactcgtcgaatctggtggcggcctcgtccaacccggccgttccctccgcctctcatgcgccgcctcgggcttcacattcaacgactacgccatgcattgggtccgccaagcccccggaaaaggccttgaatgggtctcaaccatcagctggaactcgggatccatcggctacgccgactcggtcaaaggccgcttcaccatatcccgcgacaacgcaaagaaaagcctctacctacaaatgaactcccttcgggcagaggacaccgccctctactactgcgcaaaagacatacaatacggcaactactactacggcatggacgtctggggccaaggcacgaccgtcacagtatcctcagcctccaccaaaggcccctcagtcttcccccttgccccgtcctcaaaatccacctccggaggcaccgccgccctaggctgcctcgtcaaagactacttccccgaacccgtcaccgtctcatggaactccggcgccctcacctcaggcgtccacaccttccctgctgtcctacaatcatcaggcctctactccctatcctccgtcgtaaccgtcccctcgtcatccctcggcacacaaacctacatctgcaacgtcaaccacaaaccctcaaacaccaaagtagacaaacgagtcgaaccgaaatcctgcgacaaaacccacacatgcccaccctgccccgctcccgaactcctaggaggcccatcagttttcctattcccacccaaacccaaagacaccctcatgatctctcgcactcccgaggttacatgcgtcgtcgtcgacgtcagccacgaagaccccgaggtcaagttcaactggtacgtagacggcgtagaagtacacaacgccaagaccaaaccccgcgaagaacaatacaactcaacataccgggttgtatccgtcctcaccgtcctacaccaagactggctcaacggcaaagaatacaaatgcaaagtcagtaacaaggccctacccgcccccatcgagaaaaccattagcaaagccaaaggccaacctcgcgaaccacaagtatacaccctcccaccctcccgcgaagaaatgaccaaaaaccaagtatctctaacatgcctcgtcaaaggcttttacccctccgacatcgccgtcgaatgggaatccaacggccagcccgagaacaactacaaaaccacgcccccagtcctcgactcagatggctcattcttcctatactccaaactaaccgtcgacaaatcccgatggcaacaaggcaacgtcttctcctgcagcgtaatgcacgaagccctacacaaccactacacccaaaaatcactctcactatcaccagggaaa

SEQ ID NO: 54119 - RNA, 642 nt, synthetic construct
  misc_feature 1..642: note = derived and/or modified sequence opt11 from Ofatumumab_LightChain1
  source 1..642: mol_type = other RNA
gaaatcgtcctaacacaatccccagccaccctctccctctcacccggcgaacgcgccaccctatcctgccgcgcctcccaatccgtctcctcctatctcgcctggtaccaacaaaaacccggccaagcaccccgcctcctaatctacgacgccagcaaccgagccaccggcatccccgcccgcttctccggctccggctctggaaccgacttcaccctcaccatctcctcgctcgaacccgaagacttcgccgtctactactgccaacaacgctcaaactggcccatcaccttcggacaaggcacccgcctcgaaatcaaacgcacagtcgccgccccctcagtattcatcttcccaccctccgacgaacaactcaaatcaggcaccgcctccgtcgtctgcctactcaacaacttctacccccgagaagccaaagtccaatggaaagtcgacaacgcactccaatcaggcaactcccaagaatccgtcaccgaacaagactccaaagactccacctactccctatcctccacccttaccctttccaaagccgactacgaaaaacacaaagtctacgcatgcgaagtcacccaccaaggcctctcctcacccgtaaccaaatccttcaaccgcggcgaatgc

SEQ ID NO: 54120 - RNA, 1371 nt, synthetic construct
  misc_feature 1..1371: note = derived and/or modified sequence opt11 from Olaratumab_HeavyChain1
  source 1..1371: mol_type = other RNA
caactccaactacaggaatccggccccggcctagtcaaaccctccgagaccctctctctcacttgcacagtttccggcggctcaatcaacagttccagctactactggggatggctccgacaatctccaggcaaaggactcgaatggatcggatccttcttctacaccggctcaacctactacaacccctcactccgcagccgacttacaatctccgtcgacaccagcaaaaaccaattctcacttatgctatcatccgtcaccgccgccgacacagccgtctactactgcgcccgccaatcaacctactactacggctcaggcaactactacggatggttcgaccgctgggaccaaggcaccctcgtcaccgtatcaagcgcctccacaaaaggtccatccgtattcccactcgccccatcctcgaaatcaacctcgggcggaacagccgccctaggctgcctcgtcaaagactacttccccgaacctgtcacagtcagctggaactctggagcgctcacatccggtgtccacaccttcccagcggtcctccaaagctccggcctttactcgctctcatccgtcgtaacagtacccagctcatccctcggaacacaaacctacatctgcaacgtcaaccacaaaccctcaaacaccaaagtcgataagcgcgtcgagcccaaatcctgcgacaaaacccatacctgccctccctgccccgcacccgaactcctcggaggaccctccgtcttcctgttcccacccaaacccaaagacacactgatgatatcccgcacacccgaagtcacatgcgttgtcgttgacgtgtcccacgaagatcccgaagtcaaattcaattggtatgtcgacggcgtcgaagtccacaacgcaaagaccaaaccccgtgaagaacaatacaactccacatacagagtcgtatccgtcctcaccgtcctccaccaagactggctcaacggcaaagaatacaaatgcaaagtctccaacaaagccctccccgcacccatcgagaaaacaatctccaaagcgaaaggacaaccacgcgaaccacaagtttacacccttccaccctctcgcgaagaaatgaccaaaaaccaagtttccctaacctgcctcgtaaaaggattctacccctccgatatcgccgtcgaatgggaaagcaacggccaacccgaaaacaactacaaaactacaccacccgtcctcgactcggacggctccttcttcctctactccaaactcactgtcgacaaatccagatggcaacaaggcaacgtcttctcctgttccgtcatgcacgaagccctccacaatcactatacccaaaaatcactctccctctcacccggcaaa

SEQ ID NO: 54121 - RNA, 642 nt, synthetic construct
  misc_feature 1..642: note = derived and/or modified sequence opt11 from Olaratumab_LightChain1
  source 1..642: mol_type = other RNA
gagatcgtactcacccaatcccccgccaccctctccctctcccccggcgaacgagcaacactctcctgccgagcatcccaaagcgtatcctcctaccttgcctggtaccaacaaaaacccggacaagcccccagactactcatctacgacgcctcaaaccgcgcaaccggcatccccgcacgattctcaggctccggctccggcaccgacttcaccctcaccatctcctccctcgaacccgaagacttcgccgtttactactgccaacaacgctccaactggccacccgccttcggacaaggcaccaaagtcgaaatcaaacgcaccgtcgccgccccctccgtcttcatcttcccgccctccgacgaacaactcaaatccggcaccgcctccgtcgtctgcctcctcaacaacttctacccccgcgaagccaaagtccaatggaaagtcgacaacgccctccaatccggcaactcccaagaaagcgtcaccgaacaagactccaaagactcaacctactccctatcctcaaccctcaccctctccaaagccgactacgaaaaacacaaagtctacgcctgcgaagtcacacaccaaggcctctcctcccccgtcaccaaatccttcaaccgcggcgaatgc

SEQ ID NO: 54122 - RNA, 1341 nt, synthetic construct
  misc_feature 1..1341: note = derived and/or modified sequence opt11 from Olizuab_HeavyChain1
  source 1..1341: mol_type = other RNA
gaagtccaactggtcgaaagcggtggcggcctcgtccaacctggcggatccctccgtctctcctgcgccgtatcaggctattcaataacctccggctactcctggaactggatccgacaagccccaggcaaaggtctggaatgggtcgcgtccatcacatacgacggctccacgaactacaacccgtccgtaaaaggacgaatcaccatcagccgggacgactccaaaaacactttctatctacaaaactccctacgcgccgaagacaccgccgtttactactgcgcacgaggatcccattacttcggccactggcacttcgccgtctggggacaaggaaccctcgtcacagtcagctcagcatcaaccaaaggcccctccgtcttccccctagccccctccagcaaatccacctccgggggcaccgccgcactcggctgcctcgtaaaagattacttccccgaaccagtcacagtctcatggaactccggcgccctcacctccggcgtccacaccttcccggccgtactccagagctctggcctttactccctctcatcagtagtcaccgtaccctcctcctccctcggcacacaaacttacatctgcaacgtcaaccacaaaccatccaacaccaaagtcgacaagaaagtagaacccaaatcatgcgacaaaacccacacctgtcccccatgccccgcccccgaactcctaggcggaccctcagtcttcctcttccctcctaaacccaaagacaccctaatatcacgcacccccgaagtcacatgcgtagtcgtcgacgtcagccacgaagacccagaagtcaaattcaactggtacgtcgatggtgtcgaagtgcacaatgccaagaccaaaccccgcgaagaacaatacaactccacctaccgcgtcgtctcagttcttaccgtcctacaccaagactggcttaacggcaaagaatacaaatgcaaagtctccaacaaagcactccccgcacccatcgaaaagacaatcagcaaagccaaaggccaaccccgtgaaccccaagtttacacccttccgccctcccgcgaagaaactaaaaaccaagtatcactgacctgcctcgtcaaaggcttctacccctcagacatcgccgtcgaatgggaatccaacggccaacccgaaaacaactacaaaaccacacccccagtcctcgactccgatggatccttcttcctctactcaaaactcaccgtcgacaaatcacgctggcaacaaggaaatgtcttctcctgctctgtccacgaagccctccataaccactacacccaaaaatcactctctctctccccaggaaaa

SEQ ID NO: 54123 - RNA, 651 nt, synthetic construct
  misc_feature 1..651: note = derived and/or modified sequence opt11 from Olizuab_LightChain1
  source 1..651: mol_type = other RNA
gacatccaactcacccaatccccctccagcctctccgcctccgtcggcgaccgcgtcaccataacctgccgcgcctctcaatccgtagactacgacggcgactcctacaactggtaccaacaaaaacccggcaaagcccccaaactcctcatctacgccgcctcctacctcgaatccggcgtcccctcccgcttctccggctccggctccggaacagacttcaccctcacaatctcctccctccaacccgaagacttcgccacctactactgccaacaatcacacgaagacccctacaccttcggccaaggcaccaaagtcgaaatcaaacgcaccgtcgccgccccatcagtcttcatcttccctccctcagacgaacaactcaaatccggcacagcctccgtcgtctgcctcctaaacaacttctaccctcgcgaagccaaagtccaatggaaagtcgacaacgcactccaatccggcaactcacaagaatcagtcaccgaacaagactccaaagactccacctactctctctcatccaccctcaccctctcaaaagccgactacgaaaaacacaaagtatacgcatgcgaagtcacacaccaaggcctatcctcacccgtaaccaaatccttcaaccgcggagaatgc

SEQ ID NO: 54124 - RNA, 1341 nt, synthetic construct
  misc_feature 1..1341: note = derived and/or modified sequence opt11 from Olokizumab_HeavyChain1
  source 1..1341: mol_type = other RNA
gaagtacaactcgtcgaaagcggcggcggcctagtccaaccaggcggttccctacgactatcttgcgcagcctccggcttcaacttcaacgactacttcatgaactgggtacgacaagcacccggaaaaggccttgaatgggtcgcccaaatgcgcaacaaaaactaccaatacggcacctactacgccgaatccctcgaaggacgcttcaccatatcccgtgacgactccaaaaactccctctacctccagatgaactccctcaagaccgaagacaccgccgtctactactgcgcccgagaatcgtactacggcttcacatcatactggggccaaggcaccctagtcaccgtatcctccgcctccacaaaaggaccatccgtcttcccgctcgccccctgctcccgatcaacctccgaatccaccgcagcccttggctgcctcgtcaaagactacttcccagaaccagtaaccgtctcctggaactccggcgcactcacctccggcgtacacacatttccagccgtcctccaatcctccggactttactccctcagcagcgtcgtaaccgtcccatcctcatccctcggcaccaaaacctatacctgcaacgtagaccacaaaccctccaacaccaaagtagacaaaagagtcgaaagcaaatacggtccaccatgcccaccctgccccgcacctgaatttctcggcggcccctccgtcttcctctttccccctaaaccaaaagacaccctaatgatatcacgcacacccgaagtaacatgcgtagtcgtagatgtctcacaagaagaccccgaagtccagttcaactggtacgtcgacggtgtcgaagtccacaacgccaaaaccaaaccccgagaagaacaattcaactcaacataccgcgtcgtatcggtcctcacagtcctacaccaagactggctcaacggaaaagaatacaaatgcaaagtcagcaacaaaggcctcccatcatctatcgagaaaaccatctcaaaagcaaaaggccagcccagagaaccccaagtctacaccctacccccatcccaggaagagatgaccaaaaaccaagtatccctaacctgcctagtcaagggcttctacccctccgacatcgccgtcgaatgggaatcaaacggccaacctgaaaacaactacaaaaccacacccccagtattagactcagacggatccttcttcctctactcccggctaaccgtggacaaatcccgctggcaagagggcaacgtcttcagctgctccgtcatgcacgaagccctacacaaccactacacacaaaaatccctctccctctcactcggcaaa

SEQ ID NO: 54125 - RNA, 642 nt, synthetic construct
  misc_feature 1..642: note = derived and/or modified sequence opt11 from Olokizumab_LightChain1
  source 1..642: mol_type = other RNA
gacatccaaatgacccaaagcccctcaagcctaagcgcaagcgtaggcgaccgagtaaccataacctgccaagccagccaagacatcggcataagcctaagctggtaccaacaaaaaccaggaaaagcgcccaaactcctaatctacaacgccaacaacctcgccgacggggtcccaagccgattctcaggctcaggctccggcacagacttcaccctaaccatcagctcactccaacccgaagacttcgccacctactactgcctacaacacaactcagccccatacacattcggccaaggaaccaaactcgaaatcaaacgcacagtcgcagcccccagcgtattcatattcccaccctcagacgaacaactaaaatcaggcacagcctcagtcgtctgcctgctcaacaacttctacccacgcgaagccaaagtccaatggaaagtcgacaacgcactccaaagcggaaactcacaagagagcgtgaccgaacaagacagcaaagactcaacctacagcctaagctcaaccctaaccctaagcaaagccgactacgaaaaacacaaagtatacgcctgcgaagtcacccaccaaggcctcagctcacccgtaaccaaatcattcaaccgaggcgaatgc

SEQ ID NO: 54126 - RNA, 1341 nt, synthetic construct
  misc_feature 1..1341: note = derived and/or modified sequence opt11 from Omalizumab_HeavyChain
  source 1..1341: mol_type = other RNA
gaagttcagctagtagaatccggaggcggactcgtccagcccggcggatccctccgcctctcatgcgccgtctccggctactccatcacctccggatactcatggaactggattcgccaagcccccggaaaaggcctcgaatgggtagcctccataacctacgacggctcaaccaattacgccgactccgtaaaaggccgattcaccatatcgcgcgacgactccaaaaacacattctacctccaaatgaatagcctccgcgcagaagatacagccgtctactactgcgcacgcggctcccattacttcgggcactggcacttcgccgtctggggccagggcaccctagtcaccgtctcaagcggcccctccgtattcccactcgccccctcctccaaatccacctcaggaggcaccgccgcactcggctgcctcgtaaaagattatttcccagaacccgtcaccgtctcctggaactccggcgccctcacatccggcgtccacactttccccgccgtcctacaatcctccggactctattccctctcctccgtcgtaacagtcccctcaagctcactcggaacccaaacttacatatgcaacgtaaaccacaaaccctcaaacacaaaagtcgacaagaaagccgaacccaaatcctgcgacaaaacacacacatgcccaccctgccccgcgcccgaactcttaggcggtccctccgtcttcctcttcccacccaaacccaaagacaccctcatgatctcccgcacacccgaagtaacctgcgtagtagtcgacgtctcccatgaagaccccgaagtaaaattcaactggtacgtcgacggagtcgaagtccacaacgccaaaaccaaaccccgcgaagaacaatacaactcaacctaccgcgtagtatccgtcctcactgtcctgcatcaagactggctcaacggcaaagaatacaaatgcaaagtcagcaacaaagccctacccgcccccatcgagaaaacaatctcaaaggccaagggacaaccccgcgaaccccaagtctacaccttaccaccctcaagagacgaactaaccaaaaaccaagtctcactcacatgccttgtcaaaggattctacccgagcgacatagccgtcgaatgggaatccaacggacaacccgaaaacaattacaaaacaacccctcccgtcctcgactcagacggctctttcttcctctattcgaaactcaccgtcgacaaatcccgttggcaacaaggcaacgtcttctcctgttccgtcatgcacgaagcacttcacaaccactatacccaaaaatcactatccctatcccccggaaaa

SEQ ID NO: 54127 - RNA, 645 nt, synthetic construct
  misc_feature 1..645: note = derived and/or modified sequence opt11 from Omalizumab_LightChain
  source 1..645: mol_type = other RNA
gacatccaactcacacaatccccctcctccctctccgcatccgtaggcgaccgcgtcaccatcacatgccgcgccagccaatccgtcgactacgacggcgactcctacatgaactggtaccaacaaaaacccggcaaagcacccaaactcctaatctacgcagcctcctacctcgaatccggcgtccccagccgattctccggatcaggctccggcaccgacttcacccttaccatctcctcactccaacccgaagacttcgccacctactactgccaacaatcccacgaagacccctacaccttcggccaaggcaccaaagtcgaaatcaaacgtaccgtcgccgccccctccgtcttcatcttcccaccctccgacgaacaactcaaatccggcaccgcctccgtcgtctgcctactcaacaacttctacccccgcgaagccaaagtccaatggaaagtcgacaacgccctccaatccggaaactcccaagaaagcgtcaccgaacaagacagcaaagactccacctactccctatcctcaaccctaaccctatccaaagccgactacgaaaaacacaaagtctacgcctgcgaagtcacccaccagggcctctcctcccccgtcaccaaatccttcaacaga

SEQ ID NO: 54128 - RNA, 1347 nt, synthetic construct
  misc_feature 1..1347: note = derived and/or modified sequence opt11 from Onartuzumab_HeavyChain1
  source 1..1347: mol_type = other RNA
gaagtacagctcgtcgaatccggcggcggcctcgtacagccaggcggctcccttcgactctcctgcgccgcctcaggatacacattcacatcctactggctgcactgggtccgccaagccccaggcaaaggactagaatgggtcggcatgatcgacccatccaactccgacactcgattcaaccccaacttcaaagaccgattcaccataagcgcagacaccagtaaaaacaccgcttacctccaaatgaactctctacgagcagaagacaccgcagtctattactgcgcaacctaccgctcctacgtcactccactcgactactggggccaaggtaccctcgttacagtctcctccgcctcaaccaaaggaccctccgtcttcccactcgccccctcctcaaagtcaacctccggcggcaccgccgccctagggtgcctagtcaaagattacttcccagaaccagtcacagtcagctggaacagcggagccctcacctccggcgtccatacattccccgccgtactccaatcctccggtctatactccctatcctctgtcgtaactgtcccctcctcctctctaggcacccaaacctacatctgcaacgtcaaccacaaaccatcaaacaccaaggtcgacaagaaagtcgaacccaaaagctgtgacaaaacccacacctgtcctccctgccccgcccccgaacttctcggtggcccctccgtcttcctcttcccacccaaacccaaggacacactcatgatctcccgcacccccgaagtaacctgtgtcgtcgtcgacgtctcccacgaagaccccgaagtaaaattcaactggtacgtagacggcgtagaagtccacaacgccaaaaccaaaccccgcgaagaacaatacaactccacctaccgagtcgtctcagttctcaccgtccttcaccaagactggctcaacggtaaagaatacaaatgcaaagtctccaacaaagccctccccgcccccattgagaaaaccatatctaaagccaagggccaaccacgcgaaccgcaagtctacaccctacccccttcacgcgaagaaatgaccaaaaaccaagtttccctatcctgcgccgttaaaggcttctacccatccgacatcgccgtcgaatgggaatccaatggccaaccagaaaacaactacaaaaccacacccccagtcctcgattcagacggctccttcttcctagtctccaaactgaccgtagacaaatctcgatggcagcaaggcaacgtcttctcctgctccgtcatgcacgaagccctgcacaaccactatacacaaaaatcactatccctatcccccggcaaa

SEQ ID NO: 54129 - RNA, 681 nt, synthetic construct
  misc_feature 1..681: note = derived and/or modified sequence opt11 from Onartuzumab_HeavyChain2
  source 1..681: mol_type = other RNA
gacaaaacccacacctgccccccctgccccgcccccgaactactcggcggcccctcagtcttcctcttcccccccaaaccaaaagacaccctcatgatctcccgaacccccgaagtcacctgtgtcgtcgtcgacgtctcccacgaagaccccgaagtaaaattcaactggtacgtcgacggcgtagaagtccacaacgccaaaaccaaaccccgcgaagaacaatacaactccacctaccgcgtagtctcagtccttaccgtcctccaccaagactggctcaacggcaaagaatacaaatgcaaagtctcaaacaaagccctccccgcccccatcgaaaaaaccatctccaaagccaaaggacaaccccgagaaccacaagtctacaccctccccccctcccgcgaagaaatgactaaaaaccaagtctctctctggtgcctcgtcaaaggcttctacccctccgacatcgccgtcgaatgggaatccaacggccaaccagagaacaactacaaaaccaccccccccgtcctagactccgacggctccttcttcctctactccaaactcaccgtagacaaatcccgctggcaacaaggcaacgtcttctcctgctctgtcatgcacgaagccctccacaaccactacacccaaaaatccctatccctctcccccggcaaa

SEQ ID NO: 54130 - RNA, 660 nt, synthetic construct
  misc_feature 1..660: note = derived and/or modified sequence opt11 from Onartuzumab_LightChain1
  source 1..660: mol_type = other RNA
gacatccaaatgacacaatccccctcatccctctccgcctccgtcggcgaccgcgtcaccatcacctgcaaatcctcccaatccctcctctacacctcctcccaaaaaaactacctcgcctggtaccaacaaaaacccggcaaagccccaaaactcctcatctactgggcatcaacccgcgaatccggcgtcccctcccgattctccggctctggctccggcactgacttcaccctcaccatctcctcactccaacccgaagacttcgccacctactactgccaacaatactacgcctacccctggaccttcggccaaggcaccaaagtcgaaatcaaacgcaccgtcgccgcaccctccgtcttcatcttccccccctccgacgaacaactcaaatccggcaccgcctctgtcgtctgcctcctcaacaacttctacccccgcgaagccaaagtccaatggaaagtcgacaacgccctccaatccggcaactcccaagaatccgtaaccgaacaagactccaaagactccacctactccctctcctccaccctcaccctctccaaagccgactacgaaaaacacaaagtctacgcctgcgaagtcacccaccaaggcctctcctctcccgtcaccaaatccttcaaccgcggcgaatgc

SEQ ID NO: 54131 - RNA, 1362 nt, synthetic construct
  misc_feature 1..1362: note = derived and/or modified sequence opt11 from Ontuxizumab_HeavyChain1
  source 1..1362: mol_type = other RNA
caagtccaactccaggaatccggccccggactcgtccgcccctcccaaaccctatccctcacttgcaccgcctccgggtacacctttacagactacgtcatccactgggtcaaacaaccacccggacgcggactcgaatggataggctacatcaacccctacgacgacgacactacttacaaccaaaaattcaaaggacgcgtcacaatgctcgtcgacacctcatccaacaccgcatacctccgcctctcatcagtcaccgctgaagacacagcagtatactactgcgcacgccgcggcaactcctatgacggctacttcgactactcaatggactactggggcagcggcacccccgtcaccgtctcctccgcctccaccaaaggcccctcagtattccccctagccccctcctccaaatccacctccggcggaaccgcagccctcggttgcctagtcaaagactacttccccgaaccagtaaccgtctcctggaactccggcgccctcacctcaggcgttcacacattccccgccgttctccagagctccggcctctactccctctcctccgtcgtcacggtcccctcatcctccctcggcacccaaacatacatatgtaacgtaaaccacaaaccatccaacaccaaagtcgataagaaagtcgaaccaaaatcctgcgacaaaacccatacctgcccaccctgtcccgccccagaactcctaggaggcccctccgtcttcctcttcccacctaaacccaaagacacccttatgatctcccgtaccccagaagtaacctgcgtcgtcgtcgacgtatcccacgaagacccagaagtcaaattcaactggtacgtagacggcgtcgaagtccacaacgcgaaaaccaaaccccgtgaggaacaatacaacagcacctaccgcgtcgtctccgtcctcaccgtactccaccaagactggctcaacgggaaagaatacaaatgcaaagtttctaacaaagccctcccagcccccatagagaaaaccatctccaaagccaaaggccaaccacgtgaacctcaagtgtacaccctcccaccctcccgagacgaacttaccaaaaaccaagtcagcctaacctgcctagtaaaaggcttctacccctccgatatcgccgtcgaatgggaatcaaatggccaaccggaaaacaactacaaaaccacccctcccgttcttgactccgacggcttcttcttcctctactcaaaactcaccgtcgacaaatcccgatggcaacaaggcaacgtcttctcatgctccgtaatgcacgaagccctccacaaccactacacccaaaaatccctctccttatcacccggcaaa

SEQ ID NO: 54132 - RNA, 645 nt, synthetic construct
  misc_feature 1..645: note = derived and/or modified sequence opt11 from Ontuxizumab_LightChain1
  source 1..645: mol_type = other RNA
gacatacaaatgacccaatccccctcctccctctcagcctccgtcggcgaccgagtcaccatcacctgccgtgcatcccaaaacgtcggcaccgccgtcgcctggctccaacaaacccccggcaaagcccccaaactcctcatttactccgcctccaaccgctacacaggcgtcccctcccgcttctcaggctcaggctccggcaccgactacaccttcaccatctcctcccttcaacccgaagacatcgccacctactactgccaacaatacaccaactaccccatgtacaccttcggccaaggcaccaaagtccaaatcaaacgcacagtcgccgccccctccgtcttcatattccccccctccgacgaacaactaaaatccggcacagcctccgtcgtatgcctcctcaacaacttctacccccgagaagccaaagtccaatggaaagtcgacaacgccctccaatccggcaactcccaagaatccgtcaccgaacaagacagcaaagactccacctactcactatcctccaccctcaccctatccaaagccgactacgaaaaacacaaagtctacgcatgcgaagtcacccaccaaggcctctcctcccccgtcaccaaatccttcaaccgcggcgaatgc

SEQ ID NO: 54133 - RNA, 1341 nt, synthetic construct
  misc_feature 1..1341: note = derived and/or modified sequence opt11 from Opicinumab_HeavyChain1
  source 1..1341: mol_type = other RNA
gaagtccaactcctcgaatcaggcggaggcctcgtccaacccggcggcagcctaagactcagctgcgcagcctccggcttcacattctcagcatacgaaatgaaatgggtccggcaagcaccaggaaaaggcctagaatgggtctccgtcatcggcccctccggcggcttcaccttctacgccgattctgtcaaaggccgattcaccatatcacgtgacaattccaaaaacaccctctacctgcaaatgaactccctacgcgccgaagataccgctgtatactactgcgccaccgaaggcgacaacgacgcattcgacatctggggccaaggaaccaccgtaacagtctcttccgcatcaacaaaaggcccctcagtattccccctcgcgccaagctcaaaatccacctccgggggcacagctgccttaggctgcctcgtcaaagactacttccccgaaccagtcaccgtaagctggaactcaggagcactcacctccggagtacacaccttccccgccgtcctacaatcctccggactctactccctcagctccgtcgtcactgtacccagctccagcctcggcacccaaacctacatctgcaatgtcaaccacaaaccctccaacaccaaagtcgacaagaaagttgaacccaaatcgtgcgacaaaacacatacatgcccaccctgccccgcccccgagctactcggcggcccctcagtcttcctcttcccacccaaacccaaagacaccctcatgatatcacgcacacccgaagtcacgtgcgtcgtcgtcgacgtctcacatgaagatccagaagtaaaattcaactggtacgtcgacggagtagaagtccacaatgccaaaaccaaaccccgcgaagaacaatacaacagcgcttaccgagtcgtctccgttcttaccgtcctccaccaagactggctaaacggcaaagaatacaaatgcaaagtttccaacaaagccctccccgcacctatcgagaaaaccatcagcaaagccaaaggccaaccccgagaaccccaagtctacactctcccgccatcacgagacgaactcaccaaaaaccaagtatccctaacctgcctcgtcaaaggcttctatccatccgacatagccgtcgaatgggaatctaatggccaacccgaaaacaactacaaaacaaccccacccgtccttgactccgacggctcattcttcctctactcaaaactcaccgtcgacaaatcacgctggcaacaaggaaacgtcttctcttgttcagtcatgcacgaagccctacacaaccactacacccaaaaatcactatccctctcacccggc

SEQ ID NO: 54134 - RNA, 645 nt, synthetic construct
  misc_feature 1..645: note = derived and/or modified sequence opt11 from Opicinumab_LightChain1
  source 1..645: mol_type = other RNA
gacatccaaatgacccaatcccccgccaccctctccctctcccccggcgaacgagccaccctatcctgccgagcctcccaatcagtctcctcctacctcgcatggtaccaacaaaaacccggccaagccccccgcctccttatctacgacgcctccaaccgcgccaccggcatccccgcccgcttctcaggctcaggctcaggcaccgacttcaccctcaccatctcctcactcgaacccgaagacttcgccgtctactactgccaacaacgatccaactggcccatgtacaccttcggacaaggcaccaaactagaaatcaaacgcacagtcgccgccccctccgtcttcatcttccccccctcagacgaacaactcaaatccggcaccgcctccgtcgtctgcctcctcaacaacttctacccccgcgaagccaaagtccaatggaaagtcgacaacgcacttcaatcaggcaactcccaagaatccgtcaccgaacaagactccaaagactccacctactcactctcctccacactcaccctctcaaaagccgactacgaaaaacacaaagtatacgcctgcgaagtcacccaccaaggcctctcctcccccgtcaccaaatccttcaacagaggagaatgc

SEQ ID NO: 54135 - RNA, 1941 nt, synthetic construct
  misc_feature 1..1941: note = derived and/or modified sequence opt11 from Oportuzumab_monatox_HeavyChain1
  source 1..1941: mol_type = other RNA
caccatcaccaccaccacgatatacaaatgacccagagccccagctccctatcagcctcagtcggcgatcgcgtaacaataacctgccgcagcaccaaaagcctcctacactccaatggcatcacatacctctactggtaccaacagaaacccggcaaagcccccaaattgctcatataccaaatgagcaacctggcatcaggagtccccagcagattctcctcctccggaagcggcacggactttaccctcacaatctccagcctgcaaccagaagacttcgctacatactattgcgcccaaaacctcgaaatcccccgtacattcggacaaggcacaaaggtcgaactaaaacgagcaaccccctcacacaactcccatcaagttcccagtgcaggcggccccaccgcaaactcaggcacatcgggatctgaagtccaactcgtacaatcaggacccggcctcgttcaacccggcggatccgtccgcatctcctgcgccgcatcaggctacaccttcaccaactacggcatgaactgggttaaacaagcccccggaaaaggcctagaatggatgggctggattaacacctacacaggagaaagcacatacgcagactccttcaaaggccgtttcacattcagcctcgacacctccgcaagcgctgcatacctccagatcaactcgctaagagcagaagataccgcggtttactattgcgccaggttcgcaataaagggcgactactggggacaaggcacacttctcacagtaagctcagagttcggaggcgcaccagagttccccaaaccctcaaccccacccggcagctccggcctagaaggtggctctctcgcagccctaacggcccaccaagcctgccatctccccctagaaaccttcacccgccacagacagcccagaggctgggaacaactcgaacaatgcggctaccccgtacaacgcctagtcgccctctatctggccgcgcggctctcctggaatcaagtcgaccaagtcatacgtaacgccctcgcctcacccggcagcggtggcgacctcggcgaagccatacgcgaacaacccgaacaagcacgactagcgcttaccctagccgccgccgaatccgaacgattcgtcagacaaggcacaggcaacgacgaggccggagccgcatcagcagacgtagtctccctgacatgtcccgtcgccgccggagaatgcgccggccccgcggactcaggcgacgcactactcgaacgcaactacccgacaggagccgagttcctcggcgacggaggcgacgtgtcattttccacccgaggcacccaaaactggacagtcgaacgcctcctccaagcacacagacaactcgaagaacgaggatacgtcttcgtcggttaccacggcaccttcctagaagcagctcaaagcatcgtattcggtggcgtaagagcccgaagccaagacctagacgccatttggagaggcttctacatcgcaggagatccagccctggcctacggttacgctcaagaccaagaaccagacgcacgcggtcgcataagaaacggcgccctcctccgcgtttacgtcccccgctcatccctaccaggcttctatagaaccggacttaccctagccgcaccagaagccgcaggcgaagtcgaacgccttataggtcacccactcccactccgactagacgccatcaccggaccagaagaagaaggaggccgactcgaaacaatcctaggatggcccctagcagaacgtaccgtcgtcatcccgtcagccataccaacagacccgagaaacgtcggtggcgacctagaccctagctccatccccgacaaagaacaagctatctccgccctccccgactacgcaagccagccaggaaaaccaccccaccaccaccaccaccacaaagacgaacta

SEQ ID NO: 54136 - RNA, 1941 nt, synthetic construct
  misc_feature 1..1941: note = derived and/or modified sequence opt11 from Oportuzumab_monatox_SingleChain_variable_fragment
  source 1..1941: mol_type = other RNA
caccaccaccaccaccacgacatccaaatgacacaatcaccctcgtcactctccgcgtcagtcggagaccgagtaaccataacctgcagatcaaccaaatccctcctacactcaaacggcatcacctacctctactggtaccaacaaaaacccggcaaagcccccaaactcctaatctaccaaatgtctaatcttgcctcaggcgtcccttcccgattcagctcctcaggatcaggtacggacttcaccctaacaatatcatcactacaacctgaagacttcgctacctactactgcgcacaaaacctcgaaatccccagaaccttcggccaaggtaccaaggtagaactaaagcgcgccacacccagtcacaactcacaccaagttccatctgccggcggacccaccgccaactcaggaactagcggttccgaagtacaacttgtccaaagcggcccaggcctagtacagccgggaggatccgtccgcatatcctgcgctgcaagcggatacaccttcacaaactacggcatgaactgggtaaagcaagcacccggcaaaggccttgaatggatgggctggatcaacacctacacaggagaatccacatacgccgactccttcaaaggccgattcacatttagcctcgacacatccgcctccgctgcatatctccaaatcaactcactccgtgccgaagacacagccgtctactactgcgctcgcttcgcaataaaaggggactactggggacaaggcacacttctcacagtcagctctgagttcggaggggcccctgagttccctaaaccctccacgcccccaggaagctcaggactcgaaggaggatcacttgccgccctcaccgcccaccaagcctgccaccttcccctcgaaacattcacacgacaccgccagcccagaggctgggaacaactagaacaatgcggctacccagtccaacgactcgtagccctctacctggctgcacgactctcctggaaccaagtagaccaagtaatacgcaacgcccttgcatcccctggttcaggaggggacctcggcgaagccattagagaacaaccagaacaagcccgcctcgcactcactctcgcagccgccgaatccgaaagattcgtcagacaaggcaccggcaacgacgaagccggtgcagcatcagccgacgtcgtatcactaacctgcccagtcgccgccggcgaatgcgccggtccagccgattccggcgacgcgttactagaaagaaactaccccaccggtgccgagttcctcggtgacggcggagacgtcagcttcagcacacgaggcacacaaaactggacagtcgaacggctcctccaagcacatagacaactagaagaacgcggctacgtcttcgtcggttaccacggcaccttcctcgaagcagcccagtcgatagtgttcggcggtgtccgagcaagatcccaggacctagacgccatctggcgcggcttctatatagccggcgaccccgcactcgcctacggatacgcacaagaccaagaaccagacgcccgtggccgaatccgaaacggcgcgctcctcagagtctacgtaccacgatcctccttacccggcttctaccgaacaggcctaacactagctgccccagaagccgcaggcgaagtagaaagactcataggtcacccacttcccctccgtctagacgctatcaccggtcccgaagaagaaggaggccgtttagaaacaatactaggctggcccctagccgaacgaaccgtcgtaatcccaagcgcaatacccactgacccccgcaacgtcggcggagacctagacccatccagcatccccgacaaagaacaagccatatcagccctccctgactacgccagccaacccggaaaaccgccccatcaccaccaccaccacaaagacgaactc

SEQ ID NO: 54137 - RNA, 762 nt, synthetic construct
  misc_feature 1..762: note = derived and/or modified sequence opt11 from Oreptacog_alfa_HeavyChain1
  source 1..762: mol_type = other RNA
atcgtcggtggaaaagtctgccccaaaggagaatgcccctggcaagtccttctcctagtcaacggcgcccaactctgcggcggcaccctaatcaacaccatctgggtcgtatccgccgcccactgcttcgacaaaatcaaaaactggcgcaacctcatcgcagtcctaggagaacacgacctctccgaacacgacggcgacgaacaatcccgccgagtagcccaagtcatcatcccctccacctacgtccccggcacaaccaaccacgacatagcactcctccgcctccaccaacccgtcaacctcacagaccacgtcgtcccactatgcctacccgaacgcaccttctccgaacgcacactagccttcgtccgattctcactcgtctccggctggggccaactcctcgaccgcggcgccaccgccctcgaactcatggtactaaacgtcccccgcctcatgacccaagactgcctacaacaatcccgcaaagtcggcgactcacccaacatcactgaatacatgttctgcgccggctactccgacggctcaaaagactcctgcaaaggagactccggaggcccccacgccacccactaccgcggaacctggtacctaaccggcatcgtctcctggggccaaggctgcgccaccgtaggccacttcggagtctacaccagagtctcccaatacatcgaatggctccaaaaattaatgcgctcagaaccccgccccggcgtcctcctccgagcccctttcccc

SEQ ID NO: 54138 - RNA, 456 nt, synthetic construct
  misc_feature 1..456: note = derived and/or modified sequence opt11 from Oreptacog_alfa_LightChain1
  source 1..456: mol_type = other RNA
gccaacgccttcctcgaagaactccgccaaggctcactagaacgcgaatgcaaagaagaacaatgcagcttcgaagaagcccgcgaaatcttcgaagacgaagaagaaaccaaactcttctggatctcctacagcgacggcgaccaatgcgcctccagcccctgccaaaacggcggctcctgcaaagaccaactccaaagctacatctgcttctgcctccccgccttcgaaggccgcaactgcgaaacccacaaagacgaccaactcatctgcgtcaacgaaaacggcggctgcgaacaatactgctccgaccacaacggcaccaaacgaagctgccgctgccacgaaggctacagcctactcgccgacggcgtctcatgcacccccaccgtcgaatacccctgcggcaaaatccccatactcgaaaaacgaaacgccagcaaaccccaaggccgc

SEQ ID NO: 54139 - RNA, 1353 nt, synthetic construct
  misc_feature 1..1353: note = derived and/or modified sequence opt11 from Orticumab_HeavyChain1
  source 1..1353: mol_type = other RNA
gaagttcaactcctcgaatccggcggcggcctcgtccaacccggaggctcactccgcctcagctgcgcagcctccggcttcaccttctcaaacgcctggatgtcttgggtcagacaagcccccggaaaaggccttgaatgggtctcgtccatctcagtcggtggccaccgcacctactacgccgactcagtcaaaggccgctcaacgatctcccgagacaacagcaaaaacactctttacctccaaatgaactccctacgagccgaagacacagccgtctactactgcgcccgtatccgcgtgggcccctcaggaggcgccttcgactactggggccaaggcacactcgtcacagtcagctccgcctccaccaaaggcccatccgtcttccccctcgcaccctcctccaaatccacatccggaggaacagccgccctcggctgcctagtcaaagactacttccccgaaccagtcacagtctcttggaactcaggcgcactaacctccggtgtccacaccttccccgccgttttacaatcctccggcctctactcactctcctccgtcgtcaccgtcccctcctcctccctcggcacccaaacatacatatgcaacgtcaaccacaaaccctctaacaccaaagtcgacaagaaagtagagcccaaatcctgcgacaaaacccacacttgccctccatgccccgcccccgaactcctaggcggtccttccgtcttcctgtttcctcccaaacccaaagacaccctaatgatatcccgcacccccgaagttacctgcgtcgtcgtagacgtctctcacgaagaccccgaagtaaaattcaactggtacgtcgacggcgttgaagtccacaacgcaaaaaccaaaccccgcgaagaacagtacaactccacctaccgcgttgtcagcgtactaacagtcctccaccaagactggctcaacggcaaagaatacaaatgcaaagtctccaacaaagcactccccgcccctatagagaaaacaatctcaaaagccaaaggacaacctcgagaaccccaggtctacactctcccaccatcgcgcgacgaacttaccaaaaaccaagtctccctcacttgcctcgtcaaaggcttctacccctccgacatcgccgtcgaatgggaatccaacggccaacccgagaacaactacaaaaccacccctcccgtcctcgactcagacggcagcttcttcctctactcaaagctcacagtagacaaatcgcgctggcaacaaggcaacgtattctcctgctccgtaatgcacgaagctctccacaaccactacacccaaaaatccctctccctcagccccggcaag

SEQ ID NO: 54140 - RNA, 648 nt, synthetic construct
  misc_feature 1..648: note = derived and/or modified sequence opt11 from Orticumab_LightChain1
  source 1..648: mol_type = other RNA
caatccgtcctaacccaaccaccatccgcctcaggaacacccggacaacgcgtaaccatctcctgctccggctcaaataccaacatcggcaaaaactacgtctcatggtaccaacaactccccggcaccgcccccaaactcctcatctacgccaactccaaccgaccctccggagtccccgaccgcttctccggctcaaaatccggcacctccgcctccttagccatctccggcctccgatccgaagacgaagccgactactactgcgcctcatgggacgcctccctcaacggctgggtcttcggcggcggcacaaaactcaccgtcctcggacaacccaaagccgcaccctccgtcaccctcttccccccctcctccgaagaactccaagccaacaaagccaccctagtctgcctcatctccgacttctaccccggagccgtcaccgtcgcctggaaagccgactcctcccccgtcaaagccggcgtcgaaaccaccaccccctccaaacaatccaacaacaaatacgccgcctcctcctacctctcccttacccccgaacaatggaaaagccaccgctcctacagctgccaagtcacccacgaaggctccacagtcgaaaaaaccgtcgcccccaccgaatgctcc

SEQ ID NO: 54141 - RNA, 1347 nt, synthetic construct
  misc_feature 1..1347: note = derived and/or modified sequence opt11 from Otelixizumab_HeavyChain1
  source 1..1347: mol_type = other RNA
gaagtccaactactcgaatccggtggaggcctcgtccaacccggcggctccctccgcctctcatgcgccgccagcggattcaccttctcctccttccccatggcatgggtacgccaagcacccggaaaaggcctggaatgggtcagcacaatctcaacatccggaggacgcacctactaccgcgactccgtcaaaggccgcttcaccatatcccgcgacaactccaagaacactctgtacctccaaatgaactcgctccgcgccgaagacacagccgtctattattgcgcaaaattccgccaatactccggaggcttcgactactggggacaaggaacactcgtcaccgtctcatccgcatccaccaaaggcccatccgtattcccactagccccctcctcaaaatctacctccggaggcaccgccgccctaggctgcctcgtcaaagactacttccccgaacccgtcaccgtctcctggaactcaggcgccctcacctccggcgtccacaccttcccagcagtactccaatcatcaggactctactccctctcctctgtcgtcaccgtcccctcatcatccctgggcacgcaaacatacatctgcaacgtaaaccacaaaccctccaacaccaaggtcgacaagaaagtcgaacccaaaagctgcgacaaaacacacacatgcccaccctgccccgcacccgagctactcggcggaccttcagtattcctcttccctcccaaacccaaagacacccttatgatctcccgaacccccgaagtaacctgcgtcgtcgttgacgtctcccacgaagacccagaggtaaaattcaactggtacgtcgacggcgtcgaagtccacaacgccaaaaccaaaccgcgagaagaacaatacgcaagcacctaccgcgtcgtctcagtcctcaccgtccttcaccaagactggctcaacggaaaagaatacaaatgcaaagtctcaaacaaagccctacctgcccccatagagaaaacaatctccaaagcaaaagggcaaccacgcgaaccgcaggtctacaccctcccaccctcaagagacgaactcaccaaaaaccaagtctccctaacctgcctcgtcaagggcttctacccctccgacatagccgtcgaatgggaatccaatggccaacccgagaataactacaaaactaccccacccgtactggactcagacggctccttcttcctttactcgaaattaacagtcgataaatcccgctggcaacagggcaacgttttctcatgctcagtaatgcacgaagcacttcacaaccactacacacaaaaatccctatctctctcccccggcaaa

SEQ ID NO: 54142 - RNA, 648 nt, synthetic construct
  misc_feature 1..648: note = derived and/or modified sequence opt11 from Otelixizumab_LightChain1
  source 1..648: mol_type = other RNA
gacatccaactcacccaacccaactccgtctccacctccctcggctccaccgtcaaactatcctgcacactctcatccggcaatatcgaaaacaactacgtccactggtaccaactctacgaaggacgctccccaaccaccatgatctacgacgacgacaaacgccccgacggcgtccccgaccgattctcaggctccatcgaccgctcctctaattccgccttcctcaccatacacaacgtcgccatcgaagacgaagccatctacttctgccactcctacgtctcctccttcaacgtcttcggcggcggcaccaaactcaccgtcctccgccaacccaaagcagccccctccgtcacactcttccccccctcctccgaagaactccaagccaacaaagccacactcgtctgcctcatctctgacttctaccccggcgccgtcaccgtcgcctggaaagctgactcttccccagtcaaagccggcgtcgaaactaccaccccctccaaacaatccaacaacaaatacgccgcctcctcatacctatccctcacccccgaacaatggaaatcccaccgctcctactcctgccaagtcacccacgaaggaagcaccgtcgaaaaaaccgtcgcccccaccgaatgctcc

SEQ ID NO: 54143 - RNA, 1449 nt, synthetic construct
  misc_feature 1..1449: note = derived and/or modified sequence opt11 from Otlertuzumab_HeavyChain1
  source 1..1449: mol_type = other RNA
gaagttcaactggtacaaagcggagccgaggtaaagaagccaggagaaagcctaaaaatcagctgcaaaggaagcggatactcattcacaggatataacatgaactgggtcagacaaatgcccggaaaagggctagaatggatgggcaatatcgacccctactacggcggcaccacatacaacagaaaattcaaagggcaagtcacaataagcgcagacaaaagcataagcacagcctacctccaatggtccagcctaaaagcctcagacaccgccatgtactactgcgcccgaagcgtcggacccttcgacagctggggccaaggcacacttgtgacagttagctcaggcggcggcggcagcggaggtgggggctcgggaggaggcggaagcggagggggaggatccggcggcggcgggtccgaaatcgtcctaacccaatcacccgctaccctgagcctcagcccgggagagcgcgccacactgtcctgccgagcaagcgaaaacgtatactcatacctagcctggtaccaacaaaaaccaggccaagcacccagactcctaatctatttcgccaaaacactcgcagaaggcatccccgcaagattctccggctcgggctcaggcacggacttcaccctcaccataagctccctagagcccgaagacttcgccgtgtactactgccaacaccacagcgacaacccgtggaccttcggccaaggcaccaaagtcgaaatcaaaggagaccaagaacccaaaagctctgacaaaacccacacctccccaccctgccccgccccagaactactcggaggcccctccgtattcctcttcccacccaaacccaaagacacattaatgatctccagaacccccgaagtcacatgcgtagtcgtagacgtatcacatgaagaccccgaggtcaaattcaactggtacgtcgacggcgtagaagtacacaacgcaaaaaccaaacccagggaggaacaatacaactcaacctaccgtgtcgtctcagtactaactgtgctccatcaagactggctaaacggcaaggaatacaaatgcaaagtctcaaataaagccctccccgcccccatcgaaaagaccataagcaaggccaaaggccaacccagggaacctcaagtctacacactcccaccatcccgcgacgagctaaccaagaaccaagtctcactcacatgccttgtcaaaggattctaccccagcgacatagcagtcgagtgggaatccaacggccaacctgaaaacaattacaaaacaacacccccagtcctcgactccgacggcagcttcttcctgtactcaaaactaacagtagacaaaagccgatggcaacaaggaaacgtattctcgtgctcggtcatgcacgaagcactacacaaccactacacacagaaaagcctctcactatcccccggaaaa

SEQ ID NO: 54144 - RNA, 1347 nt, synthetic construct
  misc_feature 1..1347: note = derived and/or modified sequence opt11 from Oxelumab_HeavyChain1
  source 1..1347: mol_type = other RNA
gaagtccagctactcgaatccggcggcggcctcgtacaacccggcggctccctccgcttatcctgtgccgcctccggcttcaccttcaactcatacgctatgtcttgggtccgccaagccccaggcaaaggactagaatgggtctccatcatctccggatcaggaggtttcacctactacgcagactccgtaaaaggacgcttcacaatatcacgagacaactcccgaacaaccctttacctacaaatgaactccctacgcgccgaagataccgccgtatactactgcgccaaagaccgcctggtcgcccccggtacattcgactactggggacaaggagcactcgtcacggtcagttccgcatccaccaaaggcccctccgtcttccccctcgcaccatcctccaaatccaccagcggtggaaccgcagcactcggatgcctcgtaaaagactacttccccgaacccgtaacagtctcctggaactccggcgcccttacatcaggcgtccacaccttccccgccgtcctccaatcctcaggactgtactccctcagcagcgtcgtcaccgtcccctcttcctcccttggcacccaaacctacatttgcaatgtcaaccacaagccctcaaacaccaaagtcgacaagaaagtcgaacccaaatcctgcgacaaaacacacacatgcccaccctgccccgcccccgaactacttggcggccccagcgtcttcctattccctcccaaacccaaagacaccctcatgatctcacgaacccccgaagtcacttgcgtagtcgtcgacgtctctcacgaagaccccgaagtaaaattcaactggtatgtcgacggcgtcgaagtacacaacgccaaaaccaaaccccgagaagaacaatataacagcacctaccgcgtcgtcagcgtccttaccgtcctacaccaagactggctcaacggcaaagaatacaaatgcaaagtctccaacaaagcactccccgccccaatcgagaaaaccatatccaaagctaaaggccaaccacgcgaaccccaagtatacaccctaccgccctcccgcgacgaacttaccaaaaaccaagtatcactcacatgcctagtcaaaggcttctacccctcagacatcgctgtcgaatgggaatccaacggccaacccgaaaacaactacaaaactacacccccagtcctcgactccgacggatccttcttcctctactcaaaactcaccgtagacaaatcacgctggcaacaaggaaacgtcttctcctgcagcgtcatgcacgaagcactccacaaccactacacgcaaaaatccctctccctctcaccaggc

SEQ ID NO: 54145 - RNA, 642 nt, synthetic construct
  misc_feature 1..642: note = derived and/or modified sequence opt11 from Oxelumab_LightChain1
  source 1..642: mol_type = other RNA
gacatccaaatgacccaatccccctcctccctctccgcctccgtcggcgaccgcgttaccataacctgccgcgcatcccaaggcatctcctcctggctagcctggtaccaacaaaaacccgaaaaagcccccaaatccctcatctacgccgcctcctccctccaatccggcgtcccatcccgattctctggctccggatccggcacagacttcaccctcaccatctcctccctccaacccgaagacttcgccacctactactgccaacaatacaactcctacccctacacattcggccaaggcaccaaactcgaaatcaaacgaacagtcgccgccccatccgtcttcatcttcccaccctccgacgaacaactcaaatccggcaccgcctccgtcgtatgcctcctcaacaacttctacccccgcgaagccaaagtccaatggaaagtcgacaacgcccttcaatctggcaactcccaagaaagcgtcaccgaacaagactccaaagactcaacctactccctctcttcaaccctcaccctatccaaagccgactacgaaaaacacaaagtatacgcctgcgaagtcacccaccaaggcctcagctcacccgtaaccaaatccttcaaccgcggcgaatgc

SEQ ID NO: 54146 - RNA, 1329 nt, synthetic construct
  misc_feature 1..1329: note = derived and/or modified sequence opt11 from Ozanezumab_HeavyChain1
  source 1..1329: mol_type = other RNA
caagtacaactcgtccaatcaggcgccgaagtaaagaaacccggcgcctccgtcaaagtctcctgcaaagcctctggctacacatttacctcctattggatgcactgggtccgacaagcccccggccaaggactagaatggatcggcaacatcaacccctccaacggaggcactaactacaacgaaaaattcaaatccaaagcgacaatgacacgagacacatcaaccagcaccgcctacatggaactctcctcactccggtccgaagacaccgccgtctactactgcgaactcatgcaggggtactggggccaaggcaccttagtcactgtctcatccgcctccacgaaaggccccagcgttttcccgctcgcaccatcgtccaaatcaacctcaggagggacagccgccctcggctgcctcgtcaaagactacttccccgaacccgtaaccgtctcctggaacagcggtgcactcacctcaggcgttcacaccttccccgcagtcctccaaagctcgggcctctacagcctctcctccgtcgttacagtcccctcatcctccctaggcacccaaacctacatctgcaacgtaaaccacaaaccatcaaacaccaaagtcgacaagaaagtcgaaccaaaaagctgcgacaaaactcacacatgcccaccctgccccgcgcccgaactcgccggtgcaccctccgtcttcctattcccacccaaacccaaagacaccctaatgatatcccgcacccccgaagtaacatgcgtcgtcgtcgacgtaagccacgaagaccccgaagtcaaattcaactggtacgtagacggcgtcgaagtccacaatgccaaaaccaaaccccgcgaagaacaatacaactctacctaccgcgtcgtctccgtactcaccgtcctccaccaagactggctcaacggcaaagaatacaaatgcaaagtatccaacaaagcccttcccgcaccaatcgagaaaaccatcagcaaagctaaaggccaaccacgcgaaccccaagtctacacccttccaccctctcgcgacgaactcaccaaaaaccaagtcagcctgacctgcctcgtcaaaggcttctacccctcagacatcgccgttgaatgggaatccaacggccagcccgaaaacaactacaaaacaaccccgccagtcctggactccgacggctcattcttcctctactccaaactaaccgtcgacaaatcccgctggcaacaaggcaacgtcttctcatgctccgtcatgcacgaagcccttcacaaccactacacccaaaaatccctcagcctctccccaggaaaa

SEQ ID NO: 54147 - RNA, 657 nt, synthetic construct
  misc_feature 1..657: note = derived and/or modified sequence opt11 from Ozanezumab_LightChain1
  source 1..657: mol_type = other RNA
gacatcgtcatgacccaaagccccctatccaacccagtcaccctcggccaaccagtctcaatctcctgccgatcctccaaatccctactctacaaagacggcaaaacctacctcaactggttcctccaacgccccggacaatcaccccaactcttaatctacctcatgtccacccgcgcatccggcgtcccagaccgcttctccggcggcggctcaggcacggacttcacactaaaaatctcccgcgtcgaagccgaagacgtcggcgtctactactgccaacaactcgtcgaataccccctcaccttcggccaaggcaccaaactcgaaatcaaacgcacagtcgccgcccccagcgtcttcatattcccaccctccgacgaacaactcaaatcaggcaccgcctccgtcgtctgcctactcaacaacttctacccccgagaagccaaagtccaatggaaagtcgacaacgcactacaatccggcaactcacaagaatcagtcaccgaacaagactccaaagactccacctactccctctcctccaccctaacactctccaaagccgactacgaaaaacacaaagtatacgcctgcgaagtaacccaccaaggcctctcatcacccgtaaccaaatccttcaaccgtggcgaatgc

SEQ ID NO: 54148 - RNA, 1089 nt, synthetic construct
  misc_feature 1..1089: note = derived and/or modified sequence opt11 from Ozoralizumab_HeavyChain1
  source 1..1089: mol_type = other RNA
gaggtccagctcgtggagtcgggagggggattagtccagcccgggggatcattaaggctatcatgcgcggcatcaggatttacatttagtgactactggatgtattgggtgcgacaggccccgggaaagggattagaatgggtctcagaaataaacacgaacgggctaataaccaagtacccggactcggtaaagggaaggttcacaatctcacgagataatgcgaaaaacaccctgtacttacagatgaactcactcaggcccgaggacacggcagtgtactactgcgcgcgctcaccctcgggattcaacagaggccagggcacacttgtgactgtgagctcgggcgggggcgggagcgggggagggagcgaggtccagctcgtggaaagcggcggaggcttggtccagcccgggaactcgctacggctatcatgcgcggcctcaggctttacctttagctcgttcgggatgtcgtgggtgcgacaagcgccgggcaagggcctagaatgggtctcgagcataagcggaagcgggagcgacaccttgtacgcggacagtgtaaagggcaggttcacgatcagtcgcgataacgcgaaaacgaccctgtacttgcaaatgaactcgctcagacccgaagacacggcagtgtactactgcacgattgggggatcactatcgagaagcagccaaggaacgcttgtgacagtgagctcgggtggaggcgggagcggaggaggaagcgaggtccagctagtggaatcgggcggaggcctggtccaaccagggggctcgctcaggctctcgtgtgcggcctcgggctttacatttagcgattactggatgtactgggtgcgccaggccccgggtaagggattggagtgggtatcggaaattaacacaaacggactaataaccaagtacccagactcggtaaagggcaggttcacgatctcccgagataatgcgaaaaataccctgtacttgcaaatgaactcactcaggcccgaggacacggccgtatactattgcgcgcgatcgccctccggctttaacaggggccaaggcacgctcgtgacagtgagctcg

SEQ ID NO: 54149 - RNA, 1350 nt, synthetic construct
  misc_feature 1..1350: note = derived and/or modified sequence opt11 from Palivizumab_HeavyChain
  source 1..1350: mol_type = other RNA
caagtcacactccgcgaatcaggcccagccctcgttaaaccaacccaaaccctcaccctaacctgcacattcagcggattctcactatccacatctggaatgtccgtaggctggatccgccaaccacccggcaaagccctagaatggctcgccgacatctggtgggacgacaagaaagactacaacccctccctcaagtccagactcactatctcaaaagacacctccaaaaaccaagtcgtcctaaaagtaaccaacatggaccccgccgataccgccacatactactgcgccagaagcatgataaccaactggtacttcgacgtctggggcgcaggcaccacagtaaccgtatcatccgcctccaccaaaggcccctccgtcttccccctggctccatcaagcaaatccacaagcgggggaacggccgcattaggctgcctcgtaaaagactatttcccagaacctgtcaccgtcagctggaactcaggcgccctaacatccggtgtccacacattccccgccgtccttcaatcctctggtctatactcactctcaagcgtggttacagtcccctcaagctccctaggaacccaaacctacatctgcaacgttaaccacaagccctcaaacacaaaagtcgacaaacgagtggaacccaaaagctgcgacaaaacccacacatgtcccccatgccccgcacccgaactcctcggcggcccatcagtattccttttcccacccaaaccaaaagacacactcatgatcagccgaaccccagaagtcacatgcgtcgtcgtcgatgtctcccacgaagaccccgaagtcaaattcaactggtacgtagacggcgtcgaagttcataacgcaaaaactaaaccccgcgaagaacaatacaacagcacataccgcgtcgtctccgtcctaacagtcttgcatcaagactggctcaacggaaaagaatacaaatgcaaagtatccaacaaagctctccccgccccaatcgagaaaaccatctccaaagccaaaggacaaccccgagaaccccaagtctacaccctgcccccatcccgagaagaaatgaccaaaaaccaagtctccctaacctgcctcgtcaaaggcttctacccctcagacatcgccgtcgaatgggaatcaaacgggcaacccgaaaacaactacaaaacaaccccacccgtactagacagcgacggatccttcttcctatactcaaaactgaccgtagacaagtcacgctggcaacaaggcaacgtattctcctgctcagtaatgcacgaagccctacacaaccactacacgcaaaaatccctctccctctcccccggaaaa

SEQ ID NO: 54150 - RNA, 639 nt, synthetic construct
  misc_feature 1..639: note = derived and/or modified sequence opt11 from Palivizumab_LightChain
  source 1..639: mol_type = other RNA
gacatccaaatgacccaatccccctccaccctatccgcctccgtcggcgaccgcgtcacaataacctgcaaatgccaactctcagtaggctacatgcactggtaccaacaaaaacccggcaaagcccccaaacttctaatctacgacacctccaaactcgcctccggcgtcccctcacgtttctccggctccggctccggcaccgaattcaccctcaccatctcctccctccaacccgacgacttcgccacatactattgcttccaaggctccggctaccccttcaccttcggcggcggcaccaaactcgaaatcaaacgcaccgtcgcagccccatccgtattcatcttccccccctccgacgaacaactcaaatccggcaccgcctccgtcgtctgcctcctcaacaacttctacccccgcgaagccaaagtccaatggaaagtcgacaacgccctccaatccggcaactcacaagaatctgtaaccgaacaagactcaaaagactccacctactcactctcctccactctcaccctctccaaagccgactacgaaaaacacaaagtctacgcatgcgaagtcacccaccaaggcctctcctcccccgtcaccaaatccttcaaccgaggcgaatgc

SEQ ID NO: 54151 - RNA, 360 nt, synthetic construct
  misc_feature 1..360: note = derived and/or modified sequence opt11 from Palivizumab_VH-Region
  source 1..360: mol_type = other RNA
caagtcaccctccgcgaatccggccccgccctcgtcaaacccacccaaaccctcaccctcacctgcaccttctccggcttctccctctccacctccggcatgtccgtcggctggatccgccaaccccccggcaaagccctcgaatggctcgccgacatctggtgggacgacaaaaaagactacaacccctccctcaaatcccgcctcaccatctccaaagacacctccaaaaaccaagtcgtcctcaaagtcaccaacatggaccccgccgacaccgcaacatactactgcgcccgctccatgatcaccaactggtacttcgacgtctggggcgccggcaccaccgtcaccgtctcctcc

SEQ ID NO: 54152 - RNA, 1347 nt, synthetic construct
  misc_feature 1..1347: note = derived and/or modified sequence opt11 from Pamrevlumab_HeavyChain1
  source 1..1347: mol_type = other RNA
gaaggacaactcgtccaatcaggaggcggcctcgtccacccaggcggctctctccgcctctcctgcgcaggatccggcttcaccttctcctcctacggaatgcactgggtcagacaagccccgggaaaaggactagagtgggtcagcggcatcggcacaggcggcggcacatactcaacagactccgtcaaaggccgcttcaccatctcacgcgacaacgccaaaaactcactatacctgcaaatgaactcactccgcgcagaagacatggccgtctactactgcgcccgcggcgattactacggatcaggttccttcttcgattgttggggccaaggcaccctcgtcacagtctcatctgcctccacaaaaggcccctcagtcttcccactcgccccctcctccaaatccacctccggaggcaccgcagccctaggctgcttagtcaaagactacttcccagaacccgtcacagtatcatggaactccggcgcactcacgagcggcgtacacaccttccccgccgtcctccaatcctcaggactatactcactctcatcggtcgtcaccgtcccatcctcatctctcggtacccaaacctacatctgcaacgtaaaccacaaaccctcaaacactaaagtcgacaaacgagtcgaacccaaatcctgcgacaaaacacacacatgtcccccatgccccgcccccgaactcctaggaggtcccagcgtcttcctcttcccgcccaaacccaaagacacactaatgatatcccgcacccccgaagtcacatgcgtagtcgtcgacgtctcccacgaagacccagaagtcaaattcaactggtacgtcgacggcgtcgaagtccacaacgccaaaaccaagccacgcgaagaacaatacaacagcacctaccgcgtcgtgagcgtcctcaccgtcctccaccaagactggctaaatggtaaagaatacaaatgcaaagtatccaacaaagccctgcccgccccaattgagaaaaccatctccaaagccaaaggccagccccgcgaaccccaagtctacaccctacccccatcccgagaagagatgaccaaaaaccaagtctccctaacctgcctagtcaaaggattctacccctcagacatcgccgtcgaatgggaatcaaacggacaacctgaaaacaactacaaaaccacaccccctgtcctagactccgacggatccttcttcctctactccaaactcacagtagacaaatcccgatggcaacaaggcaacgtcttctcctgctcagtcatgcacgaggcactccacaaccactacacccaaaaatctctttccctatcccccggc

SEQ ID NO: 54153 - RNA, 642 nt, synthetic construct
  misc_feature 1..642: note = derived and/or modified sequence opt11 from Pamrevlumab_LightChain1
  source 1..642: mol_type = other RNA
gacatccaaatgacacaatccccctcttccctctccgcctccgtcggcgaccgagtcacaataacctgccgcgcctcccaaggcatctcatcatggctcgcctggtaccaacaaaaacctgaaaaagcccccaaatccctaatctacgccgcctcctccctccaatccggagtcccctcccgcttctccggatccggctccggaaccgacttcacactcaccatctcctccctccaacccgaagacttcgccacctactactgccaacaatacaactcatacccacccacattcggccaaggcaccaaactcgaaatcaaacgcaccgtcgccgccccctcagtcttcatcttcccaccctcagacgaacaactcaaatccggcacagcctctgtcgtctgcctcctcaacaacttctacccccgcgaagccaaagtccaatggaaagtcgacaacgccctacaatccggcaactctcaagaatccgtaaccgaacaagactccaaagactccacctactccctctcctccaccctcaccttatccaaagccgactacgaaaaacacaaagtctacgcctgcgaagtcacccaccaaggactctcctcacccgtcaccaaatccttcaaccgcggcgaatgc

SEQ ID NO: 54154 - RNA, 1305 nt, synthetic construct
  misc_feature 1..1305: note = derived and/or modified sequence opt11 from Panitumumab_HeavyChain1
  source 1..1305: mol_type = other RNA
caggtccaactacaagaatccggccccggcctagtaaaaccctcagaaaccctatccctaacctgcaccgtttctggcggctccgtcagcagcggcgactactactggacctggatccgccaatcccccggcaagggcctcgaatggatcggacacatctactactcaggaaacaccaactacaacccctccctcaaatccagactcacaatatccatcgacacctccaaaactcagttctcactcaagctctcttccgtcactgccgcagacaccgccatatactactgcgtccgcgaccgcgtcaccggagccttcgacatctggggccaaggcaccatggtcaccgtatcaagtgcatccacaaaaggcccctcagtcttccccctcgcaccctgctctcgatccacatctgaatcaacagcagccctaggctgcctcgtcaaagactacttccccgaacccgtcaccgtctcttggaactccggagcactcaccagcggcgtccacacattcccagcagtcctccaatcctccggcctctactcactctcctcagtcgtcaccgtcccctcctctaacttcggcacccagacatacacatgcaacgtcgatcataaaccttccaacacaaaggtcgacgaacgaaaatgctgcgtcgaatgcccagcaggcccatccgtcttcctcttcccacccaaacccaaagacacactcatgatctcccgtacccccgaagtaacatgcgtcgtcgtcgacgtcagccacgaagaccccgaagtccaattcaactggtacgtcgacggagtagaagtccacaacgccaaaaccaaaccccgcgaagaacaatttaactccacattccgcgttgtctcggttctcacagtcgtccaccaagactggctcaacggcaaagaatacaaatgtaaagtctccaacaaaggtctccccgcacccatcgagaaaaccatctccaagaccaagggacaaccccgtgaaccccaagtatacaccctaccaccctcccgagaagaaatgaccaaaaaccaagtctcactgacctgcctcgtaaaaggcttttacccctccgacatagctgtagagtgggaatccaacggccaacccgaaaataactacaaaaccaccccacccatgctcgactcagacggatccttcttcctctacagcaaactgactgtcgacaaatctcgctggcaacaaggaaacgttttctcatgctccgtcatgcacgaagcccttcacaaccactacacacaaaaatccctctcactctcccccggtaaa

SEQ ID NO: 54155 - RNA, 642 nt, synthetic construct
  misc_feature 1..642: note = derived and/or modified sequence opt11 from Panitumumab_LightChain1
  source 1..642: mol_type = other RNA
gacatccaaatgacccaatccccctcctccctcagcgcatccgtcggcgaccgcgtcaccataacatgccaagcctcccaagacatctccaactacctcaactggtaccaacaaaaacccggcaaagcccccaaacttctcatctatgacgcatccaacctcgaaaccggcgtcccctcccgattctccggctccggctcaggcaccgacttcactttcaccatctcctcactccaacccgaagacatcgccacctacttctgccaacacttcgaccacctccccctcgcattcggcggcggcaccaaagtcgaaatcaaacgcaccgtcgccgccccctccgtcttcatcttccccccctctgacgaacaactaaaatcaggcaccgcctccgtcgtctgcctcctcaacaacttctacccccgcgaagccaaagtccaatggaaagtcgacaacgccctccaatccggcaactcccaagaatccgtaaccgaacaagactcaaaagactccacctattccctatcctccaccctcacactctccaaagccgactacgaaaaacacaaagtctacgcctgcgaagtcacccaccaaggcctctcctcccccgtcaccaaatcattcaaccgcggcgaatgc

SEQ ID NO: 54156 - RNA, 1326 nt, synthetic construct
  misc_feature 1..1326: note = derived and/or modified sequence opt11 from Pankoab_HeavyChain1
  source 1..1326: mol_type = other RNA
gaggtacaactcgtagaatcaggcggcggcctcgtccaacccggcggcagccgcctctcctgcgtagcatccggcttcccctttagcaactactggaactgggtcagacaagcccccggcaaaggcctcgaatgggtaggggaaatccgcctcaaaagcaacaactacaccactcactacgccgaatcggtcaaaggccgtttcaccatctcccgagacgactccaaaaactccctctacctccaaaactccctcaaaacagaagacacagcagtatactactgcacccgccactactacttcgactactggggacaaggcaccctcgtgacagtatcctcagcctccaccaaaggcccctcagtattcccattagccccatcttccaaatccacctccggaggcacagccgccctaggctgcctcgtaaaagactacttccccgaacccgttaccgtctcctggaactccggcgcccttacctccggtgtccacaccttccccgcagtcctccaatccagcggtctttactcgctctcctcggtcgtcactgtcccctcatcctcactaggcacccaaacctacatctgcaatgtcaaccacaaaccctccaacaccaaggtcgacaagaaagtcgaaccaaaatcctgcgacaaaacccatacctgccctccctgccccgccccagaactccttggtggcccctccgtcttcctctttcccccaaaacccaaagacaccctcatctcccgaacaccagaagtcacatgcgtcgttgttgacgtctcccacgaagaccccgaagtaaaattcaactggtacgtagacggcgtcgaagtccacaacgccaaaaccaaaccccgcgaagaacaatacaactccacctaccgtgtagtctcagtactcaccgtcctccaccaagactggctcaacggcaaagaatacaaatgcaaagtctccaacaaagccctcccagcacccatcgagaaaactatatcaaaagccaaaggacaaccccgtgaaccacaagtatacacacttccaccctcccgcgacgaactcaccaaaaaccaagtctcattaacctgcctagtcaaaggcttctaccccagcgacatcgcagtcgaatgggaatccaacggccaacccgaaaacaactacaaaaccaccccacccgtcctcgactccgacggatccttcttcctctactccaaactcaccgtcgacaaatcccgctggcaacaaggcaacgtcttctcctgctcagtacacgaaggtctacacaatcactacacacaaaagagcctgtccctcagccccggcaaa

SEQ ID NO: 54157 - RNA, 651 nt, synthetic construct
  misc_feature 1..651: note = derived and/or modified sequence opt11 from Pankoab_LightChain1
  source 1..651: mol_type = other RNA
gacatcgtcacacaatcacccctctccaaccccgtcacacccggagaacccgcatccatctcctgccgctcctccaaatccctcctccactccaacggcatcacctacttcttctggtacctccaaaaacccggccaatcaccccaacttctcatctaccaaagcaacctagcatccggcgtccccgaccgattctcaggctccggctcaggaaccgacttcacactccgcatctcccgagtcgaagccgaagacgtcggagtctactactgcgcccaaaacctcgaactcccacccaccttcggccaaggcaccaaagtcgaaatcaaacgcaccgtcgcagccccctccgtattcatcttcccaccctccgacgaacaactcaaatccggcaccgcctcagtcgtctgcctactcaacaacttctacccccgcgaagccaaagtccaatggaaagtcgacaacgcactccaatccggcaactcccaagaatccgtaaccgaacaagactccaaagactccacctactccctctcctccaccctgaccctctccaaagcagactacgagaaacacaaagtctacgcatgcgaagtcacacaccaaggcctatcctcccccgtcaccaaatccttcaaccgcggcgaatgc

SEQ ID NO: 54158 - RNA, 651 nt, synthetic construct
  misc_feature 1..651: note = derived and/or modified sequence opt11 from Pankoab_LightChain2
  source 1..651: mol_type = other RNA
gacatcgtcacccaaagccccctcagcaaccccgtgacccccggagaacccgcctccatctcctgccgctcatccaaatccctcctccactccaacggcatcacctacttcttctggtacctccaaaaaccaggccaaagcccccaactcctcatataccaatccaatctcgcctccggcgtccccgaccgattctccggctccggctcaggcaccgacttcaccctccgcatctcccgagtagaagccgaagacgtcggcgtctactactgcgctggcaacctcgaactaccccctaccttcggccaaggcacaaaagtcgaaatcaaacgcaccgtcgctgccccatccgtcttcatcttccctccctcagacgaacaactcaaatccggcaccgcctcagtcgtctgcctactcaacaacttctacccccgcgaagccaaagtccaatggaaagtcgacaacgccctccagtccggcaactcccaagaatccgtcaccgaacaagactccaaagactccacctactccctctcctccaccctcaccctatccaaagccgactacgaaaaacacaaagtatacgcctgcgaagtaacccaccaaggcctatcctcacccgtcaccaaatccttcaaccgaggagaatgc

SEQ ID NO: 54159 - RNA, 351 nt, synthetic construct
  misc_feature 1..351: note = derived and/or modified sequence opt11 from PankoMab_HeavyChain_VDJ-Region
  source 1..351: mol_type = other RNA
gaagtgaaactggtcgagagcgggggcgggctcgtgcaaccgggcgggagcatgaaattgagctgtgtcgcgagcgggttcacgttctcgaactactggatgaactgggtcaggcaatcgcccgagaaagggctcgagtgggtggccgagatcaggctcaagagcaataactataccacgcactatgccgagagcgtgaaagggcgctttaccataagcagggacgatagcaagagctcggtctcgctccagatgaataacctgcgcgtggaagataccgggatctattactgtaccaggcactattactttgactattgggggcaagggaccacgctcacggtctcgagc

SEQ ID NO: 54160 - RNA, 339 nt, synthetic construct
  misc_feature 1..339: note = derived and/or modified sequence opt11 from PankoMab_LightChain_VJ-Region
  source 1..339: mol_type = other RNA
gacatcgtcatgacccaagccgccttctccaaccccgtcaccctcggcacctccgcctccatctcctgccgctcctccaaatccctactccactccaacggcatcacctacttcttctggtacctccaaaaacccggcctctccccccaactcctcatctaccaaatgtcaaacctcgcctccggcgtccccgaccgcttctcctcctccggctccggcaccgacttcaccctccgcatctcccgcgtcgaagccgaagacgtcggcgtctactactgcgcccaaaacctcgaactcccccccaccttcggcggcggcaccaaactcgaaatcaaacgc

SEQ ID NO: 54161 - RNA, 1707 nt, synthetic construct
  misc_feature 1..1707: note = derived and/or modified sequence opt11 from Panobacumab_HeavyChain1
  source 1..1707: mol_type = other RNA
gaggaacaagtcgtcgaatccggcggcggattcgtccaaccaggaggctcacttagattatcctgcgcagcatcaggcttcaccttctccccatactggatgcactgggtacgccaagcacccggcaaaggcctcgtctgggtatcgagaatcaacagcgacgggtccacatattacgccgactccgtaaaaggccgattcacaatctcacgcgacaacgcccgcaacacactctacctccaaatgaactctctccgcgccgaagataccgccgtatactactgcgcccgcgaccgctactacggacccgaaatgtggggccaaggcaccatggtaaccgtatcatccggatcagcctccgcacccaccctattccccctagtctcatgcgagaacagcccatccgatacctcctccgtagccgtcggctgcctcgcacaagacttcctccccgactcaatcaccttctcatggaaatacaaaaacaactccgacatctcatccacccgtggattcccctcagtcctacgcggcggcaaatacgccgccacctcacaagtactactgccctcaaaagatgtcatgcaaggcacagatgaacatgtagtttgcaaagtccaacaccccaacggcaacaaagagaaaaacgttccccttcccgtcatagcagaactcccaccaaaggtcagcgtcttcgtaccaccgcgggacggcttcttcggaaaccctagaaaatccaaactcatatgccaagccaccggcttctcaccccgccaaatccaagtatcctggctacgcgaaggaaaacaggtcggatccggcgtcaccacagaccaagtccaagcagaagcaaaagaatccggccccacaacctacaaggtcacctccacactcacgatcaaagaatccgactggttatcccaatccatgttcacttgccgcgtcgaccaccgcggactcacattccagcagaacgcctcgtccatgtgcgtcccagatcaagacaccgcaatccgcgttttcgcaataccaccctcattcgcctcaatcttcctcacaaaatcgacaaaattaacctgcctcgtcactgacctcaccacatacgacagcgtaaccatatcatggacacgacaaaacggcgaagcagtcaagacccacaccaacatctcggaatcccaccccaacgcaacattctcagccgtgggcgaggcttccatctgcgaagacgactggaacagcggagaacgcttcacatgcaccgtaacccacaccgacctcccctcacccctcaaacaaaccatttcccgccctaaaggcgtcgccctccatcgccccgacgtatacctgctcccacccgccagagaacaacttaatctacgcgaatccgccacgataacctgcctcgtaaccggcttctcaccagcagatgtcttcgtacagtggatgcaaagaggacaaccactatcccccgaaaaatacgtaacatccgcaccaatgcccgaaccccaggcccccggccgctacttcgcccactcaatcctcaccgtctcagaagaagaatggaacactggcgaaacctatacatgcgtcgtcgctcacgaagccctacccaaccgcgtcaccgaacgcaccgtagacaaatccacaggaaaacccaccctgtacaacgtatccctggtcatgtcagacaccgccggaacctgctac

SEQ ID NO: 54162 - RNA, 657 nt, synthetic construct
  misc_feature 1..657: note = derived and/or modified sequence opt11 from Panobacumab_LightChain1
  source 1..657: mol_type = other RNA
gacgtcgtcatgacccaatcacccctctcactccccgtcaccctcggccaaccggcctccatctcctgccgatcatcacaatccctcgtctactccgacggaaacacatacctcaactggttccaacaacgccccggccaatcccctcgccgcctcatctacaaagtctccaaccgcgactccggcgtccccgaccgcttctccggctccggctcaggcaccgacttcaccctcaaaatctcccgagtagaagccgaagacgtcggcgtctactactgcatgcaaggcacccactggcccctcacattcggcggcggcaccaaagtcgaaatcaaacgcacagtcgccgccccctccgtcttcatcttcccaccctccgacgaacaactcaaatcaggcaccgcttccgtcgtctgcctcctcaacaacttctacccccgcgaagccaaagtccaatggaaagtcgacaacgccctccaatccggcaactcccaagaatccgtaaccgaacaagactccaaagactccacctacagcctatcctccaccctcacactctccaaagccgactacgaaaaacacaaagtctacgcctgcgaagtcacccaccaaggactctcatcccccgtcaccaagtctttcaaccgcggcgaatgc

SEQ ID NO: 54163 - RNA, 414 nt, synthetic construct
  misc_feature 1..414: note = derived and/or modified sequence opt11 from Panobacumab_LightChain2
  source 1..414: mol_type = other RNA
ggcgacgacgaagccaccatcctcgccgacaacaaatgcatgtgcacccgagtaacctcccgcatcatcccctccacagaagaccccaacgaagacatcgtcgaacgcaacatccgcatcgtcgtccccctaaacaaccgcgaaaacatctccgaccccaccagccccctccgccgcaacttcgtctaccacctctccgacgtatgcaaaaaatgcgaccccgtcgaagtcgaactcgaagaccaagtcgtcaccgccacccaatccaacatctgcaacgaagacgacggcgtccccgaaacctgctacatgtacgaccgcaacaaatgctacaccaccatggtcccactccgataccacggcgaaaccaaaatggtccaagccgccctaacccccgactcctgctaccccgac

SEQ ID NO: 54164 - RNA, 1359 nt, synthetic construct
  misc_feature 1..1359: note = derived and/or modified sequence opt11 from Parsatuzumab_HeavyChain1
  source 1..1359: mol_type = other RNA
gaagtccaactcgtagaatccggaggcggcctcgtccaacccggaggctccctccgcctctcctgcgcagcatcaggctacacatttatagactactacatgaactgggtccgacaggcccccggcaaaggcctagaatgggtcggcgatatcaacctcgacaactcaggaacacattacaatcaaaaattcaaagggcgcttcaccatatcccgcgacaaaagcaaaaacaccgcctacctccaaatgaactccctccgggcggaagacaccgcagtatactactgcgcccgcgaaggagtctaccatgactacgacgactatgccatggactactggggccagggcactcttgtgaccgtatcctctgcatccacaaaaggcccctcagtcttccccctagccccctcatccaaatccacctccggcggcaccgctgccctcggctgcctagtcaaagactacttccccgaacccgtcaccgtcagctggaactcaggcgccctaacctccggcgtacacacttttcccgcagtcctccaatcctccggcctatactcactgtcctccgtcgtcaccgtaccctcctcatccctcggcacacaaacatacatctgtaatgtcaatcacaaaccatcaaacaccaaagtagacaagaaagtcgaaccaaaatcctgcgacaaaacccacacatgcccaccatgcccagccccagaactcctcggaggcccgtccgtattcctctttcccccaaaacctaaagacacccttatgatctcccgtacccccgaagtaacctgcgtcgtcgtcgacgtctcacacgaagaccccgaagtcaaattcaactggtacgtagacggcgtcgaagtccataacgccaaaaccaaaccccgcgaagaacaatacaactccacctaccgcgtcgtctccgtcctcaccgtcctgcaccaagactggctaaacggcaaggaatacaaatgcaaggtctccaacaaagccctccccgcccccatcgagaaaaccatctcaaaagccaaaggccaaccacgagaaccacaggtctacaccctgccaccctcacgcgaagaaatgaccaaaaaccaagtatccttaacctgcctcgtcaaaggattctacccctccgacatcgccgtagaatgggaatcaaacggccaacccgaaaacaactacaaaaccacccctcccgtcctcgacagcgacggctccttcttcctctactcaaaactcacggtagacaaatcccggtggcaacaaggcaacgtattctcctgcagcgtcatgcacgaagcactccacaaccactacacccaaaaatcactatctctatcccccggaaag

SEQ ID NO: 54165 - RNA, 657 nt, synthetic construct
  misc_feature 1..657: note = derived and/or modified sequence opt11 from Parsatuzumab_LightChain1
  source 1..657: mol_type = other RNA
gacatccaaatgacccaatccccctcctcactatcagcctccgtcggcgaccgcgtcaccataacctgccgcacctcccaatctctagtccacatcaacgccatcacctacctccactggtaccaacaaaaacccggcaaagcacccaaactcctaatctaccgcgtctccaaccgcttctccggcgtcccctctagattctccggctcaggctccggcacagacttcacactcaccatctcctccctccaaccagaagacttcgccacctactactgcggccaatccacccacgtcccactcaccttcggccaaggaaccaaagtcgaaatcaaacgcacagtcgccgctccatccgtcttcatcttcccaccctccgacgaacaactcaaatccggcaccgcctccgtcgtctgcctactcaacaacttctacccccgcgaagcaaaagtccaatggaaagtcgacaacgccctccaatccggcaactcacaagaatccgtcaccgaacaagacagcaaagactccacctactccctatcctccaccctcaccctatcaaaagccgactacgaaaaacacaaagtctacgcctgcgaagtcacccaccaaggcctctcatcacccgtcaccaaatccttcaaccgcggcgaatgc

SEQ ID NO: 54166 - RNA, 1353 nt, synthetic construct
  misc_feature 1..1353: note = derived and/or modified sequence opt11 from Pascolizumab_HeavyChain1
  source 1..1353: mol_type = other RNA
caagtaacactccgagaatccggacccgccctcgtaaaaccaacccaaaccctaaccctgacctgcacattctccggcttctccctcagcacctccggaatgggcgtctcatggatccgacaaccacccggcaagggcctcgaatggctcgcacacatctactgggacgatgacaaacgctacaacccctcccttaaatcccgcctaaccatctctaaagacacctcgagaaaccaagtcgtcctcacaatgaccaacatggaccccgtagacacagccacttactattgcgcacgaagggagaccgtcttctactggtacttcgacgtatggggccgcggaacccccgtcaccgtctccagcgcatccactaaaggaccatccgtcttcccactagcaccctcctccaaatccacctcaggcggcaccgcagccctcggctgccttgtcaaagactacttccccgaaccagtaacagtatcctggaactcaggcgcactcacctccggagtccacacattccccgccgtcctacaatcctccgggctctactcactaagctcagtagtaacagtaccctcctcctcactcggcacccaaacctacatctgcaacgtcaaccacaaaccctccaacaccaaagtcgacaaaagagtagaacccaaatcgtgcgacaaaactcacacatgccctccctgccccgcccccgaactcctcggcggcccctccgtgttcctcttcccacccaagcccaaagacaccctaatgatctcccgtacccccgaagtcacgtgtgtcgtcgtcgacgtatcccacgaagaccccgaagtcaaattcaactggtacgtcgacggcgtcgaagtacacaacgccaaaaccaaaccccgagaagaacaatacaactcaacctaccgcgtcgtctctgtcctcaccgtactccaccaagactggctcaacggcaaagagtacaaatgtaaagtttcaaacaaagccctccccgcccccatagagaaaaccatctccaaggccaaaggccaacccagagaaccccaagtctacaccctcccaccctcccgcgaagaaatgaccaaaaatcaagtcagcctaacatgcctagtcaaaggattctacccctccgacatcgccgtcgaatgggaatcaaacggccaacccgaaaacaactacaaaaccacacccccagtcttagactcggacggctctttcttcctctactcaaaactcaccgtcgacaaaagccgctggcaacaaggcaacgtcttctcctgctccgtcatgcacgaagcactccacaatcattacacccagaaaagcctctccctctcgcccggaaaa

SEQ ID NO: 54167 - RNA, 654 nt, synthetic construct
  misc_feature 1..654: note = derived and/or modified sequence opt11 from Pascolizumab_LightChain1
  source 1..654: mol_type = other RNA
gacatcgtgctcacccaatcaccctcaagcctgtccgcctccgtcggcgaccgcgtgaccatcacatgtaaagcctcccaatccgtagactacgacggcgactcctacatgaactggtaccaacaaaaacccggaaaagcacccaaactcctgatctacgccgcatccaacctcgaatccggaatcccctcccgattctccggctccggctcaggaaccgacttcacctttaccatcagctcactccaacccgaagacatcgccacatactactgccaacaatcaaacgaagaccctcccaccttcggccaaggcaccaaagtcgaaatcaaacgcacagtcgcagccccctccgtattcatcttcccaccctccgacgaacaactcaaatccggcacagcctcggtcgtctgcctcctcaacaacttctacccccgcgaagccaaagtccaatggaaagtcgacaacgcactccaatccggcaactcccaagaaagcgtcaccgaacaagacagcaaagactcaacctacagcctcagctccaccctcaccctaagcaaagccgactacgagaaacacaaagtctacgcctgcgaagtcacacaccaaggcctcagctcccccgtcaccaaatccttcaaccgaggcgaatgc

SEQ ID NO: 54168 - RNA, 1512 nt, synthetic construct
  misc_feature 1..1512: note = derived and/or modified sequence opt11 from Pasotuxizumab_HeavyChain1
  source 1..1512: mol_type = other RNA
caagtgcaactggtcgagagcgggggaggactcgtaaaaccaggcgagagcttacgtctgtcctgtgccgcaagcggattcacattctctgactactacatgtactgggtaagacaagcgccaggaaaaggactcgagtgggtggccatcatcagcgacggcggctactacacgtactacagcgacataataaaagggcgattcacaataagcagggacaacgcaaagaactcactctacctacaaatgaacagtctaaaagcagaagacacagcggtttactactgcgcccggggcttccccctactcaggcacggcgcgatggactactggggacaagggacattagtcacagtctcgagtggaggcggaggctctggcggaggcggaagtgggggcgggggctccgacatacaaatgacccaaagtccaagctcactatcggcctcggtcggcgacagagtcacgattacgtgcaaggcctcacaaaacgtcgacacaaacgtcgcatggtatcaacaaaaaccgggacaggcaccgaaaagcctaatatactcagcatcgtacagatactccgacgtcccaagccgcttcagcggaagcgcaagcggaactgacttcacgctaacaatctccagcgtgcaatccgaagacttcgcgacctattactgccaacagtacgacagctacccctacaccttcggcggaggaacaaaactagaaataaaaagcggcgggggcgggagcgaagtacagctcgtggaatcaggcggaggcctagtacagcccgggggaagcctcaagttatcgtgcgcagcctcaggcttcacattcaacaagtacgcgatgaactgggtaagacaggccccaggaaagggcctagaatgggtcgcaagaatacgctcgaaatacaacaactacgcaacatactacgcggactccgtcaaggacagattcacgatatcacgcgacgactctaaaaataccgcgtacctacaaatgaacaacctcaaaaccgaggacacggccgtatactactgcgtacgccacggcaacttcgggaactcctacataagctactgggcatactggggacagggaacgctcgtgaccgtcagctcaggaggcggcggaagcggaggcggaggatcgggcgggggaggaagccaaacagtggtaacgcaagaaccctcgctcacagtctcccccggaggcacagtcaccctcacatgcgggagctcgacaggcgcagtcacatccggcaactacccaaactgggtccagcaaaaacccggccaagcacccaggggactgatcggcggcacaaaatttctcgcgccaggcaccccggccaggttcagcggatcactactgggaggcaaagcggccctaaccctaagcggagtacagcctgaagacgaggccgaatactattgcgtgctctggtacagcaaccggtgggtcttcgggggcgggaccaagctcacagtcctacaccatcaccatcaccac

SEQ ID NO: 54169 - RNA, 1512 nt, synthetic construct
  misc_feature 1..1512: note = derived and/or modified sequence opt11 from Pasotuxizumab_SingleChain
  source 1..1512: mol_type = other RNA
caagtgcagctagtacaaagcggcgggggactcgtgaagcccggggaatcactcagactatcctgcgcagcatcaggatttaccttcagcgactactatatgtactgggtgagacaagcaccagggaagggactggagtgggtagcaatcataagcgatggagggtactacacctactacagtgacataataaagggacggtttacaatatcgagggacaacgccaaaaacagcctatacctgcaaatgaactcactcaaggcagaggacacagcagtgtactactgcgcacgcggattcccactactacgacacggcgcaatggactactggggccagggaacgctcgtaaccgtcagcagtggcggaggcggaagcggaggaggaggaagcggaggaggagggagcgacatccaaatgacgcaatcgcccagtagcctaagcgcaagtgtgggcgacagagtgaccataacctgcaaagcaagccaaaacgtggacacgaatgtagcatggtaccaacaaaaaccagggcaagcgcccaaaagcctgatctacagtgccagctacaggtactccgacgtcccaagccgattctccggcagcgccagcggcacggacttcacactaacaattagcagcgtccagagcgaagacttcgccacatactactgccagcaatacgactcgtacccatacacgttcgggggaggcacaaaactagaaatcaaatccggaggaggaggatcagaagtacagctagtagaatccgggggaggcctagtacaaccaggaggcagcctgaagctaagctgcgccgcaagcggcttcacattcaacaaatacgccatgaactgggtccgacaagcaccagggaaaggcctcgaatgggtcgcccgaataaggagcaagtacaataactacgcaacatactacgcggacagcgtaaaagaccgattcacgataagcagagacgacagcaaaaacacagcatacctccaaatgaacaacttaaaaaccgaagacacagctgtctactactgcgtgaggcacggaaacttcggcaacagctacatctcatactgggcatactggggacaaggaaccctagtcacagtctcaagcggaggaggaggatcaggcggaggaggcagcggaggagggggaagccaaaccgtagtaacccaggaaccatccctcacagtgtcaccaggcggaaccgtaaccctaacctgcggatcgagtacaggagcagttacgagcggaaactacccgaactgggtccaacagaaaccaggccaagcaccccgcggtctaataggcggaacaaaattcctagccccaggcacgcctgcacgattcagcggaagtctactaggaggcaaggcagccctaacactaagcggagtacaaccagaagacgaagcggaatactactgcgttctgtggtacagcaaccgatgggtcttcggcgggggcacaaaattaaccgtgctccaccaccaccaccaccac

SEQ ID NO: 54170 - RNA, 1341 nt, synthetic construct
  misc_feature 1..1341: note = derived and/or modified sequence opt11 from Pateclizumab_HeavyChain1
  source 1..1341: mol_type = other RNA
gaagtccagctcgtcgaaagcggcggcggcctcgtccaacccggaggctcccttcgactctcttgcgcagcatcaggttacaccttcacctcatacgtcatccactgggtccgccaagcacccggcaaaggattagaatgggtcggctacaacaacccctacaacgctggcaccaactacaacgaaaagttcaaaggccgcttcaccatctcatcagacaaaagcaaaaacaccgcctacttacaaatgaactccctccgcgccgaagacaccgccgtttactactgctcacgccccaccatgctcccctggttcgcctactggggccaaggaaccctagtcactgtctcctccgcttccaccaaaggcccctcagtcttccccttagccccatcctcaaaatccacctccggcggtaccgcagccctaggatgcctcgttaaagactacttccccgaacccgtcaccgtctcctggaactcaggagccctcacctccggagtccacacctttcccgccgtcctccaatccagcggcctctactcactctcctcagtagtcaccgtcccatcaagctcgctaggcacccaaacctacatctgcaacgtaaaccacaaaccctcaaacaccaaagtcgacaagaaagtcgaaccaaaaagctgcgacaaaacacacacttgcccaccctgccccgcccccgaactactcggaggcccctccgtatttctgttcccacccaaacccaaagacacgctaatgatatcccgcaccccagaagtaacctgcgtcgtcgtcgacgtctcccacgaagaccctgaagtcaaattcaactggtacgtcgacggcgttgaagtacacaacgccaaaactaagccccgagaagaacaatacaactcaacctaccgcgtagtctcggtcctcaccgtcctccaccaagactggctcaacggcaaggaatataaatgcaaggtctccaacaaagccctacccgcacccatcgagaaaactatatccaaagccaaaggccaaccccgagaaccacaagtctacacactcccgccctcccgcgaagaaatgaccaaaaaccaagtatcgctaacctgcctcgtcaagggcttctacccctcagacatcgcagtcgaatgggaatcaaacggacaacccgaaaacaactacaaaacaacaccaccagtactcgactccgacggatcattcttcctctactcaaaactaacagtagacaaaagccgctggcagcaaggaaacgtcttctcctgctctgtcatgcacgaagctctccacaaccactacacccaaaaatccctatcgctttcccccggc

SEQ ID NO: 54171 - RNA, 642 nt, synthetic construct
  misc_feature 1..642: note = derived and/or modified sequence opt11 from Pateclizumab_LightChain1
  source 1..642: mol_type = other RNA
gacatccaaatgacacaatccccctcctcactctccgcctccgtcggcgaccgcgtcaccataacctgccgcgcctcccaagccgtctcctccgccgtcgcctggtaccaacaaaaacccggcaaagcccccaaactcctaatctactccgcctcccaccgctacaccggcgtcccctcccgcttctcaggctccggctccggaaccgacttcacccttaccatctcctccctccaacccgaagacttcgcaacctactactgccaagaatcctactctaccccctggaccttcggccaaggcaccaaagtcgaaatcaaacgcaccgtcgcagccccctccgtcttcatcttcccaccctccgacgaacaactcaaatcaggcaccgcatccgtcgtctgcctactcaacaacttttacccccgcgaagccaaagtccaatggaaagtcgacaacgccctccaatccggcaactcccaagagtccgtcaccgaacaagactccaaagactccacctactccctctcctccaccctcaccctctccaaagccgactacgaaaaacacaaagtatacgcctgcgaagtcacccaccaaggcctatcatcccccgtcaccaaatccttcaaccgaggagaatgc

SEQ ID NO: 54172 - RNA, 1341 nt, synthetic construct
  misc_feature 1..1341: note = derived and/or modified sequence opt11 from Patritumab_HeavyChain1
  source 1..1341: mol_type = other RNA
caagtccaactccaacaatggggcgccggcctcctaaaaccctccgaaaccctctcactaacctgcgccgtttacggcggatcattctccggctactactggagctggatccgccaaccacccggcaaaggtctcgaatggatcggcgaaatcaaccacagcggctcaacaaactacaaccccagcctgaaatcccgcgtaaccatcagcgtagaaacctccaaaaaccaattctccctcaaactctcatcagtcaccgccgcagacaccgccgtctactactgcgcccgcgacaaatggacctggtacttcgacctttggggccgcggtaccctcgtaaccgtctcctcagcctccaccaaaggcccctccgttttccccctagccccctcaagcaaaagcaccagcggcggcacagccgcactcggttgcctcgtaaaagactacttccccgaacccgtcaccgtatcctggaactcaggagccctaacctccggcgttcacacattcccagcagtcctacaatcctcaggcctctactcactctcctctgtagttaccgtccccagctcgtccctaggaacccaaacatacatatgcaacgtcaaccacaaaccctccaacaccaaagttgacaaacgagtagaacccaaatcctgcgacaaaacccatacctgcccaccctgccccgcccccgaactcctcggcggcccctccgtcttcctcttcccacccaaacccaaagacactctaatgatatctcgcacccccgaagtaacctgcgtcgtcgtagacgtctcacacgaagaccccgaagtaaaattcaactggtacgtcgacggagttgaagtgcacaatgccaaaacaaaaccccgtgaagaacaatacaacagcacctacagagtagtctcagtcctcacagttctacaccaagactggctaaacggcaaagaatacaaatgcaaagtatccaacaaagccctccccgccccaatagaaaagaccatatccaaagcaaaaggtcaaccccgcgaaccccaagtctacaccctaccaccctcccgagaagaaatgaccaaaaaccaagtgtcactcacatgcctagtcaaaggtttctacccctcagacatagccgtcgaatgggaatccaacggccaacccgaaaacaactacaaaacaaccccacccgtactcgactcagacggcagcttcttcctctattcaaaactcaccgtcgacaaaagccgctggcaacaaggaaacgtcttttcatgctccgtaatgcacgaagccctccacaaccactacacccagaaatccctaagcctatcccccggcaaa

SEQ ID NO: 54173 - RNA, 681 nt, synthetic construct
  misc_feature 1..681: note = derived and/or modified sequence opt11 from Patritumab_hinge-CH2-CH3
  source 1..681: mol_type = other RNA
gacaaaacccacacatgcccaccctgccccgcccccgaactcctcggcggcccctccgtattcctcttcccacccaaacccaaagacaccctcatgatctcccgcacccccgaagtaacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctccgtcctcaccgtcctacaccaagactggctcaacggaaaagaatacaaatgcaaagtctcaaacaaagccctccccgcccccatcgagaaaaccatctcaaaagcaaaaggccaaccccgagaaccccaagtctacaccctcccaccctcccgcgaagaaatgaccaaaaaccaagtctccctctggtgcctcgtcaaaggcttctacccctcagacatcgccgtcgaatgggaatccaacggccaacccgaaaacaactataaaaccacaccacccgtcctcgactccgacggctccttcttcctctactccaaactcacagtcgacaaatcccgatggcagcaaggcaacgtcttctcctgctccgtcatgcacgaagccctccacaaccactacacccaaaaatcactctccctctcccccggcaaa

SEQ ID NO: 54174 - RNA, 660 nt, synthetic construct
  misc_feature 1..660: note = derived and/or modified sequence opt11 from Patritumab_LightChain1
  source 1..660: mol_type = other RNA
gacatcgaaatgacccaatcccccgacagcctagccgtctccctcggcgaacgagccaccatcaactgccgctcctcccaatccgtcctctactcctcatccaaccgcaactacctcgcctggtaccaacaaaaccccggacaaccacccaaactcctcatctactgggcctccacccgcgaatcaggcgtccccgaccgattctcaggctccggctccggcaccgacttcacactcaccatctcctcactccaagccgaagacgtagccgtctactactgccaacaatactactccacaccccgcaccttcggccaaggaaccaaagtcgaaatcaaacgcaccgtcgccgccccctccgtcttcatattcccaccctccgacgaacaactaaaatccggcaccgcctccgtagtctgcctcctcaacaacttctacccccgcgaagccaaagtccaatggaaagtcgacaacgccctccaatccggaaactcccaagaaagcgtaaccgaacaagactccaaagactccacctactccctttcctccaccctcaccctatccaaagccgactacgaaaaacacaaagtctacgcctgcgaagttacccaccaaggcctctcctcacccgtcacaaaatccttcaaccgcggcgaatgc

SEQ ID NO: 54175 - RNA, 1341 nt, synthetic construct
  misc_feature 1..1341: note = derived and/or modified sequence opt11 from Pembrolizumab_HeavyChain1
  source 1..1341: mol_type = other RNA
caagtccaactcgtccaaagcggcgtcgaagtcaagaaacccggcgcctccgtcaaagtctcctgcaaggcttcaggctacaccttcacaaactactacatgtactgggtccgccaagcccccggccaaggattagaatggatgggcggcatcaacccatcaaacggcggcaccaacttcaacgaaaaattcaaaaaccgcgtcaccctgaccaccgactcctccacaaccaccgcctacatggagctcaaatccctacaattcgacgataccgccgtctactactgcgcaaggcgcgactaccgcttcgacatgggcttcgactactggggacaaggaacaaccgtcaccgtcagctcagcatcaaccaaaggcccctccgtattcccactcgcaccctgctcccgctccacctccgaatctaccgccgccctcggatgcctcgtaaaagactacttcccagaacctgtcacggtctcatggaactccggagccctcacatccggcgtccacaccttccccgccgtcctgcaatcctccggcctctactcactctcaagcgtcgtaaccgtccccagctcctccctaggcaccaaaacctacacgtgcaacgtcgaccacaaaccctctaacacaaaagtcgacaaacgagtcgaatcaaaatacggtcccccatgccctccgtgcccagcacccgaatttctaggcggcccctccgtcttcctctttcccccaaaacccaaagacacactcatgatatcccgcacaccagaggtgacctgcgtcgtcgtcgacgtcagccaggaagacccagaagtccaattcaactggtacgtcgacggcgtcgaagtccacaacgccaagaccaaaccacgcgaagaacaattcaactccacctaccgcgtcgtctccgtcctgaccgtactccaccaagactggctcaacggcaaggaatacaagtgcaaagtctcaaacaaaggcctcccctcctccatagagaaaacaatatccaaggccaaaggccaaccccgagaaccgcaagtctacacacttccaccctcccaagaagaaatgacaaagaaccaagtctccctaacctgcctcgtcaaaggattctacccctccgacatcgccgtcgaatgggaatccaacggacaacctgaaaacaactacaaaaccacccctcccgtcctcgattcagacggctccttcttcctctactcacgcctcactgtcgacaaatcccgctggcaagaaggcaacgtattctcatgctcagtaatgcacgaggccttacacaaccactatacccaaaaatccctctccctttccctaggaaaa

SEQ ID NO: 54176 - RNA, 654 nt, synthetic construct
  misc_feature 1..654: note = derived and/or modified sequence opt11 from Pembrolizumab_LightChain1
  source 1..654: mol_type = other RNA
gaaatcgtactcacacaatcacccgcaaccctcagcctaagccccggcgaacgcgctaccctaagctgccgcgcaagcaaaggcgtctccacaagcggatactcatacctacactggtaccaacaaaaacccggacaagcacccagactcctcatctacctcgcaagctacctcgaaagcggggtcccagccagattctcaggctccggctcaggcacagacttcaccctcaccataagctcgctcgaacccgaggacttcgccgtatactactgccaacactcacgcgacctcccactaacattcggaggcggaaccaaagtcgaaatcaaacgcacagtcgccgccccatccgtattcatattcccgccctccgacgaacaactaaaatcaggcaccgcctccgtcgtatgcctcctcaacaacttctacccacgcgaagccaaagtccaatggaaagtcgacaacgccctccagagcggaaactcgcaagaaagcgtcaccgaacaagacagcaaagactcaacctactccctcagctcaaccctcaccctctccaaagccgactacgaaaaacacaaagtatacgcctgcgaagtcacacaccaaggcctaagctcccccgtcaccaaatccttcaacaggggcgaatgc

SEQ ID NO: 54177 - RNA, 1356 nt, synthetic construct
  misc_feature 1..1356: note = derived and/or modified sequence opt11 from Perakizumab_HeavyChain1
  source 1..1356: mol_type = other RNA
gaagtacaactcgtagaatccggcggcggcctagtccaacccggaggatcactccgactctcttgcgcagcatccggcttcacattctcagactacaccatgctctgggtccgacaagccccaggcaaaggcctagaatgggtagccatcatcaaatccggcggatcatactcctactaccccgactccgtcaaaggccgcttcacaatctcccgagacaacgccaaaaacagcctttacctccagatgaactctctccgagcagaagacaccgcagtatactactgcgccagagacggcgactacggctcatcatacggcgccatggactactggggccaaggcaccctggtcaccgtatcctccgcatcaacaaaaggcccctcagtattccccctcgcaccatcaagcaaatccacatccggcggtacggccgccctaggctgcctcgtaaaagactacttccccgaacccgtaacagtatcctggaactccggcgccctaacctccggtgttcacaccttccccgccgtccttcaatcatccggtctttactccctatcctccgtcgtaacagtacccagctcctccctaggcacccaaacctacatttgcaatgtcaaccacaaacccagcaacacaaaagtcgacaagaaagtcgaacccaaaagctgcgacaaaacacacacctgtccaccctgccccgcccccgaagctgccggtggcccctccgtctttcttttcccacccaaacccaaagataccctaatgatatcccgaacccccgaagtaacctgcgtcgtcgtcgacgtctcacacgaagaccccgaagtcaaattcaattggtatgtagacggcgtcgaggtccacaacgccaaaacaaaaccacgcgaggaacaatacaactccacctaccgcgtcgtatcagtcctcaccgtactccaccaggactggctaaacggaaaagaatacaaatgcaaagtctcaaacaaagccctccccgccccaatcgagaaaacaatctccaaagccaaaggccaaccccgcgaaccgcaagtctacacactaccaccatcccgcgacgaactaacgaaaaaccaagtctccctaacctgcctcgtcaaaggcttctatccttcagacatcgccgtcgaatgggaatccaacggccaaccagaaaacaactacaaaaccaccccacctgtccttgactcagacggctccttcttcctttactcaaaactgaccgtcgacaaatcccgctggcaacagggcaacgtattcagctgctccgtcatgcacgaagccctacacaaccactacacccaaaaatccctctccctatcccccggcaaa

SEQ ID NO: 54178 - RNA, 645 nt, synthetic construct
  misc_feature 1..645: note = derived and/or modified sequence opt11 from Perakizumab_LightChain1
  source 1..645: mol_type = other RNA
gacatccaaatgacccaatccccctcctcactctccgcatccgtcggcgaccgcgtcaccatcacatgccgcgcctcccaagacatcaactcctacctctcctggttccaacaaaaacccggaaaagcccccaaatccctcatcgtcagagccaaccgcctcgtcgacggcgtcccctcacgattcagcggctccggatccggacaagactactcactcaccatctcctccctccaacccgaagacttcgccacctactactgcctacaatacgacgccttcccaccctacaccttcggccaaggcaccaaactcgaaatcaaacgcaccgtcgccgccccctccgtattcatcttcccaccctccgacgaacaactcaaatcaggcacagcctccgtcgtctgcctcctcaacaacttctacccccgcgaagccaaagtccaatggaaagtcgacaacgccctccaatccggcaactcccaagaatccgtcaccgaacaagactccaaagactccacatactccctctcctccaccctaaccctctccaaagccgactacgaaaaacacaaagtctacgcctgcgaagtcacccaccaaggcctctcctcacccgtaaccaaatccttcaaccgaggagaatgc

SEQ ID NO: 54179 - RNA, 1332 nt, synthetic construct
  misc_feature 1..1332: note = derived and/or modified sequence opt11 from Pertuzuab_HeavyChain1
  source 1..1332: mol_type = other RNA
gaagtgcaactcgtcgaatcaggaggcggcctcgtccaacctggcggcagcctccgcctttcatgcgcagcatccggcttcacattcaccgactacaccgactgggttagacaagctcctggaaaaggcctcgaatgggtcgccgacgttaatcccaactccggaggctcgatctacaaccaacgattcaaaggtcgctttaccctctcagtagaccgctccaaaaacaccctctacctccaaaactcattacgagcagaagacaccgccgtatactactgcgcgagaaacctcggcccctcattctacttcgattactggggccaaggaaccctcgtcacagtctcatccgcctccaccaaaggcccctccgtcttccccctcgccccctcctcaaagtccaccagcggcggcacagccgccctcggttgcctcgtaaaagactacttccccgaacccgtcacggtatcatggaactccggcgcactaacctccggcgtccacaccttccccgccgtcctacagtcctctggcctatactctctctcatcagtcgtcacagtaccctcatcctccctcggcacccaaacctacatctgcaacgtcaaccacaaaccctcaaataccaaagtcgacaagaaagtcgaacccaaatcgtgcgacaaaacccacacctgtcccccatgccctgcccccgaattattaggcggcccatcagtctttctcttccctcccaaacccaaagacaccctcatatcccgcaccccagaagtaacctgcgttgtcgtcgacgtgtcacacgaagaccccgaggtcaaattcaactggtacgtcgacggcgtcgaagtccacaacgccaaaaccaaaccacgcgaagaacaatacaactcaacctacagagtcgtctccgtcctcaccgtcctacaccaagactggctcaacggcaaagaatacaaatgcaaagtctccaacaaagcactccccgcccctatagagaaaaccatctccaaagccaaaggacaaccacgcgaaccccaagtctacaccctaccaccctcccgcgaagaaaccaaaaaccaagtctcactaacctgcctcgtcaaaggcttctacccctcagacatcgcagtagaatgggaatccaacggccaacccgaaaacaactacaaaaccaccccaccagtcctcgactccgacggctctttctttctctacagcaaactaaccgtcgacaaatcaagatggcaacaaggcaacgtcttctcctgctcagtacacgaagctctccacaaccactacacacagaaatcactctccctctctcccggcaaa

SEQ ID NO: 54180 - RNA, 639 nt, synthetic construct
  misc_feature 1..639: note = derived and/or modified sequence opt11 from Pertuzuab_LightChain1
  source 1..639: mol_type = other RNA
gacatccaaacccaatcgccctcatccctctccgcctccgtaggcgaccgcgtcaccatcacatgcaaagcctcccaagacgtctccatcggcgtcgcctggtaccaacaaaaaccaggcaaagcccccaaactcctcatctactccgcatcctaccgctacaccggtgtcccatcccgcttctccggctcaggctcaggcaccgacttcaccctcaccatctcctccctccaacccgaagacttcgccacctactactgccaacaatactacatctacccctacaccttcggccaaggcaccaaagtcgaaatcaaacgcaccgtcgccgccccttccgtcttcatcttcccaccctcagatgaacaactaaaatccggcaccgcctccgtcgtctgcctcctcaacaacttctacccccgcgaagccaaagtccaatggaaagtcgacaacgccctccaatccggaaactcccaagaatccgtcaccgaacaagactccaaagactccacctactccctctcctcaacactcacactctccaaagccgactacgaaaaacacaaagtctacgcctgcgaagtcacacaccaaggcctctcctcccccgtcaccaaatccttcaaccgcggcgaatgc

SEQ ID NO: 54181 - RNA, 642 nt, synthetic construct
  misc_feature 1..642: note = derived and/or modified sequence opt11 from Pertuzumab_HeavyChain
  source 1..642: mol_type = other RNA
gacatccaaatgacccaatccccctcctccctctccgccagcgtcggcgaccgcgtcaccataacctgcaaagcctcccaagacgtctcaatcggcgtcgcctggtaccaacaaaaacccggaaaagcccccaaactcctcatctacagcgcctcctaccgctacaccggcgtcccctcccgcttctccggctcaggctccggcaccgacttcaccctcaccatatcctcactccaacccgaagacttcgccacctactactgccaacaatactacatctacccctacacattcggccaaggcaccaaagtagaaatcaaacgcaccgtcgccgccccctccgtcttcatcttcccaccctccgacgaacaacttaaatccggcaccgcctccgtcgtctgcctcctcaacaacttctacccccgagaagccaaagtccaatggaaagtcgacaacgcactccaatctggaaactcccaagaatccgtcaccgaacaagactccaaagactccacctactccctctcctccaccctcaccctctccaaggccgactacgaaaaacacaaagtctacgcctgcgaagtaacacaccaaggcctatcctcccccgtaaccaaatccttcaaccgcggcgaatgc

SEQ ID NO: 54182 - RNA, 1344 nt, synthetic construct
  misc_feature 1..1344: note = derived and/or modified sequence opt11 from Pertuzumab_LightChain
  source 1..1344: mol_type = other RNA
gaagtccagctagtcgaatcaggcggaggcctcgtacagcccggcggctcactccgactatcatgcgccgcatcaggcttcacattcaccgactacactatggactgggtacgccaagcccctggaaaaggcctcgaatgggtagccgacgtaaaccccaactccggcggatcaatctacaaccaacgcttcaaaggccgattcacactctccgtcgacagatccaaaaacaccctctacctccaaatgaactccctacgcgccgaagacaccgccgtctactactgtgcccgcaacctaggaccctccttctacttcgactactggggtcaaggcaccctagtcaccgtctcctctgcatccacaaaaggcccatccgtcttccccctggccccgtcatcaaaatccacctccggcggcaccgccgccctcggatgcctcgtcaaagactacttccctgaacccgtcaccgtatcctggaactcaggcgccctcacctctggggtacacacattccccgccgtcctacagtcctccggcctctattccctttcctccgtcgtcactgtcccatcttcctcactaggcacacaaacctacatctgcaacgtcaaccacaaaccctcgaacacaaaagtcgacaagaaagtcgaacccaaatcctgcgataaaacccacacttgcccaccctgccctgcacccgaactcctaggaggcccatcagtattcctattcccacccaaacccaaagacacactgatgatctcccgaaccccagaagtaacatgcgtcgtcgtcgacgtctcccacgaagaccccgaagtgaaattcaactggtacgtcgacggcgtcgaagtccataacgcaaaaaccaaacccagagaagaacaatacaatagcacctaccgcgtcgtatccgtccttactgtactccaccaagactggctaaacggaaaagaatacaaatgcaaagtgagcaacaaagccctccccgcccccattgagaaaacaatctccaaagccaaaggccaaccccgagaaccccaagtctacaccctcccgccctcccgcgaagaaatgaccaaaaaccaagtctcactgacctgcctcgtcaaagggttctacccctccgacatagccgttgaatgggaatcaaacggccaacccgaaaacaactacaaaaccaccccacccgtactcgactccgacggctccttcttcctatactcaaaattaaccgtcgacaaaagtcgctggcaacaaggcaatgtcttctcatgctcggtaatgcacgaagctctacataaccactacacccaaaaatccctgtccctctcccccggc

SEQ ID NO: 54183 - RNA, 750 nt, synthetic construct
  misc_feature 1..750: note = derived and/or modified sequence opt11 from Pexelizumab_h5g1.1-scFv
  source 1..750: mol_type = other RNA
atggccgacatccagatgacgcaatcgccctcaagcctgagcgcgagcgtgggcgaccgagtaaccataacatgcggcgcgagcgagaacatatacggagccctgaactggtaccagcgaaagcccgggaaagcgcccaagctcctgatctacggcgcgacaaacctcgcagacggggtcccaagcaggttctcgggctcgggctcgggcacagactacaccctgaccataagctcactccagcccgaagactttgccacgtactattgccagaacgtgctcaacaccccgctcacgttcggacaagggaccaaggtcgagatcaagcgaacgggcgggggcggaagcgggggcgggggctcaggcgggggcgggagccaggtccagcttgtgcaatcgggagcggaagtggaaaagcccggagcatcagtcaagaaagtaagctgcaaagcgagcgggtacatattctcaaactactggatacaatgggtcaggcaagcacccgggcaaggactcgagtggatgggagaaatcctacccgggagcggaagcacggaatacgcccagaaattccaaggacgcgtgaccatgaccgcggacacgagcacaagcacggcatacatggagctttcgagcttaagatcggaagacaccgcagtctattactgtgccagatacttcttcgggagctcgccaaattactggtacttcgacgtatgggggcaagggaccctggtaacggtctcaagc

SEQ ID NO: 54184 - RNA, 345 nt, synthetic construct
  misc_feature 1..345: note = derived and/or modified sequence opt11 from Pexelizumab_h5g1.1VHC_+_F_Heavy_Chain_V-Region
  source 1..345: mol_type = other RNA
caagtgcaattggtccagagcggggccgaggtcaagaaaccgggcgcgagcgtgaaagtgagctgtaaagcgagcgggtacatattctcgaactattggatacaatgggtcaggcaagcgcccgggcaagggctcgagtggatgggcgagatcttgcccgggagcgggagcacggaatatgcccagaaatttcaagggcgcgtgaccatgacagcggacacgagcacgagcacggcctatatggagctctcgagcttgcgctcggaagataccgcggtctattactgtgccaggtactttttcgggagctcgcccaattggtatttcgtgtgggggcaagggacc

SEQ ID NO: 54185 - RNA, 318 nt, synthetic construct
  misc_feature 1..318: note = derived and/or modified sequence opt11 from Pexelizumab_h5g1.1VHC_+_F_Light_Chain_V-Region
  source 1..318: mol_type = other RNA
gacatccaaatgacccaatccccctcactctccgcctccgtcggcgaccgcgtcaccatcacctgcggcgcatccgaaaacatctacggcgccctcaactggtaccaacgcaaacccggcaaagcccccaaactcctcatctacggcgcaaccaacctcgccgacggagtcccctcccgattctccggctccggctccggcaccgactacaccctcaccatctcctccctccaacccgaagacttcgccacctactactgccaaaacgtcctcaacacccccctcaccttcggccaaggcaccaaagtcgaaatcaaa

SEQ ID NO: 54186 - RNA, 1326 nt, synthetic construct
  misc_feature 1..1326: note = derived and/or modified sequence opt11 from PF-05082566_HeavyChain1
  source 1..1326: mol_type = other RNA
gaggtccaactcgtccaatccggcgctgaagtcaagaaacccggagaatcactccgcatctcctgcaaaggatccggctactcattcagcacctactggatctcctgggttcgccaaatgccaggcaaaggcctcgaatggatgggcaaaatctaccccggagactcatacaccaactactcaccctccttccaaggtcaagtcacaatctccgccgacaaatcaatctccaccgcctacctccaatggtcgtccctcaaagcctcagacaccgctatgtactactgcgcacgcggctacggcatcttcgactactggggacaaggcaccctcgtaaccgtttcatccgcctccaccaaaggaccctccgtattcccactcgcaccatgctcacgatccacctcggaatccaccgcagccttaggctgcctcgtaaaagactacttcccagaaccagttacagtctcatggaactcaggcgcactcacctccggcgtccacaccttcccagccgtcctccagtcatccggcctctactccctctcctccgtcgtaacagtccccagctccaacttcggaacccaaacatatacctgcaacgtggaccacaaaccctccaacaccaaagtcgacaaaacagtcgaacgcaaatgctgcgtcgaatgcccaccctgccccgccccacccgtagccggcccctccgtcttcctcttcccacccaaacccaaagacaccctcatgatatcccgaacacccgaggttacctgcgtcgtcgtcgacgtaagccacgaagaccccgaagtccaattcaactggtacgtcgacggcgtcgaagtccacaatgcaaaaacgaaaccccgtgaggaacaattcaactccacattcagagtcgtatccgtactcaccgtcgtccaccaagactggctaaatggcaaagagtacaaatgcaaagtctctaacaaaggcctacccgcccccattgaaaagaccatctcaaaaaccaaaggccaaccccgcgaaccccaagtctataccctaccaccctcccgcgaggaaatgaccaaaaaccaagtctccctcacatgcctcgtcaaaggcttctacccctccgacatcgccgtcgaatgggaatcgaacggccaacccgaaaacaattataaaacaacacccccaatgctcgactccgacggttccttcttcctctactccaaactcaccgtcgacaaatcccgctggcaacaaggcaacgtcttctcctgctccgtcatgcacgaagcactccacaaccactacacacaaaaatcactctccttatccccaggcaaa

SEQ ID NO: 54187 - RNA, 642 nt, synthetic construct
  misc_feature 1..642: note = derived and/or modified sequence opt11 from PF-05082568_LightChain1
  source 1..642: mol_type = other RNA
tcctacgaactaacccaacccccctccgtctccgtctcacccggacaaaccgcctcaatcacttgctccggcgacaacataggcgaccaatacgcccactggtaccaacaaaaacccggacaatcacccgtcctcgtcatctaccaagacaaaaaccgcccctccggcatccccgaacgcttctccggctccaactccggcaacacagccaccctaaccatctccggcacccaagccatggacgaagccgactactactgcgccacctacaccggcttcggctccctagccgtcttcggcggcggcaccaaactcacagtcctcggccaacccaaagccgccccctccgtcacactattccccccatcctccgaagaacttcaagccaataaagccaccctcgtctgcctcatctcagacttctaccccggcgccgtcaccgtagcctggaaagccgactcctcacccgtcaaagccggcgtcgaaaccaccaccccatccaaacaatccaacaacaaatacgccgcctcctcctacctctccctcaccccagaacaatggaaatctcaccgctcctactcctgccaagtcacccacgaaggctccaccgtcgaaaaaacagtcgcccccaccgaatgctcc

SEQ ID NO: 54188 - RNA, 1341 nt, synthetic construct
  misc_feature 1..1341: note = derived and/or modified sequence opt11 from Pidilizumab_HeavyChain1
  source 1..1341: mol_type = other RNA
caagtccagctagtccaatcaggctccgagctcaaaaagcccggagcctccgtaaaaatctcctgcaaagcctctggctacaccttcacaaactacggaatgaactgggttcgccaagcccccggacaaggcctacaatggatgggatggatcaacactgactcaggggaatccacgtacgcagaagaatttaaaggtcgcttcgtcttctccctcgacacttcagtcaacaccgcctacctacaaatcacatcccttaccgctgaagacacaggcatgtacttctgcgtccgcgtaggctacgacgccctcgactactggggacaaggcaccctagtcaccgttagctcagcctccacaaaaggcccatccgtattccccctcgccccatcatccaaatccacttcaggcggcaccgccgccctcggatgcctcgtaaaagactacttccccgaacccgtcaccgtatcctggaacagtggagccctaaccagcggcgtccacactttcccagcagtcctacaatcatcaggcctctatagcctctcctccgtcgtcaccgtcccctccagctcactcggcacccaaacatacatctgcaacgtcaaccacaaaccctcaaacaccaaagtcgacaaacgcgtagaacccaagagctgcgacaaaacccacacctgtcccccttgccccgcaccagagctactaggcggcccaagcgtcttcctcttcccacccaaacccaaagacaccctcatgatctcccgcacccccgaagtaacctgcgtcgtagtagacgtctctcacgaagatccagaagtcaaattcaactggtatgttgacggagtagaagtccacaacgcaaaaaccaaaccccgcgaagaacaatacaactccacctaccgcgtcgtcagcgtcctcaccgtcctccaccaagactggctaaacggcaaagaatacaaatgcaaagtcagcaacaaagccctccccgcacccatcgagaaaaccatcagcaaagcaaaaggccaaccccgcgaaccccaagtctacacactcccaccatcccgcgaagaaatgaccaaaaaccaagtctccctaacttgcctagtaaaaggcttctaccccagcgacatcgccgtcgaatgggaatcaaacgggcaacccgaaaacaactacaaaaccacacccccagtcctcgactccgacggctccttcttcctctactcaaaactaaccgtcgacaaatcccgctggcaacaaggcaacgtcttctcctgctccgtcatgcacgaagcccttcacaaccactacacccagaaatccctctccctctcccccggtaaa

SEQ ID NO: 54189 - RNA, 639 nt, synthetic construct
  misc_feature 1..639: note = derived and/or modified sequence opt11 from Pidilizumab_LightChain1
  source 1..639: mol_type = other RNA
gaaatcgtcctcacccaatccccctcttcactctcggcatccgtcggcgaccgcgtcaccattacctgctccgcccgctcctccgtctcctacatgcactggttccaacaaaaacccggcaaagcacccaaactctggatctaccgcaccagcaacctcgcctccggcgtcccctcccgcttctccggctccggctccggaacatcctactgcctcacaatcaactccctccaacccgaagacttcgccacctactactgccaacaacgctcctccttccccctcacattcggaggcggcaccaaactcgaaatcaaacgcacagtcgccgccccctccgtcttcatcttcccaccctccgacgaacaactaaaatccggcacagcctccgtagtctgcctccttaacaacttctacccccgcgaagccaaagtccaatggaaagtcgacaacgcactccaatccggcaactcacaagaatccgtcaccgaacaagactccaaagactccacctactccctatcctcaacccttaccctctccaaagccgactacgaaaaacacaaagtctacgcctgcgaagtcacccaccaaggcctctcctcacccgttaccaaatccttcaaccgcggcgaatgc

SEQ ID NO: 54190 - RNA, 1350 nt, synthetic construct
  misc_feature 1..1350: note = derived and/or modified sequence opt11 from Pinatuzumab_vedotin_HeavyChain1
  source 1..1350: mol_type = other RNA
gaagtacaactcgtcgaatcaggcggaggtctcgtccaacccggtggatccctccgtctctcctgcgccgccagcggctacgagttctcccgctcatggatgaactgggtccgccaagcacccggaaaaggcctcgaatgggtaggccgaatctatcccggagacggcgacaccaactactcaggcaaattcaaaggccgcttcaccatctcagccgacaccagcaaaaacaccgcctacctccaaatgaactcactccgggccgaagacacagctgtctactactgcgcacgagacggaagctcctgggactggtacttcgacgtctggggccaaggcaccctcgtaaccgtcagctcagcatccaccaaaggccccagcgtatttccactcgccccatcctcgaaatcaacctccggaggaaccgcagcactcggctgcctagtcaaagactactttcctgaacccgtcaccgtctcatggaactcaggcgccctaacatccggcgtacacacattcccagcagtcctccaatcctccggcctctactccctctcctccgtagtcaccgtaccctcgtcaagcctaggcacccaaacctacatctgcaatgtcaaccacaagcccagcaacaccaaagtcgacaagaaagtcgaacccaaatcctgcgacaaaacacacacctgtccaccctgccccgccccggaactactcggcgggccctccgtgttcctcttcccacccaaacccaaagacaccctcatgatatcaagaacccccgaagtaacctgcgtagtagtcgacgtgtctcacgaagaccccgaagtcaaattcaactggtacgtcgacggcgtcgaagtacacaacgccaaaaccaaaccccgcgaagaacaatacaacagcacataccgcgtcgtaagcgtcctcaccgtcctacaccaggactggttgaacggcaaagaatacaaatgcaaagtatcaaacaaagccctacccgcccccatcgagaaaaccatctccaaagcgaaaggccaaccccgagaaccacaagtctataccctaccacccagccgcgaagaaatgactaaaaaccaagtctccctaacctgcctggtcaaaggcttctacccctcagacatcgccgtcgaatgggaatccaacggacaacccgaaaacaactacaaaacaacaccacccgttctagactccgacggatcattcttcctctactccaaactcaccgtcgacaaaagccgatggcaacagggcaacgtcttcagctgctccgtgatgcacgaagctctccacaaccattacacacaaaaatccctctccctctctcccggcaaa

SEQ ID NO: 54191 - RNA, 657 nt, synthetic construct
  misc_feature 1..657: note = derived and/or modified sequence opt11 from Pinatuzumab_vedotin_LightChain1
  source 1..657: mol_type = other RNA
gacatccaaatgacccaaagcccctcctcactctccgcctccgtcggcgaccgcgtcaccataacctgccgctcctcccaatccatcgtccactccgtcggcaacaccttcctcgaatggtaccaacaaaaacccggcaaagcacccaaactcctcatctacaaagtctccaaccgcttctccggcgtcccctcccgcttctccggctccggatccggcacagacttcaccctcaccatctcctccctccaaccagaagacttcgccacatactactgcttccaaggctcccaattcccctacacattcggccaaggaaccaaagtcgaaatcaaacgcaccgtcgccgccccctccgtattcatcttcccaccctccgacgaacaactcaaatccggcaccgcctccgtcgtctgcctcctcaacaacttctacccccgcgaagccaaggtccaatggaaagtagacaacgctctccaatccggcaactcccaagaatccgtcaccgaacaagactcaaaagactcaacctactctctctcctccaccttaaccctctccaaagccgactacgaaaaacacaaagtctacgcctgcgaagtcacccaccaaggcctatcatcccccgtaaccaaatccttcaaccgcggcgaatgc

SEQ ID NO: 54192 - RNA, 1023 nt, synthetic construct
  misc_feature 1..1023: note = derived and/or modified sequence opt11 from Placulumab_chain1
  source 1..1023: mol_type = other RNA
gacatccaaatgacccagtcaccctcatccctctccgcctccgtaggcgaccgagtcaccatcacatgccgcgccagccaagccatcgactcctacctacactggtaccaacaaaaacccggcaaagcacccaaactcctcatctactcagcctccaacctcgaaaccggcgtcccttccagattctccggctccggctctgggaccgacttcaccctcaccatctcctccctccttcccgaagacttcgctacatactactgccaacaagtcgtctggcgaccattcaccttcggacaaggcaccaaagtcgaaatcaaacgcgtagaaccaaaatcctccgacaaaacacacacttgcccaccatgcccagcccccgaactactcggcggcccatcagtattcctcttccctcccaaacccaaagacaccctcatgatctcacgcacccccgaagttacctgcgtcgtcgtcgacgtctcccacgaagacccagaagtcaaattcaactggtacgtagacggcgtagaagtgcacaacgccaaaaccaaacctcgcgaagaacaatacaactccacctaccgcgtcgtctcagtcctaaccgtcctacaccaagactggctaaacggaaaagaatacaaatgtaaagtatccaacaaagccctccccgcccccatcgaaaagaccatctccaaagccaaaggccaaccccgcgaaccccaagtctacaccctcccaccctcacgcgacgaactcaccaaaaaccaagtctcccttacctgcctcgtcaaaggcttctacccctcagacatcgccgttgaatgggaatccaacggccaaccagaaaacaactacaaaaccacaccacccgtcctcgacagcgacggctccttcttcctctactcaaaactcaccgtagacaaaagccgctggcaacaaggcaacgtcttctcctgctccgttatgcacgaagccctccacaaccactacacccaaaaatccctatccctctcacccggcaaa

SEQ ID NO: 54193 - RNA, 1023 nt, synthetic construct
  misc_feature 1..1023: note = derived and/or modified sequence opt11 from Placulumab_HeavyChain1
  source 1..1023: mol_type = other RNA
gacatccaaatgacccaatccccctcctcactctccgcctccgtaggcgaccgcgtcaccataacctgccgagcttcacaagccatcgactcctacctacactggtaccaacaaaaacccggcaaagcccccaaactactcatctactccgcctccaacctcgaaacgggcgtcccctcccgcttctctggctccggatctggaaccgacttcactctaaccatctcatcactactacccgaagacttcgcaacctactactgccaacaagtcgtctggcgacccttcaccttcggccaaggtacaaaagtcgaaatcaaacgcgtcgagcccaaatcctccgataaaactcatacctgccctccctgccccgcccccgaactcctcggaggaccctctgtctttctattccctcccaaacccaaagacaccctcatgatctcccgcacccccgaagtaacctgcgtcgtcgtagacgtatcacacgaagaccccgaagtcaaattcaactggtacgtcgacggagtcgaagtccacaacgccaaaactaaaccccgcgaagaacaatacaattccacctaccgcgtcgtctccgtcctgaccgtcctccaccaggactggctcaacggcaaagaatataaatgcaaagtctccaacaaggccctccccgcccccatcgagaaaaccatatccaaagccaaaggccaaccccgcgaaccccaagtctacaccctaccaccctcccgcgacgaactcaccaaaaaccaagtctccctaacctgcctcgttaaaggcttctacccctccgacatcgccgtcgaatgggaatccaacggccaacccgaaaacaactacaaaaccaccccgcccgtcctcgactccgacggctccttcttcctctactcaaaactcaccgtggacaaatcccgatggcaacaaggcaacgtcttctcctgctccgtcatgcacgaagccctacacaatcactacacccaaaaatccctctccctctcgcccggcaaa

SEQ ID NO: 54194 - RNA, 1341 nt, synthetic construct
  misc_feature 1..1341: note = derived and/or modified sequence opt11 from Plozalizumab_HeavyChain1
  source 1..1341: mol_type = other RNA
gaagtccagctagttgaatcaggcggaggcctcgtcaaacccggcggatcactccgcctctcatgcgccgcctcaggcttcacattctccgcatatgccatgaactgggtccgacaagcccccggcaaaggcctagaatgggtcggccgcatccgtaccaaaaacaacaactacgccacctactacgccgactccgtaaaggaccgtttcaccatttcccgcgacgactcgaagaacacactatacctccaaatgaactccctcaaaactgaagacacagcagtatactactgcacaaccttctacggcaacggagtatggggccaaggcaccctagtaacagtctcatccgcatcaacaaaaggaccctccgtcttccccctcgcaccatcctccaaatcaacctccggcggcacggccgccctcggttgcctcgtcaaagactacttccccgaacccgttaccgtatcctggaacagcggcgccctcacctctggcgtccacaccttccccgccgtactccaaagctcaggcctatactcactctcctccgtcgtcaccgtcccatcctctagcctcggcacacaaacctacatctgcaacgtcaaccacaaaccctccaacaccaaagtagacaagaaagtagaacccaaatcatgcgacaaaacccacacatgccctccctgccccgcccccgaactcgcaggcgcaccctcagtcttcctctttcctccaaaacccaaagacaccctaatgatctcccgaacccccgaagtcacatgcgtcgtcgtagacgtctctcacgaagatccagaagtcaaattcaactggtacgtcgacggagtcgaagtccacaacgccaaaaccaaaccccgagaagaacaatacaactcaacctaccgagtcgtgtccgtcctcaccgtcttacaccaagactggctaaacggcaaagaatacaaatgcaaagtaagcaacaaagctctccccgcccccatagagaaaacaatctcaaaagccaaaggccaaccacgcgaaccccaagtatataccctgccaccctctcgcgacgaactcaccaaaaaccaagtctccctaacctgcctagttaaaggattctacccctccgacatcgcagtcgaatgggaatccaacggccaacccgaaaacaactacaaaaccaccccacccgtcctcgactcagacggcagcttcttcctatactcaaaactcaccgtagacaaatcccgctggcaacaaggaaacgtcttctcttgttccgtaatgcacgaagccctacacaaccactacacccagaaaagcctgtccctctcccccggaaag

SEQ ID NO: 54195 - RNA, 657 nt, synthetic construct
  misc_feature 1..657: note = derived and/or modified sequence opt11 from Plozalizumab_LightChain1
  source 1..657: mol_type = other RNA
gacgtagtcatgacccaatcacccctctcccttcccgtcaccctcggccaacccgcctccatctcatgcaaatcctcccaatccctactcgactccgacggcaaaaccttcctcaactggttccaacaacgccccggccaatcaccccgccgcctcatctacctcgtctccaaactcgacagcggcgtcccagaccgcttctcaggctccggctccggcaccgacttcaccctcaaaatctcccgcgtcgaagccgaagacgtcggcgtctactactgctggcaaggcacccacttcccatacacattcggccaaggcacccgactcgaaatcaaacgcaccgtcgccgccccctccgtcttcatcttcccaccctcagacgaacaactcaaatccggaacagcatccgtcgtctgcctcctaaacaacttctacccccgcgaagcaaaagtccaatggaaagtcgacaacgccctccaatccggcaactcccaagaatccgtaaccgaacaagactcaaaagactccacctactccctttcctccaccctcaccctctccaaagccgactacgaaaaacacaaagtctacgcctgcgaagtcacacaccaaggcctctcttcacccgtcaccaaatcattcaaccgcggcgaatgc

SEQ ID NO: 54196 - RNA, 1341 nt, synthetic construct
  misc_feature 1..1341: note = derived and/or modified sequence opt11 from Pogalizumab_HeavyChain1
  source 1..1341: mol_type = other RNA
gaagtccaactcgtccaatccggcgccgaagtcaagaaacccggagcctccgtcaaagtatcctgcaaagcctccggctacaccttcactgactcatacatgagctgggtcagacaagccccaggccagggactcgaatggatcggtgacatgtaccccgataacggcgattccagctacaaccaaaaattccgcgaacgagtcaccatcacccgcgacacctcaacaagcaccgcatacctcgaactctcctccctccgctccgaagacacagccgtttactactgcgtactcgctccccgatggtacttcagcgtatggggccaaggcaccttagtcaccgtctccagcgcctccacaaaaggcccctccgtattccccctcgcccccagcagcaaatccacctccggcggcacagccgccctcggatgcctcgtcaaagactacttccccgaacccgtaacagtcagctggaactcaggcgccctcacatccggagtccacacctttcccgccgtccttcaaagttccggcctctattccctatccagcgtagtcaccgtcccatccagctccctcggcacccaaacctacatctgcaacgtcaaccataaaccaagcaacactaaagtcgacaagaaagtcgaaccgaaatcttgcgacaaaacccacacctgtccaccctgccccgcccccgagctgctcggcggcccctccgtattcctcttcccacccaaacccaaagacaccctcatgatctcccgcacccccgaagtcacatgcgtagtcgtcgacgtctcacacgaagaccccgaagtaaaatttaactggtacgtcgacggagtcgaagtccacaatgccaaaaccaaaccccgagaagaacaatacaactcaacctaccgcgttgtctctgtcctcacagtcctccaccaagactggcttaacggcaaagaatacaaatgcaaagtctctaacaaagccctgcccgcccccatcgagaaaacaatcagcaaagccaaaggccaaccccgagaacctcaagtctacaccctcccaccctcaagagaagaaatgaccaaaaaccaagtctcactaacctgcctcgtaaaaggattctacccctccgacatagccgtcgaatgggaatccaacggccaacccgaaaacaactacaaaaccacacccccagtcctcgactcagacggctccttcttcctctactccaaactcaccgtcgacaaatcccgatggcagcagggcaacgtattttcttgctcagtaatgcacgaagccctccacaaccactacacccaaaaatcactctccctctcccccggaaaa

SEQ ID NO: 54197 - RNA, 642 nt, synthetic construct
  misc_feature 1..642: note = derived and/or modified sequence opt11 from Pogalizumab_LightChain1
  source 1..642: mol_type = other RNA
gacatccaaatgacccagtccccctcatccctatccgcctccgtcggcgaccgcgtaaccatcacatgccgcgcatcccaagacatctcaaactacctcaactggtaccaacaaaaacccggtaaagcccccaaactcctcatctactacacctcccgcctccgctccggcgtcccctcccgattctccggctccggctccggcaccgacttcaccctcaccatctcctccctccaacccgaagacttcgccacctactactgccaacaaggacacaccctcccacccaccttcggccaaggcaccaaagtcgaaatcaaacgcaccgtcgccgccccctccgtcttcatcttcccaccctccgacgaacaactcaaatccggcaccgcctccgtcgtatgcctactcaacaacttctacccccgcgaagccaaagtccaatggaaagtcgataacgccctccaatccggcaactcacaagaatccgtcaccgaacaagactccaaagactcaacctactctctctcctcaacccttaccctctccaaagcagactacgaaaaacacaaagtctacgcatgcgaagtcacccaccaaggactctcctcccccgttaccaaatccttcaaccgaggcgaatgc

SEQ ID NO: 54198 - RNA, 1341 nt, synthetic construct
  misc_feature 1..1341: note = derived and/or modified sequence opt11 from Polatuzumab_vedotin_HeavyChain1
  source 1..1341: mol_type = other RNA
gaagttcagctagtcgaatccggcggcggcctcgtccaacccggcggctctctacgactctcttgcgcagcctccggatacaccttctcctcatactggatcgaatgggtcagacaagcccccggtaaaggcctcgaatggatcggcgaaatcctacccggaggcggcgacaccaactacaacgaaatcttcaaaggccgcgccaccttttccgcggacacatccaaaaacacagcctacctccaaatgaactcactccgggcagaagacaccgccgtatactactgcacacgacgcgtccccattcgactggactactggggccaaggcacgctcgtcacagtctcctccgcctccacaaaaggaccctcagtcttccccctcgccccctcatcgaaatcaacctccggcggaaccgccgcactcggctgcctcgttaaagactacttccccgaaccagtcaccgtttcatggaacagcggagcattaaccagtggagtccacacattccccgcggtcctccaatcatctggcttgtactccctatcctccgtcgtaaccgtcccctcctcctccctaggcacccaaacgtacatctgcaacgtgaaccacaaaccttccaacaccaaagtcgacaagaaagtagaacccaaatcatgcgacaaaacacacacatgcccaccctgccccgccccagaactcctaggcggcccctcagtcttcctattcccacccaaacccaaagacaccctgatgatctcccgcacccccgaagtaacatgtgtcgtagtcgacgtctcccacgaagacccagaagtcaaattcaactggtacgtcgacggtgtggaagtccacaacgccaaaaccaaaccgcgagaagaacaatacaactccacctaccgcgtcgtctccgtactcactgtcctccaccaagactggctcaacggtaaagaatacaaatgtaaagtctccaacaaagcactccccgcccccatcgaaaagactatcagcaaagccaaaggacaaccccgtgaaccccaagtctacaccctcccaccctcccgcgaagaaatgaccaaaaaccaagtctcactcacatgcctagtcaaaggcttctacccctcagacatcgccgtcgaatgggaatcaaacggccaacccgaaaacaactacaaaacaaccccaccagtcctcgactccgacggctccttcttcctgtactccaaactcaccgtcgacaaatcccgatggcaacaaggcaacgtattctcctgctccgtcatgcacgaagcactgcacaatcactacacacaaaaatccctctccttatcacctggcaaa

SEQ ID NO: 54199 - RNA, 654 nt, synthetic construct
  misc_feature 1..654: note = derived and/or modified sequence opt11 from Polatuzumab_vedotin_LightChain1
  source 1..654: mol_type = other RNA
gacatccaactcactcaatccccctcctcccttagtgcctcagtcggcgaccgcgtcaccataacctgcaaagcatcacaatccgtcgactatgaaggcgactccttcctcaactggtaccaacaaaaacccggcaaagcccccaaactcctcatctacgccgcctcaaacctcgaatccggcgtaccctcccgattctccggctccggctccggcacagacttcaccctcaccatctcctccctccaacccgaagacttcgccacatactattgccaacaatccaacgaagaccccctcaccttcggccaaggcaccaaagtagaaatcaaacgcaccgtcgccgccccctccgtcttcatcttcccaccctccgacgaacaactaaaatccggcaccgcctcagtcgtctgcctcctcaacaacttctacccccgcgaagccaaagtccaatggaaagtagacaacgccctccaatccggcaactcccaagaatccgtcaccgaacaagactccaaagactccacatactcactatcctcaactctcaccctctccaaagccgactacgaaaaacacaaagtctacgcctgcgaagtcacccaccaaggactctcctcccccgtcaccaaatccttcaaccgcggcgaatgc

SEQ ID NO: 54200 - RNA, 1326 nt, synthetic construct
  misc_feature 1..1326: note = derived and/or modified sequence opt11 from Ponezumab_HeavyChain1
  source 1..1326: mol_type = other RNA
caagtccagctcgtacaatcaggcgccgaagtaaagaaacccggcgcctccgtcaaagtctcctgcaaagcatccggctactacaccgaagcatactacatacactgggtccgacaagcccccggccaaggactcgaatggatgggccgcatcgaccccgccacaggcaacactaagtacgcccccagactccaagaccgggtcaccatgacccgcgatacatccacctcaaccgtctacatggaactaagctcactaagatccgaagacaccgcagtctactactgcgcttccctctactccctcccagtctattggggccaaggcaccacagtcaccgtctcatccgcaagcaccaaaggcccatccgtcttccccctcgcaccctgctctcgatcaacctccgaatccaccgccgccctcggctgcctcgtcaaagactacttccctgaacctgtaaccgtcagctggaactcaggcgcactaacatccggagtccacacatttcccgccgtcctacaaagctccggcctctattctctctcctcagtcgttacagtaccttcctccaacttcggaacccaaacatacacctgtaacgtcgaccacaaaccctccaacaccaaggttgacaaaacagtcgaacgtaaatgctgcgtcgaatgcccaccctgccccgctcccccagtcgccggcccctcagtattcctgtttcctccaaaacccaaagacacactcatgatctcccgaacccccgaagtcacttgcgtcgtagtggacgtctcacacgaagaccccgaagtccaattcaactggtacgtcgacggcgtcgaagtacacaacgcaaaaacaaaaccccgcgaagaacaattcaactcgaccttccgagtagtctcagtcctcacagtagtacaccaagactggttaaacggaaaagaatacaaatgcaaagtctcaaacaaaggcctcccctccagcatcgagaaaaccatctccaaaaccaaaggccaaccccgcgaaccacaagtctacacactcccaccctcacgcgaagaaatgaccaagaaccaagtctccctaacctgcctcgtcaaaggcttctacccctcagacatcgcagtcgaatgggaaagcaacggccaacccgaaaataactacaaaacaacacctcccatgctcgactccgacggatccttcttcctctactccaaactaaccgtcgacaaatcacgctggcaacaaggtaacgtcttctcatgctcagtcatgcacgaagccctacataatcactacacccaaaaatcactatccctatcccccggcaag

SEQ ID NO: 54201 - RNA, 657 nt, synthetic construct
  misc_feature 1..657: note = derived and/or modified sequence opt11 from Ponezumab_LightChain1
  source 1..657: mol_type = other RNA
gacgtcgtaatgacccaatcacccctctccctcccagtcaccctcggccaacccgcctccatctcctgcaaatcctcccaatcccttctctactccgacgccaaaacctacctcaactggttccaacaacgccccggacaatctccccgccgactcatctaccaaatctcccgactcgacccaggagtccccgaccgcttctccggctcaggctccggcaccgacttcaccctcaaaatatcccgcgtcgaagccgaagacgtcggcgtctactactgcctccaaggaacccactaccccgtcctcttcggacaaggcacccgactcgaaattaaacgcaccgttgccgccccctccgtcttcatcttcccaccctcagacgaacaactaaaatccggcaccgcctccgtcgtctgcctactaaacaacttctacccccgcgaagccaaagtccaatggaaagtcgataacgccctccaatccggcaactcacaagaatccgtcacagaacaagactccaaagactccacctactccctctcctccaccctaacactctccaaagccgactatgaaaaacacaaagtctacgcctgcgaagtcacccaccaaggcctctcctcccccgtcaccaaatccttcaaccgaggcgaatgc

SEQ ID NO: 54202 - RNA, 1362 nt, synthetic construct
  misc_feature 1..1362: note = derived and/or modified sequence opt11 from Pritoxaximab_HeavyChain1
  source 1..1362: mol_type = other RNA
caagtccagctccaagaatccggcgcagaactcgtccgctccggagcctcagtacgcatgtcctgcaaagcctcaggctacaccttcacatcctacaacatgcactgggtcaaacaaacccctggccaaggactagaatggataggctacatttaccccggcaacggcggcaccaactacatccaaaaattcaaaggaaaagccatcctaaccgcagacacttcttcctctaccgcatacatgcaaatctcatcactaacctccgaagactcagccgtctacttctgcacccgctccccatctcactactcctcagacccctacttcgactactggggccagggcaccaccctaaccgtctcctctgagttcgcctccacaaaaggtccgtccgtcttcccactagccccctcctccaaatccacctccggcggcacagccgcccttggctgcctagtcaaagactactttcccgaacccgtcacggtctcctggaactccggtgccttaacctcaggcgtacacaccttcccagccgtcctccaatcctctggcctctactccctctcctcggtagtcaccgtcccctcctcctcactcggcacacagacctacatctgcaacgtcaaccacaaaccctcaaacacaaaagtagacaagaaagtagaaccaaaatcctgcgacaaaacccacacatgcccaccctgcccagccccagaactcctcggcggaccatccgtattcctatttcctcccaaacccaaagacaccctaatgataagccgcacccccgaagtaacctgcgtcgtcgtcgacgtatcacacgaagacccagaagtcaaattcaactggtacgtcgacggcgtcgaagtacacaacgcaaaaaccaaacctcgcgaagaacaatacaactccacataccgcgttgtctcagtcctcacagtcctccaccaagactggctcaacggcaaagaatacaaatgcaaagtctccaacaaagccctccccgcccccatcgaaaagaccatctccaaagccaaaggtcagccccgagaaccccaagtctacaccctacccccatcccgcgacgaactaaccaaaaatcaagtctcactaacatgcctcgtcaaaggcttctacccaagcgacatcgcagttgaatgggaatccaacggccaacccgaaaacaactacaaaacaacccctcccgtcctcgattctgatggatcattcttcctatactccaaactaacagtagacaaatctcgctggcaacaaggaaatgtcttctcctgctccgtcatgcacgaagccctccacaaccactacacccagaaatccctctcactctcacccggaaaa

SEQ ID NO: 54203 - RNA, 642 nt, synthetic construct
  misc_feature 1..642: note = derived and/or modified sequence opt11 from Pritoxaximab_LightChain1
  source 1..642: mol_type = other RNA
gacatcgtcatgtcccaatctcacaaattcatgtcaacctccgtaggagaccgagtctccataacctgcaaagcctcccaagacgtcggcaccgccgtcgcctggtaccaacaaaaccccggacaatcccccaaattcctcatctactgggcctccacccgccacaccggagtccccgaccgattcacaggctcaggctcaggcaccgacttcaccctcaccatcaccaacgtccaaagcgaagacctcgccgactacttctgccaacaatactcctcataccccctcaccttcggcgccggcacctccctcgaactcaaacgcaccgtcgccgccccctccgtattcatcttcccaccctccgacgaacaactcaaatccggcaccgcctccgtcgtctgcctcctcaacaacttctacccccgcgaagccaaagtccaatggaaagtcgacaacgccctccaatccggcaactcccaagaatccgtaaccgaacaagactctaaagactccacctactcactctcctccaccctcacactatccaaagccgactacgaaaaacacaaagtctacgcctgcgaagtcacccaccaaggcctctcctcacccgtcaccaaatccttcaaccgcggcgaatgc

SEQ ID NO: 54204 - RNA, 1350 nt, synthetic construct
  misc_feature 1..1350: note = derived and/or modified sequence opt11 from Pritumumab_HeavyChain1
  source 1..1350: mol_type = other RNA
gaagtccaactcctagaatcgggcggcgacctcgtccaacccggtggatccctccgcctttcatgcgccgcatccggattcacattcagcaactacgccatgagctgggtccgccaagcccccggcaaaggactcgaatgggtaagcgccataacaccctccggcggctcaaccaactacgccgactccgtcaaaggccgcttcaccatatcgcgcgacaactcacaaaacactctatacctccaaatgaacagccttcgcgtcgaagacaccgcagtctacatatgcggcagagtgccctaccgatcaacctggtaccccctctactggggccaaggaaccctcgtcaccgtctcatccgcatcgaccaagggaccgtcagtattcccactagccccctcctccaaatccaccagcggcggaaccgcagccctcggctgcctagtcaaagactacttccccgaacccgtcaccgtctcctggaactccggagccctcacgagcggcgtccacaccttccccgccgtactccaatcttcaggactctactccctatcatccgtcgtcaccgttccctcctcatcactcggaacccaaacctacatctgcaacgtcaaccacaaaccctctaacaccaaagtagacaagaaagtagagccaaaatcctgcgacaaaacccacacatgcccaccctgccccgcccccgaactcctaggcggcccctccgtattcctctttcccccaaaacccaaagacaccctcatgatctcccgcacaccagaagtgacctgcgtcgtcgtcgacgtctctcacgaagatccggaagtaaaattcaactggtacgtcgacggcgtcgaagtccacaacgcgaaaactaaaccacgcgaagaacaatacaactccacctaccgcgtagtatctgtcctcactgtactacaccaagactggctcaacggaaaagaatacaaatgcaaagtctccaacaaagccctccccgcaccaatcgagaaaacaatctccaaagctaaaggccaaccccgcgaaccccaggtatacacccttccaccctcccgagacgagctcaccaaaaatcaagtctccctaacctgcctcgtaaaaggcttctacccctccgacatcgccgtagaatgggaatccaacgggcaacccgaaaacaactacaaaaccactccccctgtcctcgactccgacggcagcttcttcctttactcaaaactaaccgtcgataaaagcagatggcaacaaggcaacgtgttctcatgctcagtcatgcatgaagcactccacaaccactacacccagaaaagcctctccctctcccccggaaaa

SEQ ID NO: 54205 - RNA, 642 nt, synthetic construct
  misc_feature 1..642: note = derived and/or modified sequence opt11 from Pritumumab_LightChain1
  source 1..642: mol_type = other RNA
gacatccaaatgacacagtccccctcctccctctccgcctccgtcggagaccgcgtcaccatcacctgccgcgcctcccaagacatctccaactacctcgcctggttccaacaaaaacccggcaaagcccccaaatccctaatatacgccgcctcctccctccactccaaagtccccacccaattctccggctctggctccggcaccgacttcaccctaaccatctcctccctccaacccgaagacttcgccacatactattgcctccaatactccacctaccccatcaccttcggcggaggcaccaaagtcgaaatcaaacgcaccgtcgccgcaccctccgtcttcatcttccccccctccgacgaacaactcaaatccggcaccgcctccgtagtctgcctcctcaacaacttctacccccgcgaagccaaagtccaatggaaagttgacaacgccctccaatccggcaactcccaagaatccgtcaccgaacaagactccaaagactccacctactccctatcctccaccctcaccctatccaaagccgactacgaaaaacacaaagtctacgcctgcgaagtaacccaccaaggcctctcctcccccgtcaccaaatccttcaaccgtggcgaatgc

SEQ ID NO: 54206 - RNA, 1341 nt, synthetic construct
  misc_feature 1..1341: note = derived and/or modified sequence opt11 from Quilizumab_HeavyChain1
  source 1..1341: mol_type = other RNA
gaagtccaactcgtagaatcaggcggcggcctcgtccaacccggcggatccctccgcctctcatgcgcagcctccggcttcaccttctctgactacggcatcgcctgggtccgacaagccccaggcaaaggcctggaatgggtcgccttcatttcagaccttgcctataccatatactacgccgacaccgtaaccggcagattcacaataagccgcgacaattccaaaaacaccctctacctccaaatgaactcactccgagccgaagacaccgctgtctactactgcgcccgagacaactgggacgccatggactactggggccaaggcacactcgtcaccgtctcctccgccagcaccaaaggcccatcagtgttccccctcgcaccgtcaagcaaatctacctccggcggcaccgcagccctcggctgcctcgtcaaagactacttccctgaacccgtcaccgtcagctggaactcaggcgccctcacatccggagtccacaccttccccgccgtcctccaatcctccggcctatacagcctcagctctgtcgtcactgtcccctcctcctccctcggcacacaaacatacatatgcaacgtcaaccataaaccctccaacacaaaagtcgacaagaaagtcgaacccaaatcctgcgacaaaacccatacctgcccaccctgccccgcccccgaactactcggcggccccagcgtcttcctcttcccacccaaacccaaagacaccctaatgatctcccgcacccccgaagtaacatgcgtcgtcgtcgacgtctcccacgaagaccccgaagtaaaattcaattggtacgtcgacggagtcgaagtccacaacgccaaaaccaaaccccgcgaagaacagtataacagcacataccgcgtcgtctccgtactaaccgtcctccaccaagactggctcaacggaaaagaatacaaatgcaaagtgtccaacaaagccctccccgccccaatcgaaaagacaatcagcaaagccaaaggccaaccacgcgaaccgcaagtttacacactaccaccatctcgcgaagaaatgaccaaaaaccaagtctctctaacatgcctcgtcaaaggcttctacccctccgacatcgccgtagaatgggagtccaacggccaaccagaaaacaactacaaaacaacccctcccgtcctcgactcagacggctcattcttcctatactcaaaacttaccgtcgacaaatcccgttggcaacaaggaaacgtcttcagctgctcagtcatgcacgaagcccttcacaatcactacacacaaaaatccttatctctctcccccggaaaa

SEQ ID NO: 54207 - RNA, 657 nt, synthetic construct
  misc_feature 1..657: note = derived and/or modified sequence opt11 from Quilizumab_LightChain1
  source 1..657: mol_type = other RNA
gacatccaaatgacccaatccccctcctccctctccgcctcagtcggcgaccgcgtcaccatcacttgccgctcctcacaatccctcgtacacaacaacgccaacacctacctacactggtaccaacaaaaacccggcaaagcccccaaactcctcatctacaaagtctccaaccgcttctccggcgtaccctcccgcttctcaggctccggatccggcaccgacttcacactaaccatctcctcactccaacccgaagacttcgccacctactactgctcccaaaacaccctcgtcccctggacattcggacaaggcaccaaagtcgaaatcaaacgcaccgtcgccgccccctccgtcttcatcttcccaccctccgacgaacaactcaaatccggcacagcctccgtcgtctgcctactcaacaacttctacccccgcgaagccaaagtccaatggaaagtcgataacgccctccaatccggcaactcacaagaatccgtcaccgaacaagacagcaaagactccacctactccctatcatccaccctaaccctctccaaagccgactacgaaaaacacaaagtctacgcctgcgaagtaacccaccaaggcctctcctcccccgtcaccaaatccttcaaccgcggcgaatgc

SEQ ID NO: 54208 - RNA, 1335 nt, synthetic construct
  misc_feature 1..1335: note = derived and/or modified sequence opt11 from Racotumomab_HeavyChain1
  source 1..1335: mol_type = other RNA
caagtacaacttcaacaatccggcgccgaactcgttaaacccggagcctccgtcaaactcagctgcaaagcctccggctacactttcacatcctacgacatcaactgggtccgacaacgccccgaacaaggcctcgaatggataggctggatcttccccggcgacggctcaactaaatacaacgaaaaattcaaaggcaaagccaccctcaccaccgacaaatcctccagcaccgcttacatgcaactctcccgcctcacctcagaagactccgcagtctacttctgcgcccgcgaagactactacgacaactcctactacttcgactactggggccaaggcaccacccttaccgtctcttccgccaaaaccacaccaccctcagtctaccccctcgcccccggctctgccgcccaaaccaattccatggtaaccctcggctgcctcgtcaaaggctacttccccgaacccgtcacagtcacctggaactccggctcactctcatccggcgtccacaccttcccagcagttctgcaatccgacctatacaccctctcatcctccgtcacagtcccctcatcaccccgcccaagcgaaacagtaacctgcaacgtcgcgcaccccgcatcctcaacaaaggttgacaagaaaatagtcccccgcgactgcggctgcaaaccctgcatctgcaccgtacccgaagtatcatccgtcttcatctttccacccaaacccaaagacgtccttaccatcactctcaccccaaaagtaacctgcgtcgtcgtcgacataagcaaggacgaccctgaagtccaattctcctggttcgtcgacgacgttgaagtccacaccgcccaaacacaaccccgtgaagaacaattcaactccaccttccgctccgtctccgagctaccaatcatgcaccaagactggctcaacggaaaagagttcaagtgcagagtcaactccgctgccttccccgccccgatcgagaaaacaatctccaagacaaaaggccggcccaaagcaccccaagtctacaccatcccaccacccaaagaacaaatggccaaagacaaagtctccctcacatgcatgatcaccgactttttccccgaagacatcaccgtagaatggcaatggaacggccaacccgccgaaaactacaaaaatacccaacccatcatgaacacaaacggatcttacttcgtctactccaaactaaacgtccaaaaatccaactgggaagccggtaatacatttacctgctccgtcctacacgaaggactacacaaccatcacaccgaaaaatccctttcacactcccccggcaaa

SEQ ID NO: 54209 - RNA, 642 nt, synthetic construct
  misc_feature 1..642: note = derived and/or modified sequence opt11 from Racotumomab_LightChain1
  source 1..642: mol_type = other RNA
gacatacaaatgacccaaaccacctcatccctctcagcctccctcggcgaccgcgtaaccatctcctgccgcgcctcccaagacatctccaactacctcaactggtaccaacaaaaacccgacggcaccgtcaaactcctaatctactacacctcccgcctccactccggcgtcccctcccgattctccggatccggctccggcaccgactactccctcaccatctcaaacctcgaacaagaagacatcgccacttacttctgccaacaaggcaacaccctaccctggaccttcggaggcggcaccaaactagaaatcaaacgagccgacgccgcccccaccgtctccatattcccaccctcctccgaacaactcacctccggcggcgcctccgtcgtatgcttcctcaacaacttctaccccaaagacatcaacgtcaaatggaaaatcgacggctccgaacgacaaaacggcgtactcaactcctggaccgaccaagacagcaaagactccacctactccatgtcatcaaccctcacactcaccaaagacgaatacgaacgtcacaactcctacacatgcgaagcaacccacaaaacctccacctcccccatagtcaaatccttcaaccgcaacgaatgc

SEQ ID NO: 54210 - RNA, 1089 nt, synthetic construct
  misc_feature 1..1089: note = derived and/or modified sequence opt11 from Racotumomab_scVH-VH'-VH_chain
  source 1..1089: mol_type = other RNA
gaggtccagctagtagaatcaggaggaggcctggtccagcccggaggctcgctaaggctctcgtgcgcggcctcaggattcaccttcagcgactactggatgtactgggtgcgccaggccccgggaaagggcttagaatgggtctcggaaataaacacgaacgggctcataacaaagtacccggactcggtcaaaggcagattcacgatctcacgcgacaacgcgaaaaacaccctgtacctacaaatgaactcgctaaggcccgaagacacggccgtgtattactgcgcgcgcagtccctcaggcttcaacaggggccagggaacgctcgtaaccgtgagctcgggagggggcgggagcgggggcgggagtgaggtacagctggtagaatcgggtggaggactggtccagccaggaaattcgctaagactatcttgcgcggcatcagggttcaccttcagctcgttcggaatgagctgggtgagacaagccccgggtaagggcttggaatgggtttcgagcataagcggaagcgggagcgacacactgtatgcggactcggtcaagggccgattcacaatcagccgcgacaacgcgaaaacgactctgtacttgcaaatgaactcactccggcccgaggacacggccgtgtactactgcacaatcgggggctcgctatcgagatcaagccagggcacgctcgtgacggtaagctccggcgggggaggaagcgggggcgggagcgaggtccagctagtggaatcgggcgggggattggttcagcccgggggctcgcttagactctcgtgcgcggcctcaggattcaccttcagtgactactggatgtactgggtgcgccaagccccaggcaaaggcttagaatgggtctcggaaattaacacaaacgggctcatcacaaagtacccagactcggtcaagggcagattcacgatctcgcgcgataacgcgaaaaacaccctgtacctgcaaatgaactcgctcagaccagaggacacggcagtatactattgcgcacgctcaccctcaggcttcaacagaggccagggcacgctagtgaccgtaagctcg

SEQ ID NO: 54211 - RNA, 1071 nt, synthetic construct
  misc_feature 1..1071: note = derived and/or modified sequence opt11 from Radretumab_HeavyChain1
  source 1..1071: mol_type = other RNA
gaagtccaactcctcgaatccggaggcggtctcgtccaacccggcggctcactccgactatcctgcgccgcctctggcttcaccttctcatccttctcaatgtcatgggtccgccaagcccctggcaaaggccttgaatgggtatcgtccatatccggaagctccggaacaacctactacgccgactccgtcaaaggaaggttcacaatatcccgcgacaactccaaaaacaccctctacctccaaatgaactcactacgcgccgaagacacagccgtatactactgcgcaaaacccttcccatacttcgactactggggacaaggcaccctagtcaccgtctctagcggcgacggctcctcaggaggctcaggcggcgcctccgaaatcgtcctaacacaatcacccggaaccctcagcttaagccccggcgaacgcgccacactctcctgccgcgcttcccaatccgtctcctcttccttcctagcatggtaccaacaaaaacccggccaagccccacgactcctaatatactacgcctcctcccgagccaccggcatcccagaccgcttctcaggcagcggatccggcaccgacttcacactcacaatctctcgcctcgaaccagaagacttcgccgtctactactgccaacagaccggccgcatccctcccaccttcggccaaggcacaaaagtcgaaatcaaatctggaggctccggcggcccacgcgccgcacccgaagtttacgccttcgccacccccgaatggcccggatcccgcgacaaacgcaccctagcctgcctaatccaaaacttcatgcctgaagacatctctgtacaatggctccacaacgaagtacaactgcccgacgcccgccactcaaccacccaaccccgaaaaacaaagggctccggcttcttcgtcttctcccgcctggaagtcaccagagccgaatgggaacaaaaggacgaattcatctgccgagccgtacacgaagccgcctccccctcacaaaccgtccaacgcgccgtcagcgtcaaccccgaatccagccgccgaggaggctgc

SEQ ID NO: 54212 - RNA, 414 nt, synthetic construct
  misc_feature 1..414: note = derived and/or modified sequence opt11 from Radretumab_j_chain
  source 1..414: mol_type = other RNA
ggcgacgacgaagccaccatcctcgccgacaacaaatgcatgtgcacccgcgtaacctcccgcatcatcccctccacagaagaccccaacgaagacatcgtcgaacgcaacatccgcatcgtcgtccccctcaacaaccgcgaaaacatatccgaccccacctcccccctccgccgcaacttcgtctaccacctctccgacgtctgcaaaaaatgcgaccccgtcgaagtcgaactcgaagaccaagtcgtcaccgccacccaatccaacatctgcaacgaagacgacggagtccccgaaacctgctacatgtacgaccgcaacaaatgctacaccaccatggtccccctccgctaccacggcgaaaccaaaatggtccaagccgccctcacccccgactcctgctaccccgac

SEQ ID NO: 54213 - RNA, 1368 nt, synthetic construct
  misc_feature 1..1368: note = derived and/or modified sequence opt11 from Rafivirumab_HeavyChain1
  source 1..1368: mol_type = other RNA
caagttcaactcgtccaatcaggcgccgaggtaaagaaacctggctcatccgtaaaagtatcctgcaaagcctccggaggtaccttcaatcgatacaccgtcaactgggtccgccaagcacccggccaaggactggaatggatgggcggcatcatcccaatattcggcaccgccaactacgcacaacgcttccaaggccgactcacaatcaccgcagacgaatcaacatccacagcctacatggaactctctagccttcgctccgacgacacagccgtctacttctgcgctcgagaaaacctcgacaactctggcacctactactacttctccggatggttcgacccctggggccaaggaaccctagtcacagtctccagcgcctcaacaaaaggaccatccgtattccccttagccccctcatccaaatcaacatccggaggcacagccgcactaggatgcctagtcaaagactacttcccagaacccgtaaccgtctcctggaactcaggcgctctcaccagcggagtccacacattccccgctgtacttcaatcatcaggcctctacagcctctcctccgtcgtcacagtcccctcctcatccctaggaacccaaacctacatatgcaacgtaaatcacaaaccttccaacaccaaggtagacaaacgagtcgaacccaagtcatgcgacaaaacccatacctgcccaccctgccccgcccccgaactactcggcggcccctcagttttcctattcccacccaaacccaaagatactctaatgatctcacgcacacccgaagtaacctgcgtcgtcgtcgacgtcagccacgaagaccccgaagtcaaattcaactggtacgtcgatggagtcgaagtccacaacgcaaaaaccaaaccccgagaagaacagtacaactccacatacagagtagtctccgtactcacagtcctacaccaagactggctcaacggaaaagaatacaaatgcaaagtatcaaacaaagccctccccgctcccatagagaaaacaatatccaaagcaaaaggacaaccccgagaaccccaagtctacaccctaccaccctcccgagaagaaatgaccaagaaccaagtgtcgctcacatgcctcgtcaaaggcttctatccctcagacatcgccgtcgaatgggaatccaatggccaacccgaaaacaactataaaaccacacccccagtcctggactcagacggctcctttttcctctactccaaactaaccgtagacaaatccagatggcaacaaggaaacgtattctcctgctccgtcatgcacgaagccctccacaaccactacacccagaaatccctctccctaagccccggc

SEQ ID NO: 54214 - RNA, 1368 nt, synthetic construct
  misc_feature 1..1368: note = derived and/or modified sequence opt11 from Rafivirumab_HeavyChain
  source 1..1368: mol_type = other RNA
gaagtccaactcgtccaatccggcgccgaagtcaagaaacccggctccagcgtcaaagtatcgtgcaaagcatcaggcggaaccttcaaccgctacacagtaaactgggtccgacaagcacccggccaaggtctcgaatggatgggaggcatcatacccattttcggcaccgccaactacgcccaacgcttccaaggacgcctaaccatcaccgccgacgaatccacctccacagcatacatggaactctcctcactccgaagcgacgacaccgccgtctacttctgcgcccgcgaaaacctcgacaactcgggaacctactactacttctccggctggttcgacccctggggtcaaggcaccctcgtcaccgtcagctccgcctctaccaaaggcccctctgtattccccctcgccccatcaagcaaatccacatcaggcggcaccgccgcactaggctgcctagtcaaagactacttccccgaacccgtaacagtctcctggaactccggcgccctcacaagcggcgtccacaccttccctgccgtcctccaatcctccggactatattctctctcttccgtcgtaactgtaccctcctcctcactcggcacccaaacatatatctgtaacgtcaaccacaaaccctccaacaccaaagtcgacaaacgcgtcgaacccaagtcctgcgacaaaacccacacctgtccgccctgccccgcccccgaactactcggcggcccctcagtcttcctatttcccccaaagcccaaagacaccctcatgatctcccgcacgcccgaagtcacatgcgtcgtcgtcgacgtatctcacgaagacccagaagtcaaattcaactggtacgtcgacggagtcgaagtccacaacgccaaaaccaaaccccgcgaagaacaatacaactccacctaccgcgttgtctctgtcctcacagtactccaccaagactggcttaacggcaaagaatacaaatgcaaagtctcaaacaaagctctccccgcccctatcgagaaaacaatcagcaaagccaaaggacaacccagggaaccacaagtctacaccctacccccatctcgcgaagaaatgaccaaaaaccaagtatccctaacatgcctagtcaaaggattctacccctccgacattgccgtagaatgggaatccaacggccaacccgaaaacaactacaaaacaacacctcccgttcttgactcggacggctccttcttcctctactccaaactcacagtcgacaaatcccgatggcaacaaggcaacgtattctcctgctcagtcatgcatgaagcccttcacaaccactacacccaaaaatcactctccctcagccccgga

SEQ ID NO: 54215 - RNA, 654 nt, synthetic construct
  misc_feature 1..654: note = derived and/or modified sequence opt11 from Rafivirumab_LightChain1
  source 1..654: mol_type = other RNA
caatcagcactcacccaaccccgctccgtcagcggatcccccggacaatccgtcaccatctcctgcaccggcacctcatccgacatcggcggctacaacttcgtctcctggtaccaacaacaccccggaaaagcacccaaactcatgatctacgacgcaaccaaacgcccctccggcgtccccgaccgcttctccggatccaaatccggcaacaccgcctcactcaccatctccggcctccaagccgaagacgaagccgactactactgctgctcctacgccggcgactacactccaggagtcgtcttcggcggcggcaccaaactcaccgtcctcggacaacccaaagccgcaccatcagtcaccctattccccccctcctccgaagaactccaagcaaacaaagccaccctcgtctgcctcatctctgacttctaccccggcgccgtaaccgtcgcctggaaagccgactcctcccccgtaaaagccggcgtcgaaaccacaacacccagcaaacaatcaaacaacaaatacgccgcctccagctacctatccctaacccccgaacaatggaaatcccaccgatcatactcctgccaagtcacacacgaaggatcaaccgtcgaaaaaaccgtcgcccccaccgaatgctcc

SEQ ID NO: 54216 - RNA, 654 nt, synthetic construct
  misc_feature 1..654: note = derived and/or modified sequence opt11 from Rafivirumab_LightChain
  source 1..654: mol_type = other RNA
gaaagcgcactcacccaaccccgctcagtctccggatcgcccgggcaatccgtcacaatctcctgcacaggcacatcctccgacatcggcggctacaacttcgtcagctggtaccaacaacaccccggaaaagcacccaaactcatgatctacgacgccaccaaacgcccctccggagtcccagaccgcttctccggatcaaaatccggcaacaccgcctccctaaccatctccggactccaagccgaagacgaagccgactactactgctgcagctacgccggcgactacacacccggcgtcgtcttcggcgggggcacaaaactcacagtcctcggacaacccaaagccgccccttccgtcacccttttcccaccctcaagcgaagaactacaagccaacaaagccaccctcgtctgcttaatctcggacttctaccccggcgccgtcaccgtagcctggaaagccgacagctcacccgtcaaagccggcgtcgaaaccaccacaccctccaaacaaagcaacaacaaatacgcagcatcaagctacctctccctcacccccgaacaatggaaatcccaccgaagctacagctgccaagtcacccacgaaggcagcacagtcgaaaaaaccgtcgccccaaccgaatgcagc

SEQ ID NO: 54217 - RNA, 1332 nt, synthetic construct
  misc_feature 1..1332: note = derived and/or modified sequence opt11 from Ralpancizumab_HeavyChain1
  source 1..1332: mol_type = other RNA
caagtccaactcgtccaatccggagccgaagtcaagaaaccaggcgcctcagtcaaagtctcctgcaaagcctcaggctacaccttcacctcttactacatgcactgggttcgtcaagcccccggccagggactagaatggatgggcgagatacacccctccggaggccgcacaaactataacgaaaaattcaaatcacgcgtcactatgacccgagacacctcgacctccaccgtctatatggaactctcctccctccgttccgaagacacagccgtctactactgcgcccgtgaacgacccctctacgcctcagacctatggggacaaggcacaacagtcaccgtctcatccgcatccacaaaaggcccttcagtcttccctctagccccgtgctcccgttcgaccagcgaatccaccgcagccctcggctgcctcgtaaaagactacttcccagaacccgtcaccgtatcatggaactctggagccctaacctccggcgtacacaccttccccgccgtcctccaatcctccggactctactcattatcctccgtcgtcaccgtaccatcatcaaacttcggcacccaaacctatacctgcaacgtagaccataaaccctccaacaccaaagtcgacaaaacagtagaacgcaaatgctgcgtagaatgcccaccctgtcccgcaccaccggtagccggaccctccgttttcctcttcccacccaaacccaaggacaccctcatgatctcccgcacccccgaagtaacctgcgtcgtcgtcgacgttagccacgaagaccccgaagtgcaattcaactggtacgtcgacggcgtcgaagtccacaacgcaaaaaccaaacctcgcgaggaacaattcaactccaccttccgcgtagtctcagtactcacagtcgtccaccaagactggctaaacggcaaagaatacaaatgcaaagtctccaacaaaggactccccagctctatcgagaaaaccatatcaaaaaccaaaggccagccccgagaaccccaagtctacacactcccaccctcccgagaagaaatgaccaaaaatcaagtctcactaacctgcctagtaaaaggcttctacccctccgacatcgccgtcgaatgggaatcaaacggccaacccgaaaacaactacaaaacaacgcccccaatgctcgactcggacggctccttcttcctctactccaaactcaccgtcgacaaatcacgctggcaacaaggcaacgtcttctcgtgctccgttatgcacgaagccctccacaaccactacacccaaaaatcactttccctctccccaggaaaa

SEQ ID NO: 54218 - RNA, 642 nt, synthetic construct
  misc_feature 1..642: note = derived and/or modified sequence opt11 from Ralpancizumab_LightChain1
  source 1..642: mol_type = other RNA
gacatccaaatgacacaatccccctcctccctctccgccagcgtcggcgaccgcgtcaccataacctgcaaagcctcccaagacgtccacaccgcagtcgcctggtaccaacaaaaacccggcaaagcccccaaactcctaatctaccacgcctcctaccgatacaccggcgtcccctcccgcttctccggctcaggctcaggcaccgacttcaccttcaccatctcatccctccaacccgaagacatcgccacctactactgccaacaacgctactcactctggcgaaccttcggccaaggcaccaaactcgaaatcaaacgcaccgtcgccgccccctccgtattcatcttcccaccctccgacgaacaactcaaatccggcaccgcctccgtcgtctgcctactcaacaacttctacccccgcgaagccaaagtccaatggaaagtcgacaacgccctccaatccggcaactcgcaagaatccgtcaccgaacaagactccaaagactccacctactcactctcctccacccttaccctctccaaagccgactacgaaaaacacaaagtctacgcctgcgaagtcacccaccaaggactctcatcccccgtcaccaaatccttcaaccgcggcgaatgc

SEQ ID NO: 54219 - RNA, 1338 nt, synthetic construct
  misc_feature 1..1338: note = derived and/or modified sequence opt11 from Ramucirumab_HeavyChain1
  source 1..1338: mol_type = other RNA
gaagtccaactcgtacaatccggcggcggcctcgtaaaacctggcggatcattacgcctatcatgcgcagcctcaggcttcaccttctcatcgtactcaatgaactgggtacgacaagcccccggcaaaggcctcgaatgggtctcctccatctcatcctcctcctcctacatctactacgccgactccgttaaaggccgattcaccatcagccgcgacaacgcgaaaaactcactctacctccaaatgaactcactccgcgccgaagacaccgccgtatattactgtgcccgcgtcacagacgcctttgacatctggggacaaggcaccatggtcaccgtcagctcagcttccacaaaaggaccctcagtcttcccactcgcaccaagctccaaaagcaccagcggaggcaccgcggcacttggctgcctcgtcaaagactacttccccgaacccgtcactgtctcctggaactccggcgcactaaccagcggcgtacatacattccccgccgtcctccaaagctccggcctctactcgctatcctccgtcgtcacagtcccctcatcctccctcggcactcaaacctacatctgcaacgtaaaccataaaccctccaacaccaaagtcgacaagaaagtcgaacccaaaagctgcgacaaaacccacacctgtccaccctgccccgcccccgaactcctcggcggcccctccgtattcctcttccctcccaagcccaaagacacccttatgatttccagaacccccgaagttacctgcgtcgtagtagacgtctcacacgaggaccccgaagtcaaattcaactggtacgttgacggcgtagaagtacacaacgccaaaaccaaaccccgcgaggaacaatacaactcaacctacagagtcgtatcagttctcaccgtcctccaccaagactggctaaacggcaaagaatacaagtgcaaagtctccaacaaggccctcccagcacccatcgagaaaaccatctccaaagctaaaggtcaaccccgcgaaccccaggtctacaccctcccaccctcccgcgaagaaatgaccaagaaccaagtttccctcacatgtctagtcaaaggattctacccctccgacatcgccgtagaatgggaatctaacggccaaccagaaaacaactacaaaaccacaccacccgtactcgactccgacggatccttcttcctctattccaaactcaccgtagataaaagccgctggcaacaaggaaacgtgttctcttgctccgtaatgcacgaagcactccacaaccactatacacaaaaatcactatccctctcacccgggaaa

SEQ ID NO: 54220 - RNA, 642 nt, synthetic construct
  misc_feature 1..642: note = derived and/or modified sequence opt11 from Ramucirumab_LightChain1
  source 1..642: mol_type = other RNA
gacatccaaatgacacaatccccctcttccgtctccgcatccatcggcgaccgcgtcaccatcacctgccgcgcctcccaaggcatcgacaactggctcggctggtaccaacaaaaacccggcaaagcccccaaactactcatatacgacgcctccaacctcgacaccggcgtccccagccgcttctccggctccggctcaggcacctacttcacactcaccatctcctcactccaggccgaagacttcgccgtatacttctgccaacaagccaaagccttcccccccaccttcggcggcggcaccaaagtagacatcaaaggcaccgtcgccgccccttccgtcttcatattccccccctccgacgaacaactcaaatccggcaccgcctccgtcgtctgcctcctcaacaacttctacccccgcgaagccaaagtccaatggaaagtcgataacgcactccaaagcggaaactcccaagaatccgtaaccgaacaagactcaaaagactccacctactccctctcctccaccctcaccctatccaaagccgactacgaaaaacacaaagtctacgcatgcgaagtcacccaccaaggcctatcctcccccgtaaccaaatccttcaaccgaggcgaatgc

SEQ ID NO: 54221 - RNA, 687 nt, synthetic construct
  misc_feature 1..687: note = derived and/or modified sequence opt11 from Ranibiziuab_HeavyChain1
  source 1..687: mol_type = other RNA
gaagtccaactcgtcgaatccggcggcggcctcgtccaacctggcggctccctccgactctcctgcgccgcctccggctacgacttcacacactacggcaactgggtccgccaagcccctggcaaaggcctagaatgggtcggctggatcaacacctacaccggcgaacccacctacgccgccgacttcaaacgccgcttcaccttctccctagacacctccaaatcaaccgcatacctccaaaactccctccgcgccgaagacaccgccgtctactactgcgccaaatacccctactactacggtacctcccactggtacttcgacgtctggggccaaggcaccctcgtaacagtctcgtccgcctccaccaaaggccccagcgtcttccccctcgccccctcctcaaaatctacctccggcggcaccgccgccctcggctgcctagtaaaagactacttcccagaacccgtcaccgtctcctggaactccggcgccctcacctccggcgtccacactttccccgccgtcctacaatcctccggactatactccctctccagcgtcgtcaccgtcccctcctcctccctcggcacccaaacctacatctgcaacgtcaaccacaaaccctcaaacaccaaagtcgacaaaaaagtcgaacccaaatcctgcgacaaaacccacctc

SEQ ID NO: 54222 - RNA, 642 nt, synthetic construct
  misc_feature 1..642: note = derived and/or modified sequence opt11 from Ranibiziuab_LightChain1
  source 1..642: mol_type = other RNA
gacatccaactcacccaatccccctcatccctctccgcctccgtcggcgaccgcgtaaccatcacatgctccgcctcccaagacatctccaactacctcaactggtaccaacaaaaacccggcaaagcccccaaagtactcatctacttcacctcctctctccactccggcgtcccctcccgattctccggctccggatccggcaccgacttcacccttaccatctcctccctccaacccgaagacttcgccacctactactgccaacaatactccaccgtcccatggaccttcggccaaggcaccaaagtcgaaatcaaacgcaccgtagccgcaccctccgtattcatcttcccaccctcagacgaacaactcaaatccggcaccgcctccgtcgtatgcctcctcaacaacttctacccccgcgaagccaaagtccaatggaaagtcgataacgcccttcaatccggcaactcccaagaatccgtcaccgaacaagactccaaagactccacctactccctctcctccaccctcaccctctccaaagcagactacgaaaaacataaagtatacgcctgcgaagtcacccaccaaggcctatcctcccccgtaaccaaatccttcaaccgcggcgaatgc

SEQ ID NO: 54223 - RNA, 639 nt, synthetic construct
  misc_feature 1..639: note = derived and/or modified sequence opt11 from Ranibizumab_fab_fragment
  source 1..639: mol_type = other RNA
gacatccaactcacccaatccccctcatccctctccgcctccgtcggcgaccgcgtcaccatcacatgctccgcctcccaagacatctctaactacctcaactggtaccaacaaaaacccggaaaagcacccaaagtcctcatctacttcacctcctcactccactccggcgtcccatcccgcttctccggctcaggctccggcaccgacttcactctaaccatctcctccctccaacccgaagacttcgccacctactactgccaacaatactccaccgtcccctggaccttcggccaaggcaccaaagtcgaaataaaacgcaccgtcgccgccccctccgtattcatcttcccaccctccgacgaacaactcaaatccggcaccgcctccgtcgtctgcctcctcaacaacttctacccccgcgaagccaaggtccaatggaaagtcgacaacgccctccaatccggcaactcccaagaatccgtcaccgaacaagactccaaagactccacatactccctctcctccaccctcaccctctccaaagccgactacgaaaaacacaaagtctacgcatgcgaagtcacccaccaaggcctctcctcccccgtcaccaaatccttcaacagaggcgaa

SEQ ID NO: 54224 - RNA, 693 nt, synthetic construct
  misc_feature 1..693: note = derived and/or modified sequence opt11 from Ranibizumab_HeavyChain
  source 1..693: mol_type = other RNA
gaagtccaactcgtcgaatccggcggcggcctagtccaacccggaggctccctccgactatcatgcgccgcctccggctacgacttcacccactacggaatgaactgggtccgacaagctccaggaaaaggcctcgaatgggtcggctggatcaacacctacaccggcgaaccaacatacgccgccgacttcaaacgccgattcaccttctcactcgacacctccaaatccaccgcatacctccaaatgaactcactccgcgccgaagacaccgcagtctactactgcgccaaatacccctactactacggaacctcccactggtacttcgacgtctggggccaaggcaccctcgtcaccgtctcctccgcctccacaaaaggcccctccgtcttcccactcgcaccctcctccaaatccacctccggcggcaccgccgccctcggctgcctcgtcaaagactacttccccgaacccgtcaccgtatcctggaactcaggcgcactaacctcaggcgtccacaccttccccgccgtcctccaatcctccggactttactccctttcatccgtcgtcaccgtcccctcctcctccctcggcacccaaacctacatctgcaacgtcaaccacaaaccctccaacaccaaagtcgacaagaaagtcgaacccaaatcctgcgacaaaactcaccta

SEQ ID NO: 54225 - RNA, 654 nt, synthetic construct
  misc_feature 1..654: note = derived and/or modified sequence opt11 from Ranibizumab_LightChain
  source 1..654: mol_type = other RNA
gaagtccaactagtcgaaagcggcggcggcctcgtccaacccggcggctccctacgcctctcctgcgccgcctccggctacgacttcacccactacggcatgaactgggtccgccaagcccccggcaaaggcctcgaatgggtcggctggatcaacacatacaccggcgaacccacctacgcagcagacttcaaacgccgcttcaccttctccctcgacacatccaaatccaccgcctacctccaaatgaactccctccgagcagaagacacagccgtctactactgcgccaaatacccctactactacggcacctcccactggtacttcgacgtctggggacaaggcacactcgtaaccgtctcctccgcctcaaccaaaggcccctctgtcttccccctcgccccctccggcaccgcagccctcggctgcctcgtcaaagactacttcccagaacccgtcacagtctcctggaactccggcgcactcacatccggcgtacacacattccccgccgtcctccaatcctcaggcctctactcactctcctccgtcgtcaccgtcccctcctcctccctcggcacacaaacctacatctgcaacgttaaccacaaaccctccaacaccaaagtcgacaaaaaagtcgaacccaaa

SEQ ID NO: 54226 - RNA, 642 nt, synthetic construct
  misc_feature 1..642: note = derived and/or modified sequence opt11 from Ranibizumab_LightChain_variant
  source 1..642: mol_type = other RNA
gacatccaactcactcaatccccctcctccctctcagcctccgtcggcgaccgcgtcaccataacctgctcagcatcccaagacatctccaactacctcaactggtaccaacaaaaaccaggcaaagcacccaaagtcctcatctacttcacctcctccctacactccggcgtcccatcccgattctccggctccggctcaggcacagacttcaccctcaccatctcctccctccaacccgaagacttcgccacatactactgccaacaatactccaccgtcccctggaccttcggccaaggcactaaagtcgaaatcaaacgtaccgtcgcagccccctccgtcttcatcttcccaccctccgacgaacaactcaaatccggcaccgcctccgtcgtctgcctcctcaacaacttctacccccgcgaagccaaagtccaatggaaagtcgacaacgcactccaatccggaaactcccaagaatccgtcaccgaacaagactccaaagactccacctactccctctcctccacccttaccctctccaaagccgactacgaaaaacacaaagtctacgcctgcgaagtcacccaccaaggcctctcctcccccgtcaccaaatccttcaaccgcggcgaatgc

SEQ ID NO: 54227 - RNA, 1368 nt, synthetic construct
  misc_feature 1..1368: note = derived and/or modified sequence opt11 from Refanezumab_HeavyChain1
  source 1..1368: mol_type = other RNA
caagtccaactcgtacaaagcggctccgaactcaagaaacccggcgcatccgtcaaagtctcctgcaaagcgtcaggctacaccttcaccaactacggcatgaactgggtaagacaagcgcccggccaaggcctcgaatggatgggctggatcaacacctacaccggcgagccaacctacgctgacgacttcaccggccgctttgtattcagcctcgacacctctgtaagcaccgcctacctacaaatctcctccctaaaagcagaagacacagccgtatactactgcgctcgcaacccaatcaactactacggaatcaactatgaaggatacgtaatggactactggggccaaggcaccctagtcacagtatcctccgcctctaccaaaggcccctccgtcttccccctcgccccctcctcaaaatcaacctcaggaggcaccgccgccctcggctgcctagtcaaagactacttccccgaaccagtaaccgtgtcctggaactcaggcgcactcacctcaggagtccacaccttccccgccgtcctccagtcatcaggcctatactcactctcatccgtcgtcacagtaccgtcatcctccctcggcacacaaacctacatctgcaatgtcaaccataaaccctccaataccaaagtcgacaagaaagtagaacccaaatcatgcgacaaaacccacacgtgcccaccctgccccgcccccgaactagccggcgcccccagcgtcttcctctttccacccaaacccaaagacaccctcatgatatctcgcacccccgaagtaacctgcgtcgtcgtcgacgtctcccacgaagaccccgaagtcaaattcaactggtacgtcgatggtgtcgaagtacacaacgcaaaaacaaaaccccgtgaggaacaatataactccacctacagagtcgtatcagtcctcacagtactacaccaggactggctaaacggaaaagaatataaatgcaaagtctcaaacaaagcactgccagcccccattgagaaaaccatcagcaaagcaaaaggccaaccccgcgaaccccaagtatacacactaccaccctcccgagacgaactcaccaaaaaccaagtctcactaacctgcctcgtaaaaggcttctacccctccgacatcgccgtcgaatgggaaagcaacggccaacccgaaaacaactacaaaaccacacccccggtcctcgactcagacggatccttcttcctctactccaaactcaccgtcgacaaatcccgctggcaacaaggaaacgtattttcatgctcagtcatgcacgaggccctccacaaccactacacccaaaaatccctctccctctctcccggcaag

SEQ ID NO: 54228 - RNA, 657 nt, synthetic construct
  misc_feature 1..657: note = derived and/or modified sequence opt11 from Refanezumab_LightChain1
  source 1..657: mol_type = other RNA
gacatcgtcatgacccaatcccccgactccctcgccgtctccctcggcgaacgcgcaaccatcaactgcaaatcctcccactcagtcctctactcatcaaaccaaaaaaactacctcgcatggtaccaacaaaaacccggccaaccccccaaactactcatctactgggcctccacccgcgaatctggcgtccccgaccgcttctccggctccggctccggaaccgacttcaccctcaccatctcctccctccaagcagaagacgtcgctgtctactactgccaccaatacctctcctccctcacattcggccaaggcaccaaactcgaaatcaaacgcaccgtcgccgccccctccgtattcatcttccccccctccgacgagcaactcaaatctggcaccgcctccgtcgtctgcctcctcaacaacttctacccccgcgaagccaaagtccaatggaaagtcgacaacgcactccaatccggcaactcacaagaatccgtcaccgaacaagactccaaagactccacatactccctctcctccaccctcaccctctccaaagccgactacgaaaaacacaaagtctacgcctgcgaagtcacccaccaaggcctctcctcccccgtcaccaaatccttcaaccgcggcgaatgc

SEQ ID NO: 54229 - RNA, 1314 nt, synthetic construct
  misc_feature 1..1314: note = derived and/or modified sequence opt11 from REGN2810_HeavyChain1
  source 1..1314: mol_type = other RNA
gaagtacaactcctagaatccggaggcgtccttgtgcaacccggcggaagcctacgcctctcctgcgctgcctccggcttcaccttctcaaacttcggcacctgggtccgccaagctcccggcaaaggacttgaatgggtctccggcatatcaggaggcggacgcgacacctacttcgccgactccgtcaaaggcagattcaccatctcccgcgacaactccaaaaacactctctacctccagaactcactcaaaggcgaagacacggccgtctactactgcgttaagtggggcaacatctacttcgactactggggacagggaaccctcgtaacagtctccagcgcatcgaccaaaggaccctccgtcttcccacttgcaccctgctccagatccacctccgaaagcacagccgctcttggctgcctagtcaaagactacttcccagaacccgtcacagtatcctggaactccggcgcactcacctcaggagtccacaccttcccagccgtcctccaatcttccggactatactcactatcatccgtcgtaaccgtgccctcatcctccctaggcaccaaaacctacacatgcaacgtagaccacaaaccaagcaataccaaagtagacaaacgagtcgaatccaaatacggcccaccctgccctccctgccccgcacccgagttcctaggcggaccctcagtcttcctcttcccacccaaacccaaagacacccttatctctcgcacccccgaagtaacctgcgtcgtcgtcgacgtctcgcaggaagaccccgaagtccaattcaactggtacgtcgacggcgtagaagtccacaacgccaaaaccaaaccccgcgaagaacaattcaactccacataccgcgtcgtctcagtactgaccgtcttacaccaagactggctcaacggaaaagaatacaaatgcaaagtctccaacaaaggcctaccctcctcaatagagaaaaccatctcaaaagccaaaggccaaccccgtgaaccccaagtatacaccctaccaccctcccaagaagaaaccaaaaaccaagtatccctaacctgcctcgtcaaaggcttctacccctccgacatcgccgtcgaatgggaatcaaacggtcaacccgagaacaactacaaaaccactcccccagtcctcgactccgacggatcattcttcctatactcacgactcaccgtagacaagtccagatggcaagaaggcaacgtcttttcatgcagcgtccacgaagccctacacaaccactacacccaaaaatccctttcactctcactcggc

SEQ ID NO: 54230 - RNA, 639 nt, synthetic construct
  misc_feature 1..639: note = derived and/or modified sequence opt11 from REGN2810_LightChain1
  source 1..639: mol_type = other RNA
gacattcaaacccaatcaccctcctcactatccgcctccgtcggcgactccatcaccatcacatgccgcgcctccctctccatcaacaccttcctcaactggtaccaacaaaaacccggcaaagcacccaacctcctcatatacgccgcatcatcactccacggcggcgtcccatcccgcttctccggctcaggctcaggcacagactttaccctcaccatccgcaccctccaacccgaagacttcgccacctactactgccaacaatcctccaacacaccattcaccttcggccccggaaccgtcgtcgacttccgccgcaccgtcgcagccccctcagtcttcatcttcccaccctccgacgaacaactcaaatccggcaccgcctccgtcgtatgcctactcaacaacttctacccccgcgaagccaaagtccaatggaaagtagacaacgccctccaatcaggaaactcacaagaatccgtaaccgaacaagactccaaagactccacctactccctctcctccaccctcacactctccaaagccgactacgaaaaacacaaagtctacgcctgcgaagtcacccaccaaggcctctcctcccccgtcaccaaatccttcaaccgcggcgaatgc

SEQ ID NO: 54231 - RNA, 651 nt, synthetic construct
  misc_feature 1..651: note = derived and/or modified sequence opt11 from rhuMab_HER2(9CI)_LightChain
  source 1..651: mol_type = other RNA
gtccactccgacatccaaatgacccaatccccctcctctctctctgcctcagtcggcgaccgcgtcaccatcacatgcaaagcctcacaagacgtctccatcggcgtagcctggtaccaacaaaaacccggcaaagcccccaaactcctcatctactccgcctcctaccgctacaccggcgtcccctcccgattctccggctcaggctcaggcaccgacttcaccctcaccatctcctccctccaacccgaagacttcgccacctactactgccagcaatactacatctacccctacaccttcggccaaggcaccaaagtcgaaatcaaacgaaccgtcgcagcaccctccgtcttcatcttcccaccctccgacgaacaactcaaatccggcaccgcctccgtcgtttgcctactaaacaacttctacccccgcgaagccaaagtccaatggaaagtcgacaacgccctccaatccggcaactcccaagaatccgtcaccgaacaagactccaaagactcaacctactcactctcctctaccctcaccctctccaaagccgactacgaaaaacacaaagtctacgcctgcgaagtcacccaccaaggactttcctcacccgtaaccaaatccttcaaccgcggcgaatgc

SEQ ID NO: 54232 - RNA, 1215 nt, synthetic construct
  misc_feature 1..1215: note = derived and/or modified sequence opt11 from rhuMab_HER2_HeavyChain
  source 1..1215: mol_type = other RNA
gaagtccaacttgtcgaatccggcggcggcctcgtacaacccggtggatcactccgcctctcatgcgccgcctcaggattcaccttcacagactacacaatggactgggtccgccaagcccccggcaaaggactaacagccgtctactactgcgcccgtaaccttggcccctcattctacttcgattactggggccaaggcacactcgtaaccgtatcatccgcaagcaccaaaggcccctcggtattccccctcgccccctcatcaaaatccacctcaggcggaacagctgccctcggctgcctagttaaagactacttccccgaacccgtcaccgtctcctggaactctggcgcactcacctccggcgtccacacattccccgccgtcctacaatcctcaggcctctactccctgtcatcagtcgtcaccgtcccctccagctccctaggcacccaaacctacatctgcaacgtcaaccacaaacccagcaacaccaaagtagacaagaaagtcgagcccaaatcctgcgacaaaactcacacatgcccaccctgccccgcacccgaacttctaggcggcccatccgtcttccttttccctccaaaacccaaagacaccctgatgatctcccgcacacccgaagtcacatgcgtagtagtcgacgtctcacacgaagaccccgaagtcaaattcaactggtacgtcgacggcgtcgaagtccacaacgcaaaaaccaaaccccgcgaggaacagtacaactccacataccgcgtcgtctccgtactcacagtcctccaccaagactggctcaacggcaaagaatacaaatgcaaagtctcaaataaagccctccccgctcccattgagaaaaccatatccaaagccaaaggccaaccccgcgaaccccaagtctacaccctacccccatcccgagaagaaatgaccaaaaatcaagtctccctaacctgcctcgtcaaaggcttctacccatccgacatcgccgtcgaatgggaatccaacggacaacccgaaaacaactacaaaaccacaccacccgtactcgactccgacggatcattcttcctctactcaaaactaaccgtagacaaatcccgatggcaacaaggcaacgtattcagttgctccgtcatgcacgaagccctccacaaccactacacccaaaaatcactgtccctctcccccggccccaaa

SEQ ID NO: 54233 - RNA, 645 nt, synthetic construct
  misc_feature 1..645: note = derived and/or modified sequence opt11 from rhuMab_HER2_LightChain
  source 1..645: mol_type = other RNA
tccgacatccaaatgacccaatccccctccagcctctccgcctccgtcggcgaccgcgtcaccatcacctgccgcgcatcacaagacgtcaacaccgccgtcgcttggtaccaacaaaaacccggcaaagcccccaaactcctcatctactccgcatccttcctatactccggagtcccctcccgcttctcaggctcccgttctggaaccgacttcaccctcaccatctcctcgctccaacccgaagacttcgccacctactactgccaacaacactacaccaccccacccaccttcggccaaggaaccaaagtcgaaatcaaacgcaccgtcgccgccccctccgtcttcatcttccccccctccgacgaacaactcaaatccggcacagcctccgtcgtctgcctcctcaacaacttctacccccgcgaagccaaagtccaatggaaagtagacaacgccctccaatccggaaactcccaagaatccgtcaccgaacaagactccaaagactccacctactccctctcctcaacactcaccctatctaaagccgactacgaaaaacacaaagtctacgcctgcgaagtaacacaccaaggcctctcctcacccgtaacaaaatccttcaaccgcggcgaatgc

SEQ ID NO: 54234 - RNA, 318 nt, synthetic construct
  misc_feature 1..318: note = derived and/or modified sequence opt11 from rhuMab_HER2_LightChain_variant1
  source 1..318: mol_type = other RNA
accgtcgccgccccctccgtcttcatcttccccccctccgacgaacaactcaaatccggcaccgcctccgtcgtctgcctcctcaacaacttctacccccgcgaagccaaagtccaatggaaagtcgacaacgccctccaatccggcaactcccaagaatccgtcaccgaacaagactccaaagactccacctactccctctcctccaccctcaccctctctaaagccgactacgaaaaacacaaagtctacgcctgcgaagtcacccaccaaggcctctcctcccccgtcaccaaatccttcaaccgcggcgaatgc

SEQ ID NO: 54235 - RNA, 642 nt, synthetic construct
  misc_feature 1..642: note = derived and/or modified sequence opt11 from rhuMab_HER2_LightChain_variant2
  source 1..642: mol_type = other RNA
gatatccaaatgacccaatccccctcatccctcagcgcctccgtcggcgaccgcgtcaccatcacatgccgcgcctcacaagacgtaaacaccgccgtcgcatggtatcaacaaaaacccggaaaagcccccaaactcctcatctactcagcctctttcctctactccggagtcccctcccgcttctccggctcacgctcaggcaccgacttcaccctaaccatctcttccctccaacccgaagacttcgccacctactactgccaacaacactacaccaccccacccaccttcggacaaggaaccaaagtcgaaatcaaacgaacctgcgccgcaccctccgtcttcatcttcccaccctccgacgaacaactcaaatccggcaccgcctcagtcgtatgccttctcaacaacttctacccccgcgaagccaaagtacaatggaaagtcgacaacgccctccaatccggcaactcccaagaatccgtcaccgaacaagactccaaagactccacctactccctctcctcaaccctaaccctctccaaagccgactacgaaaaacacaaagtctacgcatgcgaagtcacccaccaaggcctctcatcccccgtcaccaaatccttcaaccgcggcgaatgc

SEQ ID NO: 54236 - RNA, 642 nt, synthetic construct
  misc_feature 1..642: note = derived and/or modified sequence opt11 from rhuMab_HER2_LightChain_variant3
  source 1..642: mol_type = other RNA
gacatccaaatgacccaatcaccctcctctctctccgcatccgtaggcgaccgtgtaaccatcacctgccgcgcctcccaagacgtcaacaccgccgtcgcctggtaccaacaaaaacccggcaaagcccccaaactcctaatctactccgcctccttcctatactccggcgtcccctcccgcttctccggctcccgctccggcaccgacttcaccctcaccatctcctccctccaacccgaagacttcgccacctactactgccaacaacactacaccaccccacccaccttcggccaaggcaccaaagtcgaaatcaaacgcacagtcgccgccccctccgtattcatcttccccccctccgacgaacaactaaaatccggcaccgcctccgtcgtatgcctactcaataacttctacccccgcgaagccaaagtccaatggaaagtcgacaacgccctccaatcaggcaactcccaagaatccgtcaccgaacaagactcaaaagactcaacctactccctatcctccaccctcaccctctccaaagcagactacgaaaaacacaaagtctacgcatgcgaagtcacccaccaaggcctcagctcccccgtcaccaaatccttcaaccgcggcgaatgc

SEQ ID NO: 54237 - RNA, 645 nt, synthetic construct
  misc_feature 1..645: note = derived and/or modified sequence opt11 from rhuMab_HER2_LightChain_variant4
  source 1..645: mol_type = other RNA
tccgacatccaaatgacccaatccccctcatccctctccgcctccgtcggcgaccgcgtaaccatcacatgccgcgcctcccaagacgtcaacaccgccgtcgcctggtaccaacaaaaacccggcaaagcccccaaactcctcatctactccgcctccttcctctactccggcgtcccctcccgattctccggctcccgctcaggaaccgacttcaccctaaccatctcctccctccaacccgaagacttcgccacatactactgccaacaacactacacaaccccacccaccttcggtcaaggcaccaaagtcgaaatcaaacgcacagtcgcagccccctccgtcttcatcttcccaccctccgacgaacaactcaaatccggcactgcatccgtcgtctgcctcctaaacaacttctacccccgcgaagccaaagtccaatggaaagtcgacaacgccctccaatccggcaactcccaagaatccgtcaccgaacaagactccaaagactccacctactccctctcctccaccctcaccctctccaaagccgactacgaaaaacataaagtatacgcctgcgaagtcacacaccaaggcctcagctcccccgtaactaaatccttcaaccgcggcgaatgc

SEQ ID NO: 54238 - RNA, 321 nt, synthetic construct
  misc_feature 1..321: note = derived and/or modified sequence opt11 from rhuMab_HER2_LightChain_V-Region
  source 1..321: mol_type = other RNA
gacatccaaatgacccaatccccctcatccctctccgcctccgtaggcgaccgcgtcaccatcacctgccgcgcctcccaagacgtcaacaccgccgtcgcctggtaccaacaaaaacccggcaaagcccccaaactcctcatctactccgcctccttcctctactccggcgtcccctcccgcttctccggctcccgctccggcaccgacttcaccctcaccatctcctccctccaacccgaagacttcgccacctactactgccaacaacactacaccaccccccccaccttcggccaaggcaccaaagtcgaaatcaaa

SEQ ID NO: 54239 - RNA, 1350 nt, synthetic construct
  misc_feature 1..1350: note = derived and/or modified sequence opt11 from rhuMab_HER2_gamma1-Chain
  source 1..1350: mol_type = other RNA
gaagtacaactcgtcgaatcgggcggcggcctcgtacaaccaggaggctcacttcggctctcctgcgccgcatccggattcaacataaaagacacctacatccactgggtccgacaagcccccggcaaaggcctcgagtgggtcgcacgaatataccccaccaacggatacacccgctacgccgactccgtcaaaggccgcttcacaatatcagccgatacatccaaaaacaccgcctacctccaaatgaactcactacgcgccgaagacacagcagtatactactgctcacgctggggcggcgacggcttctacgccatggactactggggccaaggtaccctcgtaacagtctcatccgccagcacaaaagggccctctgtcttcccactagcaccctcctccaaatctacatccggcggcacagccgccctcggctgcctagtcaaagactacttccccgaaccagtaacagtctcctggaactcgggcgcacttacctcaggcgtacacaccttccccgccgtactccaatcaagcggcctctactcgctatcctccgtagtcaccgtccccagcagcagcctcggcacccaaacctacatctgcaacgtcaaccacaaaccctccaacaccaaagtcgacaagaaagtcgaacccaaaagctgcgacaaaacccacacatgcccaccgtgccccgcacccgaactactcggaggaccctccgtattcctcttcccacccaaacccaaagacaccctcatgatatcaagaacccccgaagttacctgcgtcgtcgtcgacgtatcccacgaagacccagaagtcaaattcaactggtatgtagacggcgtagaagtccacaacgccaaaaccaagcccagagaagaacaatacaactcaacctaccgcgtcgtctcagtacttaccgtcctccaccaagactggctcaacggaaaagaatataaatgcaaagtgtcaaacaaggcactgcccgcccccatcgaaaagaccatcagcaaagccaaaggacaaccacgagaaccccaagtctacacacttccaccctcccgagaggagatgaccaaaaaccaagtctccctaacctgcctagtcaaaggcttctacccctctgacatcgccgtcgaatgggaaagtaacggccaacccgaaaacaactacaaaaccacacccccagtactagactccgatggatccttctttctatactccaaactaacagtcgacaagtcacgctggcaacaagggaacgtcttctcttgctcagtaatgcacgaagcactccacaaccactacacacaaaaatcactctccctaagccccggcaaa

SEQ ID NO: 54240 - RNA, 1350 nt, synthetic construct
  misc_feature 1..1350: note = derived and/or modified sequence opt11 from rhuMab_HER2__gamma1-Chain
  source 1..1350: mol_type = other RNA
gaagtccaactcgtcgagtccggaggaggactcgtacaacccggcggatcactccgcctctcctgcgccgcctccggattcaacatcaaagacacctacatccactgggtccgccaagcccccggcaaaggcctagaatgggtagcccgtatctaccccacaaacgggtacacccgctatgcagacagcgtcaagggccgcttcaccatttcagccgacacaagcaagaacaccgcctacctccaaatgaactctttacgcgccgaagacacagccgtctactactgctcacgctggggcggagacggcttctacgccatggactactggggccaaggcaccctcgtcaccgtctcatcatgctctaccaaaggaccatccgtcttccccctcgccccctcgtccaaaagcacatctggcggcaccgccgccctcggctgcctagtcaaagactacttcccagaacccgtcacagtatcctggaacagcggcgcccttacctccggcgtccacaccttccccgccgtactacaaagctcgggcctctacagcctatcatccgtagtcacagtaccatcctcatccttaggcacccaaacatacatctgcaacgtcaaccacaagccatccaacaccaaagtcgacaagaaagtagaacccaaatcctgcgacaaaacacacacctgtccaccctgccccgcccccgagctactcggcggcccctccgtcttcctattcccacccaaacccaaagacaccctaatgatctcccgaacccccgaagtaacctgtgtcgtcgtcgatgtctcacacgaggaccccgaagttaaattcaactggtacgtcgacggagtcgaggtacacaatgctaaaaccaaaccccgcgaagaacagtacaactccacataccgcgtcgtctccgtcctcaccgtactacatcaagactggctcaacggaaaagaatacaaatgcaaagtctccaataaagccctcccagcccccatcgagaaaacaatctccaaagccaaaggccaaccacgagaaccacaagtctatacgctcccaccatcccgagaagaaatgaccaaaaaccaagtatccctcacatgcctcgtaaaaggcttctacccatccgatatagccgtcgaatgggaatccaacggccaaccggaaaacaactacaaaaccacccctcccgtattagactccgacggcagcttcttcctctactccaaactcaccgtagacaaatcccgctggcaacaaggaaacgtcttctcctgctcagttatgcacgaggccctccacaaccactacacacaaaagtcactcagcctttcccccggcaaa

SEQ ID NO: 54241 - RNA, 729 nt, synthetic construct
  misc_feature 1..729: note = derived and/or modified sequence opt11 from rhuMab_HER2_gamma1-Chain__rhuMab_HER2_LightChain_sc4D5
  source 1..729: mol_type = other RNA
gaagtgcaattggtcgagagcggaggcgggctcgtgcaaccaggcgggagtctgcgcctgagctgtgccgcgagcggcttcaatatcaaggacacatacatacactgggtcaggcaagcacccgggaaaggactagagtgggtggcaaggatctatccaacgaacgggtacacgcgatatgccgacagcgtgaaagggcgcttcaccataagcgcggacacgagcaagaacacggcctatctccagatgaatagcctgcgcgcggaagataccgcggtctattactgtagcagatggggcggggacggcttttacgcgatggattactggggccaaggcacgctagtgaccgtgagctcgggcggaggcgggagcgggggcgggggctcgggcggaggcggaagcgatatccagatgacgcaatcaccatcgagcttgagcgcgagcgtgggcgatcgcgtgaccataacctgtcgagcaagccaggacgtgaacacggccgtggcatggtaccagcaaaagcccgggaaagcgcccaagctcttaatctatagcgcgagcttcctctacagcggggtcccaagcaggttctcgggctcgcgctcgggaacagactttaccctaaccatcagctcactccagcccgaggactttgccacgtactattgccagcaacattacacaacaccgcccacgttcgggcaagggaccaaggtcgagatcaagcgc

SEQ ID NO: 54242 - RNA, 1350 nt, synthetic construct
  misc_feature 1..1350: note = derived and/or modified sequence opt11 from rhuMab_HER2_gamma1-Chain_variant1
  source 1..1350: mol_type = other RNA
gaagtacaactcgtcgaatcaggtggcggcctagtccaacctggtggctcactccgactaagctgcgccgcctccggcttcaacatcaaagacacttacatccactgggtacgacaagcacccggaaaaggcctagaatgggtagccagaatctaccccaccaacggctacactagatacgccgactccgtaaaaggccgcttcaccatctcagccgacaccagcaaaaataccgcctacctacaaatgaactccctgcgcgctgaagacaccgcggtatactactgctcccgatggggcggagacggcttctacgccatggactactggggacaaggaaccctcgtaaccgtatcctccgcctccaccaaaggaccctccgtcttcccactcgcaccctcatcaaaatccaccagcggcggcaccgctgccctaggatgcctcgtcaaagactacttccccgagcccgttacagtctcctggaacagcggcgcactaaccagcggcgtacacacattccccgcagtcctacaatcatccggcctctactcactctcctccgtcgtcaccgtcccctcctcatccctcggcacccaaacatacatctgcaacgtcaaccacaaaccctcaaacaccaaagtagacaagaaagtcgaaccaaaatcatgcgacaaaacccacacatgcccaccctgcccagctcccgaactcctcggcggcccctccgtattcctcttcccaccaaaacccaaagataccctcatgatctcccgcacccctgaagtaacctgcgtcgtcgtagacgtatcgcacgaagaccccgaagtcaaattcaactggtacgtcgacggagtcgaggtacacaacgccaaaaccaaacctagagaagaacaatacaacagcacctaccgcgtcgtctccgtcctcacagtccttcaccaagactggctcaacggcaaagaatacaaatgcaaagtttctaacaaagccctcccggcccccatagagaaaactatatccaaagccaaaggccaaccacgcgaaccccaagtctataccctacccccatcccgcgaagaaatgaccaaaaaccaagtctccctaacctgcctcgtaaaaggtttctacccctccgacatcgccgtggaatgggaatcaaacgggcaacccgaaaacaactacaaaaccaccccacccgtgctagactccgacggatcattcttcctatactcaaaacttaccgtcgacaaatcccgctggcaacaaggcaacgtcttctcctgctccgtcatgcacgaagccctccacaaccactacactcaaaagagtctatccctcagccccggaaaa

SEQ ID NO: 54243 - RNA, 1350 nt, synthetic construct
  misc_feature 1..1350: note = derived and/or modified sequence opt11 from rhuMab_HER2_gamma1-Chain_variant2
  source 1..1350: mol_type = other RNA
gaagtccaactcgtcgaatccggcggtggcctagttcaacccggcggctccctccgcctctcctgcgccgcatccggcttcaacatcaaagacacctacatccactgggtccgacaagcccccggaaaaggcctagaatgggtcgcacgcatataccccacaaacggctacacccgctacgccgactccgtcaaaggcagattcaccatttccgcagacacctccaaaaacaccgcctacctccaaatgaactctctccgcgctgaagacaccgccgtctactactgttcccgatggggcggcgacggattctatgccatggactactggggccaaggcacactcgtcacagtatcctcatgctccaccaaaggccccagcgtcttccccctcgccccctccagtaaaagcacctccggtggaaccgccgcactaggatgcctggtcaaagactacttccccgaacccgtaaccgtaagctggaactcaggcgccctcacatccggcgtccacaccttccccgccgtcctccaatcatcgggcctttactcactgtcatcagtcgtcaccgtcccctcatcctccctcggaacgcaaacgtacatctgcaatgtcaaccacaaaccctccaacacaaaagtcgacaagaaagtagaaccaaaaagctgcgacaaaacccacacatgcccaccctgtccagcccccgaactcctcggcggcccctccgtcttcctctttcccccaaaacccaaagacaccctcatgatctcccgcaccccagaagtaacctgcgtcgtcgtcgacgtctctcacgaagacccagaagtcaaattcaattggtatgtcgacggcgtagaagtccacaacgccaaaaccaaaccccgagaagaacaatacaactccacataccgcgtcgtatccgtcctaaccgtccttcaccaagactggctcaacggcaaagaatacaaatgcaaagtatccaacaaggccctccccgccccgatcgagaaaaccatatcaaaagccaaaggacaaccgagagaacctcaagtatacacactaccacccagccgagaagaaatgaccaaaaaccaagtctcccttacatgcctcgtcaaaggcttctacccctccgacatcgccgtcgaatgggaatccaacggccaacccgaaaacaactacaaaacaacaccacccgtcctcgactcagacggctcattcttcctctactccaaattaacagtcgacaaatcacgctggcaacaaggaaacgtcttctcctgctccgtcatgcacgaagccctccacaaccactacactcaaaaatccctcagcctgagccccggcaaa

SEQ ID NO: 54244 - RNA, 1350 nt, synthetic construct
  misc_feature 1..1350: note = derived and/or modified sequence opt11 from rhuMab_HER2_gamma1-Chain_variant3
  source 1..1350: mol_type = other RNA
gaagtccaactcgttgaatcaggcggaggcctagtccaaccaggaggctcactccgactctcctgcgccgcctcaggcttcaacatcaaagacacctacatccactgggtacgccaagctcccggcaaaggcctggaatgggtcgcccgaatctatcccacaaacggctacacccgctacgccgactccgtcaaaggccgattcacaatctccgcagacacaagcaaaaacaccgcctacctccaaatgaactcactccgatgcgaagacacagccgtctactactgctctcgctggggtggagacggattctacgccatggattactggggccaaggcaccctcgtcaccgtatcatccgctagcaccaagggcccctcagtctttccacttgccccgtcatcaaaatccacatcaggcggaacagcagccctcggctgcctcgtcaaagactacttccctgaacccgtcaccgtctcctggaactccggcgccctcacctctggcgtacacacctttccagcagtactccaatcatccggcctctactccctatcctcagtcgtcacagtcccctcctcatcccttggaacccaaacatacatctgcaacgtcaaccacaaaccttccaacaccaaagtagacaagaaagtagaacccaaatcctgcgacaaaacccatacctgcccaccctgccccgctcccgaactactcggcggcccctccgtattcctatttccacccaaaccgaaagacaccctaatgatctcaagaacccccgaagttacctgcgtcgttgtcgacgtctcccacgaagaccccgaagtcaaattcaactggtacgtcgacggcgtcgaagtccacaacgccaaaacaaaaccacgcgaagaacaatacaactccacctaccgagtagtttccgtccttaccgtcctccaccaagactggctcaacggcaaagaatacaaatgcaaagtctccaacaaagctctcccagccccaatcgagaaaacaatatccaaggccaaaggccaaccccgcgaaccacaagtttacacactcccgccctcccgcgaagaaatgaccaaaaaccaagtttcgctaacctgccttgtcaaaggcttctaccccagcgacatcgccgtcgaatgggaatccaacggccaaccagaaaacaactacaagaccaccccacccgtcctagacagcgacggctccttcttcctatactccaaactcaccgtagacaaatcacgatggcaacaaggcaacgtattttcatgctcggtcatgcacgaagccctacacaaccactacacacagaaaagcctctccctatccccaggaaaa

SEQ ID NO: 54245 - RNA, 360 nt, synthetic construct
  misc_feature 1..360: note = derived and/or modified sequence opt11 from rhuMab_HER2_gamma1-Chain_V-Region
  source 1..360: mol_type = other RNA
gaagtgcaattggtcgagagcgggggcgggctagtgcaaccgggcgggagcttgcgattgagctgtgccgcgagcgggttcaatatcaaggacacgtacatacactgggtcaggcaagcgcccgggaaagggctcgagtgggtggccaggatctatcccacgaacgggtacacgcgctatgccgatagcgtgaaagggcgctttaccataagcgcggacacgagcaagaacacggcctatctccagatgaatagcttgcgcgcggaagataccgcggtctattactgttcgaggtggggcggggatggcttttacgcgatggattactggggccagggcacgctcgtgaccgtgagcagc

SEQ ID NO: 54246 - RNA, 1359 nt, synthetic construct
  misc_feature 1..1359: note = derived and/or modified sequence opt11 from rhuMAb-VEGF_HeavyChain1
  source 1..1359: mol_type = other RNA
gaagtccagctcgtcgaatccggaggaggactcgtccaacccggaggctctcttcgcctaagctgcgccgcctcaggctacacattcactaactacggaatgaactgggtccgacaagcccccggcaaaggcctcgagtgggtcggctggataaacacctacaccggcgaacccacctacgccgctgacttcaaacgccgattcactttctctctagacacatcaaagtccaccgcctacctccaaatgaactcactccgcgccgaagacacagcagtctactattgcgccaaatacccccactactacggctcctcccactggtacttcgatgtctggggccaaggcacactcgtcaccgtcagctcagcatccaccaaaggcccctccgtgttccccctcgccccctcatccaaatcaacctccggaggcaccgccgccctcggctgcctcgtcaaagactacttccccgaaccagtcacagtatcctggaactcgggcgccttgacatccggcgtacacaccttccccgccgtccttcagtcatcaggactatactcactttcctccgtagtaaccgtcccatcctcatccttaggcacccaaacctacatctgcaatgtcaaccacaaacccagcaacaccaaagtagacaagaaagtcgaacccaaatcctgcgacaaaacgcacacatgcccaccctgccccgccccagaacttctaggcggcccctccgtcttcctcttcccaccaaaacccaaagacaccctaatgatatcccgaaccccagaagtaacctgcgtcgtcgtcgacgtcagccacgaagacccagaagtaaaattcaactggtacgtcgacggagtcgaagtccacaacgccaaaacaaaaccccgagaagaacaatacaactcgacctaccgcgtagtctcagtcctaacagtcctacaccaagactggctcaacggcaaagaatacaaatgcaaggtctccaacaaagcactccccgcaccaatcgagaaaaccatctcaaaagcaaaaggccaaccccgcgaaccccaagtctataccctacccccttcacgcgaagaaatgaccaaaaaccaagtcagcctaacctgcctcgtaaagggcttttacccctccgacatcgccgtagaatgggaatcaaacggccaacccgaaaacaactacaagaccacacctcccgtcctcgactcagacggatccttcttcctctactcaaaactcaccgtagacaaaagccgctggcagcaaggtaacgtcttcagctgcagcgtcatgcacgaagccctccacaaccactatacacaaaaatcactctccctctcacccggcaaa

SEQ ID NO: 54247 - RNA, 642 nt, synthetic construct
  misc_feature 1..642: note = derived and/or modified sequence opt11 from rhuMAb-VEGF_LightChain1
  source 1..642: mol_type = other RNA
gacatccaaatgacccaatcaccctcctccctctcagcctccgtcggcgaccgcgtcaccatcacatgctccgcatcccaagacatctccaactacctaaactggtaccaacaaaaacccggcaaagcccccaaagtcctaatctacttcacctcctccctccactccggcgtcccatcacgcttctccggctcaggctctggcaccgacttcaccctcaccatctcttccctccaacccgaagacttcgccacctactactgccaacaatactccacagtcccctggaccttcggccaaggcaccaaagtcgaaatcaaacgcaccgtcgccgccccctccgtcttcatcttcccaccctccgacgaacaactcaaatccggcaccgcctctgtcgtctgcctcctcaacaacttctacccccgagaagccaaagtccaatggaaagtcgacaatgccctccaatccggcaactcccaagaatccgttaccgaacaagactccaaagactccacctactccctctcttccacccttaccctctccaaagccgactacgaaaaacacaaagtctacgcctgcgaagtcacccaccaaggcctctcctcccccgtaaccaaatccttcaaccgcggcgagtgc

SEQ ID NO: 54248 - RNA, 642 nt, synthetic construct
  misc_feature 1..642: note = derived and/or modified sequence opt11 from rhuMAb-VEGF_LightChain
  source 1..642: mol_type = other RNA
gacatccaaatgacccaatccccctcctccctctccgcctccgtaggtgaccgcgtcaccataacctgctcagcctcccaagacatcagcaactacctaaactggtaccaacaaaaacccggcaaagcccccaaagtcctaatctacttcacctcctcactacactccggcgtcccctccagattctccggatccggctccggcaccgacttcaccctaaccatctcctcactccaacccgaagacttcgccacatactactgccaacaatactccaccgtcccctggaccttcggccaaggcaccaaagtcgaaatcaaacgcacagtcgccgccccctccgtcttcatcttcccaccctccgacgaacaactcaaatccggcaccgcatccgtcgtctgcctactcaacaacttctacccccgcgaagccaaagtccaatggaaagtcgacaacgccctccaatcaggcaactcccaagaatccgtcaccgaacaagactccaaagactccacctactccctctcctccaccctcaccctctccaaagcagactacgaaaaacacaaagtctacgcctgcgaagtcacccaccaaggcctctcctcacccgtcaccaaatccttcaaccgcggcgaatgc

SEQ ID NO: 54249 - RNA, 321 nt, synthetic construct; identical to SEQ ID NO: 53589
  misc_feature 1..321: note = derived and/or modified sequence opt11 from rhuMAb-VEGF_LightChain__VG-Region
  source 1..321: mol_type = other RNA

SEQ ID NO: 54250 - RNA, 1359 nt, synthetic construct
  misc_feature 1..1359: note = derived and/or modified sequence opt11 from rhuMAb-VEGF_gamma1-Chain
  source 1..1359: mol_type = other RNA
gaagtccaactcgtcgaatccggcggcggactcgtccaacccggcggctccctcagactcagctgcgcagcctcaggatacaccttcaccaactacggcatgaactgggtacgacaagcccccggcaaaggactcgaatgggtcggatggatcaacacctacaccggcgaacccacctacgccgcagacttcaaacgccgattcaccttttcccttgatacctctaaatccaccgcctatctccaaatgaactccctccgcgctgaagacacagcagtctactactgcgcaaaatacccccactactacggctcctcccactggtacttcgacgtctggggacaaggcacccttgtaacagtatcatccgcctcaacaaaaggcccctccgtcttccccctcgccccctcatcaaaatcaacctcaggaggcaccgccgccctcggatgcctcgtaaaagactacttcccagaaccagtaaccgtctcctggaacagtggcgccctcacatccggcgtccacaccttccccgccgtactccaaagctccggcctatactccctttcctcagtcgtcaccgtcccttcttcctcacttggcacccaaacatacatctgcaacgtcaaccacaaacccagcaacacaaaggtagacaagaaagtcgagccaaaatcctgcgacaaaacccacacctgtccaccctgccccgcacctgagctcctcggcggcccatcagtattcctcttcccacccaaacccaaagatacactcatgatctcccgaacccccgaagtaacctgcgtcgtcgtagatgtttcccacgaagaccccgaagtcaaatttaactggtacgtagacggcgtcgaagtacacaatgcaaaaaccaaaccccgcgaagaacaatacaactcaacctaccgagtagtctctgtactcaccgtcctacaccaagactggcttaacggcaaagaatacaaatgcaaagtctccaacaaagccctccccgcccccatcgagaaaaccatcagcaaagcaaaaggccaaccccgagaaccccaagtatacaccctacccccatcacgcgaagaaatgaccaaaaaccaagtctccctaacatgcctagtcaaaggcttctacccctccgacatcgcagtcgaatgggaatcaaacggacaacccgaaaacaactacaaaacaacaccacccgtcctcgacagcgacgggtccttcttcctttactccaaacttaccgtagacaaatcccgatggcaacaaggaaacgtcttctcgtgctcggtcatgcacgaggccctacacaaccactacacccagaaaagtctctcactctcacccggaaaa

SEQ ID NO: 54251 - RNA, 369 nt, synthetic construct
  misc_feature 1..369: note = derived and/or modified sequence opt11 from rhuMAb-VEGF_gamma1-Chain_VDG-Region
  source 1..369: mol_type = other RNA
gaagtccaactcgtcgaatcaggcggcggcctcgtccaacccggcggctccctccgcctctcctgcgccgcctccggctacaccttcaccaactacggcatgaactgggtccgccaagcccccggcaaaggcctcgaatgggtcggctggatcaacacctacaccggcgaacccacctacgccgccgacttcaaacgacgcttcaccttctcactcgacacctccaaatccaccgcctacctccaaatgaactccctccgcgccgaagacaccgccgtctactactgcgccaaatacccccactactacggctcctcccactggtacttcgacgtatggggccaaggcaccctcgtcaccgtctcctca

SEQ ID NO: 54252 - RNA, 1338 nt, synthetic construct
  misc_feature 1..1338: note = derived and/or modified sequence opt11 from Rilotumumab_HeavyChain1
  source 1..1338: mol_type = other RNA
caagtccaactccaagaatccggacccggcctcgtcaaaccctccgaaaccctcagcctaacctgcactgtctccggcggctccatctcgatctactactggtcatggataagacaacctcccggcaaaggactagaatggatcggctacgtctactactcaggctccaccaactacaacccctcactaaaatcccgcgtcaccatatccgtcgatacctccaaaaaccaattctcactcaaactcaattccgtaaccgccgccgacaccgccgtatactactgcgcccgtggaggctacgacttctggtccggctacttcgactactggggccaaggaaccctagtaacagtctcatccgcctccaccaaaggcccctccgtattccccctagccccctgcagccgatccacctccgaatcaactgccgccctcggctgcctcgtaaaagattacttccccgaacccgtaacagtcagctggaactcaggcgccctaaccagcggcgtccacaccttccccgcagtcctccaatcatccggcctctactcactctcctccgtagtcaccgtcccctcttccaactttgggacccaaacctatacctgcaacgtcgaccacaaaccctccaacactaaagtcgacaaaacggtagaacgcaaatgctgcgtcgaatgtcccccatgccccgcacccccagtggccggaccctccgtcttcctcttcccacccaaaccaaaagacacactcatgatctctcgcacccccgaggtaacctgcgtcgtcgtcgacgtctcccacgaagacccagaggtccagttcaactggtacgtcgacggcgtcgaagtccacaacgccaagaccaaaccccgcgaagaacaattcaacagcacatttcgtgtcgtctcagtcctcacagtcgtccatcaagactggctcaacggcaaagaatacaaatgtaaagtatcaaacaaaggcctaccagcccccatagagaaaaccatcagcaaaaccaaaggccagccccgcgagccgcaagtctacaccctcccaccctctcgagaggaaatgaccaaaaaccaagtctcactaacctgcctcgtaaaaggcttctacccctccgacatcgccgtcgaatgggaatccaacggccaacccgagaacaactacaaaaccacccctcccatgctagatagcgacggctcattcttcctttattccaaactgaccgtcgacaaatcccgatggcaacaaggcaacgtcttctcttgctccgtcatgcacgaagccctccacaatcactacacccaaaaatccctctctctctcccccggcaaa

SEQ ID NO: 54253 - RNA, 645 nt, synthetic construct
  misc_feature 1..645: note = derived and/or modified sequence opt11 from Rilotumumab_LightChain1
  source 1..645: mol_type = other RNA
gaaatcgtaatgacccaatcccccgccaccctctcagtctccccaggagaacgagccaccctctcctgccgcgcctcacaatccgtcgactccaacctcgcctggtaccgccaaaaacccggccaagccccccgcctcctcatctacggcgccagcacccgcgccacaggcatccccgcacgcttctccggctccggctccggaaccgaattcaccctcaccatctcatccctccaatcagaagacttcgccgtctactactgccaacaatacatcaactggccccccatcaccttcggccaaggcacccgcctagaaatcaaacgcaccgtcgccgccccctcagtcttcatcttccccccatccgacgaacaactcaaatccggcaccgcctccgtcgtctgcctcctcaacaacttctacccccgcgaagccaaagtacaatggaaagtcgacaacgcactccaatccggcaactcccaagaatccgtcaccgaacaagactccaaagactccacctactccctaagctccaccctcaccctctccaaagccgactacgaaaaacacaaagtctacgcctgcgaagtcacccaccaaggcctctcctcccccgtcacaaaatcattcaaccgcggcgaatgc

SEQ ID NO: 54254 - RNA, 1071 nt, synthetic construct
  misc_feature 1..1071: note = derived and/or modified sequence opt11 from Rilotumumab_scFv-CH_chain
  source 1..1071: mol_type = other RNA
gaagtccagctcctagaatctggaggcggcctagtccaacccggcggctccctcagactatcctgcgccgcatccggcttcacattctcttccttctcaatgtcctgggtccgccaagcccccggaaaaggcctagaatgggtctcatccatctctggctcatccggcactacatactacgccgactccgtcaaaggtcgcttcaccatctcaagagacaactccaaaaacaccctctacctacaaatgaactccctgcgcgccgaagacaccgcagtatactactgcgccaaaccgttcccctacttcgactactggggacaaggcacactcgtcacagtatccagcggcgacggctcctcaggcggatccggcggcgcctcagaaatcgtcctcacccagtcccccggcaccctatcgctctctcccggcgaacgcgccaccctctcctgcagagcatcccaatcagtatcctcctccttcctcgcatggtaccaacaaaaacccggccaagcaccccgcctcctcatatactacgcctcctcaagagccaccggcatccccgaccgcttctcaggctccggtagcggtaccgacttcaccctcaccatctcccgactcgaaccagaagacttcgccgtctactactgccaacaaaccggccgcatacccccaaccttcggacaaggaacaaaagtcgaaatcaagtccggtggctccggcggccccagagccgcaccagaagtctacgcgttcgccacccccgaatggcccggctcccgagacaaacgcacactcgcctgcctaatccaaaacttcatgcccgaagacatctccgttcaatggctacacaacgaagttcaactccccgacgcccgacactccacaacacaaccacgcaaaaccaaaggctcaggcttcttcgtcttctcccgcctagaagtcacacgcgcagaatgggaacagaaagacgaatttatctgccgcgccgtccacgaagccgcctcaccctcccaaacagtccagcgagccgtctccgtaaatcccgaatcctccagacgaggcggatgc

SEQ ID NO: 54255 - RNA, 1347 nt, synthetic construct
  misc_feature 1..1347: note = derived and/or modified sequence opt11 from Rinucumab_HeavyChain1
  source 1..1347: mol_type = other RNA
caactacaactacaagaatccggccccggcctcgtcaaaccctccgaaacactctccctaacctgcaccgtgtccggcggctccatcacctcctcatcctactattggggctggatcagacaaccacccggtaaaggcctagaatggataggctccatctactaccgcggatcaaccaactacaacccctccctcaaaagcagggtaaccatatcagtcgactcctccaaaaaccaattctacctaaaagtatcttccgtcaccgccgtagacactgccgtatactactgcgcccgccaaaacggcgccgcccgcccctcatggttcgacccctggggccaaggcaccctcgttacagtctcctccgcctcaaccaaaggcccctccgtctttcccctcgccccctgctcccgctccacaagcgagtccacagccgcactcggatgcctcgtaaaagactacttcccagaacccgtaaccgtctcctggaactccggcgccttaacatcaggcgtccacacatttcccgccgtcctccaatcctccggactctactccttatcgtccgtagtcaccgtcccatcatctagcctaggcacaaaaacatatacctgcaacgttgaccataaaccctccaacacaaaagtagacaagcgagtcgaaagcaaatacggaccaccctgccctccctgccccgctcccgagttcctaggcggaccctctgtcttcctcttcccacccaagcccaaagacaccctcatgatctccagaacacccgaagttacctgcgtcgtcgtcgacgtctcccaagaagacccagaagtccagttcaactggtacgtcgacggcgtagaagtccacaacgccaagacaaaaccacgcgaggaacaattcaactccacctacagagttgtctccgtcctcacagtactccaccaggactggcttaacggaaaagaatacaaatgcaaagtcagcaacaaaggtctcccctcctccatcgagaaaacaatatccaaggccaaaggacaacctcgcgaaccccaagtctacaccctcccaccctcccaagaagaaatgaccaaaaaccaagtatccctcacatgcctcgtcaaaggattctacccctcagacatcgcagtcgaatgggaatccaacggccaacccgaaaacaactacaaaaccaccccgcccgtactagactccgacggctccttcttcctctattcccggctcaccgtagacaaaagccgctggcaagaaggaaacgtcttctcctgcagcgtcatgcatgaagccctacacaaccactacacacaaaaatcactctcactctcactaggcaaa

SEQ ID NO: 54256 - RNA, 1344 nt, synthetic construct
  misc_feature 1..1344: note = derived and/or modified sequence opt11 from Rinucumab_HeavyChain
  source 1..1344: mol_type = other RNA
caactccaactacaagaatcaggccccggcctcgtcaaaccctcagaaaccctctcgctcacatgtaccgtttccggaggctctatcactagctcaagctactactggggctggatacgccaaccacccggcaaaggactcgaatggatcggatcaatatactaccgtggaagcacaaactacaacccttcactcaaatcacgcgtaaccatctcagtcgactcatccaaaaaccaattctacctcaaagtctcctccgtcaccgccgtcgataccgccgtctactactgtgccagacaaaacggcgccgcccgcccctcatggttcgacccatggggccaaggcaccctcgtaaccgtttcctcagccagcacaaaaggcccctccgtcttcccactcgcaccatgctcacgctccacctccgaaagcaccgccgcactaggatgcctcgtcaaagactactttcccgaacccgtaaccgtctcctggaactctggtgcactcacctccggtgtccacacttttccagccgtcctccagtcctccggcctatactccctctcctccgtcgtaaccgtaccctcctcatccctaggcaccaaaacgtatacctgcaacgtagatcacaaaccctccaacaccaaagtcgacaaacgcgtcgaatccaaatacggaccaccctgcccaccctgccccgcccccgaatttctaggcggcccctccgtcttcttattcccacccaaacccaaggacacactaatgatatcccgcacccccgaagtcacttgcgtcgtcgtcgacgtctcacaagaagatcccgaagtccaattcaactggtacgtagatggcgtcgaagtccacaacgccaaaaccaaacccagagaagaacagttcaacagcacataccgtgttgtatcagtcctcaccgtcctacaccaagactggctcaacggtaaagaatacaaatgcaaagtctctaacaaaggcctgccctccagcatcgaaaagacaatctccaaagccaaaggccaaccccgcgaaccccaagtctacacactaccaccctcacaagaagaaatgactaaaaaccaagtctcactcacatgcctagtcaaaggcttctacccctctgacatagccgtcgaatgggaatcaaatggtcaacccgaaaataactacaaaaccaccccacccgtactcgactccgacggctccttcttcctatactcccgcctcaccgtcgacaaatcccgttggcaagaaggcaatgtcttctcctgctctgtaatgcacgaagccctccacaaccactacacacaaaaatcactctcattatccctaggc

SEQ ID NO: 54257 - RNA, 645 nt, synthetic construct
  misc_feature 1..645: note = derived and/or modified sequence opt11 from Rinucumab_LightChain1
  source 1..645: mol_type = other RNA
gaaatcgttctcacccaatcccccgacaccatctccctctcacccggcgaacgagccaccctctcctgccgcgcctcccaatccatctcctccatctacctcgcctggtaccaacaaaaacccggccaagcaccccgcctcctcatctacggcgcctcctcccgagtcaccggcatccccgaccgcttctcagtctccggctccggaaccgacttcaccctcaccatctcacgcctcgaaccagaagacttcgccgtctactactgccaacattacggcatctcccccttcaccttcggccccggcaccaaagtcgacatccgccgcaccgtcgccgccccctccgtcttcatcttcccaccctccgacgaacaactcaaatccggcaccgcctccgtcgtctgcctcctcaacaacttctacccccgcgaagccaaagtccaatggaaagtcgacaacgccctccaatccggcaactcccaagaatccgtcaccgaacaagactccaaagactcaacctactccctctcctcaactctcacactctccaaagccgactacgaaaaacacaaagtctacgcctgcgaagtcacccaccaaggcctctcgtcccccgtcaccaaatccttcaaccgaggcgaatgc

SEQ ID NO: 54258 - RNA, 1347 nt, synthetic construct
  misc_feature 1..1347: note = derived and/or modified sequence opt11 from Risankizumab_HeavyChain1
  source 1..1347: mol_type = other RNA
caggtacaactagtccaatcaggcgcagaagtaaaaaaacccggttcatcagtcaaagtctcttgtaaagcatcaggctacaccttcaccgaccaaaccatccattggatgcgccaagccccaggccaaggcctagaatggataggctacatatacccccgcgacgactcccccaaatacaacgaaaacttcaaaggcaaagtcaccatcaccgcagacaaatccacatctaccgcgtacatggaactcagcagcttacggagcgaagacaccgccgtctactactgcgccatccccgaccgctcaggctacgcctggttcatctactggggccaaggcaccctcgtaaccgtctcctccgcctccactaaaggcccctccgtcttcccactcgccccctcctcaaaatcgacctcaggaggcaccgccgcccttggctgcctcgtcaaagactactttcctgaacccgtaacagtatcctggaacagcggcgccctaacatccggcgtccacaccttccccgccgtcctccaatcatccggactctattcactctcctcagtagtcactgttccttcatcttctctcggaacccaaacctacatctgcaacgtaaaccacaaaccatcaaacacaaaagtcgacaaacgagtcgaacccaaatcctgcgacaaaacccacacctgtcccccctgccccgcacccgaagccgccgggggcccctcagtattcctcttcccccccaaaccaaaagacacactcatgatctcccgcacacccgaagtaacctgcgtcgtagtagacgtctcccacgaagaccctgaagtcaaattcaactggtacgttgacggcgtagaggtccacaatgccaaaaccaaaccccgagaagaacaatacaactccacttaccgcgtcgtctccgtactcaccgtattacaccaagactggctaaacggaaaagaatacaaatgcaaagtctccaacaaagcactccccgctcccatagaaaaaaccatatcaaaagcaaaaggccaaccccgagaaccacaagtctacacactccccccctcccgcgaagaaatgaccaaaaaccaagtctcccttacctgcctcgtcaaaggcttctacccatccgacatagccgtcgaatgggaatccaatggccagcccgaaaacaactataaaactactcccccagtcctcgactcagacgggtccttcttcctctacagcaaactcaccgtagacaaatcccgctggcaacaaggcaacgtcttctcctgctcagtcatgcacgaagccctccacaaccactacacacaaaaatccctctccctctccccaggc

SEQ ID NO: 54259 - RNA, 642 nt, synthetic construct
  misc_feature 1..642: note = derived and/or modified sequence opt11 from Risankizumab_LightChain1
  source 1..642: mol_type = other RNA
gacatccaaatgacccaatccccctcctccctctccgcctctgtcggcgaccgcgtaaccataacatgcaaagcctcccgcgacgtagccatcgccgtcgcctggtaccaacaaaaacccggcaaagtccccaaactcctcatctactgggcctccacccgccacaccggagtcccctcccgtttctcaggctcaggctcccgcaccgacttcaccctcaccatctcctcactccaacccgaagacgtagccgactacttctgccaccaatactcatcataccccttcaccttcggctccggcaccaaactagaaatcaaacgcaccgtcgcagccccatccgtcttcatattcccaccctccgacgaacaactcaaatccggcaccgcctccgtcgtatgcctcctcaacaacttctacccccgcgaagccaaagtccaatggaaagtcgacaacgccctccaatccggcaactcccaagaatccgtaaccgaacaagactccaaagactccacctactccctatcctccaccctcaccctctccaaagccgactacgaaaaacacaaagtctacgcatgcgaagtcacccaccaaggcctatcctcccccgtcaccaaatccttcaaccgcggcgaatgc

SEQ ID NO: 54260 - RNA, 1353 nt, synthetic construct
  misc_feature 1..1353: note = derived and/or modified sequence opt11 from Rituximab_HeavyChain
  source 1..1353: mol_type = other RNA
caagtccaactccaacaacccggcgcagaactcgtcaaacccggcgcttcggttaaaatgtcctgcaaagccagcggctacaccttcacatcttataacatgcactgggtcaaacaaacacccggcagaggactagaatggatcggcgccatctaccccggcaacggcgacacatcatacaaccaaaaattcaaaggcaaagccaccctaaccgcagacaaatcctcatccacagcctacatgcaattatcctccctcacctccgaagacagcgccgtttactactgtgcccgatcaacctactatggcggcgactggtacttcaacgtctggggagccggaaccactgtaaccgtctccgccgcctccaccaaaggaccctcagtattcccactggccccctcatcaaaatcaacatcaggcggcaccgcagccctaggctgcctagtcaaagactacttccccgaacctgtcaccgtaagctggaactccggcgccctaacatccggtgtccacaccttccccgcagtcctacaatcatccggcctctactccctctcctcagtagtaaccgtaccgtccagctcgctcggcacccaaacctacatctgcaacgtcaaccacaaacccagcaacaccaaggtcgacaagaaagtcgaaccaaaatcctgcgacaaaacccacacctgtcccccttgcccagcaccagaactcttaggaggcccttcagtcttcctatttccacccaaacccaaagacaccctcatgatctcccgcaccccagaagtgacctgcgtcgtcgtagacgtttcacacgaagaccccgaagtaaaattcaactggtacgtcgacggcgtcgaagtccacaacgccaaaaccaaacccagagaagaacaatacaactcaacttaccgagtcgtctccgtcctcacagtcctacatcaagactggctcaacggcaaagaatacaaatgcaaagtatccaacaaagccctccccgcacccatcgagaaaaccatctcaaaagccaaaggccaaccacgcgaaccacaagtctacacactgccgccctcacgagacgaactaaccaaaaaccaagtatccctaacctgcctcgtaaaaggcttctacccatccgacatcgccgttgaatgggaatccaacggacaacccgaaaacaactacaaaaccacaccacccgttctagactctgacggctccttcttcctctacagcaaactcacagtcgacaaaagccgctggcaacaaggcaacgttttctcttgctccgtaatgcacgaagcactccacaaccactacacccagaaatccctctccctctcacccggaaaa

SEQ ID NO: 54261 - RNA, 1353 nt, synthetic construct
  misc_feature 1..1353: note = derived and/or modified sequence opt11 from Rituximab_HeavyChain_variant
  source 1..1353: mol_type = other RNA
caagtccaactacaacaacccggcgcagagctcgtcaaacccggcgcctccgtcaaaatgtcctgcaaggccagcggatacacattcacatcctacaacatgcactgggtcaaacaaacccccggccgagggctcgaatggatcggcgcaatataccccggcaacggcgacacatcctacaaccaaaaattcaagggcaaagccaccctcaccgccgacaaatcctcatcaacagcatacatgcagctcagctccctgacctccgaagactccgcagtctactactgcgcacgatccacatactacggcggcgattggtactttaacgtctggggcgccggaacaacagtcaccgtatccgcagcctccaccaaaggaccctccgtcttccctctagcacccagctccaaatccacctctggaggcaccgcagccctcgggtgtctagtcaaagactacttcccagaacccgtcaccgtaagctggaactccggcgccctaacaagcggcgtacacactttcccagccgtactacaatcctccggactctactccctatccagcgtagtcacagtcccctcctcttccctaggcacacaaacgtacatctgcaatgtcaaccacaaaccctcaaacaccaaggtagacaagaaagcagaacccaaaagctgcgacaaaacccacacctgtcccccatgccccgcccccgaactactcggaggccccagcgtattcctcttcccacccaaacccaaagacacactcatgatctcccgcaccccagaagtaacctgcgtcgtcgtcgacgtctcccacgaagaccccgaagtcaaattcaactggtatgtcgacggcgtcgaagtacacaacgccaaaaccaaaccccgcgaagaacaatacaactctacctatcgtgtagtctccgtcctaaccgtcctccaccaagactggctcaacggaaaagagtacaaatgcaaagtcagcaacaaagccctccccgcccccatcgagaaaaccatttccaaagccaaagggcaaccacgagaaccgcaagtctacaccctcccaccctcccgtgacgaactcaccaaaaaccaagtctcactaacgtgcctcgtcaaaggcttctacccctcagatatcgcagtcgaatgggaatccaatggccaacccgaaaacaactacaaaacaacgccaccagtactagactcagacggttccttcttcctatactcaaaactcacagtcgacaaaagccgctggcaacaaggcaacgtcttctcatgcagcgtcatgcacgaagcactccacaaccactatactcagaaaagcctatccctctccccaggaaaa

SEQ ID NO: 54262 - RNA, 639 nt, synthetic construct
  misc_feature 1..639: note = derived and/or modified sequence opt11 from Rituximab_LightChain
  source 1..639: mol_type = other RNA
caaatcgtcctctcccaatcccccgccatcctctccgcctcccccggcgaaaaagtcaccatgacctgccgcgcctcctcctccgtctcctacatccactggttccaacaaaaacccggctcctccccaaaaccctggatctacgccacctccaaccttgcctccggcgtccccgtccgcttctccggctccggctccggcacctcctactccctcaccatctcccgcgtcgaagccgaagacgccgccacctactactgccaacaatggacctccaacccccccaccttcggcggcggcaccaaactcgaaatcaaacgcaccgtagccgccccctccgtcttcatcttccccccctcagacgaacaactcaaatcaggtacagcctcagtcgtatgcctcctcaacaacttctacccccgcgaagccaaagtccaatggaaagtcgacaacgccctccaatccggcaactcccaagaatccgtcaccgaacaagactccaaagactccacctactccctctcatcaaccctcaccctctccaaagccgactacgaaaaacacaaagtctacgcctgcgaagtcacccaccaaggactctcctcccccgtaacaaaatcattcaaccgaggcgaatgc

SEQ ID NO: 54263 - RNA, 714 nt, synthetic construct
  misc_feature 1..714: note = derived and/or modified sequence opt11 from Rivabazumab_pegol_HeavyChain1
  source 1..714: mol_type = other RNA
gaagtccaactcgtagaatccggcggcggcgtcgtccaacccggcagatccctacgcctctcctgcgccgcctccggcttcaccttctccaactaccccatgcactgggttagacaagcccccggcaaaggcctcgaatgggtcgccgtcatctcatacgacggctctgaaaaatggtacgccgactcagtaaaaggccgattcacaatcagcagagataactcaaaaaacaccctctacctagaaatgaacagcctccgcccagaagacaccgccgtctactactgcgcccgcaaccgaggcgacatctactacgacttcacctacgccatggacatctggggccaaggcaccaccgtaaccgtctcatccgcatccaccaaaggcccatccgtcttcccactcgccccctccagcaaatcaacctccggcggcaccgccgccctcggctgcctcgtcaaagactacttccccgaaccagtcaccgtctcatggaactccggcgccctcacctcaggagtccacaccttccccgccgtcctccaatcctccggcctctactccctctcctccgtcgtcaccgtcccaagctcctccctcggcacacaaacctacatctgcaacgtaaaccacaaacccagcaacaccaaagtcgacaaaaaagtagaacctaaatcatccgacaaaacccacacctgccccccatgcccagcc

SEQ ID NO: 54264 - RNA, 642 nt, synthetic construct
  misc_feature 1..642: note = derived and/or modified sequence opt11 from Rivabazumab_pegol_LightChain1
  source 1..642: mol_type = other RNA
gacatacaactcacccaatccccatccaccctctcagcctccgtcggcgactccgtaaccatcacatgccgagcctccgaaggcgtcgaccgctggctcgcctggtaccaacaaaaacccggccgcgcccccaaactcctaatctacgacgcctccaccctacaatccggcgtcccctcccgattctctggctccggctccggcaccgaattctccctcaccatctcttcccttcaacccgacgacgtcgctacctactactgccaacacttctggggcaccccctacacattcggccaaggcaccaaactcgaaataaaacgaaccgtcgccgccccctccgtcttcatcttcccaccctccgacgaacaactcaaatccggcaccgcctccgtagtctgcctcctcaacaacttctacccccgcgaagccaaagtccaatggaaagtcgacaacgccctccaatccggcaactcccaagaatccgtcaccgaacaagactcaaaagactccacctactccctctcctccacactcacactctcaaaagccgactacgaaaaacacaaagtatacgcctgcgaagtcacccaccaaggactctcctcccccgtcaccaaatccttcaaccgcggcgaatcc

SEQ ID NO: 54265 - RNA, 1344 nt, synthetic construct
  misc_feature 1..1344: note = derived and/or modified sequence opt11 from Robatumumab_HeavyChain1
  source 1..1344: mol_type = other RNA
gaagtccagctcgtccaatctggcggtggcctagtaaaacccggagggtccctccgcctttcatgcgccgcaagcggcttcaccttctccagcttcgccatgcactgggtcagacaagcaccaggaaaaggcctagaatggatttccgtaatcgacacccgcggtgccacgtactacgccgacagcgtcaaaggccgattcaccatctcaagagacaacgccaaaaactccctctatctccaaatgaactccctccgagcagaagacactgccgtttactactgcgcccgccttggaaacttctactacggcatggacgtctggggacaaggaaccacagtcaccgtttcctccgcctccaccaaaggaccatccgtcttccccctagccccatcatccaaatccacctccggaggcaccgccgccctaggatgcctagtcaaagactactttcccgaacccgtcaccgtctcctggaactccggcgctctcacatctggcgtccacaccttccccgccgtactccaatcatcaggactctactcactatcatccgtcgtaacggtcccctcctcctcactaggcacacaaacctacatctgcaacgtcaaccacaagccatccaacaccaaagtcgacaagaaagtcgagccaaaatcctgcgacaaaacccatacctgcccaccctgccccgcccccgaacttctcggaggaccctccgtcttcctcttcccacccaaacccaaagacacacttatgatctcccgaacacccgaagtaacctgcgtcgtagtcgacgtctcacacgaagaccccgaagtcaaattcaactggtacgttgatggagtcgaagtccacaacgccaaaaccaaaccccgagaagaacaatacaactccacctaccgtgtcgtaagcgtcctcacagtactccaccaagactggctaaacggaaaagaatacaaatgcaaagtaagcaacaaagccttaccagcccccatcgagaagaccatatccaaagcaaaaggccaaccccgagaaccccaagtatacaccctcccgccctcccgagacgaactaaccaaaaaccaagtatcactaacctgcctagtcaaaggcttctacccctccgacatcgcagttgaatgggaatccaacggccaaccagagaacaactacaagaccacaccacccgtcctcgactcggacggcagctttttcctctactccaaactaacagtcgacaaatcccgctggcaacaaggaaacgtattctcatgctcagtcatgcacgaagccctccacaaccactacacccagaaaagcctctcactctcccccggaaaa

SEQ ID NO: 54266 - RNA, 642 nt, synthetic construct
  misc_feature 1..642: note = derived and/or modified sequence opt11 from Robatumumab_LightChain1
  source 1..642: mol_type = other RNA
gaaatcgtactcacccaatcccccggaaccctcagcgtctcccccggcgaacgcgcaaccctaagctgccgcgcaagccaatccatcggctctagcctccactggtaccaacaaaaacccggccaagcccccagactactcatcaaatacgcctcacaatccctttccggcatccccgaccgattctcaggctccggatccggcacagacttcaccctcaccatcagccgactagaacccgaagacttcgccgtctactactgccaccaatcctcccgactcccccacaccttcggacaaggaaccaaagtcgaaatcaaacgcaccgtcgccgcccccagcgtcttcatattcccaccctccgacgaacaactcaaatccggcacagcctcagtcgtatgcctactcaacaacttctacccccgcgaagcaaaagtccaatggaaagtagacaacgccctccaatccggcaactcacaagaatccgtaaccgaacaagactccaaagactccacctactccctaagctcaaccctaaccctaagcaaagccgactacgaaaaacacaaagtctacgcatgcgaagtcacccaccaaggcctctcctcacccgtaaccaaatccttcaacaggggcgaatgc

SEQ ID NO: 54267 - RNA, 1368 nt, synthetic construct
  misc_feature 1..1368: note = derived and/or modified sequence opt11 from Roledumab_HeavyChain1
  source 1..1368: mol_type = other RNA
caagtacaactcgtcgaatccgggggcggtgtcgtacagcccggccgcagcttacgcctttcctgcacagcctccggattcacattcaagaactacgccatgcactgggtccgacaagcgcccgccaaaggcctcgaatgggtcgctacaatctcctacgacggccgcaacatccaatacgccgactccgtcaaaggccgcttcaccttctccagagacaactcacaagacaccctctaccttcaactgaactcgctacgacccgaagacaccgccgtatactactgcgcccgccccgtccgctcccgttggctccaactcggcctcgaagacgctttccacatctggggccaaggcaccatggtcaccgtttcatccgcctcaaccaagggcccctccgtcttcccactcgcaccatcctccaagtccacctccggcggaaccgccgccctgggatgcttagtaaaagactacttccccgaacccgtcaccgtatcatggaactccggcgcactcacctccggcgtccacacattccccgctgtcctccagtcatccggcctctactccctcagctccgtcgtcaccgtaccctcctcatccctcggcacccaaacctatatctgcaacgtcaaccacaaaccctccaacaccaaagtcgacaagaaagtagaacccaaatcctgcgacaaaacccatacctgcccaccctgccctgcacccgaactcctcggaggcccctcagtcttcctgttcccacccaagcccaaagacactctgatgatctcacgaacccccgaagtaacatgcgtcgtcgtcgacgtctcacacgaggaccctgaagtcaaattcaactggtacgtcgacggcgtcgaagtccacaacgctaaaaccaaaccccgcgaggaacaatataactccacctatagagtcgtgtccgtactcacagttcttcaccaagactggctaaacggcaaagaatacaaatgcaaggtatcaaacaaagcactacccgcacccatcgaaaagacaatctccaaagctaaaggccaaccccgcgaaccccaagtctacaccctcccaccctcccgcgacgaactaacgaaaaaccaggtctcactaacctgcctcgtcaaaggcttctacccctccgacatagccgtcgaatgggaatccaacggacaacccgaaaacaactacaaaacgaccccacccgtcctcgactccgacggctccttcttcctctacagcaaactcaccgtcgacaagtcccgctggcaacaaggcaacgtcttctcctgctcggtcatgcacgaagcactacacaaccactacacacaaaaatccctatccctctcacccggtaaa

SEQ ID NO: 54268 - RNA, 642 nt, synthetic construct
  misc_feature 1..642: note = derived and/or modified sequence opt11 from Roledumab_LightChain1
  source 1..642: mol_type = other RNA
gccatccgcatgacccaatccccctcctccttctccgcctctaccggcgaccgcgtcaccatcacatgccgcgcctcccaagacatccgcaactacgtcgcctggtaccaacaaaaatccggcaaagcacccaaattccttatctacgcagcctccaccctccaatcaggcgtccccagcagattctccggctccggctcaggcacagacttcaccctcaccatcaactccctacaatccgaagacttcgccacatactactgccaacaatactacaactccccacccacattcggccaaggcacccgagtcgaaatcacccgcaccgtcgccgccccctccgtcttcatcttcccaccctccgacgaacaactcaaatctggcaccgcctccgtcgtatgcctcctcaacaacttctacccccgagaagccaaagtccaatggaaagtcgacaacgccctccaatctggaaactctcaagaatccgtcaccgaacaagactccaaagactccacctactccctctcctccaccctcaccctctccaaagccgactacgaaaaacacaaagtctacgcctgcgaagtcacccaccaaggcctatcctcccccgtcaccaaatccttcaaccgaggcgaatgc

SEQ ID NO: 54269 - RNA, 639 nt, synthetic construct
  misc_feature 1..639: note = derived and/or modified sequence opt11 from Romosozumab_fab_fragment
  source 1..639: mol_type = other RNA
gacatacaactcacccaatcaccctcatccctatcagcctccgtcggcgaccgcgtcaccataacctgctccgcctcccaagacatctcaaactacctaaactggtaccaacaaaaacccggcaaagcccccaaagtcctcatctacttcacctcatcactccacagcggagtcccctcccgattctccggctctggctccggcaccgacttcaccctcaccatctcatcactccaacccgaagacttcgccacctactactgccaacaatactccacagtcccctggaccttcggccaaggcaccaaagtcgaaatcaaacgcaccgtcgccgccccctccgtcttcatcttcccaccctccgacgaacaactcaaatccggcacagcctccgtagtctgcctcctcaacaacttctacccccgcgaagccaaagtccaatggaaagtcgacaacgcccttcaatccggcaactcccaagaatccgtcaccgaacaagactccaaagactcaacctactccctctcatccaccctaaccctctccaaagccgactacgaaaaacacaaagtctacgcctgcgaagtcacccaccaaggactctcctcccccgtcaccaaatccttcaaccgcggagaa

SEQ ID NO: 54270 - RNA, 1347 nt, synthetic construct
  misc_feature 1..1347: note = derived and/or modified sequence opt11 from Romosozumab_HeavyChain1
  source 1..1347: mol_type = other RNA
gaagtccaactcgtccaaagtggcgccgaagtcaagaaaccaggagcctccgtcaaagtctcctgcaaagcatccggatacacattcaccgactacaacatgcactgggtacgacaagcccccggccaaggactagaatggatgggagaaatcaacccaaactccgggggcgccggctacaaccaaaaattcaaaggccgagtcactatgaccaccgacaccagcacgtcaacagcctacatggaactacgatccctacgatccgacgataccgccgtatactactgcgcccgactaggctacgacgacatctacgacgactggtactttgatgtatggggtcaaggcaccaccgtcaccgtctcatcagcctccacaaaaggaccctccgtgttcccccttgcgccctgctcccgctccacctccgaatccaccgcagccctcggatgcctcgtcaaagactacttccccgaacccgtcaccgtgtcctggaactcaggcgccctgaccagcggcgtccacaccttccccgcggtcctacaatcaagcggcctttactccctaagctcagtcgtcacagtcccaagcagcaacttcggcacccaaacttacacttgcaacgtcgaccacaaacccagcaacaccaaagtcgacaaaaccgtagaacgaaaatgctgcgtcgaatgcccaccctgccccgcccctcccgtagccggacccagcgtcttcctattcccacccaaacccaaagacaccctaatgatctcacgcacccccgaagtgacctgcgtcgtcgtcgacgtaagccacgaagaccccgaagtccaattcaactggtacgtagacggcgtagaagtccacaacgcaaaaaccaaacccagagaagaacaattcaactctacattccgagtagtctccgtcctaacagtcgtccaccaagactggctaaacggaaaagaatacaaatgcaaagtctcaaacaaaggcctgcccgcccccatcgaaaagacaataagcaaaaccaaaggccaaccacgagaaccccaagtctacactctccctccctcccgcgaagaaatgaccaaaaaccaagtatccctaacatgcctcgtcaaaggcttctacccatccgacatagccgttgaatgggaatccaacggacaacccgaaaacaactacaaaacaacccctcccatgctcgactccgacggctccttcttcctgtactctaaactaacagtcgacaaatctagatggcaacaaggcaacgtattctcttgctccgtcatgcatgaagcgctccacaaccactacacccaaaaatcactctccctatcccccggcaaa

SEQ ID NO: 54271 - RNA, 642 nt, synthetic construct
  misc_feature 1..642: note = derived and/or modified sequence opt11 from Romosozumab_LightChain1
  source 1..642: mol_type = other RNA
gacatccaaatgacccaatctccctccagcctctccgcctcagtcggcgaccgcgtcaccatcacatgccgcgcctcccaagacatctccaactacctcaactggtaccaacaaaaacccggcaaagcccccaaactactcatctactacacctcccgactcctctccggcgtccccagcagattctccggctccggctccggcaccgacttcacactaaccatctcctcactccaacccgaagacttcgccacctactactgccagcaaggagacaccctcccctacaccttcggcggcggaaccaaagtcgaaatcaaacgcaccgtagccgcaccctccgtattcatcttcccaccctctgacgaacaactcaaatccggcaccgcctcagtcgtctgcctcctcaataacttctacccccgcgaagccaaagtccaatggaaagtcgacaacgccctccaatccggcaactcccaagaatcagtcaccgaacaagactccaaagactccacctactcactcagctcaaccctaaccctatccaaagccgactacgaaaaacacaaagtctacgcctgcgaagtcacccaccaaggcctcagctcccccgtcaccaaatccttcaaccgcggcgaatgc

SEQ ID NO: 54272 - RNA, 1326 nt, synthetic construct
  misc_feature 1..1326: note = derived and/or modified sequence opt11 from Rontalizuab_HeavyChain1
  source 1..1326: mol_type = other RNA
gaagtccaactcgtcgaatccggaggcggcctagtacaacccggaggcagcctacgcctctcctgcgccaccagcgggtacacattcaccgaatacatcatccactgggttcgccaagccccaggaaaaggactcgaatgggtcgcctccatcaaccccgactacgacataaccaactacaaccaacggttcaaaggccgcttcaccatttctctcgacaaatccaaacgcaccgcctacctccaaaactccctccgcgcagaagacacagccgtatactattgcgcctcttggatctcagatttcttcgactattggggccaaggaaccctcgtaacagtctcctcagcctccaccaaaggcccctccgtcttccccctcgccccatcctccaaatccacctccggaggaaccgccgccctcggatgcctcgtaaaagactacttccccgaacccgtaaccgtgtcctggaacagcggcgccctaacctccggcgtccacacgttccccgccgtgctccaatcctcaggtctctacagcctctcatcggtcgtcacagtcccctcctcatccctcggtacccaaacctacatctgcaatgtaaaccacaaaccatccaacactaaagtcgacaagaaagtcgaacccaaatcctgcgacaaaacacacacctgtccaccctgccccgcacccgaactactaggcggcccctccgtcttcctcttcccacccaaacccaaagacaccctaatctcccgcacacccgaagtcacatgcgtcgtagtcgatgtatctcacgaagaccccgaagtcaaattcaactggtacgtcgacggcgtagaagtgcacaacgccaaaaccaaacccagggaggaacaatacaactccacctaccgtgtcgtctccgtgctcactgtattacaccaagactggctcaacggcaaagaatacaaatgcaaagtttccaacaaagctctaccagcccctatcgagaaaaccatatccaaagccaaaggccaacccagagaaccccaagtatacacactcccacccagccgcgaagaaaccaaaaaccaagtatcacttacctgcctcgtgaaaggcttctacccttccgacattgccgtcgaatgggaatcaaacggccaaccggaaaataactacaaaacaacaccacccgtcctcgactcagacggctccttcttcctctacagcaaactaacggtcgacaaatcacgttggcaacaaggcaacgtcttctcctgctccgtccacgaagccctacacaaccactacacccaaaaatccctatctctctcccccgga

SEQ ID NO: 54273 - RNA, 648 nt, synthetic construct
  misc_feature 1..648: note = derived and/or modified sequence opt11 from Rontalizuab_LightChain1
  source 1..648: mol_type = other RNA
gacatccaaacccaatccccctcctcactctccgcctccgtcggagaccgagtcaccatcacatgccgcgcctcccaatccgtctccacctcctcctactcctaccactggtaccaacaaaaacccggcaaagcacccaaagtcctaatctcatacgcctccaacctcgaatccggcgtcccctcacgattctccggctccggctccggcaccgacttcaccctcaccatctcctccctccaacccgaagacttcgccacatactactgccaacactcctggggaatcccacgcaccttcggccaaggcaccaaagtcgaaatcaaacgcaccgtcgccgccccctccgtattcatcttccctccctcagacgaacaactcaaatccggcacagcctccgtcgtctgcctcctcaacaatttctacccccgcgaagccaaagtccaatggaaagtagacaacgccctacaatcaggcaactcccaagaatccgtcaccgaacaagactccaaagactccacctactccctttcctccaccctcaccctctccaaagccgactacgaaaaacacaaagtctacgcctgcgaagtcacccaccaaggcctctcctcccccgtcaccaaatctttcaaccgcggcgaatgc

SEQ ID NO: 54274 - RNA, 1341 nt, synthetic construct
  misc_feature 1..1341: note = derived and/or modified sequence opt11 from Rontalizumab_HeavyChain1
  source 1..1341: mol_type = other RNA
gaagtacagctagtcgaatccggcggaggccttgtacaacccggaggctctctacgcctctcatgcgccacatccggctacaccttcaccgaatacatcatccactgggtccgccaagcccccggcaaagggctcgaatgggtagcctccattaaccccgactacgatataaccaactacaaccaacgctttaaaggacgcttcacaatctccttagacaaatccaaacgcaccgcctacctccaaatgaactcacttcgcgcagaagacacagccgtctactactgcgccagctggatatcagacttcttcgactactggggccaaggcacgctcgtcacagtctcatctgcctccacaaaaggcccctcagtcttccccctagccccttcctccaaaagcacctccggcggcaccgccgcactcggctgcctcgtcaaagactacttccccgaacctgtcacagtctcctggaactccggcgcactcacatccggcgtccacacattccccgccgtcctacaatcatcaggcctatactccctttcaagcgtcgtcaccgtccctagctcctccctcggcacccaaacttacatctgcaacgtcaatcacaaaccatccaacaccaaagtagacaagaaagtagaaccaaaatcctgcgacaaaacccacacatgcccaccctgccccgcacccgaactcctcggaggaccctccgtctttctcttcccacccaaacccaaagacaccctcatgatctcacgcacacccgaagtaacctgcgtcgtcgtcgacgtctcccacgaagaccccgaagtcaagttcaactggtatgtagacggcgtagaggtacacaacgccaaaaccaaaccccgcgaagaacaatacaattccacctaccgagtcgtcagcgtcctaacagtactccaccaggactggctcaacggcaaggaatacaaatgcaaagtctctaacaaagccctcccagccccaatcgagaaaactatctccaaagccaaaggccaaccacgcgaaccccaagtttacaccctacccccatcccgtgaagaaatgaccaaaaaccaagtctccctcacctgtctcgtcaaaggattctacccatccgacatcgccgtcgaatgggaatccaacggccaaccagaaaacaactacaaaaccacccctcccgtcctagactccgacggctccttcttcctctactctaaactaaccgtcgacaaatcacgctggcaacaaggcaacgtcttctcctgctccgtaatgcacgaagcccttcacaaccactacacacaaaaatcactctccctttcccccggtaag

SEQ ID NO: 54275 - RNA, 654 nt, synthetic construct
  misc_feature 1..654: note = derived and/or modified sequence opt11 from Rontalizumab_LightChain1
  source 1..654: mol_type = other RNA
gacatccagatgacgcaatcgccctcgagcctgagcgcgagcgtgggcgatcgcgtgaccataacctgccgcgcgagccagagcgtgagcacgagctcgtactcgtacatgcactggtaccagcaaaagcccggaaaagcgcccaaggtcttgatctcgtacgcaagcaatctcgagagcggagtcccaagcaggttctcgggctcgggctcgggcacggacttcaccctgaccataagctcactccagcccgaggactttgccacgtactactgccagcactcgtgggggatcccacgcacattcgggcaagggaccaaggtcgagatcaagcgcacagtcgcagccccaagcgtattcatattcccgccctcagacgagcaactgaaatcaggcacggcctcagtcgtatgcctactcaacaacttctacccgcgcgaggccaaggtccagtggaaggtcgataacgcactccaatccgggaactcacaagagagcgtgaccgagcaagacagcaaagactcgacatatagcctgagttcaaccctgaccttgagcaaggccgattacgagaaacataaagtgtacgcgtgcgaggtcacacaccagggcctgagctcacccgtgaccaagagcttcaacaggggcgagtgc

SEQ ID NO: 54276 - RNA, 1341 nt, synthetic construct
  misc_feature 1..1341: note = derived and/or modified sequence opt11 from Rovalpituzumab_tesirine_HeavyChain1
  source 1..1341: mol_type = other RNA
caagtccaactcgttcaaagtggagccgaagtcaagaaacccggcgcttctgtcaaagtatcctgcaaagcctcgggatacacctttaccaactacggcatgaactgggtccgccaagcccccggacaaggcctcgaatggatgggctggatcaacacctacaccggcgaacccacctacgcagacgacttcaaaggacgtgtcaccatgaccacagacacgtcgacctccaccgcctacatggaactacgcagcctccgcagcgacgacaccgcagtctactactgcgcacgcataggagactcctccccatccgactactggggacaaggaaccctcgtcacagtatcctcagcctccaccaaaggcccgtcagtcttccccctcgccccctcctccaaaagcacctccggcggcaccgccgccctaggctgcctcgtcaaagactacttcccagaacccgtaaccgtctcctggaactccggcgcactgacctcaggcgtgcacaccttcccagcagtcctccaaagctcaggcctctattccctctcatccgtcgtcaccgtcccctcctccagcctaggcactcaaacctacatctgcaacgtcaaccacaaacccagcaacaccaaagtcgacaagaaagtagaacccaaatcctgtgacaaaacccacacctgtcccccttgcccagccccagaactattaggcggcccctccgtcttcctcttcccacccaaacccaaagataccctcatgatctctcggacacccgaagtcacatgcgttgtcgtcgacgtatcccacgaagaccccgaagtcaaattcaactggtacgtcgacggcgtagaagtccacaacgcaaaaaccaaaccccgcgaagaacaatataactctacctaccgagtagtcagcgtcctcacagtcctccatcaagactggctcaacgggaaagaatacaaatgcaaagtctccaacaaggccctacccgcccccatcgagaaaaccatctcaaaagccaaaggccaacccagagaaccacaagtctacaccctccctccctcacgcgacgaactaaccaaaaaccaagtttccctaacctgcctcgtcaaaggcttctacccctccgacatagccgtagaatgggaatccaacggccagcccgaaaacaactataaaaccacacccccagtactcgactcagacggctccttcttcctctactcaaaactaaccgtcgacaagtcccgctggcaacaaggcaacgtcttctcctgctcagtcatgcacgaagccctccacaaccactacacccagaaaagcctctcactaagccccggc

SEQ ID NO: 54277 - RNA, 642 nt, synthetic construct
  misc_feature 1..642: note = derived and/or modified sequence opt11 from Rovalpituzumab_tesirine_LightChain1
  source 1..642: mol_type = other RNA
gaaatcgtcatgacccaatcacccgccaccctctccgtatcccccggcgaacgagccaccctctcctgcaaagcctcccaatccgtctccaacgacgtagtctggtaccaacaaaaacccggccaagccccccgcctcctaatctactacgcatccaaccgctacaccggcatccccgcccgattctccggctccggctcaggcaccgaattcaccctaaccatcagctccctccaatccgaagacttcgccgtatactactgccaacaagactacacctccccctggaccttcggccaaggaaccaaactcgaaatcaaacgaaccgtcgccgccccctccgtcttcatcttccccccctcagacgaacaactcaaatccggcaccgcctccgtcgtctgcctcctcaacaacttctacccccgcgaagccaaagtccaatggaaagtcgacaacgccctacaatccggaaactcccaagaatccgtcaccgaacaagactccaaagactcaacatactccctctcctcaaccctcaccctctccaaggcagactacgaaaaacacaaagtctacgcctgcgaagtcacacaccaaggcctttcctcccccgtaaccaaatccttcaaccgcggcgaatgc

SEQ ID NO: 54278 - RNA, 1341 nt, synthetic construct
  misc_feature 1..1341: note = derived and/or modified sequence opt11 from Rovelizumab_HeavyChain1
  source 1..1341: mol_type = other RNA
caagtacaactggtccaatccggagccgaagtcaagaaaccaggcgcctcagtcaaagtctcctgcaaagccagcggatacaccttcacaaacaactggatgcaatgggtcagacaagcccccggccaaggactcgagtggatgggcgcaatcttccccggcgacgacgaaacccgctacacccaaaaattccgaggcaaagcaactatcaccgcggacacctccacctccaccgcctacatggaactatcaagcctccgctcggaagacaccgcggtatattactgtggccgaggaggaaaactccgcccattcgccctcgactactggggacaaggcaccctcgtaaccgtctcatcagcctcaaccaaaggcccctccgtattcccgctagcgccctgcagccgctccacctccgaaagcaccgctgcactcgggtgcctagtcaaggactattttcctgaaccagtcacagtatcctggaactccggagccctaacctccggagttcacacattcccagcagtactccagagctctggcctgtactcactctcaagcgtagtcaccgttccatcatccagcctaggaacaaaaacctacacatgcaacgtcgaccacaagccctccaacaccaaagtcgacaaacgcgtcgaatcgaaatatggccctccctgcccctcatgccccgcccccgaatttctaggaggacccagcgtcttcctcttcccacccaaacccaaagacaccctaatgatctcccgaacacccgaggttacctgcgtcgtcgtcgacgtaagccaagaagaccccgaagtccaattcaactggtatgtcgacggtgtcgaagtccacaacgccaaaaccaaacccagagaagaacaattcaactctacctaccgagtagtatccgtcctaaccgtcttacaccaagactggctcaatgggaaagagtacaaatgcaaagtctcaaacaagggactcccctcaagcatcgagaaaaccatcagcaaagctaaaggccaaccccgcgaaccccaagtctacaccctcccaccatcgcaagaagaaatgaccaaaaaccaagtctctctcacatgcctggtcaaaggcttctacccctccgacattgccgtcgaatgggaaagcaacggccaacccgaaaacaactacaaaacaacccctcccgtcctcgacagcgacggcagctttttcctgtactcacgcctcaccgtcgataaatcccgatggcaggaaggaaacgtattctcgtgctcagtaatgcacgaagccctacacaaccactacacccaaaaatcactctcactctccctcggcaaa

SEQ ID NO: 54279 - RNA, 654 nt, synthetic construct
  misc_feature 1..654: note = derived and/or modified sequence opt11 from Rovelizumab_LightChain1
  source 1..654: mol_type = other RNA
gacatccagatgacacaatcaccatcaagcctcagcgcaagcgtaggcgaccgcgtgaccataacctgccgcgcaagcgaaagcgtagaatcgtacggaaacaacttcatgtactggtaccaacaaaaacccgggaaagcacccaaactcctaatctacctcgcaagcaacctcgaaagcggagtcccgagcagattctccggctcaggctcaggcacagacttcaccctgaccataagctcactccaacccgaagacttcgcaacgtactactgccaccaagacaacgaagacccacccacattcggacaaggaaccaaactcgaaatcaaacgcacggtcgcagccccaagcgtattcatattcccaccctcagacgaacaactaaaatcaggcacagcctcagtcgtgtgcctcctcaacaacttctacccacgcgaagccaaagtccaatggaaagtcgacaacgcactccaaagcggaaactcacaagaaagcgtgaccgaacaagacagcaaggactcaacctactccctgagctcgacactaaccctaagcaaggccgactacgaaaaacacaaagtatacgcgtgcgaagtcacacaccaaggcctaagctcacccgtaaccaaatccttcaacagaggcgaatgc

SEQ ID NO: 54280 - RNA, 1341 nt, synthetic construct
  misc_feature 1..1341: note = derived and/or modified sequence opt11 from Ruplizumab_HeavyChain1
  source 1..1341: mol_type = other RNA
caagtacagctagtacaatccggcgccgaagtcgtcaaacccggcgcctccgtcaaactctcctgcaaggcatccggctacatcttcacatcctactacatgtactgggtcaagcaagcccccggacaaggcctcgaatggataggtgagatcaacccctccaacggagacacgaacttcaacgaaaaattcaaaagcaaagccaccctcaccgtcgacaaatcagcatccaccgcctacatggagctatcctctctccgctccgaagacaccgccgtctactactgcacccgctcagacggacgaaacgatatggactcatggggccaaggaactctagtcacagtctcttctgccagcacaaaaggcccctcagtcttccccctcgccccctcctcaaagtccaccagcggaggaaccgcagccttaggctgcctcgttaaagactacttcccagaacccgtcaccgtctcctggaactccggagccctaacctcaggcgtacacacattccccgcagtcctccaatcatccggcctatactctctctcatcagtcgtaacagtcccctcatcctcactcggcacacaaacatacatctgcaacgtcaaccacaaacccagcaacacaaaggtcgacaagaaagtagaacccaaaagctgcgacaaaactcacacatgcccaccctgccccgccccagaactactcggaggcccctcagtcttcctcttcccacccaaacccaaagacaccctaatgatatcccgaactcccgaagttacctgcgtcgtcgtcgacgtctcccacgaagaccccgaagtcaaattcaactggtacgtcgacggcgtcgaggtccacaacgctaaaaccaaaccccgcgaggaacagtacaactccacctaccgagttgtctccgtcctaacagtactccaccaagactggctcaacggcaaagaatacaaatgcaaagtatccaacaaagccctcccggctcccatcgagaaaaccatctcaaaagccaaaggccaaccccgcgaacctcaggtctacaccctacccccatcacgcgacgaactcaccaaaaaccaagtaagcctgacatgcctcgttaagggcttctatccctccgacatcgccgtagaatgggagtcaaacggacaacccgaaaacaactacaaaaccaccccacccgtacttgactccgacggctcattcttcctctacagcaaactcacagtcgacaaatcccgctggcaacagggcaacgtattctcatgctccgtaatgcacgaagccctacacaaccattacacccaaaaatccctgtccctctcccccggc

SEQ ID NO: 54281 - RNA, 654 nt, synthetic construct
  misc_feature 1..654: note = derived and/or modified sequence opt11 from Ruplizumab_LightChain1
  source 1..654: mol_type = other RNA
gacatcgtactcacccaatcccccgcaaccctctccgtcagccccggcgaacgcgccaccatatcctgccgcgcttcccaacgcgtctcctcatcaacctactcttacatgcactggtaccaacaaaaacccggccaaccacccaagctactcatcaaatacgcctccaacctcgaatcaggcgtcccagcccgattctctggctccggctccggcaccgacttcaccctcaccatctcctcagtcgaacccgaagacttcgccacctactactgccaacactcctgggaaatcccacccaccttcggcggcggcaccaaactcgaaatcaaacgcacagtcgccgcccccagcgtcttcatcttcccaccctccgacgaacaactaaaatctggcaccgcctccgtcgtctgcctcctcaacaacttctacccccgcgaagccaaggtccaatggaaagtcgacaacgccctccaatccggcaactcacaagaaagcgtcaccgagcaagactccaaagactcaacttactccctctcctccaccctaaccctctccaaagccgactacgaaaaacacaaagtatacgcatgcgaagtcacccaccaaggcctctcctcccccgtcaccaaatccttcaaccgcggcgaatgc

SEQ ID NO: 54282 - RNA, 1353 nt, synthetic construct
  misc_feature 1..1353: note = derived and/or modified sequence opt11 from Sacituzumab_govitecan_HeavyChain1
  source 1..1353: mol_type = other RNA
caagtacaactccaacaatccggaagcgaactcaagaaacccggtgcctccgtaaaagtctcatgcaaagcctctggctacacattcaccaactacggaatgaactgggtcaaacaagctcccggacaaggcctcaaatggatgggctggataaacacctacaccggagaaccaacttacacagacgacttcaaaggtcgatttgccttctccctcgacacctcagtctcaaccgcctacctccaaatttcgtccctcaaagcagacgacacagccgtctacttctgcgcacgcggcggcttcggctcatcatactggtacttcgatgtgtggggccaaggatcccttgtcactgtaagttcagcatctacgaaaggccccagcgtcttccccctcgcccccagctcaaaatccacctccggcggcaccgccgccctaggctgcctagttaaagactacttccccgagccagtcaccgtctcgtggaacagcggagccctcacctccggagtccacaccttccccgccgtcctccaatcctccggactatactccctctcctccgtcgtcaccgtaccatcatcatcactcggaacacaaacctacatctgcaacgtcaaccataaaccctccaacaccaaagtcgacaaacgagtcgaacccaaaagctgcgacaaaacccacacctgtcccccatgccccgccccagaactacttggcggcccctccgtcttcctcttccctcccaaaccaaaagacaccctaatgatctcccggacacccgaagtaacctgcgtcgtcgtcgacgtctcccacgaagaccccgaagtcaaattcaactggtacgtcgacggcgtcgaagtccacaacgccaaaaccaaacccagagaagaacaatacaactccacataccgagtcgtctccgtcctaaccgtcctacaccaagactggctcaacggcaaagaatacaaatgcaaagtctccaacaaagccctccccgcccccatcgagaaaaccatctccaaagccaaaggacaaccacgcgaacctcaagtatacaccctacccccgagccgcgaagaaatgaccaaaaaccaagtctccctaacctgcctcgtgaaaggcttctacccctccgacatagccgtagaatgggaatcaaacggacaacccgaaaacaactataaaaccacaccccctgttctcgactcagacggctccttcttcctctactccaaactcaccgtcgacaaatcccgctggcaacaaggcaacgtattctcatgcagtgtcatgcacgaagccctccacaaccactacacccaaaaatcgcttagcctaagccccggcaaa

SEQ ID NO: 54283 - RNA, 642 nt, synthetic construct
  misc_feature 1..642: note = derived and/or modified sequence opt11 from Sacituzumab_govitecan_LightChain1
  source 1..642: mol_type = other RNA
gacatccaactcacccaatccccctcatccctctccgcctccgtcggcgaccgagtctccattacctgcaaagcatcccaagacgtctccatcgccgtcgcctggtaccaacaaaaacccggcaaagcacccaaactcctaatctactccgcctcctatcgatacaccggcgtccccgaccgcttctccggctcaggctcaggcaccgacttcaccctcaccatctcctcactccaacccgaagacttcgccgtctactactgccaacaacactacatcacacccctcaccttcggcgccggcaccaaagtcgaaatcaaacgaacagtagccgccccctccgtcttcatcttcccaccctccgacgaacaactcaaatccggcaccgcctccgtcgtctgcctcctcaacaacttctacccccgcgaagccaaagtccaatggaaagtcgacaacgccctccaatcaggcaactcccaagaatccgtcaccgaacaagactccaaagactccacctactccctctcctccacactcaccctctccaaagctgactacgaaaaacacaaagtctacgcatgcgaagtaacccaccaaggcttatcctcccccgtcaccaaatccttcaacagaggcgaatgc

SEQ ID NO: 54284 - RNA, 1326 nt, synthetic construct
  misc_feature 1..1326: note = derived and/or modified sequence opt11 from Samalizumab_HeavyChain1
  source 1..1326: mol_type = other RNA
caagtacaactccaacaaagcggaagcgaacttaagaaaccaggtgcctcagtcaaaataagctgcaaagccagcggctactcattcaccgactacatcatactatgggtacgacaaaatccaggcaaaggactcgaatggataggacacatcgacccctactacggcagctcaaactacaacctcaaattcaaaggccgggtaaccataaccgccgaccaatcaaccaccaccgcgtacatggaactctcatccctccgctcagaagacaccgcagtctactactgcggacgatccaaacgagactacttcgactactggggccaaggcaccaccctcaccgtctcatcagcctccaccaaaggcccctccgtcttccccctcgccccttgctcgagatcaacatcagaatccaccgccgccctcggctgcctcgtcaaagactacttccccgaacccgtaacagtctcttggaactcaggagcccttacctcaggcgtccacacctttcctgccgtactccagtcctccggtctatactccctctcctccgtcgtcaccgtcccctcctccaacttcggcacccaaacatatacctgcaacgtagaccataaaccatctaacaccaaagttgacaaaaccgtcgaacgcaaatgctgcgtagaatgcccaccctgtcccgcccctcccgtcgccggaccctccgtcttcctcttcccacccaaacccaaagacaccctcatgatctcacgcacccccgaagtcacatgcgtagtcgtagacgtatcccaagaagaccccgaagtccaattcaactggtacgtcgacggcgtcgaagtccacaacgccaaaaccaaacccagggaagaacaattcaactccacataccgagtagtttccgtcctcaccgtactccaccaagactggctaaacggaaaagaatacaaatgcaaagtctcaaacaaaggcctcccctcctccatcgagaaaaccatctccaaagcaaaaggtcaacccagagaaccccaagtctacacgcttcccccaagccaagaagaaatgaccaaaaaccaagtctcactaacctgcctcgtaaaaggcttctacccaagtgatatcgccgtcgaatgggaatcaaacggacaacccgaaaacaactacaaaaccacacccccagtactcgattcagacggatcattcttcctatactcacgattaaccgtcgacaaatcccgatggcaagaaggcaacgtattctcatgcagtgtcatgcacgaagccctccacaaccactacacccaaaaatccctttccttatcgctagga

SEQ ID NO: 54285 - RNA, 642 nt, synthetic construct
  misc_feature 1..642: note = derived and/or modified sequence opt11 from Samalizumab_LightChain1
  source 1..642: mol_type = other RNA
gacatccaaatgacacaatcaccctcaagcctttccgcatccataggcgaccgcgtcaccatcacctgcaaagcatcccaagacattaactcctacctcagctggttccaacaaaaaccaggcaaagccccaaaactcctcatataccgcgccaaccgcctcgtcgacggcgtcccctcccgcttctccggctccggctccggcaccgactacaccctcaccatatcctccctccaacccgaagacttcgcagtctactactgcctccaatacgacgaattcccatacactttcggaggcggcaccaaactcgaaatcaaacgcaccgtcgccgccccctccgtcttcatcttccccccctccgacgaacaactcaaatccggcacagcctcagtcgtctgcctactcaacaacttctacccccgcgaagccaaagtccaatggaaagtcgacaacgcactccaatccggcaactcccaagaatccgtcaccgaacaagactccaaagactccacctactccctctcctcaaccctcacactctccaaagccgactacgaaaaacacaaagtctacgcctgcgaagtcacccaccaaggcctctcctctcccgtaaccaaatcattcaaccgcggcgaatgc

SEQ ID NO: 54286 - RNA, 1338 nt, synthetic construct
  misc_feature 1..1338: note = derived and/or modified sequence opt11 from Sarilumab_HeavyChain1
  source 1..1338: mol_type = other RNA
gaagtccaactcgtagaatccggcggcggcctcgttcaacccggccgctccctgcgcctctcatgcgccgcaagccgtttcactttcgacgactacgcaatgcactgggtacgccaagcccccggaaaaggactcgaatgggtctcaggcatcagctggaactccggcagaataggttacgccgactcagttaagggcagattcacaatctcccgcgacaacgccgaaaactcactcttccttcagatgaacggactcagagccgaagacaccgccctatactactgcgcaaaaggaagagactccttcgacatatggggccaaggtaccatggttaccgtctcctccgcctctaccaaaggaccctcagtcttccccctcgcaccctcctcaaaatccaccagcggaggaaccgccgcactcggctgcctcgtcaaggactacttccccgaaccagtcacagtatcctggaactccggcgccctcacctctggagtccacaccttccccgccgtcctccaatcatccggcctctattcactatcatccgtcgtaacagtaccatcctcctccctcggcacccaaacctacatctgcaacgtcaaccacaaaccatccaacaccaaagttgacaaaaaggtcgaacccaaatcctgcgacaaaacccacacatgcccaccatgccccgcaccagaactactaggaggcccctccgtcttcctattcccacccaaacccaaagacaccctaatgatcagccgtacccccgaagtaacctgcgtcgtcgttgacgtcagccacgaagacccagaagtaaaattcaactggtacgtcgacggcgtcgaagtgcacaatgccaaaaccaaaccacgagaagaacagtacaacagcacctaccgagtagtctcagtactcacagtcctccaccaagactggctcaacggcaaagaatacaaatgcaaagtaagcaataaagccctccccgcccccatcgagaaaaccatatccaaagccaaaggccaaccccgcgaaccacaagtctacacactgcctccctcccgcgacgaactcaccaaaaaccaagtatcactaacatgtctcgtcaaaggattctaccccagcgacatagccgtcgaatgggaatcaaacggccaacccgaaaacaactacaaaaccacacccccagtcctcgactccgacggcagcttcttcctatactccaaactaaccgtcgacaaatcccgctggcaacaaggcaacgtcttctcctgctcagtcatgcacgaagcccttcacaaccactacacccaaaaatcgctctccctatcccccggcaaa

SEQ ID NO: 54287 - RNA, 642 nt, synthetic construct
  misc_feature 1..642: note = derived and/or modified sequence opt11 from Sarilumab_LightChain1
  source 1..642: mol_type = other RNA
gacatccagatgacccaatcaccctcctccgtatccgcctccgtcggcgaccgcgtaaccataacctgccgcgcctcccaaggcatctcctcatggctagcctggtaccaacaaaaacccggcaaagcccccaaactcctaatctacggcgcctcctccctcgaatccggagtcccctcccgcttctccggctctggatcaggcaccgacttcaccctcaccatctcctccctccaaccagaagacttcgcatcctactactgccaacaagccaactccttcccttacacattcggccaaggcaccaaactcgaaatcaaacgcaccgtagccgccccctcagtcttcatcttcccaccatccgacgaacaactcaaatccggcacagcctctgtcgtatgcctactcaacaacttctacccccgcgaagccaaagtccaatggaaagtcgacaacgcactccaatccggcaactcccaagaatccgtcaccgaacaagactccaaagactcaacctactccctctcctccaccctcaccctctccaaagccgactacgaaaaacacaaagtctacgcatgcgaagtcacccaccaaggcttatcttcccccgtcaccaaatccttcaaccgcggcgaatgc

SEQ ID NO: 54288 - RNA, 1296 nt, synthetic construct
  misc_feature 1..1296: note = derived and/or modified sequence opt11 from Satumomab_pendetide_HeavyChain
  source 1..1296: mol_type = other RNA
caagtacaactacaacaatccgacgccgaactcgtcaaacccggcgcctccgtaaaaatctcctgcaaagcctccggctacaccttcacggaccacgccatacactgggccaaacaaaaacctgaacaaggcctagaatggatcgggtacatttccccaggcaacgacgacatcaaatacaacgaaaaattcaaaggaaaagccacactcaccgccgacaaatcttcctccaccgcctacatgcaactcaactcactcaccagcgaagactccgccgtctacttctgcaaacgcagctactacggacactggggacaaggcacaacactcaccgtatcctccgcctccaccaaaggaccttccgtattccccctcgcaccctgctcacgctccacctccgaatccaccgccgcccttggctgcctcgtcaaagactacttcccagaacccgtcacagtctcctggaactccggcgccctcacatccggcgtccacaccttccccgccgtcctgcaatcctccggactctactcactctccagcgtagtaacagtcccctcatcttcactaggaacaaaaacatatacctgcaacgtagaccacaaaccctcaaacaccaaagtagacaaacgtgtatgcccaccctgcaaatgccccgcccccaacctgctaggcggtccctccgtcttcatcttcccaccaaagatcaaggacgtcctaatgatctccctatcccccatcgtcacgtgcgttgtcgtcgacgtctccgaagacgaccccgacgttcaaatctcttggttcgtcaacaatgtagaagtacacaccgcccagacccaaacgcaccgcgaagactacaactccacactccgcgtcgtatccgccctccccatccaacaccaagactggatgtccggcaaagagttcaaatgcaaagtaaacaacaaagacctccccgcccccatcgaacgcaccatatcaaaacccaaaggctccgtcagagcaccccaagtctacgtcctcccacccccagaagaagaaatgacaaagaaacaagtaaccttaacctgcatggtcacagacttcatgcccgaagatatttacgtcgaatggacaaacaacggcaaaaccgaactcaactacaaaaacaccgaaccagtactcgactccgacggatcatacttcatgtactccaaacttcgcgtcgaaaagaaaaactgggtagaacgcaactcatactcctgctccgtcgtccacgaaggccttcacaaccaccacaccaccaaatccttctcccgc

SEQ ID NO: 54289 - RNA, 630 nt, synthetic construct
  misc_feature 1..630: note = derived and/or modified sequence opt11 from Satumomab_pendetide_LightChain
  source 1..630: mol_type = other RNA
gacatccaaatgacccaatctcccgcctccctcagcgtctccgtcggagaaaccgtcaccataacctgccgcgcctccgaaaacatctactccaacctcgcctggtaccaacaaaaacaaggcaaatcaccccaactcctcgtctacgccgccaccaacctcgccgacggcgtcccatcccgattctccggctccggctccggcacccaatactcccttaaaatcaactccctccaatccgaagacttcggctcctactactgccaacacttctggggcaccccatacaccttcggcggcggaacccgcctcgaaatcaagcgcgccgacgccgcccccaccgtcttcatcttcccaccctccgacgaacaactgaaatccggcaccgcctccgtcgtctgcctactcaacaacttctacccccgcgaagccaaagtccaatggaaagtcgacaacgccctccaatccggcaactcccaagaatccgtcaccgaacaagactcaaaagactccacctactcactctcatcaaccctcaccctctccaaagccgactacgaaaaacacaaagtctacgcctgcgaagtcacccaccaaggcctctcctcccccgtcaccaaatccttcaac

SEQ ID NO: 54290 - RNA, 1371 nt, synthetic construct
  misc_feature 1..1371: note = derived and/or modified sequence opt11 from Secukinumab_HeavyChain1
  source 1..1371: mol_type = other RNA
gaagtccaactcgtcgaatcaggcggcggccttgtccaacccggcggctccctccgattatcctgcgccgcctccggcttcaccttctccaactactggatgaactgggtacgtcaggcccctggcaaaggactcgaatgggtcgccgccataaaccaagacggctccgaaaaatactacgtaggctcagtcaaaggcagattcaccatctcccgcgacaacgccaaaaactccctctaccttcaaatgaactccctaagagttgaagacaccgcagtatactactgcgtacgcgactattacgatatcctaacagactattacatccactactggtacttcgacctctggggccgcggaactctcgtcaccgtcagctccgcctccactaaaggcccctcagtattccccctagctccatcttccaaaagcacaagtggaggcacagcagccctaggttgcctcgtaaaagactacttccccgaacccgtcaccgtatcatggaacagcggcgccctcacctctggcgtccacaccttcccagccgtcctccaatccagcggtctctacagcctcagctccgtcgtcaccgtcccctcctcctccctcggcacacaaacctacatctgcaacgtcaaccacaaaccatctaacacaaaagtcgataaacgcgtcgaacccaaatcctgcgacaaaacacacacatgtccaccctgccccgcccccgaactactaggcggcccctccgtcttcctgttcccacccaaacccaaagacaccctcatgataagccgcacacccgaagtaacctgcgtcgtcgtagacgtctcccacgaagaccccgaagtcaaattcaactggtacgtggacggcgtcgaagtccacaacgccaaaacaaaaccccgcgaagaacaatacaactcaacctaccgagtcgtctccgtcctcaccgtcctacaccaagactggctcaacggcaaggaatacaaatgcaaagtcagcaacaaggccctccccgccccaatcgaaaagaccatatcaaaagccaaaggccaaccacgcgaaccacaagtctacaccctcccaccctcccgcgaagaaatgaccaaaaaccaagtttccctcacatgcctcgtaaaagggttctacccctccgacatcgcagtcgaatgggaatccaatggacaaccagaaaacaactacaaaacaacccctcccgtcctcgacagcgacggctccttcttcctatactcaaaactcaccgtcgacaaatcccgatggcaacaaggtaacgtcttctcctgctccgtcatgcacgaagcactccacaaccactacacgcaaaaatccctctcactctcccccggcaaa

SEQ ID NO: 54291 - RNA, 645 nt, synthetic construct
  misc_feature 1..645: note = derived and/or modified sequence opt11 from Secukinumab_LightChain1
  source 1..645: mol_type = other RNA
gaaatcgtcctcacccaatccccaggcacactctccctctcccccggagaacgcgccaccctctcctgccgcgcctcccaatccgtctcctcctcatacctcgcatggtaccaacaaaaacccggccaagcaccccgcctcctaatctacggcgcctcctcccgcgccacaggcatccccgaccgcttctccggatccggctccggcaccgacttcaccctaaccatctcccgcctcgaacccgaagacttcgccgtctactactgccaacaatacggctcctccccctgcacattcggccaaggcacacgcctcgaaatcaaacgcacagtcgccgccccctcagtattcatcttcccaccctcagacgaacaactcaaatccggcaccgcctcagtcgtatgcctcctaaacaacttctacccccgcgaagccaaagtacaatggaaagtcgacaacgccctccaatccggcaactcacaagaatcagtcaccgaacaagactccaaagactccacctactccctcagctccaccctcaccctctccaaagccgactacgaaaaacacaaagtctacgcctgcgaagtcacccaccaaggcctctcatcccccgtcaccaaatcattcaaccgcggcgaatgc

SEQ ID NO: 54292 - RNA, 1335 nt, synthetic construct
  misc_feature 1..1335: note = derived and/or modified sequence opt11 from Seribantumab_HeavyChain1
  source 1..1335: mol_type = other RNA
gaagtacaactcctcgaatcaggcggcggcctagtccaacccggcggatctcttcgcctctcctgcgccgcctcaggattcaccttctcacactacgtaatggcctgggtccgccaagcccccggaaaaggtctcgaatgggtctcctcaatatcatcctccggcggctggaccctatacgccgactcagtcaaaggccgcttcaccataagccgtgacaactctaaaaacaccctctacctccaaatgaactccctacgcgcggaagacaccgccgtctactactgcactcgcggtctcaaaatggcaaccatattcgactactggggccaaggcaccctcgtaactgtctcatccgcctccaccaaaggcccatcagtcttccccctagccccatgctccagatccacctccgaatcgacagcagcactcggatgcctcgtaaaagactactttccagaacccgttactgtatcctggaactccggcgccctaacaagcggcgtacacacattccccgccgtcctccagtcatcaggcctctactccctatcctccgtcgtaaccgtaccatcatccaacttcggcacccaaacatacacatgcaacgtcgaccacaaaccctcaaacaccaaagtagacaaaaccgtcgaacgaaaatgctgcgtcgaatgcccaccctgccccgcgcccccagtagccggacccagcgtattcctcttcccacccaaacccaaggacaccctaatgatctcccgaacccccgaggtcacatgcgtcgtagtcgacgtatcccacgaagaccccgaagtacaattcaactggtacgtcgacggcgtcgaggtacacaacgccaaaacaaagcccagagaagaacaattcaactccaccttccgagtcgtctcagtcctgacagtcgtccaccaagactggctcaacgggaaagaatacaaatgcaaagtctcaaacaaaggcctcccagcccccatcgagaaaactatcagcaaaacaaaaggacaaccccgagaaccccaagtatacacgctccctccctcacgagaagaaatgaccaaaaaccaagtctccctgacctgcctcgtcaaaggattctacccctcggacatcgcagtcgaatgggaaagcaacggacaacccgaaaacaactacaaaaccaccccacccatgctcgactccgacggcagcttctttctgtactcaaaactcacagtagacaaatcccgctggcaacaaggaaacgtcttctcctgttccgtcatgcacgaagccctccacaaccactacacccaaaaatctctctcactctcccccggcaaa

SEQ ID NO: 54293 - RNA, 651 nt, synthetic construct
  misc_feature 1..651: note = derived and/or modified sequence opt11 from Seribantumab_LightChain1
  source 1..651: mol_type = other RNA
caatccgccctaacacaacccgcctcagtctccggctcccccggccaatccatcacaatctcctgcaccggcacctcatccgacgtaggatcctacaacgttgtctcatggtaccaacaacaccccggcaaagcccccaaactcatcatctacgaagtctcacaacgcccctccggcgtctccaaccgcttctccggctccaaatccggcaacaccgcctccctcaccatctccggcctccaaaccgaagacgaagcagactactactgctgctcctacgccggctcttccatcttcgtaattttcggcggcggcacaaaagtcacagtcctcggccaacccaaagccgcaccctccgtcacactcttccccccctcctccgaagaactccaagccaacaaagccaccctagtctgcctcgtctcagacttctaccccggcgccgtcaccgtcgcctggaaagccgacggctcacccgtcaaagtaggcgtcgaaaccaccaaaccctcaaaacaaagcaacaacaaatacgccgcctcctcctacctatccctcacccccgaacaatggaaatctcaccgctcctactcctgccgagtcacacacgaaggatccacagtcgaaaaaaccgtcgcccccgccgaatgctcc

SEQ ID NO: 54294 - RNA, 1353 nt, synthetic construct
  misc_feature 1..1353: note = derived and/or modified sequence opt11 from Setoxaximab_HeavyChain1
  source 1..1353: mol_type = other RNA
gaagtacagctccaacaacctggcccagaactcgaaaaacccggcgcctccgtcaagctcagctgcaaagcctcaggatactctttcacagactacaacatgaactgggtcaaacaaaacaacggagaatcactagaatggatcggtaaaatcgacccctactacggcggcccatcctacaaccaaaaattcaaggacaaggcaaccctcacagtcgacaaatcatcctccaccgcctacatgcaacttaaatccctcacctcagaagactcagctgtctactactgcacccgcggcggcaaccgcgactggtacttcgacgtctggggcgccggcaccaccctcaccgtctccgcagagttcgcctcaaccaaaggaccctcagtcttccccctagccccatcctcaaaatccacctcaggaggcaccgccgcactaggatgcctagtcaaagactacttccccgaacccgtaacggtctcctggaactctggcgcactcacctccggagttcataccttcccagccgtcctacagtcctcgggcctctactccctctcctcagtcgtcaccgtcccctccagcagcctaggcacacaaacctacatatgcaacgtcaaccacaaaccatcaaacaccaaagtcgacaagaaagtcgaaccaaaatcctgcgacaaaacccacacatgcccaccgtgcccagcacccgaattgctcggcggcccctcagtattcctattcccacccaaaccaaaagacacccttatgatatcccgaacccccgaagtcacatgcgtcgtcgtcgacgtctcccacgaagaccccgaagtcaaattcaactggtacgtcgacggcgtggaagttcacaacgccaaaaccaaaccccgagaagaacaatacaacagtacctaccgcgtcgtctctgtcctcaccgtcctacaccaagactggctcaacggtaaagaatacaaatgtaaagtatccaacaaagccttaccagcccctatcgaaaagaccatatctaaagccaaaggccaaccccgtgaaccccaagtctacacactcccgccctctagagacgaactaaccaaaaatcaagtctccctaacctgcctcgtaaaaggtttctacccctcggacatcgccgtcgaatgggaatccaacggacaacccgaaaacaactacaaaacgaccccacccgtcctcgattccgacggctcattcttcctctacagcaaactcacagttgacaaatccagatggcaacaaggcaacgtattctcatgctcagtcatgcatgaagccctccacaaccactacacacaaaaatctctctccctctcccccggcaaa

SEQ ID NO: 54295 - RNA, 660 nt, synthetic construct
  misc_feature 1..660: note = derived and/or modified sequence opt11 from Setoxaximab_LightChain1
  source 1..660: mol_type = other RNA
gacatcgtcctctcccaatccccctcctcactcgtcgtctccgtcggcgaaaaagtcaccatgtcctgcaaatcctcccaatccctcctctactcccgaaaccaaaaaaactacctcgcctggtaccaacaaaaacccggccaatcccccaaagtcctcatctactgggcatccacccgcgaatctggcgtcccagaccgactcacaggctccggctccggcacagacttcacactcacaatctcctctgtcaaagccgaagacctcgccgtctactactgccaacaatactactcctaccctctaaccttcggcgccggcacaaaactcgaactcaaacgcaccgtcgccgctccctccgtattcatcttcccaccctccgacgaacaattaaaatcaggcaccgcctctgtcgtctgcctcctcaacaacttctacccccgcgaagccaaagtccaatggaaagtcgacaacgccctccaatccggaaactcccaagaatccgtcaccgaacaagactccaaagactccacctactccctatcctccaccttaaccctctcaaaagccgactacgaaaaacacaaagtctacgcctgcgaagtcacccaccaaggcctctcctcccccgtcaccaaatccttcaacagaggcgaatgc

SEQ ID NO: 54296 - RNA, 1338 nt, synthetic construct
  misc_feature 1..1338: note = derived and/or modified sequence opt11 from Sifalimumab_HeavyChain1
  source 1..1338: mol_type = other RNA
caagtccaactcgtccaatcaggcgcagaagtcaagaaaccaggagcatccgtcaaagtctcctgcaaagcctccggctacaccttcacatcatactccatctcctgggtccgccaagcccccggccaaggcctagaatggatgggctggatatccgtttacaacggcaataccaactacgcccaaaaattccaaggccgcgtcaccatgacaaccgacacctccacatccaccgcatatctggaacttcgatcactacgatccgacgacacagccgtctactactgcgcccgcgaccctatagcagccggctactggggccaaggcaccctagtaaccgttagctcagcctccacaaaaggcccatccgtcttccctctcgccccctcctccaaatccacatccggcggaaccgccgcactaggatgcctggtcaaagactacttccccgaaccagtaaccgtttcttggaactccggagcccttaccagcggagtacacaccttccccgccgtcctccaatcctccggactatactccttatcctcagtagtcacagtacccagctcctcactcggaacccaaacctacatatgcaatgtcaaccacaaaccctcaaacaccaaagttgacaagaaagtcgaacccaaaagctgcgacaaaacccacacatgcccaccatgccccgcccccgaactcctcggcggcccctcagtcttcctattcccaccaaaaccaaaagacaccctaatgataagccgaaccccagaagtaacctgcgtcgtagtcgatgtctcccacgaagaccccgaggtcaaattcaactggtacgtcgacggcgtagaagtccacaacgcaaaaaccaaaccacgagaagaacaatacaacagcacctaccgcgtggtctccgtcctcaccgtactacaccaagactggctcaacggtaaagaatacaaatgcaaagtctccaacaaagcccttccagcaccaatagagaaaaccatctccaaagccaaaggtcaaccccgcgaaccacaagtctacacactaccaccatcacgcgaagaaatgaccaaaaaccaagtctccctcacatgcctagtcaaaggcttctacccctccgacatcgccgtcgaatgggaatccaacggccaacccgagaacaactacaaaaccacaccacccgtactcgactctgacggctcattcttcctatactcaaaacttaccgtcgacaagtcccgctggcaacaaggaaacgtcttctcctgctccgtcatgcacgaagccctacacaaccactacacccaaaaatccctcagcctctcccccggaaaa

SEQ ID NO: 54297 - RNA, 645 nt, synthetic construct
  misc_feature 1..645: note = derived and/or modified sequence opt11 from Sifalimumab_LightChain1
  source 1..645: mol_type = other RNA
gaaatcgtcctcacccaatcccccggcaccctatccctctcccccggcgaacgagccacactctcctgcagagcctcccaatcagtctcctccacctacctagcctggtaccaacaaaaacccggccaagcaccccgcctactcatctacggcgcctcctcccgcgccaccggcatccccgaccgcttctccggctccggctccggcaccgacttcacactcaccatctcccgcctcgaacccgaagacttcgcagtctactactgccaacaatacggctcctcaccccgcaccttcggccaaggcaccaaagtcgaaatcaaaagaaccgtcgcagccccctccgtcttcatcttccctccctccgacgaacaactcaaatccggcacagcctccgtcgtctgcctcctcaacaacttctacccccgcgaagccaaagtccaatggaaagtcgacaacgccctacaatcaggcaactcccaagaatccgtcactgaacaagactcaaaagactccacctactcactctcctccaccctcacactctccaaagccgattacgaaaaacacaaagtctacgcctgcgaagtcacccaccaaggactctcctcccccgtcaccaaatcattcaaccgcggcgaatgc

SEQ ID NO: 54298 - RNA, 1347 nt, synthetic construct
  misc_feature 1..1347: note = derived and/or modified sequence opt11 from Siltuximab_HeavyChain1
  source 1..1347: mol_type = other RNA
gaagtacagctagtagaatcaggaggcaaattactcaaacccggcggatccctcaaactctcctgcgccgcatccggattcacattctcctcattcgcaatgagctggttccgacaatcccccgaaaaacgcctagaatgggtagccgagatctcctcaggcggttcctacacctactatcccgacaccgtcaccggaagattcaccatctcccgcgacaacgccaaaaacaccctctacttagaaatgtcttcgctacgatccgaagacaccgccatgtactactgcgcccgaggcctctggggctactacgcactagattactggggccaaggcacctcggtcaccgtatcttccgcctccaccaaaggcccctccgtcttccccttagcaccctcctcaaaatccacttccggcggaaccgccgccctcggatgcctagtcaaagactactttcccgaacccgtcacagtctcctggaactcaggcgccctcacctccggcgtccacacattcccagctgtactccaatcctccggcctctactccctctcctccgtcgtcaccgtcccctcctcttccctcggaacccaaacctacatctgcaacgtcaaccacaaaccttcaaacaccaaagtcgacaagaaagtcgaacccaaatcttgcgacaaaacccacacatgcccaccctgccccgcccccgaactcctcggcggcccatccgtattcctcttcccacccaaacccaaagacacgctcatgattagccgaacccccgaagtaacctgcgtcgtagtcgacgtctcccacgaagacccagaagtcaaatttaactggtacgtcgacggcgtcgaagtacacaacgcaaaaaccaaacctcgcgaagaacaatacaactcaacataccgagtcgtctcagtcctcacagtcctccaccaagactggctaaacggcaaagaatacaaatgcaaagtctcaaataaagccctccccgccccaattgagaaaacaatatctaaagccaaaggacaaccccgagaaccccaagtctacacactccctccctcccgcgacgaactcaccaaaaaccaagtctcactaacctgcctcgtcaaaggcttctacccctccgacatcgccgtcgaatgggaatctaacggccaacccgaaaacaactacaaaaccaccccacccgtcctcgactcagacggctccttcttcctatactcaaaactcaccgtagacaaatcccgttggcaacaaggcaacgtattctcctgctccgtcatgcacgaagcactccacaaccattacacccaaaaatccctctccctcagccccggcaaa

SEQ ID NO: 54299 - RNA, 639 nt, synthetic construct
  misc_feature 1..639: note = derived and/or modified sequence opt11 from Siltuximab_LightChain1
  source 1..639: mol_type = other RNA
caaatcgtcctcatccaatcccccgccatcatgtcagcctcccccggcgaaaaagtcaccatgacctgctccgcctcatcctccgtctcctacatgtactggtaccaacaaaaacccggctcctcaccccgcctcctaatctacgacacctccaacctcgcctctggagtccccgtccgcttctcaggctccggctccggtacctcctactccctcaccatctcccgaatggaagccgaagacgccgccacctactactgccaacaatggtccggctacccctacaccttcggcggcggcacaaaactagagatcaaacgaaccgtcgccgccccctccgtcttcatcttcccaccctccgacgaacaactcaaatccggcactgcctccgtcgtttgcctcctaaacaacttctacccccgcgaagccaaagtccaatggaaagtcgacaacgccctccaatccggcaactcccaagaatccgtaaccgaacaagactccaaagactccacctactccctctcctccaccctcaccctctccaaagccgactacgaaaaacacaaagtctacgcctgcgaagtcacccaccaaggcctctcctcacccgtcaccaaatcattcaaccgcggcgaatgc

SEQ ID NO: 54300 - RNA, 1329 nt, synthetic construct
  misc_feature 1..1329: note = derived and/or modified sequence opt11 from Simtuzumab_HeavyChain1
  source 1..1329: mol_type = other RNA
caagtccaactcgtgcaatccggcgccgaagtcaagaaacccggcgcctccgtcaaagtttcctgcaaagcctcaggctacgcattcacctactacctaatcgaatgggtacgccaagcacccggacagggcctagaatggatcggcgtcatcaacccaggctccggcggcaccaactacaacgaaaaattcaaaggcagagccaccataaccgcagacaaatcaacctccacagcatacatggaactcagctcactccgctcagaagataccgccgtatacttctgcgcccgaaactggatgaacttcgactactggggacaaggcaccaccgtcaccgtatcatccgcctccaccaaaggccccagcgtcttcccacttgcaccctgctcccgctccacatccgaaagcaccgccgccctgggctgcctcgtcaaagactacttccccgaaccagtaactgtcagctggaactccggagccctcacctcaggcgtccacaccttcccagccgtactccaatcttcaggtctatattccctctcctccgtcgtcaccgtccccagctcatccttaggtacaaaaacctacacatgcaacgtagaccacaaaccatccaacaccaaagtcgacaaacgcgtagaatctaaatacggcccaccctgcccaccctgcccagccccggagttcctcggcggcccctccgtcttcctatttccccctaagcctaaagacacactcatgatctcccgaaccccagaagtcacttgcgtcgtcgtcgacgtgtcccaagaagatcccgaagtccaattcaactggtacgtcgatggagtcgaagtccacaacgcaaagaccaagccccgcgaagaacaattcaactccacgtaccgcgtcgtatccgtcctcaccgtcctccaccaggactggctcaacggcaaagaatataaatgcaaagtctccaacaaaggcctaccttcctcaatcgagaaaaccatctcaaaagcaaaaggccaaccccgcgaaccccaagtgtacacactcccaccctcccaagaagaaatgaccaaaaaccaagtctccctaacctgcctcgtaaaaggcttctacccctccgacatcgctgtcgaatgggaatcaaacggccaaccagagaacaactacaaaaccacacccccagtcctcgacagcgacggctccttcttcctctacagccgcctcaccgtcgacaaaagccgctggcaagaaggcaacgtcttctcttgctccgtcatgcacgaagccctacacaaccattacacccaaaaatcgctctccctctcacttggaaaa

SEQ ID NO: 54301 - RNA, 657 nt, synthetic construct
  misc_feature 1..657: note = derived and/or modified sequence opt11 from Simtuzumab_LightChain1
  source 1..657: mol_type = other RNA
gacatcgtcatgacccaaacacccctctccctatccgtaacccccggccaacccgcctccatctcctgcagatcctccaaatccctcctgcactccaacggcaacacctacctttactggttcctacaaaaacccggccaatcaccccaattcctaatctaccgcatgagcaacctcgcctccggagtccccgaccgcttctccggatcaggctccggcaccgacttcaccctcaaaatctcccgagtcgaagccgaagacgtcggcgtctactactgcatgcaacacctcgaatacccatacaccttcggcggcggcaccaaagtcgaaatcaaacgcaccgtcgccgccccctccgtcttcatcttcccaccctcagacgaacaactcaaatcaggcaccgcctccgtcgtctgcctcctaaacaacttctacccacgcgaagccaaagtccaatggaaagtcgacaacgccctccaatccggaaactcacaagaatccgtcaccgaacaagactccaaagactccacctactccctctcctccaccctaaccctcagcaaagccgactacgaaaaacacaaagtctacgcctgcgaagtcacccaccaaggactatcctcccccgttaccaaatcattcaaccgaggcgaatgc

SEQ ID NO: 54302 - RNA, 1347 nt, synthetic construct
  misc_feature 1..1347: note = derived and/or modified sequence opt11 from Sirukumab_HeavyChain1
  source 1..1347: mol_type = other RNA
gaagtccagctcgtcgaatccggcggaggcctcgtccaacccggcggctccctccgcctatcctgcgcagcctccggcttcaccttctcccccttcgcaatgtcctgggtccgccaagcccccggcaaaggactcgaatgggtagccaaaatcagcccgggcggctcctggacctactactccgacaccgtcaccggccgcttcacaatctcccgagacaacgcaaaaaactcactctacctccaaatgaatagcctccgtgccgaagacactgccgtctactactgcgcacgccaactatggggctactacgcactcgacatttggggacaaggcaccaccgtaaccgtctcctcagcttcaaccaaaggcccctccgtattccccctcgctccatccagcaaatctacctccgggggcaccgcagcactaggatgcctcgtaaaagactacttccccgaacccgtcacagtctcttggaactcaggtgccctcacatctggcgtccatacgttccccgctgtcctacaatcctcaggactctactccctctcatcagtagtcaccgtcccctcctcctccctcggaacccaaacatacatatgcaacgtcaaccacaaaccctccaacaccaaagtagacaaaaaagtagaaccaaaatcgtgcgacaaaacccacacctgcccaccctgccccgctcccgaactcctaggcggcccaagcgttttccttttccccccaaaacccaaagacaccctaatgatatctcgaacccccgaagtcacctgcgtcgtagtcgacgtctcccacgaagaccccgaagtaaaatttaactggtacgtcgatggcgtcgaagtacataatgcaaaaaccaaaccccgcgaagaacaatacaattcaacctaccgagttgtctcagtactaactgtactccaccaagactggctcaacggcaaagaatacaaatgcaaagtctccaacaaagcactcccagcaccaatcgaaaaaaccatctccaaagccaaaggacagccccgcgaaccacaagtctacaccctcccaccatcacgcgacgagctcaccaaaaatcaagtctcactcacatgcctagtcaaaggcttctacccctcagacatcgccgtcgaatgggaatccaacgggcaacccgaaaacaactacaaaaccactccacccgtactcgactccgacggctccttcttcctatactccaaactcaccgtagacaaatcacgctggcaacaaggcaacgtcttctcctgcagcgtcatgcacgaagccctccacaaccactacacccaaaaaagcctctcactctcacccggcaaa

SEQ ID NO: 54303 - RNA, 639 nt, synthetic construct
  misc_feature 1..639: note = derived and/or modified sequence opt11 from Sirukumab_LightChain1
  source 1..639: mol_type = other RNA
gaaatcgtcctcacccaatcccccgccaccctctcactctcccccggcgaacgcgccaccctctcctgctccgcatccatctccgtctcctacatgtactggtaccaacaaaaacccggccaagcaccccgcctcctcatctacgacatgtccaacctcgcctccggcatccccgcccgcttctccggctccggctccggcaccgacttcaccctcaccatctcctccctcgaacccgaagacttcgccgtatactactgcatgcaatggtccggctacccctacaccttcggcggcggaaccaaagtcgaaatcaaacgcaccgtcgccgccccctccgtattcatcttcccaccctccgacgaacaactcaaatccggcaccgcctccgtcgtttgcctactcaacaacttctacccccgcgaagccaaagtccaatggaaagtcgacaacgccctacaatccggcaactcccaagaatccgtaaccgaacaagactcaaaagactccacctactcactatcatcaacccttaccctctccaaagccgactacgaaaaacacaaagtctacgcctgcgaagtaacccaccaaggcctatcatcccccgtcaccaaatccttcaaccgcggcgaatgc

SEQ ID NO: 54304 - RNA, 1338 nt, synthetic construct
  misc_feature 1..1338: note = derived and/or modified sequence opt11 from Sofituzumab_vedotin_HeavyChain1
  source 1..1338: mol_type = other RNA
gaagtccagctcgtcgaatccggcggcggcctagtccaacccggaggctccctccgactatcatgcgcagcctcaggatactcaatcacaaatgactacgcatggaactgggtccgccaagccccaggcaagggcctagaatgggtcggatacatatcttactcaggctacaccacctacaacccaagcctaaaatcacgcttcacaatctcccgcgacacatccaaaaacacactctacctccaaatgaacagcctacgtgcagaagacaccgccgtctactactgcgccagatggacctcaggcctcgactactggggccagggaacccttgtcaccgtctcctcagcctccacaaagggcccctcagtcttcccccttgcaccctcctccaaatccacctccggaggaaccgccgccctcggctgcctagtcaaagattacttcccagaacccgtcaccgtctcgtggaactccggcgctctcacatcaggcgtccacaccttcccagcagtcctacaatcctccggcctctactcactctcctccgtagtcacagtaccctcctcctccctaggcacccaaacctacatctgtaacgtcaaccacaaaccatcaaacaccaaagtcgacaagaaagtagaacccaaatcctgcgacaaaacacacacatgcccaccctgccccgcccctgaactactcggaggcccctccgtcttcctcttcccacccaaacccaaagacaccctaatgatttcccgcacccccgaggtaacatgtgtagtagtcgacgtctctcacgaagaccctgaagtcaaattcaactggtacgtcgacggcgtagaagtccacaacgccaaaaccaaaccccgcgaagaacaatacaactccacctaccgtgtagtctccgtcctcaccgtcctccaccaagattggctcaacggcaaagaatataaatgcaaggtctccaacaaagcactccccgccccaatagagaaaaccatctcaaaagctaaaggccaaccacgcgaaccccaagtatacaccctgcccccttcacgcgaagaaatgaccaaaaaccaagtctccctaacctgcctcgtcaaaggtttctacccatccgacatagcagtcgaatgggaatccaacggacaaccagaaaacaactacaaaacaacaccacccgtcctcgactccgacggatcattcttcctctattcaaaactaaccgtcgacaaatcccgctggcaacaaggcaacgtcttctcctgctccgtcatgcacgaagctctacacaaccactacacacaaaaatccctatccctctcacctggcaaa

SEQ ID NO: 54305 - RNA, 642 nt, synthetic construct
  misc_feature 1..642: note = derived and/or modified sequence opt11 from Sofituzumab_vedotin_LightChain1
  source 1..642: mol_type = other RNA
gacatccaaatgacccaatccccctcatccctctccgcctcagtcggcgaccgagtcaccataacctgcaaagcctccgacctcatccacaactggctcgcctggtaccaacaaaaacccggcaaagcacccaaactcctcatctacggagcaacctcactcgaaaccggcgtcccatccagattctcaggctccggctccggcaccgacttcaccctaaccatctcctcactccaacccgaagacttcgccacctactactgccaacaatactggaccacccccttcactttcggccaaggcaccaaagtcgaaatcaaacgcaccgtcgctgccccctccgtcttcatcttccctccctcagacgagcaactcaaatccggcacagcctccgtcgtatgcctcctcaacaacttctacccccgcgaagccaaagtccaatggaaagtcgacaacgccctccaatccggtaactcccaagaatcagtcaccgaacaagactccaaagactccacctactccctctcctcaaccctcaccctctccaaagccgactacgaaaaacacaaagtctacgcctgcgaagtcacccaccaaggcctctcctcacccgtcaccaaatccttcaaccgcggcgaatgc

SEQ ID NO: 54306 - RNA, 1323 nt, synthetic construct
  misc_feature 1..1323: note = derived and/or modified sequence opt11 from Solanezumab_HeavyChain1
  source 1..1323: mol_type = other RNA
gaagtacagctagtcgaatccggcggcggattagtccaacccggaggcagcctccgtctctcatgcgccgcctcaggattcaccttctcccgctactccatgtcctgggtccgccaagccccaggaaaaggcctcgaacttgtcgcacaaatcaacagcgtaggtaactcaacatactaccccgacaccgtcaaaggcagattcacaatctcacgagacaacgccaaaaacaccctctacctacaaatgaactccctccgcgcagaagacaccgcagtctattactgcgcctccggcgactactggggtcaaggtaccctagtcacagtctcatccgcatccaccaaaggcccctccgtcttcccactcgcaccctcctcaaaatccacctctggaggaacagccgccctcggctgcctagtaaaagactacttccccgaacccgtcaccgtctcttggaactcaggagccctcacctccggagtccacactttccccgcagtactgcaatcctccggcctatactccctctcatccgtcgttaccgtcccctccagctcactaggcacccaaacctacatctgcaacgtcaaccacaaaccctctaacactaaagtcgacaaaaaagtcgaacccaaatcctgcgacaaaacccacacctgccccccatgtcccgcgcccgaactcctcggtggcccctctgtattcctctttccccccaaacccaaagacaccctcatgatatcccgcaccccagaagttacctgcgtcgtcgtcgacgtctcccacgaagaccccgaagtcaaattcaactggtacgtagacggcgtcgaagtccacaacgcaaaaacaaaaccacgagaagaacaatacaactccacctaccgtgtcgtctccgtactcaccgtcctccaccaggactggctaaacggaaaggaatacaaatgcaaagtttcaaacaaagccctcccagcccccatcgaaaaaaccatctctaaagcaaaaggccaaccacgtgaaccccaagtctacaccctcccaccctcacgcgacgaactcaccaaaaaccaagtctcgctaacctgtctcgtcaaaggcttctatccatcagacatcgcagtcgaatgggaatccaacggacaacccgaaaacaactacaaaacaaccccccccgtcctcgactccgacggctccttctttctctacagcaaactaaccgtcgacaaatcccgatggcaacaaggcaacgtcttttcctgctccgtcatgcatgaagccctgcacaaccactacacacaaaaatccctcagcctctccccaggt

SEQ ID NO: 54307 - RNA, 1326 nt, synthetic construct
  misc_feature 1..1326: note = derived and/or modified sequence opt11 from Solanezumab_HeavyChain
  source 1..1326: mol_type = other RNA
gaagtacaactcgtcgaatcaggaggaggcctagttcaacccggaggctcccttagactctcatgcgccgcctcaggtttcaccttcagccgatactccatgtcttgggtccgccaagcacctggtaaaggcctcgaacttgtcgcccaaataaactccgtgggaaactccacctactatcccgacaccgtcaaaggccgcttcaccatctcccgagacaacgccaaaaacaccctttacctacaaatgaactcactccgagccgaagacaccgcagtctactactgcgcgtccggggactactggggccagggcaccctcgtaaccgtgtcctccgcctccacaaaaggccccagcgtattccccctcgccccatcctccaaatccacctccggcggcaccgctgccctcggatgcctcgtcaaagactatttccccgaacccgtcaccgttagctggaactcaggcgccctcacatcaggagtacacaccttccccgcagtactccaatcttcaggactctactcgctatcttccgtcgtaaccgtcccctcctcctccctcggcacacaaacctacatctgcaatgtaaaccacaaacccagcaatacaaaagtcgacaagaaagtcgaacccaaaagctgcgacaaaacccacacctgtccaccctgccccgcccccgaactcctaggcggcccctcggtcttcctcttcccacccaaacccaaagacactctcatgatctcccgcacaccagaagtaacctgcgtcgtcgtcgacgtctcccatgaagaccccgaagtcaaattcaactggtacgtcgacggcgtcgaagtccacaacgcaaaaaccaaaccccgagaagaacaatacaactccacataccgcgtcgtctccgtcctcacagtactacatcaagactggctcaacggcaaagaatacaaatgtaaagtctccaataaagccctacccgccccaatcgagaaaaccatatcaaaagccaaaggccaaccccgcgaaccccaagtctacaccctcccaccctcgcgcgacgaactcacaaagaaccaagtctcactcacatgtctcgtcaaaggcttctacccctccgacatcgcagtcgaatgggaatccaatggacaacccgaaaacaactacaaaaccaccccaccagtcctcgactccgacggatcattcttcctctactctaaactcaccgtcgacaaatcccgctggcaacaaggcaacgtcttctcctgctccgtcatgcacgaagcactccacaaccattacacccaaaaatccctctcactctcccccggaaaa

SEQ ID NO: 54308 - RNA, 657 nt, synthetic construct
  misc_feature 1..657: note = derived and/or modified sequence opt11 from Solanezumab_LightChain1
  source 1..657: mol_type = other RNA
gacgtcgtcatgacacaatcacccctctccctccccgtaacactcggacaacccgcctccatatcctgccgatcctcccaatccctaatctactccgacggaaacgcctacctccactggttcctccaaaaacccggccaatcaccccgcctcctcatctacaaagtctccaaccgcttctccggcgtccccgaccgcttctccggctccggctccggcacagacttcaccctcaaaatctcccgcgtcgaagccgaagacgtaggagtctactactgctcccaatccacccacgtcccctggaccttcggccaaggcaccaaagtcgaaatcaaacgaaccgtcgccgccccctccgtcttcatattcccaccctcagacgaacaactcaaatcaggcacagcctcagtcgtctgcctcctcaacaacttctacccccgcgaagccaaagtccaatggaaagtcgacaacgccctccaatccggcaactcacaagaatccgtcaccgaacaagactcaaaagactccacctactctctctcctcaaccctgaccctttccaaagccgactacgaaaaacacaaagtctatgcctgcgaagtcacccaccaaggcctctcctcacccgtcaccaaatccttcaaccgcggcgaatgc

SEQ ID NO: 54309 - RNA, 1506 nt, synthetic construct
  misc_feature 1..1506: note = derived and/or modified sequence opt11 from Solitomab_HeavyChain1
  source 1..1506: mol_type = other RNA
gaactcgtaatgacacaatcgccaagcagcctaaccgtcacagcaggcgaaaaagtcaccatgagctgcaaatcgagccagagcctcctaaactcaggaaaccagaaaaactacttaacctggtaccaacaaaaacccggccaaccacccaaacttctcatatactgggccagcacacgcgaatccggagtccccgacagattcacagggtcgggttcaggcaccgacttcaccctaaccatctcctcggtccaagccgaagacctagccgtctactattgccaaaacgactactcctacccactaaccttcggggctggaaccaaactcgaaatcaaaggaggcggcggctcaggaggcgggggatccggaggaggcggctccgaggtacaactcctcgaacaaagcggggcagaactcgtacgcccaggcaccagcgtaaaaataagctgcaaagccagcggctacgcattcacaaactactggctcggctgggtcaagcaacggcccggacacggactcgagtggataggcgacatcttcccaggcagcggcaacatacactacaatgaaaaattcaaaggaaaagcaacactaacagccgacaaatcaagcagcacagcctacatgcaactatccagcctcaccttcgaagacagcgccgtctacttctgcgcccgacttagaaactgggacgaacccatggactactggggacaaggaacaacagtcacagtctcaagcggaggcggaggatcagacgtacaactcgtccaaagcggagccgaagtcaagaaaccaggcgcgagcgtgaaagtaagctgcaaagcaagcggctacacattcacccgatacacaatgcattgggtcagacaagcacccggacaaggactcgaatggatcggctacatcaacccaagccgcggctacaccaactacgcagacagcgtaaaaggccgcttcaccatcaccactgacaaatccacttccaccgcctatatggaactgagcagccttcgctccgaagacaccgcaacctactactgcgcaaggtactatgatgaccactactgcctcgactactggggacaaggaaccacagtaaccgtttcttccggagaaggaaccagcaccggctcaggaggctcaggtggcagcgggggcgcagacgacatagtactcacacaatcgcccgctacccttagcctgtcccccggcgaacgcgccaccctgagttgccgagcctcccaaagcgtaagctacatgaactggtatcaacaaaaacccggcaaagccccaaagaggtggatatacgacacctcaaaagtggccagcggagtgcccgcacgcttcagcggaagcggaagtggcaccgactacagcctaacaataaacagcctagaggccgaagacgcagcaacctactactgccaacaatggtccagcaaccccctaacattcggcggcggcacaaaagtagaaataaagcaccatcaccaccaccac

SEQ ID NO: 54310 - RNA, 1506 nt, synthetic construct
  misc_feature 1..1506: note = derived and/or modified sequence opt11 from Solitomab_SingleChain
  source 1..1506: mol_type = other RNA
gagctagtaatgacacaaagcccctcaagcctaacggtaacagcaggagaaaaagtaaccatgagctgcaagtcctcccaatccctcctaaactccggaaaccagaaaaattacctcacctggtaccaacaaaaaccaggacaaccacccaagctcctaatctactgggcgagcacccgcgaatccggagtccccgacaggttcacaggctctggctcaggcaccgactttaccctaacaataagctcagtacaagcagaagacctagctgtctactactgccagaacgactacagctaccccttaacatttggggccggaaccaaactcgaaatcaaaggaggcggcggaagcggcggaggcggatccggaggcggcggaagcgaagtccaactcctagaacaatcaggagcagaattagtccgacccggcacaagcgtaaaaatcagctgcaaagcatcaggatacgcattcaccaattactggctaggatgggtcaagcaaagacccggacacggcctggaatggatcggcgacatattcccaggaagcggaaacatccactacaacgaaaaattcaagggaaaagcaaccctaaccgctgacaagagcagctccaccgcatacatgcaactctcatcactaacctttgaagactccgccgtatacttctgcgccaggctaaggaactgggacgaacccatggactactggggacaaggcaccacggtaaccgtctcaagtggaggaggaggctccgacgtccaattagtacaatccggcgcagaagtcaagaaaccaggagcaagcgtcaaagtctcctgtaaagcatccggttacaccttcacacgctataccatgcactgggtacgacaagcacccggccaaggactggaatggattggatacatcaacccctccagaggctacacaaactacgccgacagcgtaaaagggagattcaccataaccaccgacaaaagcacatcaaccgcctacatggaactatccagcctgcgcagcgaagatacagcaacctactactgcgcaaggtactacgacgatcactactgcctcgactactgggggcaaggaaccacagtcaccgtatcctccggagagggcacttccaccggcagtggcggatcgggcggcagcggcggcgcggacgacatcgtactcacacaatcacccgccaccctctccctctcccctggcgaacgagccaccctctcatgccgcgccagccaaagcgtgtcatacatgaactggtaccaacaaaaaccaggcaaagcacccaaacgatggatatacgacacctccaaagtcgcctcaggcgtacccgcacgcttcagcggaagtggatcaggcacagactacagcctcacaatcaacagcctagaagcagaagacgcagcaacctactactgccagcaatggtcctccaaccccctaaccttcggaggcggaaccaaagtggaaatcaagcaccaccaccaccaccac

SEQ ID NO: 54311 - RNA, 702 nt, synthetic construct
  misc_feature 1..702: note = derived and/or modified sequence opt11 from Sonepcizumab_LightChain_Precursor
  source 1..702: mol_type = other RNA
atgtccgtccccacccaagtactcggcctcctcctcctctggctcaccgacgcccgatgcgaaaccaccgtcacccaatcaccctcattcctctccgcctccgtaggcgaccgcgtcaccataacctgcatcaccaccaccgacatcgacgacgacatgaactggttccaacaagaacccggcaaagcccccaaactactaatctcagaaggcaacatcctccgcccaggcgtcccatcccgcttctcctcctccggctacggcacagacttcaccctaaccatctccaaactccaacccgaagacttcgccacctactactgcctccaatccgacaacctccccttcactttcggccaaggcactaaactcgaaatcaaacgcaccgtcgcagccccctccgtcttcatcttcccaccctccgacgagcaactaaaatcaggcaccgcctccgtcgtctgcttacttaacaacttctacccccgcgaagccaaagtccaatggaaagtcgacaacgccctccaatccggcaactcccaagaatccgtaaccgaacaagactccaaagactccacctactccctatcctccaccctcaccctctcaaaagccgactacgaaaaacacaaagtatacgcctgcgaagtcacccaccaaggcctatcctcccccgtaaccaaatccttcaaccgtggcgaatgc

SEQ ID NO: 54312 - RNA, 1365 nt, synthetic construct
  misc_feature 1..1365: note = derived and/or modified sequence opt11 from Sonepcizumab_gamma1-Chain_Precursor
  source 1..1365: mol_type = other RNA
atggagtggtcctgggtcttcctcttcttcctttccgtaaccaccggagtccactccgaggtccaactcgtccaatccggcgccgaagtcaagaaacccggcgaatcactcaaaatatcgtgccaatccttcggctacatcttcatcgaccacaccatccactggatgcgccagatgccgggacaaggactcgaatggatgggagccatcagccctcgccacgacatcaccaaatacaacgaaatgttccgaggccaagtcaccatctccgcagacaaatcgtcctccaccgcctacctacaatggagttcactcaaagcatcagacaccgccatgtacttttgcgcccgcggcggcttctacggctccaccatctggttcgacttctggggccaaggcaccatggtaaccgtctcctcggcatccaccaaaggcccatccgtcttcccactagccccctcctccaaatccacatccggaggcacggccgccctcggctgtctcgtcaaagactacttcccggaaccagtcaccgtctcctggaactccggcgccctcacttccggagtccacaccttccccgcagtcctccaatcctcaggcctatactccctctcctccgtagtaaccgtcccgtcctccagcttaggcacgcaaacatacatctgcaacgtaaatcacaaaccatcaaacaccaaagtcgacaaacgagtagcacccgaactcctgggcggcccctccgtcttcctatttcccccgaaacccaaagacaccctcatgatctcccgcacccccgaagttacctgcgtcgtcgtcgacgtaagccacgaggaccccgaagtcaaattcaactggtacgtcgacggagttgaagtacacaatgccaaaacaaaaccccgggaagaacaatacaactccacctaccgagtagtctccgtccttaccgtactccaccaagactggctaaacggcaaagaatacaaatgcaaagtctccaacaaagccctcccggcgcccatcgagaaaacaatctccaaagccaaaggccagccccgggaacctcaagtatacaccctcccaccctctcgcgaagaaatgaccaaaaaccaagtctccctcacttgccttgtcaaaggcttctacccctccgacatcgcagtcgaatgggaatccaacggccaacctgaaaacaattacaaaaccacacccccagtcctagactccgacggctccttcttcttatactcaaaactcaccgtcgacaaatcacgctggcaacaaggtaacgtattctcatgctccgtcatgcacgaagccctccacaaccactatacccagaaatccctctccctctcacccggcaaa

SEQ ID NO: 54313 - RNA, 1338 nt, synthetic construct
  misc_feature 1..1338: note = derived and/or modified sequence opt11 from Stamulumab_HeavyChain1
  source 1..1338: mol_type = other RNA
gttcaactcgtccaatccggcgccgaagtcaaaaaacccggcgccagcgtcaaagtatcctgcaaagcatccggctacacattcacctcctactacatgcactgggtccgccaagcccccgggcaaggactagaatggatgggcatcattaatccctccggcggttccacctcctacgcccaaaaattccaaggacgcgtcaccatgacccgagacacctccacctccaccgtatacatggaactctcaagcctacgaagcgaagacaccgccgtctactactgcgcccgagacgaaaactggggcttcgacccctggggccaaggaaccctcgtcacagtctcgagcgcctccacaaaaggcccttccgtcttccccctagccccgagcagcaaatccacctcaggcggcaccgccgccctcggctgcctagtcaaagactacttccccgaacccgtcaccgtcagctggaactccggcgcactaacatcaggcgtccatacattccccgccgtacttcaatcttccggcctatactcactttcatcagtagtaaccgttccctcaagctccctaggcacacaaacctacatatgcaacgtcaaccataaaccatccaataccaaagtcgacaaaaaagtagaacccaaaagctgcgacaaaacccacacctgccccccctgccctgccccagaactcctcggcgggccctccgtcttcctattcccccccaagcccaaagacaccctaatgatctccagaacccctgaagtcacctgcgtcgtagtagacgtctcccacgaagaccccgaagtgaaattcaactggtacgtcgacggagtcgaagttcacaacgccaaaactaaacccagagaagaacaatacaactccacataccgagtcgtctccgtcctcacagtcctacaccaagactggttgaacggaaaagaatacaaatgcaaagtctccaacaaagccctgcccgcccccatcgaaaaaaccatttcaaaagccaaaggacaaccaagagaaccccaagtatacactttacccccctcccgcgaagaaatgaccaaaaaccaagtctccctcacatgcctcgtcaaaggcttctaccccagcgacatagccgtagaatgggaaagcaacggccaacccgaaaacaactacaaaaccactccccccgtacttgattcagacggctccttcttcctctactcaaaactcaccgtcgacaaatcccgatggcaacaaggcaacgtcttctcatgctccgtcatgcacgaagccctacacaaccactacacccaaaaatccctctccctctccccaggaaaa

SEQ ID NO: 54314 - RNA, 633 nt, synthetic construct
  misc_feature 1..633: note = derived and/or modified sequence opt11 from Stamulumab_LightChain1
  source 1..633: mol_type = other RNA
tcctacgaactcacccaacccccctccgtctccgtctcccccggccaaaccgcctccatcacatgcagcggccacgccctcggcgacaaattcgtctcctggtaccaacaaaaacccggacaatcccccgtcctagtcatctacgacgacacccaacgaccctcaggcatccccgaacgcttctccggctccaactccggcaacaccgcaaccctcaccatctccggcacccaagccatggacgaagccgactactactgccaagcctgggactcctccttcgtattcggcggaggcacaaaagtcaccgtcctcggccaacccaaagccgccccatccgtcaccctcttcccaccctcttcagaagaactccaagccaacaaagccacccttgtctgcctaatctccgacttctaccccggcgccgtcaccgtagcctggaaagcagactcctcccccgtcaaagccggcgtcgaaaccaccaccccctccaaacaatctaacaacaaatacgccgcctccagctacctctccctcacccccgaacaatggaaatcacacagatcctactcctgccaagtcacacacgaaggctccaccgtcgaaaaaaccgtcgcccccaccgaatgctcc

SEQ ID NO: 54315 - RNA, 1356 nt, synthetic construct
  misc_feature 1..1356: note = derived and/or modified sequence opt11 from Suptavumab_HeavyChain1
  source 1..1356: mol_type = other RNA
gaagtccaattagtcgaatcaggcggcgacctcgtccaacccggccgatccctccgcctgtcctgcgtagcatccggcttcaccttcgacgactacgccatgcactgggtccgacaagcgcccggcaaaggactagaatgggtctccggagtcagttggtcgggatccaccgttggctacgccgattcagtcaaaggccgctttaccgtctcacgcgacaacgcccaaaaatccctctacctacagatgaactccctccgcgccgaagacaccgctctatactactgcgtaaaagacgcatacaaattcaactactactactacggcctcgacgtctggggccagggaacaacagtcacagtctcctccgcctccaccaaaggcccctccgtcttccccctagccccctcctcaaaatctacatctggaggcacagccgctctcggatgcctcgtaaaagactacttccccgagccagtaaccgtcagctggaactccggtgcactaacatcaggagtccacaccttccccgcagtcctacaatcctcaggcctctacagcctatcctccgttgtcacagtcccatcatcctctctcggaacacaaacctacatatgcaacgtcaaccacaaaccatccaacaccaaagtagacaagaaagtcgaaccaaaatcctgcgacaaaacccacacctgtccaccctgccccgcccccgaactcctcggaggcccatcagtcttcctcttcccacccaaacccaaagacacactcatgatctcccgcacccccgaagtcacatgcgtcgtcgtagacgtatcccacgaagaccccgaagtaaaattcaactggtacgtcgacggcgtcgaagtccacaacgccaaaaccaaaccccgcgaagaacaatacaactccacctacagagtcgtctccgtcctcaccgtcctacaccaagactggcttaacggcaaagaatacaaatgcaaagtctctaacaaagcccttcccgcaccaatcgaaaagaccatcagcaaagcaaaaggtcaacctcgcgaaccccaagtctacaccctacccccttcccgcgacgaactcaccaaaaaccaagtctccctcacatgcctcgtcaaaggcttttacccctccgacatcgccgtggaatgggaaagcaacggccaacccgaaaacaactacaaaaccaccccacccgtcctagactccgacggctcattcttcctatactccaaactcaccgtggacaaatcacgctggcaacaaggcaacgtcttctcctgctccgtcatgcacgaggccctccacaaccactacacacaaaaatccctctcactatcccccgga

SEQ ID NO: 54316 - RNA, 642 nt, synthetic construct
  misc_feature 1..642: note = derived and/or modified sequence opt11 from Suptavumab_LightChain1
  source 1..642: mol_type = other RNA
gaaatcgtaatgacacaatcacccgcaaccctctccgtctcccccggcgaacgcgcaaccctatcctgccgcgcctcccaaaccatcctctccaacctcgcctggtacctccaaaaacccggacaagccccccgactcctcatctacggcgcctccacacgcgcaaccggactcccagcccgcttctccggctccggctccggcaccgaattcaccctaaccatctcctccctccaatccgaagacttcgccgtctactactgccaacaatacaacaactggccactcacattcggcggcggcaccaaagtcgaaatcaaacgcaccgtcgccgccccctcagtcttcatcttcccaccctcagacgaacaactcaaatcaggcaccgcctcagtcgtatgcctcctaaacaacttctacccccgcgaagccaaagtccaatggaaagtcgataacgccctccaatccggcaactcccaagaatccgtaaccgaacaagactccaaagactccacctactccctctcatccaccctcaccctctccaaagccgactacgaaaaacacaaagtttacgcctgcgaagtcacacaccaaggactctcctcccccgtcaccaaatccttcaacagaggcgaatgc

SEQ ID NO: 54317 - RNA, 1344 nt, synthetic construct
  misc_feature 1..1344: note = derived and/or modified sequence opt11 from Suvizumab_HeavyChain1
  source 1..1344: mol_type = other RNA
caagtccagctagtccaatccggcgccgaagtcaagaaacccggcgcctccgtcaaagtctcatgcaaagcctcaggatacaccttcacgaactcctggatcggctggttccgacaagcccccggccaaggcctcgaatggatcggcgacatctaccccggaggcggctacaccaactacaacgagatcttcaaaggaaaagccaccatgaccgccgacaccagcaccaacactgcctacatggaactctcctccctgcgatcagaagacaccgccgtctactactgctccagaggaatcccaggctacgccatggactactggggacaaggcaccctcgtcaccgtttcaagcgcctcaacaaaaggcccatccgtcttccccctagccccatcctccaaatcaacaagcggaggcaccgccgctctaggatgcctcgtcaaagactacttcccggaaccagttacagtatcatggaactcaggcgccctcacctccggagtccacaccttccccgcagtactccaatcctccggcctatactccctctcttccgtggtcaccgtcccatcctcaagcctcggtacccaaacatacatctgcaacgtcaaccacaaaccctccaacacaaaagtagacaagaaagtagaacccaaatcctgcgacaaaacccacacatgccctccctgcccagcccccgagctcctcggcggaccctccgtcttcctgtttccccctaaacccaaagataccctcatgatctcacgcaccccagaagtaacctgcgtcgtcgtcgacgtatcccacgaagacccagaagtaaaattcaactggtacgtagacggagtcgaagtccacaatgcaaaaaccaaacctcgcgaagaacaatacaactccacctaccgagtcgtctccgtactaacagtcctccaccaagactggctaaacggaaaagaatacaaatgcaaagtcagcaacaaagccctccccgcccccatagagaaaaccatatccaaagccaaaggacaacctcgagaaccccaagtctacaccctaccaccttcccgcgacgaactcaccaaaaaccaagtaagcctgacatgcctcgtcaaaggcttctacccctctgacatcgccgttgaatgggaatcaaacggccaaccagaaaacaattacaaaaccaccccacccgtactcgactccgacggctcattcttcctctactccaaacttaccgtcgataaatcccgctggcaacaagggaacgtattctcctgctcagtaatgcacgaagccctacataaccactacacccagaaaagcctatcactctccccaggcaag

SEQ ID NO: 54318 - RNA, 660 nt, synthetic construct
  misc_feature 1..660: note = derived and/or modified sequence opt11 from Suvizumab_LightChain1
  source 1..660: mol_type = other RNA
gacatccaaatgacccaacgccccgacagcctctccgcctccgtcggtgaccgcgtcaccatgagctgcaaatcctcacaatccctcctcaactccggcgaccagaaaaactacctcacctggtaccaacaaaaacccggacaaccacccaaactcctcatctactgggcctccacaggcgaatccggcgtccccgaccgattctcaggctccggctccggaaccgacttcaccttcaccataagctccctccaacccgaagacatcgccacctactactgccaaaacgactactcatacccctggaccttcggccaaggcaccaaagtagaaatcaaacgcaccgtcgccgccccctccgtcttcatcttcccaccctccgacgaacaacttaaatcaggcaccgcctccgtcgtctgcctcctcaacaacttctacccccgcgaagccaaagtccaatggaaagtcgacaacgccctccaatccggcaactcccaagaatccgtcaccgaacaagactccaaagactccacctactccctatcctccaccctcaccctcagcaaagccgactacgaaaaacacaaagtctacgcctgcgaagtcacccaccaaggtctatcctcccccgtcaccaaatccttcaaccgcggcgaatgc

SEQ ID NO: 54319 - RNA, 1350 nt, synthetic construct
  misc_feature 1..1350: note = derived and/or modified sequence opt11 from Tabalumab_HeavyChain1
  source 1..1350: mol_type = other RNA
caggtccaactccaacaatggggcgcaggcctcctcaaaccctccgaaaccctctcactcacatgcgcggtatacggcggctccttctccggctactactggtcctggatccgccaacccccaggaaaaggcctagaatggatcggcgaaattaaccactccggcagcacaaactacaacccctcactaaaatcccgagtaaccatctccgtcgacacttctaaaaatcaattctcactcaaactctctagcgtaaccgccgccgacaccgccgtctactactgtgcccgcggctactacgacatcctcacaggctactactactacttcgactactggggccaaggcaccctagtaaccgtctcctcagcttccactaaaggaccatccgtcttccctctcgccccatgctcacggtccacctcggaatccaccgccgctctaggctgcctcgtcaaagactacttcccggaacccgtcaccgtctcctggaactccggcgccctaacatccggcgtacacacattccccgccgtcctacagtcctctggcctctactcactctccagcgtagtcaccgtccccagctcctccctcggcaccaaaacctacacttgcaacgttgaccacaagccctccaacaccaaagtcgataaacgcgtcgaatccaaatacggaccaccctgcccgccctgcccagcccccgagttcctcggcggcccttccgtcttcctcttcccacccaagcccaaagacaccctcatgatatcgcgcacccccgaagtcacctgtgtagtagtcgacgtctcccaagaagaccccgaagtccaattcaactggtacgtcgacggcgtcgaagtccacaacgccaagaccaagccaagagaagaacaattcaactctacctaccgcgtcgtttccgtactcaccgtactccaccaagactggctaaacggaaaagagtacaaatgcaaggtctccaacaaaggcctaccctcctccatcgaaaagacaatctcaaaagcaaaaggccaaccaagagaaccccaagtatacacgctccctcctagccaagaggaaatgaccaaaaaccaagtatcactaacctgcttagtcaaaggtttctacccctccgacatcgccgtagaatgggaatccaacggtcaacctgaaaacaactacaaaaccactccacccgtactcgactccgacggctcattcttcctatactcccgactcacagtagacaaaagccgttggcaagaaggcaacgtcttctcctgctcagtcatgcacgaagccctacacaaccactacacccaaaaatccctctcactctcactaggcaaa

SEQ ID NO: 54320 - RNA, 642 nt, synthetic construct
  misc_feature 1..642: note = derived and/or modified sequence opt11 from Tabalumab_LightChain1
  source 1..642: mol_type = other RNA
gaaatcgtcctcacacaatcccccgccaccctctccctatcccccggcgaacgcgcaacccttagctgccgcgcctcccaaagcgtctcccgctaccttgcatggtaccaacaaaaacccggtcaagcaccccgactcctcatatacgacgcctccaaccgagccaccggcatccccgcccgcttctccggctcaggctctggcacagactccaccctaaccatctcctccctcgaacccgaagacttcgccgtctactactgccaacaacgatcaaactggccccgcaccttcggacaaggcaccaaagtcgagatcaaacgcaccgtagccgccccctccgtcttcatcttcccaccctccgacgaacaactcaaatccggcaccgcctccgtcgtctgcctcctcaacaacttttacccccgcgaagccaaagtccaatggaaagtcgacaacgccctccaatccggcaactcacaagaatccgtaaccgaacaagattccaaagactcaacctactccctatccaacaccctcaccctatcaaaagccgactacgaaaaacacaaagtatacgcctgcgaagtcacacaccaaggcctctcctcccccgtcaccaaatccttcaaccgcggcgaatgc

SEQ ID NO: 54321 - RNA, 1332 nt, synthetic construct
  misc_feature 1..1332: note = derived and/or modified sequence opt11 from Tacatuzuab_HeavyChain1
  source 1..1332: mol_type = other RNA
caagtccaactccaacaatccggcgccgaagtcaagaaacccggctcctcggtaaaagtctcatgcaaagcctccggctacgccttcacctcctacgtcatccactgggtccgccaagcccccggccaaggactatactggatcggctacatccacccctacaacggcggcaccaagtacaacgaaaaattcaaaggcaaagccaccatcacagccgacgaatccaccaacaccgcctacgaactctcctccctgcgctccgaagacaccgccttctacttctgcgcaagatccggcggcggcgaccccttcgcctactggggccaaggatcactcgtgaccgtcagcagcgccagcaccaaaggcccatcagtgttccccctagcaccctcaagcaaatcaacatctggcggcacagccgccctaggctgcctcgtaaaagactacttcccagaacctgtcacagtctcttggaactccggcgcactcacatccggagtccacacgttccccgcagtactacaatcatcgggcctgtactccctctcatccgtcgtcacagtgccctcatcctccctaggaacccaaacctacatctgcaacgtcaaccacaaaccctccaacacaaaagtcgacaaacgagttgaacccaaatcatgcgataaaacccatacctgcccaccctgccccgcacccgaactccttggcggcccctccgtcttcctcttcccacccaaacccaaagacacactcatcagccgcacccccgaagtaacctgcgtcgtcgtcgatgtaagccacgaagaccccgaagtcaaattcaactggtacgtagacggagttgaagttcacaacgccaaaacaaaacccagagaggaacaatacaactcaacataccgcgtcgtctcagttttaacagtcctccaccaagactggctcaacggcaaagaatacaaatgcaaagtttccaacaaagccctgcccgcacccatcgagaaaaccatatcaaaggccaaaggacaaccccgagaaccccaagtctacaccctcccaccatcccgcgaagaaaccaaaaatcaggtctccctaacctgcctagtcaaagggttctacccctcagacatcgccgtagaatgggaatccaacggacaaccagaaaataactacaaaacaacccctcccgtcctcgacagcgacggctcattcttcctctactccaaactcacagtagacaaatcccgctggcaacaaggcaacgtcttcagctgctctgtccacgaagccctccacaaccactacacccaaaaatccctatcactctcccccggcaaa

SEQ ID NO: 54322 - RNA, 636 nt, synthetic construct
  misc_feature 1..636: note = derived and/or modified sequence opt11 from Tacatuzuab_LightChain1
  source 1..636: mol_type = other RNA
gacatccaactcacacaatcaccatcctccctctcagcctccgtcggcgaccgcgtcaccataacctgcaaagcatcccaagacatcaacaaatacatcggctggtaccaacaaaaacccggcaaagcccccaaactcctccactacacctccgccctcctcccaggcatcccctcccgcttctccggatccggctccggccgcgactacaccttcacaatctcctccctccaacccgaagatatcgccacctactactgcctccaatacgacgacctctggaccttcggaggcggcaccaaactccaaatcaaacgcacagtcgcagccccctcagtcttcatcttcccaccctccgacgaacaacttaaatccggcaccgcctcagtcgtctgcctcctcaacaacttctacccccgcgaagccaaagtccaatggaaagtcgacaacgccctccaatccggcaactcccaagaatccgtcaccgaacaagactccaaagactccacctactccctctcctccaccctaacactctccaaagccgactacgaaaaacacaaagtctacgcctgcgaagtcacccaccaaggcctctcatcacccgtcaccaaatctttcaaccgcggcgaatgc

SEQ ID NO: 54323 - RNA, 678 nt, synthetic construct
  misc_feature 1..678: note = derived and/or modified sequence opt11 from Tadocizumab_fab_fragment_HeavyChain
  source 1..678: mol_type = other RNA
caagtccaactcgtccaatcaggagccgaagtaaaaaaacccggctcctccgtaaaagtctcctgcaaagcatccggctacgccttcaccaactacctcatagaatgggtccgccaagcacccggccaaggactcgaatggatcggcgtcatctatccaggctctggcggaaccaactacaacgaaaaattcaaaggccgcgtcaccctcaccgtcgacgaatccacaaacaccgcctacatggaactctcatccctccgctccgaagacaccgccgtctacttctgcgcacgacgcgacggcaactacggctggttcgcctactggggccaaggaaccctcgtcaccgtatcctccgcctccaccaaaggcccctccgtcttccccctcgccccctcctctaaatccaccagcggcggcaccgccgcactcggctgcctcgtcaaagactacttccctgaacccgtcaccgtctcatggaactccggcgccctcacctccggcgtccacaccttccccgccgtcctccaatcctccggcctctactccctctcctcagtcgtcaccgtcccctcctcctccctcggcacccaaacctacatctgcaacgtcaaccacaaaccctccaacaccaaagtcgacaaaaaagtcgaacccaaatcctgtgacaaaacccac

SEQ ID NO: 54324 - RNA, 582 nt, synthetic construct
  misc_feature 1..582: note = derived and/or modified sequence opt11 from Tadocizumab_fab_fragment_LightChain
  source 1..582: mol_type = other RNA
gacatccaaatgacccaaaccccctccacactttccgcctccgtcggcgaccgcgtcaccatctcctgccgcgcctcacaagacatcaacaactacctcaactggtaccaacaaaaacccggcaaagcccccaaactcctcatctactacacctcaaccctccactccggagtcccctcccgcttctcaggctcaggctcaggcaccgactacaccctcaccatctcctccctccaacccgacgacttcgccacctacttctgccaacaaggcaacaccctcccctggacattcggacaaggaaccaaagtcgaagtcaaacgcaccgtcgcagccccctccgtattcatcttcccaccctccgacgaacaactaaaatccggcaccgcctccgtcgtctgccttctaaacaacttctacgaatccgtcaccgaacaagactccaaagactcaacctactccctctcctccaccctcaccctctccaaagccgactacgaaaaacacaaagtctacgcctgcgaggtcacacaccaaggcctctcctcccccgtcaccaaatccttcaaccgcggcgaatgc

SEQ ID NO: 54325 - RNA, 1359 nt, synthetic construct
  misc_feature 1..1359: note = derived and/or modified sequence opt11 from Talizumab_HeavyChain1
  source 1..1359: mol_type = other RNA
caagtccaactcgtccaatccggcgccgaagtcaagaaacccggcgcctccgtcaaagtctcctgcaaagccagcggctacaccttctccatgtattggcttgaatgggtccgacaagcacccggccacggacttgaatgggtaggcgagatctcccccggcacctttaccactaactacaacgaaaaatttaaagcccgcgccaccttcaccgcagacacgagcaccaacacagcctacatggaactctcctccttacgctccgaagacaccgcagtatactactgcgcccgattctcacacttctccggctccaattatgactacttcgactactggggacaaggaacactcgtcacagtctcatcagcctcaaccaaaggcccctcagtcttcccccttgccccctcatccaaatccacttccggcggtaccgcagccctgggatgccttgtcaaagactacttccccgaacccgtcaccgtcagctggaactccggcgccctcacatcaggcgtccacaccttccccgccgtcctccaatcctcaggactatacagcctcagctccgtcgtcacagtcccctcctcatccctcggaacccaaacatacatctgcaacgtcaaccacaaaccctcaaacaccaaagtcgacaagaaagtagaacccaaatcctgcgacaaaacccatacatgcccaccctgcccagcccccgaactcctcggcggcccatcagtcttcctctttccgcccaaacccaaagacaccctcatgatctcccgtacccccgaagtaacctgcgtcgtcgtcgacgtatcccacgaagaccccgaggtcaaattcaactggtacgtagacggcgtagaagtccacaacgccaaaacaaaaccccgcgaagaacaatacaactccacctatcgcgtcgtctccgtcctcactgtccttcaccaagactggctaaacggcaaagaatacaaatgcaaagtctccaacaaagcactacccgcacccattgagaaaaccatcagcaaagcaaaaggccaaccacgcgaaccgcaagtctatacactaccaccctcccgcgacgaactcaccaaaaaccaagtctctctcacatgcctcgtaaaaggcttctacccctccgatatagcagtagaatgggaatccaatggccaacccgaaaacaactacaaaaccacccctcccgtactcgactccgacggctccttcttcctatactctaaactcaccgtcgacaaatcccggtggcaacaaggcaacgtattctcctgcagcgtcatgcacgaagccctccacaaccactacacccagaaaagcctgtccctctcacccggaaaa

SEQ ID NO: 54326 - RNA, 642 nt, synthetic construct
  misc_feature 1..642: note = derived and/or modified sequence opt11 from Talizumab_LightChain1
  source 1..642: mol_type = other RNA
gacatcctcctcacacaatcccccggaaccctctccctaagccccggcgaacgcgccaccctatcctgccgcgcctcccaatccatcggcaccaacatccactggtaccaacaaaaacccggacaagcgccccgcctactcatcaaatacgccagcgaaagcatctccggcatcccctcccgcttctccggctcaggctccggcacagacttcaccctcaccatctcccgcctcgaacccgaagacttcgccatgtactactgccagcaatcagactcatggccaaccaccttcggacaaggcaccaaagtcgaaatcaaacgcaccgtcgccgccccctcagtcttcatattcccaccctcagacgaacaactaaaatccggcactgcctctgtcgtctgcctactcaacaacttctacccccgcgaagccaaagtccaatggaaagtcgacaacgccctccaatccggcaactcacaagaatccgtcaccgaacaagacagcaaagactcaacatactccctctcctccaccctcaccctatccaaagccgactacgaaaaacacaaagtctacgcctgcgaagtcacccaccaaggcctctcctcacccgtcaccaaatccttcaaccgcggcgaatgc

SEQ ID NO: 54327 - RNA, 1368 nt, synthetic construct
  misc_feature 1..1368: note = derived and/or modified sequence opt11 from Tamtuvetmab_HeavyChain1
  source 1..1368: mol_type = other RNA
gaagtcaaactcctggaatctggcggcggcctcgtccaacccggcggatccatgcgcctctcatgcgcgggatcaggattcacattcaccgacttctacatgaactggatacgccaacccgccggcaaagcacccgaatggctcgggttcatacgcgacaaagccaaaggctacaccaccgaatacaacccctcagtcaaaggacgcttcaccatttcacgcgacaacacacaaaacatgctatacctccaaatgaacacgctccgagccgaagacacagccacctactattgcgcacgcgagggccacaccgctgcccccttcgattactggggacaaggcacgctcgtaacagtaagctcagcctcaaccacagcaccctccgtcttccccctcgcaccctcatgcggatcaacctccggctcaacggtagcgctcgcatgcctcgtatcgggctacttccccgagccagtcaccgtatcctggaactccgggagcctaacatccggcgtccacaccttcccaagcgtactccagtcctcaggactatactcgctttcatcaatggtaacagtcccatcctcccgctggccttccgaaaccttcacatgcaacgtcgcccacccggcctccaaaaccaaagtagacaaacccgtcccaaaacgcgaaaacggccgcgtaccccgacccccagactgccccaaatgccccgcccctgaaatgctcggcggccccagcgtcttcatattcccacccaagcccaaggacacactactgatcgcccgcacgcccgaagtgacctgcgtcgtcgtcgacctcgaccccgaagatcccgaagtacaaatctcctggttcgtcgacggcaaacaaatgcaaaccgctaaaacccaaccccgcgaagaacaattcaacggaacataccgagtagtctccgtcctcccaataggtcaccaagactggctcaaaggcaaacaatttacctgcaaagtcaacaacaaagccctgccctcccccatcgaacgaaccatctcaaaagcacgcggtcaagcccaccaaccatccgtctacgtccttcctccctcgcgcgaggaactaagcaaaaacacagtctccttaacctgcctcatcaaggacttcttccctcccgacatagacgtcgaatggcaatctaacggccaacaagaacccgaaagcaaataccgaaccacaccaccccaactcgacgaggacggatcatacttcctgtactcaaaactatccgtagacaaatcccgctggcaacgaggagacacgttcatctgcgcagtcatgcacgaggccctgcacaaccactacacccaaaaatccctctcgcactcacccggaaaa

SEQ ID NO: 54328 - RNA, 639 nt, synthetic construct
  misc_feature 1..639: note = derived and/or modified sequence opt11 from Tamtuvetmab_LightChain1
  source 1..639: mol_type = other RNA
gacataaaaatgacacaatccccctccttcctctccgcctccgtcggcgaccgcgtaaccctaaactgcaaagcctcccaaaacatcgacaaatacctcaactggtaccaacaaaaactcggcgaatcccccaaactcctcatctacaacaccaacaacctccaaaccggaatcccctcccgattctccggctccggctccggcaccgacttcacactcaccatctcctccctccaacccgaagacgtagccacctacttctgccttcaacacatctcccgcccccgcaccttcggcggcggcacccacctcaccgtcctcggccaacccaaagcatccccctccgtcaccctcttccccccctcctccgaagaactcggagccaacaaagccaccctcgtctgcctcatctccgacttctaccccagcggagtcaccgtcgcctggaaagccgacggctcccccatcacccaaggcgttgaaaccaccaaaccctccaaacaatccaacaacaaatacgccgcctcctcctacctctcactcaccccagacaaatggaaatctcactcctccttctcctgcctcgtaacccacgaaggctccacagtcgaaaaaaaagtcgcccccgccgaatgctcc

SEQ ID NO: 54329 - RNA, 360 nt, synthetic construct
  misc_feature 1..360: note = derived and/or modified sequence opt11 from Tanezumab_HeavyChain
  source 1..360: mol_type = other RNA
caagtccaactccaagaatccggccccggactcgtcaaaccctccgaaaccctatccctcacctgcaccgtctccggcttctccctcatcggctacgacctcaactggatccgccaaccccccggcaaaggcctcgaatggatcggcatcatctggggcgacggcaccaccgactacaactccgccgtcaaatcccgcgtcaccatctccaaagacacctccaaaaaccaattctccctcaaactctcctccgtcaccgccgccgacaccgccgtctactactgcgcccgcggcggctactggtacgccacctcctactacttcgactactggggccaaggcaccctcgtcaccgtctca

SEQ ID NO: 54330 - RNA, 327 nt, synthetic construct
  misc_feature 1..327: note = derived and/or modified sequence opt11 from Tanezumab_LightChain
  source 1..327: mol_type = other RNA
gacatccaaatgacccaatccccctcatccctctccgcctccgtcggcgaccgcgtcaccatcacctgccgcgcctcccaatccatctccaacaacctcaactggtaccaacaaaaacccggcaaagcccccaaactcctcatctactacacctcccgcttccactccggcgtcccctcccgcttctccggctccggctccggcaccgacttcaccttcaccatctcctccctccaacccgaagacatcgccacctactactgccaacaagaacacaccctaccctacaccttcggccaaggcaccaaactcgaaatcaaacgcacc

SEQ ID NO: 54331 - RNA, 1323 nt, synthetic construct
  misc_feature 1..1323: note = derived and/or modified sequence opt11 from Tarextumab_HeavyChain1
  source 1..1323: mol_type = other RNA
gaagtccaactcgtcgaatccggaggcggactcgtccaacccggcggttcactacgcctatcctgcgccgccagcggcttcacattctccagctctggcatgtcctgggtccgccaggcccccgggaaaggactagaatgggtttccgtcatcgccagctccggctccaacacctactacgctgactcagtaaaaggccgcttcaccatctcccgcgacaacagcaaaaacaccctctacctccaaatgaactcactccgagccgaagacaccgcagtctactactgcgcacgtagcatcttctacaccacctggggccaaggaaccctcgtcaccgtatcaagcgcctcaacaaaaggaccctccgtcttccccctcgccccctgttcacgctcaacatcagaatcaacagccgccctcggctgcctcgtcaaagactacttccccgaacccgtcaccgtctcatggaactcaggcgcactcaccagcggagtacacaccttccccgcagtcctccaatcctcaggactctattccctgagctccgtcgtcaccgtaccctcctccaacttcggaacccaaacctatacatgcaacgtagaccacaaaccctccaacaccaaagtcgataaaaccgtagaacgcaaatgctgtgtcgaatgcccaccctgccccgccccacccgtcgccggcccctccgtcttcctcttcccacccaaacccaaagacacgctcatgatctctcgaacacccgaagtgacctgcgtcgtagtcgacgtctcccacgaagaccccgaagtccaattcaactggtacgtcgacggagtcgaagtccacaacgccaaaaccaaaccccgcgaggaacaattcaactccaccttccgcgttgtatccgtcctcactgtcgtacatcaagactggctcaacggaaaagaatacaaatgcaaagtatccaacaagggcctccccgcccccatcgagaaaaccatcagcaaaaccaaaggccaaccccgcgaaccccaagtgtacaccctaccaccctcacgcgaagaaatgaccaaaaaccaagtctcgctcacatgcctagttaaaggcttctacccctctgatatcgcggtcgaatgggaatccaacggccaacccgaaaacaactacaaaacaacaccacccatgctcgactcagacggcagcttcttcctatactctaaactcacagtcgacaaaagcagatggcaacaaggaaacgttttctcctgctccgtaatgcacgaagccctccacaaccactatacccagaagtccctctccctctctcccggcaaa

SEQ ID NO: 54332 - RNA, 645 nt, synthetic construct
  misc_feature 1..645: note = derived and/or modified sequence opt11 from Tarextumab_LightChain1
  source 1..645: mol_type = other RNA
gacatcgtcctcacccaatcccccgccaccctctccctctcccccggcgaacgcgccaccctctcctgccgcgcctcccaatccgtccgctctaactacctcgcctggtaccaacaaaaacccggccaagcaccccgcctcctcatctacggcgcctcctcccgcgccaccggcgtccccgcccgcttctccggctcaggctccggcaccgacttcaccctaaccatctcctccctcgaacccgaagacttcgccgtctactattgccaacaatactccaacttcccaatcaccttcggccaaggcacaaaagtcgaaatcaaacgcaccgtagccgccccctccgtcttcatcttcccaccctccgacgaacaactcaaatccggcaccgcctcagtcgtctgcctcctcaacaacttctacccccgcgaagccaaagtccaatggaaagtcgacaacgccctccaatcaggcaactcacaagaatccgtcaccgaacaagactccaaagactccacctactccctctcctccaccctcaccctatccaaagccgactacgaaaaacacaaagtctacgcctgcgaagtcacccaccaaggcctgtcctcccccgtcaccaaatccttcaaccgaggcgaatgc

SEQ ID NO: 54333 - RNA, 363 nt, synthetic construct
  misc_feature 1..363: note = derived and/or modified sequence opt11 from Tefibazumab_HeavyChain1
  source 1..363: mol_type = other RNA
caagtgcaattgaaagagagcgggcccgggctcgtgaaaccgagccagaccttgagcataacctgtaccataagcgggttctcgctctcgcgctatagcgtgcactgggtcaggcaaccgcccgggaaagggctcgagtggttgggcatgatctggggcgggggcaataccgattacaatagcgcgctcaagagcaggctctcgatctcgaaagataactcgaaaaatcaagtgttcttgaaaatgaactcactaacggccgcggacacggccgtgtactattgcgcgcgaaagggcgagttctattacgggtacgatggctttgtctattgggggcaagggaccttggtcacggtctcgagc

SEQ ID NO: 54334 - RNA, 336 nt, synthetic construct
  misc_feature 1..336: note = derived and/or modified sequence opt11 from Tefibazumab_LightChain1
  source 1..336: mol_type = other RNA
gacatcgtcatgacccaatcccccgactccctcgccgtctccctcggcgaacgcgtcaccatgaactgcaaatcctcccaatccgtcctatactcctccaaccaaaaaaactacctcgcctggtaccaacaaaaacccggccaatcccccaaactcctcatctactgggcctccacccgcgaatccggcgtccccgaccgcttctcaggctccggctccggcaccgacttcaccctcaccatctcctccgtccaagccgaagacctcgccgtctactactgccaccaatacctctcctcctacaccttcggcggcggcaccaaactcgaaatcaaa

SEQ ID NO: 54335 - RNA, 1368 nt, synthetic construct
  misc_feature 1..1368: note = derived and/or modified sequence opt11 from Tenatumomab_HeavyChain1
  source 1..1368: mol_type = other RNA
gaaatccaactacaacaatctggacccgaactagttaaaccaggcgcctcggtaaaagtctcgtgcaaagcctccggctacgcattcacctcctacaacatgtactgggtcaaacaatcacacggcaaatccctcgaatggatcggctacatcgacccctacaatggcgtcacatcatacaaccaaaaattcaaaggaaaagccaccctcaccgtcgacaaatcctcgtccacagcctacatgcacctcaacagtctcacctccgaagactcagcagtctactactgcgcccgcggcggaggctccatctactacgcaatggactactggggccaaggcacatccgtcaccgtatcctccgccaaaacaaccccccccagcgtctacccactggccccaggctgcggcgacactaccggaagctccgtcacactcggttgcctcgtcaaaggatacttccccgaaagcgtcaccgtcacctggaacagcggctccctctcttcctccgtccacacctttcccgcgctcctccaatccggcctctacacaatgtcctcctccgtaaccgtgccctcgtcaacatggcccagccagacagtcacctgctcagtagcccacccagcctcttcaaccaccgtcgacaaaaaactcgaaccctccgggcctatctcaacaatcaacccctgccccccctgcaaagaatgccacaaatgccccgccccaaacctcgaaggaggcccctctgtcttcatcttccctcctaacatcaaagacgtcctcatgatctcactaacccccaaagtcacctgcgtagtcgtagatgtctcagaagacgaccccgacgtacaaatctcatggttcgtcaacaatgtcgaagtccacacagcccaaactcaaacccaccgcgaggactacaattccacaatcagagtagtctcaacactacccatccaacaccaagactggatgtccggcaaagaattcaaatgcaaagtaaacaacaaggacctcccatcccccatagaacgtaccatctcaaaaataaaaggccttgtccgagcaccccaagtctacatcctccccccccccgccgaacaactctcccgaaaagacgtcagcctcacctgcctcgtagtcggattcaaccctggcgacatctccgtagaatggacttccaacggccacaccgaagaaaattacaaagacacagcccccgtcctagactctgacggctcctacttcatctactcaaaactaaacatgaaaaccagcaaatgggaaaaaacagactcattttcctgcaacgtccgacacgaaggcctaaaaaactactaccttaaaaaaacaatctcacgcagccccggaaaa

SEQ ID NO: 54336 - RNA, 657 nt, synthetic construct
  misc_feature 1..657: note = derived and/or modified sequence opt11 from Tenatumomab_LightChain1
  source 1..657: mol_type = other RNA
gacatcgtcatgacccaagccgccccctcagtccccgtcacccccggcgaatccgtctcaatctcctgccgctcctcaaaatcactcctccactccaacggaaacacctacctctactggttcctacaacgccccggccaatcaccccaactcctaatataccgcatgtcaaacctcgcctccggcgtccccgaccgcttctcaggctcaggctccggcaccgccttcaccctccgcatctcccgcgtcgaagccgaagacgtcggagtctactactgcatgcaacacctcgaataccccctcaccttcggcgccggcaccaaactcgaactaaaacgcgccgacgccgcccccacagtatccatcttcccaccctcctccgaacaactcacctccggcggcgcctccgtcgtatgcttcctcaacaacttctaccccaaagacatcaacgtcaaatggaaaatcgacggctccgaacgccaaaacggcgtcctaaactcctggacagaccaagactccaaagactcaacctactcaatgtcctccaccctcacactcactaaagacgaatacgaacgccacaactcctacacatgcgaagccacccacaaaacctccacctcacccatcgtaaaatcctttaaccgaaacgaatgc

SEQ ID NO: 54337 - RNA, 1356 nt, synthetic construct
  misc_feature 1..1356: note = derived and/or modified sequence opt11 from Teneliximab_HeavyChain1
  source 1..1356: mol_type = other RNA
caaatccaactcgtccaatcaggccccgaactcaagaaacccggtgaaactgtccgcatctcctgcaaagcctccggctacgccttcacaacgaccggcatgcaatgggtacaagaaatgcccggcaaaggccttaaatggatcggctggatcaacacccacagtggcgtacccaaatacgtcgaagacttcaaaggccgcttcgccttctccctcgaaacatcagccaacacagcatacctccaaatcagcaacctcaaaaatgaagacacagcaacctacttctgcgtccgctccggcaacggaaactacgacctcgcatacttcgcttactggggccaaggaaccctagtaacagtatcagccgcctccacaaaaggcccctcagtcttccccctcgccccctcctccaaatccacctcaggaggcaccgcagcactcggctgcctcgtcaaggactacttcccagaacccgtcaccgtctcctggaactccggcgccctaacttccggcgtccacaccttcccagcagtactccaatcctccggcctctactcactatcctcagtcgtaacagtaccctcctcatccctaggcacccaaacctacatctgcaacgtcaaccataaaccgtccaacaccaaagtcgacaagaaagtagagcccaaatcctgcgacaaaacccacacatgcccaccctgccccgcccccgaactcctaggcggtccctccgtgttcctattcccacccaaacccaaagacacacttatgatctcccgtaccccagaggttacctgcgtcgtcgtcgacgtctcccacgaagacccagaagtcaaattcaactggtatgtcgacggcgtagaagtacacaacgccaaaaccaaaccccgagaagaacaatacaactccacctaccgcgtcgtctccgtccttacagtactacaccaagactggctcaacggcaaagaatacaaatgcaaagtctcaaacaaagcactgccagcccccatagagaaaacaatcagcaaagccaaaggccaaccaagagaaccgcaagtctacacactcccaccctccagagacgaactaacaaagaaccaggtctctcttacctgcctcgtcaagggcttctaccccagcgacatcgccgtcgaatgggaatccaacggccaacccgaaaacaactacaaaaccaccccacccgtactcgactcagacggatcgttcttcctatacagcaaactcacagttgacaaaagccgatggcaacaaggaaacgtattctcctgctccgtaatgcacgaagccctccacaaccactacacgcagaaaagcctatcgctctcccccggcaaa

SEQ ID NO: 54338 - RNA, 642 nt, synthetic construct
  misc_feature 1..642: note = derived and/or modified sequence opt11 from Teneliximab_LightChain1
  source 1..642: mol_type = other RNA
gacatcgtcctcacccaatcccccgccaccctatccgtcacccccggcgaccgcgtatccctctcctgccgcgccagccaatccatctccgactacctccactggtaccaacaaaaatcccatgaatctccccgactcctcatcaaatacgcctcccactccatctccggaatcccctcccgattctccggctccggctcaggctccgacttcaccctctccatcaactccgtcgaaccagaagacgtaggcatctactactgccaacacggccactccttcccctggacattcggcggcggcaccaaactcgaaatcaaacgcaccgtcgccgccccctccgttttcatcttcccaccctccgacgaacaactcaaatccggcacagcctccgtcgtctgcctcctcaacaacttctacccccgcgaagccaaagtccaatggaaagtcgacaatgccctccaatccggcaactcccaagaatccgtcaccgaacaagactcaaaagactcaacctactccctcagctcgaccctcaccctctccaaagcagactacgagaaacacaaagtctacgcctgcgaagtcacccaccaaggcctctcctcccccgtcaccaaatccttcaaccgaggcgaatgc

SEQ ID NO: 54339 - RNA, 1347 nt, synthetic construct
  misc_feature 1..1347: note = derived and/or modified sequence opt11 from Teplizumab_HeavyChain1
  source 1..1347: mol_type = other RNA
caagtacaactcgtccagagcggaggcggagtagtccagcccggccgaagcctgcgactctcctgcaaagcctcaggctacaccttcacccgctacaccatgcactgggtccgacaagcccccggaaaaggactagaatggataggctacatcaatccttcccgaggttataccaactacaaccaaaaagtcaaagaccgcttcactatctcccgagacaactccaaaaacacagcatttctccaaatggactccctccgccccgaagacacaggggtatatttctgcgcccgctactacgacgaccattactgcctcgactattggggccaaggcaccccagtcacagtctccagcgcatccaccaaaggaccctcagtcttccccctggctccctccagcaaatcaacctcaggaggcaccgcagccctcggatgcctcgtaaaagactacttccccgaacccgtcacagtctcctggaactccggcgccctcacctccggcgtccacaccttccccgccgtactacaatcaagcggcctgtactccctctccagcgtcgtcacagtgccctcctcctcactaggcacacaaacctacatatgcaacgtaaaccacaaaccatcgaacaccaaagtcgacaagaaagtcgaacccaaatcctgcgacaaaacacacacatgtcccccttgccccgccccggaagccgcaggaggcccctccgtattcctctttcccccaaaacccaaagacacgctcatgatatcccgcacccctgaagtaacctgcgtcgtcgtcgacgtctcccacgaagaccccgaagtcaaattcaactggtacgtcgacggcgtcgaagtgcacaacgccaaaaccaagccccgcgaagaacaatacaattccacctaccgcgtagtctccgttctcaccgtcctccaccaagactggctcaacggcaaagagtacaaatgcaaggtctcaaacaaagccctacctgcacccatcgagaaaaccatctcaaaagcaaaaggtcaaccccgcgaaccccaagtctacaccctcccaccctcgcgagacgaactaaccaaaaaccaagtctccctaacatgcctcgtcaaaggcttctacccctccgacatcgccgttgaatgggaatccaatggccaaccagaaaacaactacaaaacaaccccacccgtcctcgattcagacggctcattcttcctctactcaaaactcaccgtagacaaatcccgctggcaacaaggaaacgtcttctcctgctccgtcatgcacgaagcactacacaaccactacacacaaaaatcgctctctctctcacccggaaaa

SEQ ID NO: 54340 - RNA, 639 nt, synthetic construct
  misc_feature 1..639: note = derived and/or modified sequence opt11 from Teplizumab_LightChain1
  source 1..639: mol_type = other RNA
gacatccaaatgacccaatccccctcctccctctccgcctcagtcggcgaccgcgtcaccataacctgctccgcctcctcctccgtatcatacatgaactggtaccaacaaactcccggcaaagcccccaaacgctggatctacgatacctccaaactcgcctccggcgtcccctcccgcttctccggctccggctccggcaccgactacaccttcaccatctcctccctccaacccgaagacatcgccacctactactgccaacaatggtcctctaacccattcaccttcggccaaggaaccaaactccaaatcacacgcaccgtcgccgccccctccgtcttcatcttcccaccctccgacgaacaactcaaatccggcaccgcctccgtcgtttgcctactcaacaacttctacccccgcgaagccaaggtccaatggaaagtcgacaacgccctccaatccggcaactcccaagaatccgtcaccgaacaagactcaaaagactccacatacagcctatcctccaccctcaccctctccaaagccgactacgaaaaacacaaagtctacgcctgcgaagtaacccaccaaggcctctcctcccccgtcaccaaatccttcaaccgcggcgaatgc

SEQ ID NO: 54341 - RNA, 1344 nt, synthetic construct
  misc_feature 1..1344: note = derived and/or modified sequence opt11 from Teprotumumab_HeavyChain1
  source 1..1344: mol_type = other RNA
caagtcgaactcgttgaatccggcgggggcgtagtccaacccggacgttctcaacgactatcatgcgcagcctccggattcaccttctcctcatacggcatgcactgggtgcgacaagcccccggcaaaggccttgaatgggtagccatcatctggttcgacggctcctcaacctactacgccgactccgtacgaggccgattcacaatctcccgagacaacagcaaaaacactctatacctccaaatgaactccctacgagcagaagacaccgcggtctatttctgcgcacgtgaactcggccgccgctacttcgatctctggggtcgcggcaccttagtatctgtctcctccgcctccacgaaaggcccctccgtcttccccctcgcaccctcctccaaatcaaccagcggcggcactgccgccctcggatgcctagtcaaagactactttcccgaacccgtcactgtatcctggaactccggcgccctcacaagcggcgtccacacattccccgcagtactccaatcctcaggcctttactccctctcctccgtcgtcaccgtcccctcatccagcctcggaacccaaacatacatctgcaacgtcaaccacaaaccctcaaacacaaaagttgacaaaaaggtcgaacccaaatcatgcgacaaaacacacacttgcccaccctgtcccgcccccgaactcctcggcggccccagcgtcttcctattcccacccaagcccaaagacacactcatgatatccagaacacccgaagtaacctgcgtcgtcgtcgatgtcagccacgaggaccccgaagtcaaattcaactggtacgtcgacggcgtcgaagtccacaacgctaaaaccaaaccccgagaagaacagtacaactccacctaccgcgtcgtctccgtcctaacagtcctccaccaagactggttgaacggaaaagaatacaaatgcaaggtctcgaacaaagccctcccagcacccatcgagaaaacaataagcaaagcaaaaggccaaccacgagaacctcaagtatacaccctacccccttcacgagatgaactaaccaaaaaccaagtctccctaacctgcctcgtaaaaggcttctacccctcagatatcgccgtcgaatgggaatccaacggacaacccgaaaacaactacaaaaccaccccacccgtcctcgactcagacggctcattcttcctctactcaaaactaaccgtagacaaatcccgctggcaacaaggcaacgttttctcttgctccgtcatgcacgaagccctccacaaccactacacccaaaaatcactatccctctcacccggcaaa

SEQ ID NO: 54342 - RNA, 645 nt, synthetic construct
  misc_feature 1..645: note = derived and/or modified sequence opt11 from Teprotumumab_LightChain1
  source 1..645: mol_type = other RNA
gaaatcgtactcacccaatcccccgccaccctctccctctcacccggcgaacgcgccaccctctcctgccgagcctcccaatcagtctcatcctacctcgcctggtaccaacaaaaacccggccaagccccacgcctcctcatctacgacgcctccaaacgcgctaccggaatccccgcccgattctccggctccggctccggcaccgacttcaccctcacaatatcctccctcgaacccgaagacttcgccgtctactactgccaacaacgctccaaatggccaccctggaccttcggccaaggcaccaaagtcgaatccaaacgaaccgtcgccgccccctccgtcttcatcttcccaccctccgacgaacaactcaaatccggcaccgcctcagtcgtatgcctcctcaacaacttctacccccgcgaagccaaagtccaatggaaagtcgacaacgccctccaatcaggcaactcccaagaatccgtaaccgaacaagattccaaagactccacctactccctctcctccaccctcacactctccaaagccgactacgaaaaacacaaagtctacgcctgcgaagtcacccaccaaggactctcctcccccgtcaccaaatcattcaaccgcggcgaatgc

SEQ ID NO: 54343 - RNA, 1338 nt, synthetic construct
  misc_feature 1..1338: note = derived and/or modified sequence opt11 from Tesidolumab_HeavyChain1
  source 1..1338: mol_type = other RNA
gaagtccaactcgtccaatcaggcgccgaagtcaagaaacccggctcctccgtaaaagtctcatgcaaagcatccggcggcaccttctcatcctatgccatatcctgggtccgtcaagcccccggacaaggcctcgaatggatgggcggcataggccccttcttcggcacagcaaactacgctcagaaattccaaggccgtgtaacaatcacagcagacgaatcaacctccaccgcctacatggagctctcttcactccgcagcgaagacaccgccgtatattactgcgcccgcgacacaccctacttcgactactggggacagggcacactcgtcaccgtatcttcagcttcaaccaaaggacccagcgtcttccccctagccccctcctctaaatccacctcaggaggcacagccgctctcggctgcctcgttaaagactacttccccgagcccgtaaccgtatcatggaactcgggagcactcacaagcggagtacacacattccccgccgtactccaatcctccggactctactccctctcctccgtcgtcacagtaccatccagctcacttgggactcaaacctacatatgcaacgtaaaccacaaaccatcaaacaccaaagtagacaaacgagtcgaaccaaaatcctgcgacaaaacccacacctgtccaccctgccccgcccccgaagccgcaggcggcccctccgtcttcctattcccacccaaacccaaagacaccctaatgatctcccgaacacccgaggtaacctgcgtagtcgtagacgtctcccacgaagaccccgaagtaaaattcaactggtacgtcgacggagtcgaagtacacaacgccaaaaccaaaccacgagaagaacaatacaactcaacctaccgcgtcgtctccgtcctcaccgtcctccaccaagactggctaaacggaaaagaatacaaatgcaaagtctccaacaaagccctaccagccccaatcgagaaaacaatctccaaagccaaaggccaaccccgcgaaccccaagtctacaccctaccaccctcacgagaagagatgaccaaaaaccaagtatcacttacctgcctcgtaaaaggcttctacccctcagacattgccgtcgaatgggaatcaaacggccaacccgaaaacaactacaaaactactccacccgtccttgactccgacggcagcttctttctatacagcaaactcacagtcgacaaatcccgctggcaacaaggaaacgtcttctcatgctccgttatgcacgaagctctccacaaccactacacccaaaaatccctctccctctcccccggaaaa

SEQ ID NO: 54344 - RNA, 642 nt, synthetic construct
  misc_feature 1..642: note = derived and/or modified sequence opt11 from Tesidolumab_LightChain1
  source 1..642: mol_type = other RNA
tcttacgaactaacccaacccctctccgtctccgtcgccctcggtcaaacagcccgcatcacctgctcaggcgactccatccccaactactacgtctactggtaccaacaaaaacccggccaagcacccgtcctcgtcatctacgacgactccaaccgcccctcaggcatcccagaacgcttctcaggctccaactccggcaacacagccacactcaccatctcacgcgcccaagccggcgacgaagcagactactactgccaatcctttgactcctccctcaacgcagaagtcttcggcggcggaaccaaactcaccgtcctcggccaacccaaagccgccccctccgtcacactctttcccccctcctccgaagaactccaagccaacaaagccacactagtctgcctcatctccgacttctaccccggcgccgtcaccgtagcctggaaagccgactcctccccagtcaaagccggcgtcgaaaccaccacaccatccaaacaatcaaacaacaaatacgccgcctcctcctacctctccctcacccccgaacaatggaaatcccaccgatcctactcctgccaagtcacacacgaaggatccacagtcgaaaaaaccgtcgcccccaccgaatgctcc

SEQ ID NO: 54345 - RNA, 1344 nt, synthetic construct
  misc_feature 1..1344: note = derived and/or modified sequence opt11 from Tezepelumab_HeavyChain1
  source 1..1344: mol_type = other RNA
caaatgcaacttgtagaatctggcgggggcgtcgtccaacccggacgctccctcagactctcctgtgcagcctccggcttcactttccgcacctacggaatgcattgggtccgccaagcccccggaaaaggactagaatgggtcgccgtcatctggtacgacggctccaacaaacactacgccgactcagtaaaaggacgcttcaccatcacacgcgacaactccaaaaacaccctcaatctccaaatgaactccctccgcgccgaggacacagccgtctactactgcgcgcgagccccacaatgggagctcgtccacgaagccttcgacatctggggtcaaggcaccatggtcaccgtatccagcgcctccacaaaaggaccctccgtcttccccctcgctccctgctcaagatcaacctccgaatcaaccgctgccctaggctgcctcgtcaaagactacttcccagaaccagtcactgtcagctggaactccggcgcgctcacctccggcgtccacacttttcctgccgtcctacaatcctcaggtctctactcacttagctcagtcgtaaccgtccccagctccaacttcggcacccagacatacacatgcaacgttgaccacaaaccctcaaacaccaaagtagacaaaacagtcgaacgcaaatgctgcgtcgaatgcccaccctgccccgccccacccgtcgcaggcccctccgtcttcctcttcccacccaaacccaaagacacactcatgatctcccgcacccccgaggttacctgcgtcgtcgtagacgtcagccacgaagatcccgaagtccaattcaactggtacgtcgacggagtcgaagtgcacaacgccaaaaccaaacccagggaagaacaattcaactcaaccttccgtgtagtatccgtcctcaccgtcgtccaccaagactggctaaacggcaaagaatacaaatgcaaagtctcaaacaaaggacttcccgcacccatagaaaagaccataagcaaaaccaaaggccaaccccgcgaaccccaagtatacacactaccgccctcacgagaggaaatgaccaaaaaccaagtctccctaacctgcctcgtaaaaggcttctacccctccgacatcgccgtcgaatgggaatcaaacggccaacccgaaaataactacaaaacaacacccccaatgctggactctgacgggagcttcttcctctactcaaagctaaccgtcgataaatcccgctggcaacaaggaaacgtattctcctgctcagtcatgcacgaagccctacacaaccactacacccagaaatccctctcactctcgcccggaaaa

SEQ ID NO: 54346 - RNA, 642 nt, synthetic construct
  misc_feature 1..642: note = derived and/or modified sequence opt11 from Tezepelumab_LightChain1
  source 1..642: mol_type = other RNA
tcctacgtcctaacccaacccccctccgtctccgtcgcccccggacaaacagcccgaatcacatgcggcggcaacaacctcggctcaaaatccgtccactggtaccaacaaaaacccggccaagcccccgtcctcgtcgtctacgacgactccgaccgaccatcctggatccccgaacgcttctccggctcaaactccggcaacaccgccaccctcaccatctcacgcggcgaagccggcgacgaagccgactactactgccaagtctgggactcaagctccgaccacgtcgtcttcggcggcggcaccaaactcaccgtcctcggccaacccaaagcagccccctccgtcaccctcttccccccatcctccgaagaactccaagccaacaaagccaccctcgtttgcctcatctccgacttctaccccggcgccgtcacagtcgcctggaaagccgactcctcacccgtcaaagccggcgtcgaaaccaccaccccctccaaacaatcaaacaacaaatacgccgcctcatcatacctctccctcacccccgaacaatggaaatcccaccgttcctactcttgccaagtcacccacgaaggctccacagtagaaaaaacagtagcccccaccgaatgctca

SEQ ID NO: 54347 - RNA, 1338 nt, synthetic construct
  misc_feature 1..1338: note = derived and/or modified sequence opt11 from ThioMAb-chMA79b-HC(A118C)_HeavyChain
  source 1..1338: mol_type = other RNA
gaagtccaacttcaacaatccggagcagaactcatgaaacccggcgcctcagtcaaaatctcttgcaaagccacaggctacaccttttccagctactggatcgaatgggtgaaacaacggcccggccacggccttgaatggatcggagaaatcctccccggcggcggcgacaccaactacaacgaaatcttcaaaggaaaagccaccttcaccgcagacacatcctccaacaccgcctacatgcagctctccagcctcacctcagaagacagcgccgtctactactgcacccgccgcgtccctgtctacttcgactactggggccaaggcaccagcgtcaccgtcagctcctgctcgaccaaaggaccatccgtattccccctagccccctcgtcaaaatcaacctccggcggcaccgccgcactcggctgtctcgtcaaagactacttccccgaacccgtcactgtctcatggaactccggagcgctcacgtccggagtacacaccttccccgcagtcctacaaagttctggcctctactcactctcatcagtcgtaaccgtcccaagctcctcactcggaacacaaacatacatctgcaacgtcaaccacaaaccctcgaacaccaaagtcgacaagaaagtcgaacccaaatcctgcgacaagacccacacatgcccaccctgccccgcacccgaactcctcggcggcccctccgtattcctcttcccacccaaacccaaagacaccctcatgatcagccgcacacccgaagttacctgcgtcgtcgtcgacgtctcccacgaagatcccgaagtaaaattcaactggtacgtcgacggagtcgaagtacacaacgcaaaaacaaaaccccgcgaggaacaatacaactccacctaccgagtagtatccgtcctaaccgtcctacaccaagactggctcaacggcaaagaatacaagtgcaaagtctcaaataaagcactccccgccccaatagagaaaacaatctccaaagcaaaaggccaaccccgcgaaccccaggtatataccctcccaccctcccgcgaagaaatgaccaaaaaccaagttagcctaacctgcctagtcaaaggtttctacccatccgacatcgcagtagaatgggaatccaacggccaacccgaaaacaactacaaaacaaccccacccgtgctcgactcagacggctcattctttctctactcaaaactcaccgtcgacaaatcccgatggcaacaaggcaatgtcttctcctgctcagtaatgcacgaagccctccacaaccactacacccaaaaatcactatcactaagccccgga

SEQ ID NO: 54348 - RNA, 1347 nt, synthetic construct
  misc_feature 1..1347: note = derived and/or modified sequence opt11 from ThioMab-hu10A8.v1-HC(A118C)_HeavyChain
  source 1..1347: mol_type = other RNA
gaagtccagctagtagaatccggcggcggcctagtccaacccggcggctccctccgtctatcatgcgccgcctccggcttcaccttctcctcctacgccgtctcctgggtacgccaagccccaggaaaaggactcgaatgggtcgccaccatctcctccggcggctccctaaccttctacctcgactcagtacgcggccgcttcactatatcacgcgataactccaaaaacacactctacctccaaatgaactccctacgagccgaggacaccgccgtctattactgcgcccgtcctatccccgactattacgccctcgactactggggccaaggcaccctcgtaaccgtatcatcctgctccactaaaggcccctccgtcttcccactcgccccctcctccaagtccaccagcggcggcaccgccgccctcggctgcctcgtaaaagactatttccccgaacctgtcaccgtctcctggaactccggcgccctcacctccggcgtccacacgttccccgcagtcctccaaagcagcggcctatattctctctcctcagtcgtcacagtaccttcctccagcctcggtacccaaacctacatctgcaacgttaaccacaaaccctccaacaccaaagtcgacaagaaagtggaacccaaatcatgcgacaaaacccacacctgtccaccctgccctgccccagaactcctaggcggaccctcagtcttcctcttcccacccaaacccaaagacaccctcatgatctcccgaacccccgaagtcacgtgcgttgtagtcgacgtctctcacgaagaccccgaagttaaatttaactggtacgtcgacggcgtagaagtccacaacgccaaaaccaaaccacgcgaagaacaatacaacagcacctaccgcgtcgtcagcgttctaactgtactacaccaagactggctcaacggcaaagaatacaaatgcaaagtatcaaacaaagccctacctgccccaatcgagaaaaccatctccaaagccaaaggccaaccccgcgaaccacaagtatacactctaccaccctcacgcgaagaaatgaccaaaaaccaagtcagcctcacatgcctcgtcaaaggcttctacccctccgacatcgccgtagaatgggaatccaacggccaacccgaaaacaactacaaaacaacacccccagtccttgattccgacggatccttcttcctctactccaaactcaccgtcgacaaatcacgctggcaacaaggcaacgtcttctcctgctcagtcatgcacgaagccctccacaaccactacacccaaaaatcactcagcctatcccccggcaaa

SEQ ID NO: 54349 - RNA, 1347 nt, synthetic construct
  misc_feature 1..1347: note = derived and/or modified sequence opt11 from ThioMab-hu10A8.v1-HC(V205C)_HeavyChain
  source 1..1347: mol_type = other RNA
gaagtacaactcgtggaatcaggcggaggcctagtccaacctggaggctccctacgcctctcgtgcgccgccagcggcttcacattctcctcctacgcagtatcatgggtccgccaagcacccggaaaaggactcgaatgggtcgcaactatatcctcaggaggatccctcacgttctacctcgactccgtccgaggccgtttcaccatctcccgcgacaactccaaaaacacactctaccttcaaatgaactcccttagagcagaagacaccgctgtctactactgcgccagaccaataccagactactacgctctagattactggggacaaggcactctcgtcaccgtctcctcagcatccacaaagggcccatcagtcttccctctcgccccttccagcaaatcaacctcaggcggcacagccgccctcggctgcctcgttaaagactacttcccagaacccgtcacagtctcctggaacagcggcgcactcaccagcggcgtccataccttccccgcagtcctccaatcttcaggactctacagcctctcctccgtcgtcacagtcccctcatcctcactcggcacccaaacatacatatgcaacgtaaaccacaaaccctccaacacaaaggtcgacaagaaagttgaaccaaaatcatgcgacaagacccatacctgcccaccctgccccgcccccgaactactcggcgggccctccgtcttcctcttcccaccaaaacccaaagataccctcatgataagccgaacccccgaagtcacatgcgtcgtcgtagacgtatcccacgaagaccccgaagtaaaattcaactggtacgtcgacggcgtcgaagtacacaacgccaaaaccaaaccccgagaagaacaatacaactccacctaccgcgtcgtctccgtccttacagtactccaccaagattggctaaacggcaaagaatacaaatgcaaagtcagcaacaaagccctcccagcccccatagaaaagaccatctccaaagccaaaggccaaccccgagaaccacaagtctacacactacccccgtcccgcgaagaaatgactaaaaaccaagtttccctcacctgtctagtaaaaggtttttacccatccgacatagccgtcgaatgggaatccaacggacaacccgaaaacaactacaaaaccacccctcccgtcctagacagcgacggcagcttcttcctctactccaaactcacagtcgacaaatcccgatggcaacaagggaacgtcttttcctgctcagtaatgcacgaagcacttcacaaccactacacccaaaaatccctatccctatcccccggcaaa

SEQ ID NO: 54350 - RNA, 642 nt, synthetic construct
  misc_feature 1..642: note = derived and/or modified sequence opt11 from ThioMab-hu10A8.v1-LC(A118C)_LightChain
  source 1..642: mol_type = other RNA
gacatccaaatgacccaatcaccctcctctctctccgcctccgtcggcgaccgcgtaaccatcacatgcaaagcatcccaagacgtatccaccgccgtcgcctggtaccaacaaaaacccggcaaagcccccaaactcctcatctactccgccagctaccgatacaccggcgtcccctcccgcttctcaggctccggctccggcaccgacttcaccctaaccatctcctccctccaacccgaagatttcgccacctactactgccaacaacacttctcatccccacgcaccttcggacaaggcaccaaagtcgaaatcaaacgcaccgtagccgccccctccgtcttcatcttcccaccctccgacgaacaactcaaatccggcaccgcctccgtagtctgcctactcaacaacttctacccccgcgaagcaaaagtacaatggaaagtcgacaacgccctccaaagcggcaactcccaagaatctgtcaccgaacaagactccaaagactccacctactccctctcctcaaccctaaccctctcaaaagccgactacgaaaaacacaaagtatacgcctgcgaagtcacccaccaaggcctctcctccccagtcaccaaatccttcaaccgcggcgaatgc

SEQ ID NO: 54351 - RNA, 642 nt, synthetic construct
  misc_feature 1..642: note = derived and/or modified sequence opt11 from ThioMab-hu10A8.v1-LC(V205C)_LightChain
  source 1..642: mol_type = other RNA
gacatccaaatgacccaatccccctcctccctctccgcatccgtcggcgaccgcgtcaccatcacctgcaaagcctcccaagacgtctccacagccgtcgcctggtaccaacaaaaacccggcaaagcccccaaactcctcatctactccgcctcctaccgatacaccggcgtaccctcccgcttctccggctccggctccggcaccgacttcaccctcacaatctcctccctccaacccgaagacttcgccacctactactgccaacaacacttctcctccccccgcacattcggccaaggcaccaaagtagaaatcaaacgcacagtcgccgcaccctccgtcttcatcttccccccctccgacgaacaactcaaatccggaaccgcctccgtcgtctgcctcctaaacaacttctacccccgcgaagccaaagtccaatggaaagtcgacaacgccctccaatccggcaactcccaagaatccgtcaccgaacaagactccaaagactccacctactccctatcctccactctcactctctccaaagccgactacgaaaaacacaaagtctacgcatgcgaagtcacccaccaaggcctatcctccccctgtaccaaatccttcaaccgaggcgaatgc

SEQ ID NO: 54352 - RNA, 1338 nt, synthetic construct
  misc_feature 1..1338: note = derived and/or modified sequence opt11 from ThioMAb-huMA79b.v17-HC(A118C)_HeavyChain
  source 1..1338: mol_type = other RNA
gaagtccaactcgtagaatccggaggcggcctcgtccaaccaggcggctccctccgcctctcctgcgccgcatccggctacaccttctccagctactggatcgaatgggtacgccaagcccctggaaaaggcctcgaatggatcggcgaaatcctacccggaggaggtgacaccaactataacgaaatcttcaaaggccgagcaactttctcagcagacacctccaaaaacaccgcctacctccaaatgaactctctccgcgcggaagacaccgccgtctactactgcacccgccgcgtacccgtctacttcgactactggggccaaggcaccctcgtcactgtctcctcctgctccaccaaaggcccctcagtgttccccctagctccatcatccaaatccacctccggaggcaccgctgccctaggctgcctagttaaagactacttccccgaaccagtcacagtctcctggaactcaggcgccctaacctccggcgttcacaccttcccggccgtcctacaatcaagcggactatactccctaagctccgtagtcaccgtaccctccagctcccttggaacccaaacctacatctgcaacgttaatcacaaaccctccaacactaaagtcgacaaaaaagtcgaacccaaaagctgcgacaaaacccacacctgccccccctgccccgcccccgaactactcggcggaccttctgtcttcctgttcccgcccaaacccaaagacaccctcatgatctcccgcacccccgaggtaacctgcgtcgtggtcgacgtctcacacgaagaccccgaagtcaaattcaactggtacgtcgacggcgttgaggtccacaacgccaaaaccaaacccagagaagaacaatataactcaacctaccgcgtcgtctcagtcctcaccgttctccaccaggactggctcaacggcaaagaatataaatgcaaagtctcaaacaaagctctccccgccccaatagaaaaaacgatatccaaagcaaaaggccaaccccgcgaaccccaagtctacaccctcccaccctcccgagaagaaatgacaaaaaaccaagtatcactcacttgcctagtcaaaggcttctacccatcggacatcgctgtcgaatgggaatcaaacggacaacccgaaaacaactacaaaactacaccccccgtcctagactccgacggatcctttttcctatactctaaactaaccgtagacaaatctcgctggcaacaaggcaacgtcttctcctgctccgtaatgcacgaagccctccataaccactacacccaaaaatccctaagcctctcccccggc

SEQ ID NO: 54353 - RNA, 654 nt, synthetic construct
  misc_feature 1..654: note = derived and/or modified sequence opt11 from ThioMAb-huMA79b.v17-HC(A118C)_LightChain
  source 1..654: mol_type = other RNA
gacatccaactcacccaaagcccctcctccctaagcgccagcgtcggcgaccgcgtaaccataacctgcaaagcatcccaaagcgtagactacgacggcgactccttcctcaactggtaccaacaaaaacccggaaaagcacccaaactactaatctacgccgcctccaaccttgaaagcggcgtccccagcagattctccggctcaggctcaggcacagacttcaccctaaccatcagctcactacaacccgaagacttcgccacatactactgccaacaatccaacgaagaccccctcaccttcggacaaggcaccaaagtcgaaatcaaacgcacagtcgccgcaccctccgtcttcatcttcccaccctcagacgaacaactaaaatccggcaccgcctcagtcgtctgcctcctcaacaacttctacccccgcgaagccaaagtccaatggaaagtcgacaacgccctccaatccggcaactcacaagaaagcgtaaccgaacaagacagcaaagactcaacctactccctaagctcaacactaaccctgtccaaagccgactacgaaaaacacaaagtgtacgcctgcgaagtcacacaccaaggcctcagctcacccgtcaccaaatcattcaaccgcggcgaatgc

SEQ ID NO: 54354 - RNA, 1338 nt, synthetic construct
  misc_feature 1..1338: note = derived and/or modified sequence opt11 from ThioMAb-huMA79b.v18-HC(A118C)_HeavyChain
  source 1..1338: mol_type = other RNA
gaagtccagctagtagaatccggcggaggcctagtccaacccggcggctcactcagactttcctgcgcagcatccggctacacattctcaagctactggatagaatgggtccgccaagcaccaggcaaaggacttgaatggataggcgaaatcctccccggaggcggcgacactaactacaacgaaatattcaaaggccgcgccacattctccgccgacacaagcaaaaacacggcctacctccaaatgaactccctccgcgccgaagacacagctgtctactactgcacccgtcgtgtccccatccgtctagattactggggacaaggcacattagtcaccgtgtccagctgctcaaccaaaggtccatccgtctttcctctcgcaccctcctcaaagtccaccagcggaggaacagcagccctcggatgcctcgtaaaagactacttccccgagcccgtcacagtctcatggaactccggcgcactaacatctggagtacacaccttccccgcagtcctccaatcctccggcctctactccctctcatccgtagttacagttccatcatccagcctcggcacccaaacctacatctgcaacgtcaaccacaaaccctctaacaccaaagtagacaagaaagtagaacccaaaagttgcgacaaaacccacacatgcccaccctgccccgcacccgaactcctaggaggcccctccgtattcctcttcccacccaaacccaaagacacactcatgatctcccgaacccccgaggtcacttgcgtcgtcgtcgacgtttcccacgaagaccccgaagtcaaattcaactggtacgtcgacggcgtcgaagtccacaacgctaaaaccaaaccccgagaggaacaatacaactccacataccgcgtcgtatcagtcctcaccgtacttcaccaagactggctcaacggcaaagaatacaagtgcaaagtgtcaaacaaagccctacccgcccccattgaaaagaccatcagtaaagccaaaggccagccacgagaaccacaagtctacaccctgccaccctcccgcgaggaaatgaccaaaaaccaagtatccctaacctgcctcgtcaaaggtttctacccctccgacatagccgttgaatgggaatccaacggccaacccgaaaacaactacaaaacaaccccaccagtcctcgactcagacggctccttcttcctatactccaaactcacagtcgacaaaagccgatggcaacaaggcaacgtctttagctgctccgtgatgcacgaagcactacacaaccactacactcaaaaatccctctcactctcacccggc

SEQ ID NO: 54355 - RNA, 654 nt, synthetic construct
  misc_feature 1..654: note = derived and/or modified sequence opt11 from ThioMAb-huMA79b.v28-HC(A118C)_LightChain
  source 1..654: mol_type = other RNA
gacatccaactcacacaatcaccctcctctctatccgcctccgtcggcgaccgcgttacaatcacatgcaaagcctcccaatccgtagactacgaaggcgactccttcctcaactggtaccaacaaaaaccaggcaaagcccccaaactcctaatctacgccgcctccaacctcgagtccggcgtcccctcccgcttctcaggctctggttccggcaccgacttcaccctcaccatctcctcactccaacccgaagacttcgccacctactactgccaacaatcaaacgaagaccccctcacattcggccaaggcaccaaagtcgaaatcaaacgcaccgtcgcagccccctccgtcttcatcttcccaccctccgacgaacaactcaaatccggaacagcctcagtagtctgcctcctcaacaacttctacccccgagaagccaaagtccaatggaaagtcgacaacgccctccaatccggcaactcacaagaatctgtcaccgaacaagactccaaagactccacctactccctctcctccaccctcaccctatccaaagccgactacgaaaaacacaaagtctacgcatgcgaagtcacacaccaaggcctctcatcccccgtcaccaaatccttcaaccgcggcgaatgc

SEQ ID NO: 54356 - RNA, 654 nt, synthetic construct
  misc_feature 1..654: note = derived and/or modified sequence opt11 from ThioMAb-huMA79b.v28-LC(V205C)_LightChain
  source 1..654: mol_type = other RNA
gacatcgttctcacccaatcccccgcatccctagccgtctccctcggccaacgcgccaccatctcctgcaaagcctcccaatccgtcgactacgacggcgactcattcctcaactggtaccaacaaaaacccggccaaccccccaaactcttcatctacgccgcctccaacctcgaatccggcatccccgcccgcttctcaggctcgggctcaggcaccgacttcaccctaaacatccaccccgtcgaagaagaagacgccgccacctactactgccaacaatcaaacgaagacccactcacattcggcgccggaaccgaactcgaactaaaacgcaccgtcgccgccccctccgtcttcatattccccccctcagatgaacaactcaaatccggcacagcctccgtcgtatgcctcctcaacaacttctacccccgcgaagccaaagtccaatggaaagtcgacaacgccctccaatccggcaactcacaagaatcagtaaccgaacaagactccaaagactccacatactccctctcatcaaccctcaccctcagcaaagccgactacgaaaaacacaaagtctacgcatgcgaagtcacccaccaaggcctctcatctccctgcaccaagtccttcaaccgcggcgaatgc

SEQ ID NO: 54357 - RNA, 1332 nt, synthetic construct
  misc_feature 1..1332: note = derived and/or modified sequence opt11 from Ticiliuab_HeavyChain1
  source 1..1332: mol_type = other RNA
caagtacagctagtcgaatccggcggcggcgtcgtacaacccggccgatcactccgactctcatgcgccgcatccggattcacattctcctcctacggccactgggtccgccaagcccccggcaaaggcctcgaatgggtcgcagtaatctggtacgacggctctaacaaatactacgccgactccgtgaaagggcgatttaccatctccagagacaactccaaaaacaccctctacctccaaaactcactccgcgccgaagacacagccgtctactactgcgcacgcgacccccgaggcgcaaccctctactactactactacggcgacgtatggggccaaggcaccactgtaacagtctcatccgcctccactaaaggcccctcagtcttccccctcgcaccctgctcccgatcaacatccgaatcaaccgcggccctcggatgcctagtcaaagactacttccccgaacccgtaaccgtcagctggaactcaggcgccctcacatccggcgtccacaccttccccgccgtcctacaatcctccggcctctactcattatcatctgtagtaactgtcccctcctccaacttcggaacccaaacctatacctgcaacgtcgaccacaagccctccaacaccaaagtagataaaaccgtcgaacgcaaatgctgtgtagaatgccctccctgccccgcaccacccgtcgccggaccctcagtattccttttccctcccaaacccaaagacaccctcatctcccgcacccccgaagtaacctgcgttgtagtcgacgtctcacacgaagaccccgaagtacaattcaactggtacgtcgacggcgtcgaagtccacaacgccaaaacaaaacctcgcgaggaacaattcaactctacattccgtgtagtctcagttctaaccgtcgtacaccaagactggctcaacggcaaagaatacaaatgcaaagtatcaaacaaaggcctaccagccccaatcgagaagaccatctccaagactaaaggccaaccacgcgagccacaagtctacaccctaccaccctctcgcgaagaaacgaaaaaccaagtctctctgacatgcctcgtaaaaggcttctacccctccgacatcgccgtagaatgggaatccaatggacagcccgagaacaactacaaaaccacaccacccctcgactccgacggctccttcttcctctactccaaactcacagtcgacaaatcccgctggcaacaaggaaacgtattttcatgctccgtccacgaggccctccataatcactacacccaaaaatccctatccctatctcccggcaaa

SEQ ID NO: 54358 - RNA, 639 nt, synthetic construct
  misc_feature 1..639: note = derived and/or modified sequence opt11 from Ticiliuab_LightChain1
  source 1..639: mol_type = other RNA
gacatccaaacccaatcaccctcttccctctccgcctccgtcggagaccgcgtcaccatcacttgccgtgcctcccaatccatcaactcctacctcgactggtaccaacaaaaacccggaaaagcccccaaactcctcatctacgccgcctcttcactccaatccggcgtcccatcacgcttctccggctccggctccggcaccgacttcaccctcaccatctcctccctccaacccgaagacttcgccacctactactgccaacaatactactccacccccttcaccttcggccccggcaccaaagtcgaaatcaaacgcaccgtcgccgcaccctccgtcttcatcttcccaccctcagacgaacaactcaaatctggcaccgcctccgtcgtctgcctcctcaacaacttctacccccgcgaagcaaaagtccaatggaaagtcgacaacgccctacagtccggcaactcccaagaatccgtcaccgaacaagactccaaagactcaacctactccctctcctcaaccctcaccctatccaaagccgactacgaaaaacacaaagtctacgcctgcgaagtcacccaccaaggcctctcctcccccgtcaccaaatccttcaaccgtggcgaatgc

SEQ ID NO: 54359 - RNA, 1347 nt, synthetic construct
  misc_feature 1..1347: note = derived and/or modified sequence opt11 from Tigatuzumab_HeavyChain1
  source 1..1347: mol_type = other RNA
gaagtacaactcgtcgaatccggaggcggccttgtacaaccaggcggctccctccggctctcatgcgccgcatccggctttacattctcaagctacgtcatgtcctgggtccgccaagcccccggcaagggccttgaatgggtagccacaatctcctcaggaggatcctacacctactaccccgactccgtcaagggtcgattcaccatatcacgcgacaacgccaaaaataccctctacctccaaatgaactccctacgagcagaagacacagccgtctactattgcgccagacgaggcgactccatgatcaccacagactactggggccaaggcacccttgtaaccgtctcctcagcatccactaaaggcccttcggtcttccccctcgcaccatcatccaaatccacctccggcggaactgctgcactcggatgccttgtcaaagactacttccccgaaccagtcaccgtctcatggaactcaggtgccctcacatccggcgtccacaccttccccgcagtcctccaatcctccggcctctactcactatcatctgtagtcactgtaccaagctcctcactcggcacccagacatacatatgcaacgtcaaccacaaaccctccaacaccaaagtagacaaacgagtcgaaccaaaatcctgcgacaaaacccacacatgcccaccctgcccggccccggaactcctcggcggaccctccgtcttcctattcccacccaaacccaaggatacactcatgatctcccgcacacccgaagtaacctgcgtcgtcgtcgacgtctcccacgaagaccccgaagtcaaattcaactggtacgtcgacggcgtcgaagtccacaacgcgaaaactaaaccccgcgaagaacagtacaactcaacataccgcgtcgtatccgtactcaccgtcctccaccaagactggctcaacggcaaagaatacaaatgcaaagtctcaaacaaagccctccccgcccccatagaaaagaccatctcaaaagccaaaggccaaccccgagaaccccaagtctacaccctccctccatcccgcgaagaaatgaccaaaaaccaagtatccctcacatgccttgtcaaaggcttctaccccagcgacatcgcagtcgaatgggaatccaacggccaacccgaaaacaactataaaaccacacccccagtcctcgattcagacggctcctttttcctctacagcaaacttaccgtcgacaaatctcgatggcaacagggcaacgtcttctcatgcagcgtaatgcacgaagcactccacaaccactatacccagaaatccctttcactgtctccaggaaaa

SEQ ID NO: 54360 - RNA, 1347 nt, synthetic construct
  misc_feature 1..1347: note = derived and/or modified sequence opt11 from Tigatuzumab_HeavyChain
  source 1..1347: mol_type = other RNA
gaagttcaactcgtcgaatctggcggcggcctcgtccaacccggcggatcactccgcctatcctgcgctgcctcaggcttcaccttttcctcctacgtaatgtcctgggtccgacaagcacccggcaaaggccttgaatgggtagccactatatcctcaggcggctcctacacctactaccccgacagcgtaaaaggccgtttcacaatatcacgagacaacgccaaaaacaccttatacctacaaatgaactccctccgcgccgaagacaccgccgtctactactgcgcccgccgcggcgactccatgatcaccaccgactactggggacaaggaaccctcgtcaccgtctcgtctgcctccaccaaaggaccatccgttttcccactcgccccctcatccaaatctaccagcggtggaacagccgccctcggctgtctcgtaaaagactacttccccgaaccggtaaccgtgtcttggaactcaggcgccctcacctcaggcgtccacacattcccagcagtactccaatcctccggactctactccctctcaagcgtcgtaaccgtaccctcctcctcactaggtacacaaacctacatctgcaacgtcaaccacaaaccctccaataccaaagtcgacaaacgcgtggaacccaaatcctgtgacaaaactcacacatgcccaccctgccccgcccccgaactactaggcggaccctcagtctttctcttcccacccaaacccaaagacaccctcatgatatcccgcacccccgaagttacctgcgtcgtcgtcgacgtatcacacgaagaccccgaagtcaaattcaactggtacgtcgatggagtcgaagtccacaacgccaaaaccaaaccccgcgaagaacaatacaactccacataccgcgtcgtctccgtcctaacagtcctccaccaagactggctcaacggcaaagaatacaaatgcaaagtctccaacaaagccctccccgcacccatagagaaaaccatctcaaaagcaaaaggccaacctcgagaaccccaagtatacacactacccccatcacgcgaagaaatgaccaaaaaccaagtctccctaacctgcctcgtcaaaggcttctacccatcagatatcgccgtcgaatgggaatcaaacggacaacccgaaaataactacaaaaccacaccacccgtcctcgactccgacggctccttcttcctctactcaaaactcaccgtagacaaatcccgctggcaacaaggtaacgtcttctcctgcagcgtcatgcacgaagcgctccacaaccactacacacaaaaatcactctccctctcccccggcaaa

SEQ ID NO: 54361 - RNA, 639 nt, synthetic construct
  misc_feature 1..639: note = derived and/or modified sequence opt11 from Tigatuzumab_LightChain1
  source 1..639: mol_type = other RNA
gacatccaaatgacccaatccccctcttccctatccgcctcagtcggcgaccgcgtcacaataacctgcaaagcctcccaagacgtcggcaccgccgtcgcctggtaccaacaaaaacccggaaaagcccccaaactcctcatctactgggcatccacccgacacaccggcgtcccctcacgcttctccggctccggctccggcaccgacttcaccctaaccatctcctccctccaacccgaagacttcgccacctactactgccaacaatactcctcttaccgaaccttcggccaaggcaccaaagtcgaaatcaaacgcacagtcgccgccccctcagtcttcatcttcccaccctccgacgaacaactcaaatccggcaccgcttcagtcgtctgcctcctcaacaacttctacccccgcgaagccaaagtccaatggaaagtcgacaacgccctccaatccggaaactcccaagaatccgtcaccgaacaagactccaaagactccacctactccctctcctcaaccctcaccctgtccaaagccgactacgaaaaacacaaagtctacgcctgcgaagtcacccaccaaggcctatcatcccccgtcacaaaatcattcaaccgaggcgaatgc

SEQ ID NO: 54362 - RNA, 639 nt, synthetic construct
  misc_feature 1..639: note = derived and/or modified sequence opt11 from Tigatuzumab_LightChain
  source 1..639: mol_type = other RNA
gacatccaaatgacccaatccccctcctccctctccgcctcagtaggcgaccgcgtcaccatcacatgcaaagcctcccaagacgtcggcacagccgtcgcctggtaccaacaaaaacccggcaaagcccccaaactactaatctactgggcctccaccagacacaccggcgtcccctcccgattctccggctcaggctccggaacagacttcaccctcaccatctcctccctacaacccgaagacttcgccacatactactgccaacaatactcctcctaccgcacattcggccaaggcaccaaagtcgaaatcaaacgaaccgtcgccgccccctccgtcttcatcttcccaccctccgacgaacaactcaaatccggcaccgcctcagtcgtatgcctactaaacaacttctacccccgcgaagccaaagtccaatggaaagtcgacaacgccctccaatccggaaactcccaagaatccgtcaccgaacaagactccaaagactccacctactccctctcatccaccctaaccctctccaaagccgactacgaaaaacacaaagtctacgcctgcgaagtaacccaccaaggcctttcctcccccgtcaccaaatccttcaaccgaggcgaatgc

SEQ ID NO: 54363 - RNA, 1338 nt, synthetic construct
  misc_feature 1..1338: note = derived and/or modified sequence opt11 from Tildrakizumab_HeavyChain1
  source 1..1338: mol_type = other RNA
caagtccaactcgtccaatccggagcagaagtcaagaaacccggcgcaagcgtcaaagtctcctgcaaagccagcggatacatcttcatcacctactggatgacatgggtacgacaagcccccggacaaggcctcgaatggatgggccaaatcttccccgcctctggaagcgccgactacaacgaaaaattcgagggccgcgtcacaatgacaacagacacctccacaagcaccgcctatatggaactccgatcactacgctccgacgacaccgccgtctactattgcgcaaggggcggaggcggcttcgcgtactggggacaaggaacgctcgtcaccgtctcatctgcctccacaaaaggaccatcagtattcccactcgcaccctccagcaaatcaacctccggcggcaccgccgccctcggctgcctagtcaaagactacttccccgaacccgtcaccgtctcctggaactcaggcgcactcacttcaggagtgcacacgttcccagccgtactccaaagcagcggactctactcactctcctctgtcgttaccgtcccatccagcagcctcggaacgcaaacatacatctgcaacgtcaaccacaaaccctccaacacaaaagtggacaagaaagtagagccaaaatcctgcgacaaaacacacacgtgcccaccctgccccgcacccgaacttctaggtggcccctccgtcttcctcttcccacccaaacccaaagacaccctcatgatctccagaacacccgaagtaacctgcgtcgtcgtcgacgtctcccacgaagacccagaagtcaaattcaactggtacgtcgacggcgtcgaagttcacaacgcaaaaacaaaaccccgcgaagaacaatacaactccacctaccgcgtcgtaagcgtcctcaccgtcctacaccaagactggctaaacggcaaagaatacaaatgcaaagttagcaacaaggcactccccgcccccattgagaaaaccatttcaaaagcaaaaggccaaccacgcgaaccacaagtctacaccctccctcccagccgggacgaactcaccaaaaaccaagtctcactaacttgcctcgttaaaggtttctacccctcagacatcgccgtcgaatgggaatcgaacggccaacccgaaaacaactacaaaaccaccccacccgtactcgactcagacggatccttcttcctatactccaaactcacagtagacaaatcccgttggcaacaaggcaacgtcttcagctgctccgtcatgcacgaagccttacacaaccactacacacagaaaagcctcagcctgtcccccggcaaa

SEQ ID NO: 54364 - RNA, 642 nt, synthetic construct
  misc_feature 1..642: note = derived and/or modified sequence opt11 from Tildrakizumab_LightChain1
  source 1..642: mol_type = other RNA
gacatccaaatgacccaatcaccctcctccctatccgcctcagtcggcgaccgcgtaaccataacctgccgcacctccgaaaacatctactcctacctcgcctggtaccaacaaaaaccaggcaaagcccccaaacttttaatctacaacgccaaaacactcgcagaaggcgtcccctccagattctccggctcaggctccggcacagacttcacactcaccatcagctccctccaacccgaagacttcgccacctactactgccaacaccactacggcatccccttcacattcggccaaggcaccaaagtcgaaatcaaacgcaccgtcgccgccccctccgtcttcatattccctccatccgacgaacaactcaaatccggaaccgcctccgtcgtctgcctcctaaacaacttctacccccgcgaagccaaagtccaatggaaagtcgacaacgccctccaatccggcaactcccaagaatccgtcaccgaacaagactccaaagactccacctactccctatcctcaaccctaaccctctccaaagccgactacgagaaacacaaagtctacgcctgcgaagtcacccaccaaggcctctcctcacccgtcaccaaatccttcaaccgcggcgaatgc

SEQ ID NO: 54365 - RNA, 1344 nt, synthetic construct
  misc_feature 1..1344: note = derived and/or modified sequence opt11 from Tisotumab_vedotin_HeavyChain1
  source 1..1344: mol_type = other RNA
gaagtacaactcctcgaatcaggcgggggcctcgtacaacccggcggctccctccgcctctcctgtgccgccagcggcttcaccttctcaaactatgccatgtcttgggtacgacaagcccccggcaaaggcctcgaatgggtatcctcaatctcaggaagcggcgactacacctactacacagactccgtaaaaggccgcttcactatctcccgagacaactccaaaaacacgctctacctacaaatgaacagcttacgagccgaagacacagccgtatactactgcgccagatccccctgggggtactacttagactcctggggccaaggcacccttgtaacggtctcctccgcctccaccaaaggcccatcagtattccccctcgccccctcctcaaaatccaccagcggcggcaccgctgccctcggatgcctcgtcaaagactactttcccgaaccagtaacagtcagctggaactcaggagccctaacctccggcgtacacacattccccgccgtcctccaatcctccggcctctacagcctctcctccgtcgttaccgtaccctcctcatccctcggcacccaaacctacatctgcaacgtcaaccacaaaccctccaacactaaagtcgacaaacgcgtagaaccaaaatcctgtgacaaaacacacacctgtcccccatgcccagcccccgaacttctcggtggacccagcgtcttcctcttcccacccaaacccaaggacaccctcatgatctcccgaacccccgaagtaacctgcgtcgtcgtcgacgtctcccacgaagaccccgaagtcaaattcaactggtacgtcgacggagtcgaagtacacaacgcaaaaacaaagccccgtgaggaacaatacaactccacctaccgagtagtatctgtacttacagtcctgcaccaggactggctcaacggtaaagagtacaaatgcaaagtatccaacaaagccctccccgcccccatcgagaaaaccatatccaaagccaaaggccaaccccgagaaccccaagtctacaccctaccaccctcgcgcgaagaaatgaccaaaaaccaagtctcactcacatgcctagttaaaggcttctacccctccgacatcgccgtcgaatgggaatcaaacggacagcccgaaaacaactacaagaccacaccgcccgtccttgactccgacggatccttcttcctctacagcaaactcaccgtggacaaatcccgatggcaacaaggcaacgtattctcatgctccgtcatgcacgaagcactacacaaccactacacccaaaaatcactttcactttcccccggcaaa

SEQ ID NO: 54366 - RNA, 642 nt, synthetic construct
  misc_feature 1..642: note = derived and/or modified sequence opt11 from Tisotumab_vedotin_LightChain1
  source 1..642: mol_type = other RNA
gacatccaaatgacccaatcacccccctccctatctgcatccgccggcgaccgagtcaccatcacctgccgcgcctcccagggaatctcctcccgcctcgcctggtaccaacaaaaacccgaaaaagcccccaaatccctaatctacgcagcatcctccctccaatccggcgtcccaagccgcttctctggctccggctccggcacagacttcaccctcaccatctcctccctacaacccgaagacttcgccacttactattgccaacaatacaactcttacccctacaccttcggccaaggaaccaaactcgaaatcaaacgcaccgtcgcagccccctcagtcttcatcttccccccctccgacgaacaactcaaatcaggcaccgcctccgtcgtctgcctactcaacaacttctacccccgcgaagccaaagtccaatggaaagtcgacaacgccctccaatccggcaactcccaagaatcagtcaccgaacaagactccaaagactctacctactctctctcctccacacttacactatccaaagccgattacgaaaaacacaaagtctacgcctgcgaagtcacccaccaaggcctatcctcccccgtcactaaatccttcaaccgcggcgaatgc

SEQ ID NO: 54367 - RNA, 1341 nt, synthetic construct
  misc_feature 1..1341: note = derived and/or modified sequence opt11 from Tocilizumab_HeavyChain1
  source 1..1341: mol_type = other RNA
gtccaactacaagaatccggccccggcctcgtccgccccagccaaacccttagcctcacatgcaccgtctcaggatactctatcacctccgaccacgcctggtcttgggtacgacaacccccaggccgcggccttgaatggatcgggtacatctcctactccggcatcaccacctacaacccatccctaaaaagccgcgtcaccatgctacgcgacacaagcaaaaaccaattctccctacgtctttcttccgtcacagccgctgacacagccgtctattactgcgcgcgtagcctcgcccgcaccaccgccatggactactggggacaaggatcactcgtaacagtctcatccgccagcaccaaaggcccatcagtcttccccctcgctccctcctccaaatccacatcaggcggaaccgcagccctcggctgccttgttaaagactacttcccagaacccgtcaccgtttcctggaactccggagccctcaccagcggtgtccacaccttccccgccgtcctacaatcctcaggactctactccctatcctcggtcgttaccgtcccatccagctccctaggaacacaaacctacatctgcaacgtaaaccacaaaccctccaacactaaagtagacaagaaagtcgaacccaaatcttgcgacaaaacccacacttgccctccctgccccgcccccgaactcctcggcggcccctctgtcttcctctttccacccaaacccaaagacaccctcatgatctcccgcactcccgaagtaacctgcgtcgtcgtcgacgtatctcacgaagaccccgaagtaaaattcaactggtacgttgacggagtcgaagtacacaacgccaaaaccaaaccccgcgaagaacaatacaactccacctaccgcgtcgtctcagtcctaaccgtcctccaccaagactggctcaacggcaaagaatacaaatgcaaagtatctaacaaagcactacccgcccccatagaaaagaccatatcaaaagccaaaggccaaccccgcgaaccccaagtatacaccctcccaccctcccgcgacgaactcaccaaaaaccaagtatctctcacttgccttgtcaaaggcttctaccccagcgatatcgcagttgaatgggaatcaaacggccaacccgaaaacaattacaaaacaacaccccctgttcttgactctgacggatccttcttcctctactccaaactcaccgtcgataaatcccgctggcaacaaggcaacgtcttctcctgctccgtcatgcatgaagccctacacaaccactacacccaaaagtccctctcgctctcccccggc

SEQ ID NO: 54368 - RNA, 642 nt, synthetic construct
  misc_feature 1..642: note = derived and/or modified sequence opt11 from Tocilizumab_LightChain1
  source 1..642: mol_type = other RNA
gacatacaaatgacccaatccccctcctcactctccgcctccgtcggcgaccgcgtcaccataacctgccgcgcctcccaagacatctcctcctacctcaactggtaccaacaaaaacccggcaaagcccccaaactactaatctactacacctcccgcctccactccggcgtcccctcccgcttctcaggctccggctcaggcaccgacttcaccttcaccatctcctcccttcagcccgaagacatcgccacctactactgccaacaaggaaacaccctcccctacacattcggccaaggcaccaaagtcgaaatcaaacgtaccgtcgccgccccctccgtcttcatcttcccaccctccgacgaacaactcaaatccggcaccgcctccgtcgtatgcctcctcaacaacttctacccccgcgaagccaaagtccaatggaaagtcgacaacgccctccaatccggcaactcccaagaatccgtcacagaacaagactccaaagactcaacctactccctctcctcaaccctcaccctctccaaagccgactacgaaaaacacaaagtctacgcctgcgaagtcacccaccaaggcctctcctcacccgtaaccaaatccttcaaccgcggcgaatgc

SEQ ID NO: 54369 - RNA, 1353 nt, synthetic construct
  misc_feature 1..1353: note = derived and/or modified sequence opt11 from Tosatoxumab_HeavyChain1
  source 1..1353: mol_type = other RNA
gaagtccagatggtccagagcggcgccgaagtcaaaaagcccggagaacccctaaaaatatcctgcaaaggctccggctacaaattcggaacacactggattggctgggtcagacaacgcccaggaaaaggcctcgaatggatggggataatccacccagccgactccgaaaccaagtactccccctcattccaaggccaagtctcattctcagccgacaaatcatccaacaccgcataccttcactggtccaccctccgtgcatccgacacagccatgtactactgcgcccgcagatccggctcctcaagctggtacgccctcgacttctggggccagggcaccatggtcaccgtctcctcagcctccaccaaaggcccatccgtcttccccctggcaccttcctccaaaagcacctccggcggcacggcagccctaggctgcctcgtcaaagactacttccccgagcccgtcaccgtctcatggaactccggcgcactcacatcaggcgtccacaccttccccgccgtcctccaatcatcaggcctctactccctatcaagcgtcgtcaccgtcccatcatcctccctcggaacccaaacatacatctgcaatgtcaaccacaaaccctccaacacaaaagtcgacaaacgagtcgaacccaaatcatgcgacaaaacgcatacctgtcccccatgccccgcacccgaactactcggcggaccctccgtattcctcttcccacccaaacccaaagacaccctaatgatctcacgaacacccgaagtaacctgcgtcgtcgtcgacgtatcccacgaagatcccgaagtcaaattcaactggtacgtcgacggagtcgaagtccacaacgccaaaaccaaaccccgagaagaacaatacaacagcacctaccgcgtcgtatccgtcctcaccgtgctccaccaagactggctaaacggcaaagaatacaaatgcaaagtctccaacaaagccctacccgccccaatagagaaaacaatctccaaagccaaaggccaaccccgcgaaccccaagtctacacactacccccttcacgagaagaaatgaccaaaaaccaagtctcccttacctgcctcgtcaaagggttctacccctccgacatcgccgtcgaatgggaatcaaacggccaacccgaaaacaactacaaaaccacccctcccgtcctcgactccgacggctccttctttctatactccaaactaaccgtcgacaaatcccgctggcaacaaggcaacgtcttctcatgctcagtaatgcacgaagcactacacaaccactacacccaaaaatcactatcactctcacccggcaag

SEQ ID NO: 54370 - RNA, 651 nt, synthetic construct
  misc_feature 1..651: note = derived and/or modified sequence opt11 from Tosatoxumab_LightChain1
  source 1..651: mol_type = other RNA
caatccgtcctcacccaatccccctccgcctccggcacccccggccaacgcgtcaccatctcctgctccggaggatcctccaacataggctccaacaccgtcaactggtaccaacaattccccggcgcagcccccaaactcctcatctacacaaacaaccaacgcccatccggcgtccccgaccgcttctccggctcaaaatccggcacctccgcctccctcgccatctccggcctccaatccgaagacgaagccgactactactgcgccacctgggacgactccctcaacggactctacgtcttcggcaccggcacaaaagtaaccgtactcggccaacccaaagccaaccccaccgtaaccctattccccccctcctccgaagaactccaagccaacaaagccaccctagtctgcctaatctcagacttctatcccggcgccgtcaccgtcgcctggaaagccgacggctccccagtcaaagccggcgtagaaaccaccaaaccctccaaacaatccaacaacaaatacgccgcctcctcctacctctccctcacccccgaacaatggaaatcccaccgctcctactcctgccaagtaacccacgaaggctcaaccgtagaaaaaacagtcgcccccaccgaatgctca

SEQ ID NO: 54371 - RNA, 1341 nt, synthetic construct
  misc_feature 1..1341: note = derived and/or modified sequence opt11 from Tositumomab_HeavyChain
  source 1..1341: mol_type = other RNA
caggcttacctacaacaatccggcgccgaactcgtcagacccggcgcctccgtcaaaatgagctgcaaagcatccggatacaccttcacctcgtacaatatgcactgggtcaaacaaacaccccgacaaggcctcgaatggattggcgcaatataccccggcaatggcgacacctcctacaaccaaaaattcaaaggcaaagccaccctcaccgtggacaagtcctcaagcaccgcctatatgcaactctcctccctcacctcagaagatagcgccgtatacttctgcgcccgcgtcgtctactattccaactcatactggtacttcgacgtctggggcaccggaaccaccgtaacagtctccggcccctccgtcttccccctcgctccaagcagcaaatccacctcaggaggcaccgccgcgcttggctgcctagtcaaagactacttcccagaaccagtaaccgtttcctggaactccggcgctctcacctcaggagtccacaccttcccagccgtactccaaagctcaggcctctactcactctcctccgtcgtaaccgtaccctcatcctccctcggcacccaaacctacatctgcaatgtaaaccacaaaccatccaacacaaaagtcgacaagaaggcagaaccaaaaagctgcgacaaaacccacacatgcccaccctgccccgcccccgaactcctaggcggcccatccgtcttcctattcccacccaaaccaaaagacaccctcatgatctcccgcaccccggaagttacctgcgtcgtcgtagacgtctcacacgaagaccccgaggtcaaattcaactggtacgtagacggcgtcgaagtccacaacgccaaaacaaaaccccgcgaagaacaatacaacagcacctaccgcgtcgtgtccgtactaactgtactccaccaagactggctcaacggcaaagagtataaatgcaaagtctctaacaaagccctccccgcccccatagagaaaaccatctccaaagccaaaggccaacccagagaaccccaggtctacactctacccccatcccgcgacgaactcaccaaaaaccaggtatccctaacctgcctcgttaaaggcttctacccctccgacatcgcagtagaatgggaaagcaacggccaacccgaaaacaattacaaaaccacacccccagttctagactccgacggctccttcttcctatactccaaactaaccgtggacaaatcccgctggcaacaaggcaacgtcttctcatgctccgtcatgcacgaagccctccacaaccactacacccaaaaatccctctcactatccccaggaaag

SEQ ID NO: 54372 - RNA, 630 nt, synthetic construct
  misc_feature 1..630: note = derived and/or modified sequence opt11 from Tositumomab_LightChain
  source 1..630: mol_type = other RNA
caaatcgtcctctcccaatcccccgccatactatccgcctcccccggcgaaaaagtaaccatgacctgccgcgcctcatcctccgtctcatacatgcactggtaccaacaaaaacccggatcttcccccaaaccctggatctacgccccatccaacctcgcatccggcgtccccgcccgtttctccggctccggctccggcacatcctactccctcaccatctctcgcgtcgaagccgaagacgccgccacctactactgccaacaatggtccttcaacccacccaccttcggcgccggcaccaaactcgaactaaaacgaaccgtcgccgccccctccgtcttcatcttccctccctccgacgaacaactcaaatccggcaccgcctccgtcgtatgcctcctcaacaacttctacccccgcgaagccaaagtccaatggaaagtcgacaacgcactacaatcaggcaactcccaagaatccgtaaccgaacaagattccaaagactccacatactccctctcctccaccctaaccctctccaaagccgactacgaaaaacacaaagtctacgcctgcgaagtcacccaccaaggcctctcatcccccgtcaccaaatccttcaaccgc

SEQ ID NO: 54373 - RNA, 1338 nt, synthetic construct
  misc_feature 1..1338: note = derived and/or modified sequence opt11 from Tovetumab_HeavyChain1
  source 1..1338: mol_type = other RNA
caagtacaactcgtagaatctggcggcggcctagtaaaacccggaggctccctacgcctctcctgcgcagccagcggattcacattctccgactactacatgaactggattcgccaagcccctggcaaaggcctcgaatgggtatcatacatctcctcttccggctcaatcatctactacgcagactctgtaaaaggacgcttcaccatatcccgcgacaacgcgaaaaactccctttacctacaaatgaactccctccgcgccgaagacacagccgtgtactactgcgcccgagaagggcgaatcgctgcacgcggcatggacgtctggggacaaggtaccacagtcaccgtctcctccgccagcaccaaaggaccctccgttttcccactagcaccatgctctcgttcaacctccgagtcaaccgcagccctaggctgcctcgtcaaagactacttccccgaacccgtaacagtatcctggaactctggcgcactcacctccggcgtccacaccttcccagccgtcctccaatccagcggcctctactccttatcatccgtcgtcaccgtccccagctccaacttcggcacccaaacgtacacttgcaatgtcgaccacaaaccatccaacaccaaagtcgacaaaaccgtcgaacgcaaatgctgcgtagaatgtcctccctgccccgccccacccgtcgcaggcccctccgtcttcctcttcccacccaaacccaaagacaccctcatgatctcccgcacccccgaagtgacctgcgtcgtcgtcgacgtctcgcacgaagaccccgaagttcaatttaactggtacgtcgacggagtcgaagtacataatgccaaaaccaaaccccgcgaagaacaattcaactccaccttccgagtagtctccgttctaaccgtagtccaccaagactggctcaacggcaaagaatacaaatgcaaagtctccaacaagggcctacccgcccccattgagaaaaccatctccaaaaccaaaggccaaccccgagaaccccaagtatacaccctcccaccctcccgagaagaaatgaccaaaaaccaagtctcacttacctgcctcgtaaaaggcttctacccctccgatatagccgtagaatgggaaagcaacggccagcccgaaaacaactacaaaactacacccccaatgctcgactcggacggatccttcttcctatactccaaacttaccgtcgacaaatcccgctggcaacaaggaaacgttttctcctgctccgtaatgcacgaagcactccacaaccactacacacaaaaatcactatccctatcccccggcaaa

SEQ ID NO: 54374 - RNA, 645 nt, synthetic construct
  misc_feature 1..645: note = derived and/or modified sequence opt11 from Tovetumab_LightChain1
  source 1..645: mol_type = other RNA
gacatacaaatgacccaaagcccctcctcactctccgcctccgtcggcgaccgcgtctcaatcacatgccgcccctcccaatccttctcccgctacatcaactggtaccaacaaaaacccggcaaagcccccaaactcctaatccacgccgcctcctcactcgtcggcggcgtaccatcccgcttctcaggctcaggctccggcaccgacttcaccctcaccatctcctccctccaacccgaagacttcgccacctactactgccaacaaacctactccaacccacccatcaccttcggccaaggcaccagactcgaaatgaaacgtaccgtcgccgccccctccgtcttcatcttcccaccctccgacgaacaactcaaatcaggaacagcctccgtcgtctgcctactcaacaacttctacccccgcgaagccaaagtccaatggaaagtcgacaacgccctccaatccggaaactcacaagaatccgtcaccgaacaagactccaaagactctacctactccctctcctccacccttaccctctccaaagccgactacgaaaaacacaaagtctacgcctgcgaagtcacccaccaaggcctctcctcacccgtcaccaaatccttcaaccgcggcgaatgc

SEQ ID NO: 54375 - RNA, 1347 nt, synthetic construct
  misc_feature 1..1347: note = derived and/or modified sequence opt11 from Tralokinumab_HeavyChain1
  source 1..1347: mol_type = other RNA
caagtacaactcgtccaatccggagccgaagtcaagaaaccaggcgcaagcgtcaaagtcagttgcaaagcgagcgggtacaccttcacaaactacggcctaagttgggtccgccaagcgcccggacaaggcctcgaatggatgggatggatctcagccaataacggcgacacaaactacggacaagagttccaaggccgcgtcacaatgaccactgacacatcaacaagcacggcctacatggaactccgaagcctcagatccgacgacaccgctgtctactactgcgcacgcgactcatcctcaagctgggccagatggttcttcgacctctggggccggggaaccctagtaaccgtaagctcagcctcaaccaaaggacccagcgtgttccccctcgccccctgcagccgcagcacaagcgagtccaccgccgctctaggctgcctggtaaaagactacttcccagaaccagtcacagtctcatggaacagcggcgctctcacctcaggtgtccacacattcccagccgtactccaaagttcgggcctatactcactctccagcgtggtaaccgtcccaagcagctcattgggcacgaaaacatacacatgcaacgtcgaccacaaacccagcaacacaaaagtagacaaacgcgtcgaatcgaaatacggcccaccctgcccctcgtgcccggccccggagttcctaggcggcccaagcgtattcctgtttcccccaaagccaaaagacacattaatgatctcccgcacccccgaagtaacctgcgtagtcgtggacgtatcccaggaagaccccgaagttcaattcaattggtatgtcgacggcgtagaagtacacaacgccaagaccaaaccccgggaagaacaattcaactcaacctaccgcgtcgtctcagtcctaaccgtactccaccaagactggctcaacggaaaagaatacaagtgcaaagtctcaaacaaaggcctaccatcaagcatcgagaaaaccataagcaaagccaagggccaaccccgagaaccacaagtctacacactaccaccctcacaagaagaaatgaccaagaaccaggtctcgctaacctgcctggtcaaaggcttctaccccagcgacatagcagtcgaatgggaatccaacggccaacccgaaaacaactacaaaaccacacccccagtcctagactcagacggcagcttcttcctctactcccgcctaaccgtcgacaaatcacggtggcaagaaggaaacgtcttctcctgcagcgtcatgcacgaggcactacacaaccactacacccaaaaatcactctcgctctcactgggaaaa

SEQ ID NO: 54376 - RNA, 642 nt, synthetic construct
  misc_feature 1..642: note = derived and/or modified sequence opt11 from Tralokinumab_LightChain1
  source 1..642: mol_type = other RNA
tcctacgtcctcactcaaccaccctcagtctccgtcgcccccggcaaaaccgcccgcatcacatgcggaggcaacatcatcggctccaaactcgtccactggtaccaacaaaaacccggacaagcccccgtcctagtcatctacgacgacggcgaccgaccctccggcatccccgaacgattctccggctccaactccggcaacaccgccaccctcaccatctcccgcgtcgaagcaggcgacgaagccgactactactgccaagtctgggacaccggctccgacccagtagtcttcggcggcggcaccaaactcaccgtccttggccaacccaaagccgcaccctccgtcaccctcttcccaccctcctccgaagaactccaagccaacaaagccaccctcgtctgcctaatcagcgacttctaccccggagcagtcaccgtcgcctggaaagccgactcctcccccgtcaaagccggcgtcgaaaccaccaccccctccaaacaatccaacaacaaatacgccgcctcatcatacctctctctcacacccgaacaatggaaatcccaccgatcctactcatgccaagtcacccacgaaggctccaccgtcgaaaagaccgtcgcccccaccgaatgctcc

SEQ ID NO: 54377 - RNA, 1332 nt, synthetic construct
  misc_feature 1..1332: note = derived and/or modified sequence opt11 from Trastuzuab_HeavyChain1
  source 1..1332: mol_type = other RNA
gaagtacaactggtcgaaagcggcggaggcctcgtacaacccggcggatcacttcgactctcatgcgccgcgagcgggttcaacatcaaagacacctacatccactgggtccgccaagccccaggaaaaggactcgaatgggtcgcccgaatctaccccacaaacggctacacacgctacgccgacagcgtcaaaggcagattcaccatatcagctgacacgtccaaaaacaccgcctacctccaaaactccctccgcgccgaagacacggccgtctactactgctcccgatggggcggagacggattctacgccgactattggggacaaggcaccctagtcacagtctcaagcgcctccaccaaaggcccctcagtattcccgctcgccccctcaagcaagagcacatcaggaggtacagccgcactcggctgcctcgtcaaggactacttccccgaacccgtcaccgtctcctggaactccggcgcccttacatcaggagtccacacattccctgccgtcctccaatcctctggcctctactccctatcttcagtcgtcactgtacccagctcatcactaggcacccaaacctacatctgcaacgtcaaccacaaaccctccaacacaaaagtcgacaagaaagtcgaacccaaatcctgcgacaaaacacacacctgtccaccctgccccgcacccgaactcttaggtggaccatccgtcttccttttccctcccaaacccaaagacaccctcatctcacgaacacccgaagtaacctgcgtcgtcgtcgacgtctcacacgaagatcccgaagtcaaattcaactggtacgtcgacggcgtcgaagtccacaacgccaaaaccaaaccccgcgaagaacaatacaacagcacctaccgcgtagtctccgtcctcacagtcctacaccaagactggctaaacggcaaagaatacaaatgcaaagtctcaaacaaagccctccctgcaccaatagaaaagactatctccaaagccaagggccaaccccgcgaacctcaagtctacacactccctccctcccgagaagaaaccaaaaaccaagtcagcctaacctgcctcgtcaaagggttctacccctcagacatcgccgtagaatgggaatcgaacggccaacctgaaaacaactacaaaaccacacccccagtcctcgactccgacggctcgttcttcctctacagcaaactcaccgtcgacaagtccagatggcaacaaggaaacgtcttctcctgctccgtccacgaagcactccacaaccactacacccaaaaatcgctttccctctctcctggc

SEQ ID NO: 54378 - RNA, 639 nt, synthetic construct
  misc_feature 1..639: note = derived and/or modified sequence opt11 from Trastuzuab_LightChain1
  source 1..639: mol_type = other RNA
gacatccaaacccaatccccctcctccctctccgcctccgtcggcgaccgcgtcaccatcacatgccgcgcctcccaagacgtcaacaccgccgtcgcctggtaccaacaaaaacccggcaaagcccccaaactcctcatctactccgcctccttcctatacagcggcgtcccctcccgcttctcaggctcacgctccggcaccgacttcaccctaaccatctcctcactccaacccgaagacttcgccacatactactgccaacaacactacacgaccccacccaccttcggacaaggaaccaaagtcgaaatcaaacgcacagtcgccgccccctcagtcttcatcttccctccctccgacgaacaactcaaatcaggcaccgcctccgtcgtctgcctcctcaacaacttctacccccgcgaagccaaagtccaatggaaagtcgacaacgcactccaatccggtaactcccaagaatccgtcaccgaacaagactccaaagactccacctactccctctcctccaccctcaccctctccaaagccgactacgaaaaacacaaagtctacgcatgcgaagtcacccaccaaggcctctcatcccccgtcaccaaatccttcaaccgcggcgaatgc

SEQ ID NO: 54379 - RNA, 1347 nt, synthetic construct
  misc_feature 1..1347: note = derived and/or modified sequence opt11 from Trastuzumab_emtansine_HeavyChain1
  source 1..1347: mol_type = other RNA
gaagtccaactcgtcgaatcgggaggcggcctcgtccaacccggcggctctctacgcctatcctgcgccgccagcggctttaacatcaaagacacatacatacactgggtacgccaagcacccggcaaaggactagaatgggtagcccgcatctatccaacaaacggctacacacgctacgccgactccgtcaaaggacgcttcaccatatccgccgatacctccaaaaacaccgcatacctccaaatgaactcactccgcgcagaagacaccgctgtatactactgctcccgttggggcggcgacggcttctacgccatggactactggggccaaggcaccctagtcaccgtctcaagtgccagcacaaaaggccccagcgtcttccccctagccccatcctctaaaagcacatccggcggcacagctgcactgggctgcctcgtgaaagactacttcccagaacccgtcaccgtaagctggaactccggagccctcacctccggcgtacacacattccccgccgtactccaatcatcgggcctatactccctcagcagcgtcgtcaccgtcccatcatcaagcctcggcacacaaacctacatttgcaacgtcaaccacaagccatccaacaccaaagtggacaagaaagtcgaacccaaatcttgcgacaaaacacatacatgccctccctgtcccgccccagaactactaggaggccccagcgtattcctcttcccaccaaaacctaaggacaccctaatgatcagccgtaccccagaagtaacatgcgtagtcgtcgacgtctcccacgaagatcccgaagtcaaattcaactggtacgtcgacggcgtcgaggtacacaacgcaaaaaccaaaccacgagaagaacagtacaactccacataccgagtcgtatctgtcctcacagtactccaccaagactggctcaacggcaaagaatacaaatgcaaagtttcaaacaaggccctacccgcccccatcgagaaaaccatcagcaaagcaaaaggccaacctagagaaccacaagtctacaccctacccccaagccgagaagaaatgaccaaaaaccaagtatccctaacctgcctagtcaaaggcttctacccatccgacatcgccgtagaatgggaatccaacggccaacccgaaaacaactacaaaacaacaccgccagtactagactcagacggctccttcttcctatacagcaaactaacagtcgacaaatctcgctggcaacaaggcaacgtattctcctgctccgtcatgcacgaagccctacacaaccactacacacagaaatccctctcactctccccaggc

SEQ ID NO: 54380 - RNA, 642 nt, synthetic construct
  misc_feature 1..642: note = derived and/or modified sequence opt11 from Trastuzumab_emtansine_LightChain1
  source 1..642: mol_type = other RNA
gacatccaaatgacacaatccccctcttccctctccgcctccgtaggcgaccgcgtcaccatcacatgccgcgcaagccaagacgtcaacaccgccgtcgcctggtaccaacaaaaacccggaaaagcccccaaactcctcatctactccgcctccttcctctactccggcgtcccctccagattctccggctcccgctccggaaccgacttcaccctaaccatctcctccctccagcccgaagacttcgccacctactactgccaacaacactacaccacaccacccacattcggccaaggcaccaaagtcgaaatcaaacgcaccgtcgccgccccctccgtcttcatcttcccaccctcggacgaacaactcaaatcaggcaccgcctccgtcgtctgcctcctaaacaacttctacccccgcgaagccaaagtccaatggaaagtcgacaacgccctacaatcaggcaactcccaagaatccgtcaccgaacaagactccaaagactccacctactccctaagctccaccctaaccctatccaaagccgactacgaaaaacacaaagtatacgcatgcgaggttacccaccaaggactatcctcccccgtaaccaaatccttcaaccgcggcgaatgc

SEQ ID NO: 54381 - RNA, 1347 nt, synthetic construct
  misc_feature 1..1347: note = derived and/or modified sequence opt11 from Trastuzumab_HeavyChain1
  source 1..1347: mol_type = other RNA
gaagtacaacttgtcgaatcaggcggaggtctagtccagcccggcggctccctccgcctctcctgcgccgcctccggctttaacataaaggacacatacatccactgggtacgacaagctcccggcaaaggcctagaatgggttgcccgcatctaccccacaaacggctacacacgatacgccgactcagtcaaaggccgattcacaatctccgccgacacctccaaaaacacagcctacctacaaatgaacagccttcgcgccgaggacaccgccgtctactactgcagccgctggggcggcgacggcttctacgccatggactactggggacaagggaccctcgtcaccgttagctccgcctccaccaaaggtccctcagtcttccccctagccccctcttccaaaagcacctccggcggcaccgccgcactcggatgcctagtaaaggactacttccccgaacccgtaacagtctcatggaactccggagcactcacctcaggcgtccacaccttccctgcagttcttcaatcctccggactctacagcctctcatccgtcgtcacagtaccctcctcctcactcggcacccaaacctacatatgcaacgtcaaccacaaaccctccaacaccaaagtcgacaagaaagtggaaccaaaatcctgcgacaaaacccacacttgcccaccatgccccgcccccgaactgctcggaggtccctcagtcttcctcttcccacccaaaccaaaagacaccctcatgatctcccgcacccccgaagtaacctgcgtcgtcgtcgatgtatcccacgaagaccccgaggtcaaattcaactggtacgtcgacggagtcgaagtccacaacgccaaaaccaaaccccgagaagaacagtacaatagcacctacagagtcgtctccgtcctcaccgtcctacaccaagactggctcaacggaaaagagtacaagtgtaaagtatccaacaaagctctacccgcccccatcgagaaaaccatatcaaaagcaaaaggtcaaccccgtgaaccccaagtctacacactcccaccctcacgcgaagaaatgaccaaaaatcaggtctccctaacctgcctcgtcaaaggcttctacccctcagacatagcagttgaatgggaaagcaacggccaacccgaaaacaactacaaaaccaccccacccgtcctcgactcagacggatcattcttcctctactccaaactcaccgtagacaaatcccgctggcaacaaggaaacgtgttctcctgctccgtcatgcacgaggccctacacaaccactacacacaaaagtccctctccctcagccccggc

SEQ ID NO: 54382 - RNA, 1353 nt, synthetic construct
  misc_feature 1..1353: note = derived and/or modified sequence opt11 from Trastuzumab_HeavyChain
  source 1..1353: mol_type = other RNA
gaagtccaactcgtcgaatccggaggcggactcgtccaacctggaggctccctccgactctcctgcgccgcaagcggtttcaacatcaaagacacatacatacactgggtccgacaagcacccggcaaaggacttgaatgggtcgcccggatataccccacgaacggctacacccgatacgccgacagcgtaaaaggacgcttcaccatctcagccgacacctccaaaaacaccgcctacctacaaatgaatagtctacgcgcagaagacaccgcagtctactactgctcaagatggggaggcgatggattttacgcaatggactactggggccaagggaccctcgtaacagtatcatcagctagtaccaaaggcccatccgtcttcccactcgccccctcttccaaaagcaccagcggcggcacagccgcgctcggctgcctagtcaaagactacttccccgaaccagtaacagtctcatggaactccggagccctaacttcaggcgtacacacattcccagccgtactccaaagctccggcctctactccctctcctccgttgtcaccgtcccctcctcctccctaggcacccaaacatacatatgcaacgtaaatcacaaaccctccaacacaaaagtcgacaagaaagtcgaaccgcccaaatcctgtgacaaaacacatacctgcccgccctgccccgcacccgaactcctcggcggccccagcgtattcctcttcccacccaaacccaaagacacactcatgatctcccgcacccccgaagtaacatgcgtggtcgtcgacgtcagccacgaagacccagaagtaaaattcaactggtacgtcgacggcgtggaagtacacaacgccaaaacaaaaccccgagaagaacagtacaactcaacctacagggtcgtctccgtcctcaccgtactacaccaagactggctgaacggcaaagaatacaaatgcaaagtctcaaacaaagccctccccgcacccatcgagaaaacaataagcaaagccaaaggccaaccacgcgaaccccaagtttacacactaccaccctcccgcgacgaactcaccaaaaaccaagtctccctaacctgcctcgtcaaaggcttctaccctagcgacatagcagtcgaatgggaatccaacggacaacccgaaaacaattacaagaccacacccccagtcctcgactccgacggctccttcttcctctactccaaactcaccgtcgacaaatcacgatggcagcaaggcaacgtcttctcctgctcggtcatgcacgaagccctccacaaccactacacccaaaaatcactctcgctctcccccggaaaa

SEQ ID NO: 54383 - RNA, 660 nt, synthetic construct
  misc_feature 1..660: note = derived and/or modified sequence opt11 from Trastuzumab_HeavyChain_variant_1n8z_B
  source 1..660: mol_type = other RNA
gaagtgcaactggtcgagagcggaggcggactcgtacaaccgggcgggagcctgagactaagctgcgccgcgagcggattcaacatcaaggacacgtacatacactgggtcaggcaagcacccggaaaagggctagaatgggtggcaaggatctatcccacgaacggatacacgcgatacgccgacagcgtgaaagggcgattcaccataagcgctgacacaagcaagaacaccgcctacctccagatgaacagcctgcgcgcggaagacaccgcagtctactactgcagcagatggggaggcgacggattctacgcgatggactactggggccagggcacgctcgtgaccgtgagctcggcctcgaccaaaggcccgagcgtgttcccgctcgcaccctcgagcaagagcaccagcggaggcacggccgcgctcgggtgcctggtcaaggactacttcccggaaccagtcacggtctcgtggaacagcggggccctgacctcgggcgtgcacacgttcccggccgtgctacagagctcgggcctatactcgctctcaagcgtagtcacggtcccgagctcaagcctaggcacgcaaacgtacatatgcaacgtcaaccacaaaccctcgaacacgaaagtggacaagaaagtggaaccg

SEQ ID NO: 54384 - RNA, 45 nt, synthetic construct
  misc_feature 1..45: note = derived and/or modified sequence opt11 from Trastuzumab_HeavyChain_variant_7637_H
  source 1..45: mol_type = other RNA
gaacccaaatcctgcgacaaaacccacacctgccccccctgcccc

SEQ ID NO: 54385 - RNA, 642 nt, synthetic construct
  misc_feature 1..642: note = derived and/or modified sequence opt11 from Trastuzumab_LightChain1
  source 1..642: mol_type = other RNA
gacatccaaatgacccaatccccctcctccctctcagcctccgtcggtgaccgcgtcaccatcacctgccgcgcctcccaagacgtcaacaccgccgtcgcctggtaccaacaaaaacccggaaaagcacccaaactcctcatctactccgcctccttcctatactccggcgtcccatcccgcttctccggctcacgctccggcaccgacttcacactcaccatctcctccctccaacccgaagacttcgccacctactactgccaacaacactacaccaccccccccaccttcggacaaggcaccaaagtcgaaatcaaacgcaccgtcgccgccccctccgtcttcatcttccccccctccgacgaacaactcaaatccggcacagcctccgtcgtctgcctcctcaacaacttttacccccgcgaagccaaagtccaatggaaagtcgacaacgcactccaatccggcaactcccaagaatccgtcaccgaacaagactccaaagactccacctactccctctcctccacactcaccctatccaaagccgactacgaaaaacacaaagtctacgcctgcgaagtcacccaccaaggcctatcatcccccgtcaccaagtccttcaaccgaggcgaatgc

SEQ ID NO: 54386 - RNA, 642 nt, synthetic construct
  misc_feature 1..642: note = derived and/or modified sequence opt11 from Trastuzumab_LightChain_variant_1n8z_A
  source 1..642: mol_type = other RNA
gacatccaaatgacccaatccccctcatccctctcagcatccgtcggcgaccgcgtcaccatcacatgccgcgcctcccaagacgtcaacaccgccgtcgcctggtaccaacaaaaacccggcaaagcccccaaactcctcatctactccgcctccttcctctactccggcgtcccctcccgcttctccggctcacgctccggcaccgacttcaccctcaccatctcctcactccaacccgaagacttcgccacctactactgccaacaacactacacaaccccaccaaccttcggacaaggcaccaaagtcgaaatcaaacgcaccgtcgcagccccgtccgtcttcatcttcccaccctccgacgaacaactcaaatccggcaccgcctccgtcgtctgcctcctaaacaacttctacccccgcgaagccaaagtccaatggaaagtcgacaacgcacttcaatccggaaactcccaagaatccgtcaccgaacaagactccaaagactcaacctactccctctcctcaaccctcaccctctcaaaagccgactacgaaaaacacaaagtctacgcctgcgaagtcacccaccaaggactctcctcacccgtcaccaaatccttcaaccgcggcgagtgc

SEQ ID NO: 54387 - RNA, 642 nt, synthetic construct
  misc_feature 1..642: note = derived and/or modified sequence opt11 from Trastuzumab_LightChain_variant_7637_L
  source 1..642: mol_type = other RNA
gatatacaaatgacccaatccccctcctcactctccgcctcagtcggcgaccgcgtaacaataacctgccgagcatcccaagacgtcaacaccgccgtcgcctggtaccaacaaaaacccggcaaagcccccaaactcctaatatactccgcctccttcctctactcaggcgtcccctcccgattctctggctcccgctccggcaccgacttcaccctcaccatctcctccctccaacccgaagacttcgccacctactactgccaacaacactacaccaccccccccaccttcggccaaggcaccaaagtcgaaatcaaacgcaccgtcgccgccccctccgtcttcatattccccccctccgacgaacaactcaaatccggcaccgcctccgtcgtctgcctcctcaacaacttctacccccgcgaagccaaagtccaatggaaagtcgacaacgccctccaatccggaaactctcaagaatctgtcaccgaacaagactccaaagactcaacctactccctctcctcaacactcaccctctccaaagccgactacgaaaaacacaaagtatacgcctgcgaagtcacccaccaaggcctctcctcccccgtcaccaaatccttcaaccgcggagaatgc

SEQ ID NO: 54388 - RNA, 1344 nt, synthetic construct
  misc_feature 1..1344: note = derived and/or modified sequence opt11 from TRC-105_HeavyChain1
  source 1..1344: mol_type = other RNA
gaagtcaagctcgaagaatcaggcggcggactcgtccaaccaggcggctccatgaaactctcctgcgccgcctccggattcaccttcagcgacgcctggatggactgggtacgccaatcccccgaaaaaggcctcgaatgggtcgcagaaatccgaagcaaagcctcaaaccacgccacctactacgcagaatccgtcaagggccgcttcactatctcccgggacgactccaagtcctcagtgtacctccaaatgaactccctacgagcagaagacaccggcatctactactgcacccgctggcgccgcttcttcgactcatggggacaaggcaccaccctcaccgtatcgtccgcctcaacaaagggcccctctgtcttccccctcgccccctcctccaaatcaacctcaggaggcacagccgccctaggctgcctagtaaaagattatttcccagaacccgtaaccgtatcctggaactcaggcgccctcacctccggcgtccacaccttccccgcagtcctccaatccagcggcctctactccctatcctccgtagtcaccgtcccctcgagctccctagggacacaaacctacatctgcaacgtcaaccacaaaccctcaaacaccaaagtcgacaagaaagtagaaccaaaatcatgcgacaaaacacacacatgcccaccctgccccgcacccgaactactaggcggcccatccgtcttcctattcccacccaaacccaaagacacactcatgatctcccgcacaccagaagtaacctgcgtcgtagtagacgtatcccacgaagaccccgaagtaaaatttaactggtacgtcgacggagtagaagtacacaacgcaaaaaccaaaccccgtgaagaacaatacaacagcacctatcgagtcgtctcagtcctaaccgtcctccaccaagactggctcaacggaaaagaatacaaatgcaaagtctccaacaaagcactccccgcccccatcgaaaagaccatatccaaagccaaagggcaaccccgagaaccccaagtctacacactccctccttcccgcgacgaactcaccaaaaaccaggtctccctaacctgcctcgtcaaaggattctacccatccgacatcgccgtcgaatgggaatccaacggacaacccgaaaacaactacaaaaccacaccacccgtactcgactccgacggatccttcttcctatactcaaaacttaccgtagacaaatcaagatggcaacaaggcaacgtcttctcgtgctcagtcatgcacgaagcactacacaaccactacacccaaaaatccctctccctatcccccggcaaa

SEQ ID NO: 54389 - RNA, 639 nt, synthetic construct
  misc_feature 1..639: note = derived and/or modified sequence opt11 from TRC-105_LightChain1
  source 1..639: mol_type = other RNA
caaatcgtcctcagccaatcccccgccatcctctcagcctcccccggcgaaaaagtcaccatgacctgccgcgcctcctcctccgtctcctacatgcactggtaccaacaaaaaccaggctcctcacccaaaccctggatctacgccacatccaacctcgcctccggcgtccccgtccgcttctcaggatccggctccggcacctcctactccctcaccatctcccgcgtcgaagccgaagacgccgccacatactactgccaacaatggtcctcaaacccactaaccttcggcgccggcaccaaactagaactcaaacgcacagtcgcagccccctccgtcttcatcttcccaccctccgacgaacaactcaaatccggcacagcctcagtcgtctgcctcctaaacaacttctacccacgcgaagccaaagtccaatggaaagtcgacaacgccctccaatccggcaactcccaagaatccgtcaccgaacaagactcaaaagactccacctactccctctcctccacactcaccctcagcaaagccgactacgaaaaacacaaagtctacgcctgcgaagtcacccaccaaggcctctcctcccccgtcaccaaatccttcaaccgcggcgaatgc

SEQ ID NO: 54390 - RNA, 1362 nt, synthetic construct
  misc_feature 1..1362: note = derived and/or modified sequence opt11 from Tregalizumab_HeavyChain1
  source 1..1362: mol_type = other RNA
gaagaacaactcgtagaatcaggcggaggactcgtcaaacccggcggcagtctaagactctcctgcgcggctagcggcttctccttcagtgactgccgcatgtactggctccggcaagcccccggcaagggactagaatggatcggcgtcatctccgtcaaaagcgaaaactacggcgcaaactacgcggagtccgtccgaggccgcttcaccatctcccgtgatgacagcaaaaacacagtctacctccagatgaactcactcaaaaccgaagacaccgccgtctactactgttccgcgtcctactaccgatacgacgtcggagcctggttcgcgtactggggccaaggaacgcttgtaaccgtctcctccgcaagcaccaaaggaccctccgtcttccccttggccccctcctcaaagtccacctcaggaggcaccgccgcactaggctgcctcgtcaaagactactttcccgagcccgtaacagtctcctggaactccggcgccctcacctcaggagtacacaccttccccgcagtcctacaatcctccggcctatactcactctccagcgtcgtcacggtcccttcctcctcccttggcacccaaacctacatctgcaacgtcaaccacaaaccctcaaacaccaaagtcgacaagaaagtcgaacccaaatcctgcgacaaaacacatacctgcccaccctgccccgccccggaactcctcggcggcccatccgtattcctcttccctcccaaacccaaagacaccctaatgatatcccgaaccccagaagtcacatgcgtagtagtcgacgtctcccacgaagaccccgaagtcaaattcaactggtacgtcgacggcgtcgaggtccacaacgccaaaacaaaaccccgcgaagaacaatacaactccacctacagagtcgtctcagtactcacggtcctccaccaggactggctaaacggcaaagagtacaaatgcaaggtctcaaacaaagccctacccgcaccaatcgagaaaaccatctccaaggccaaaggacaaccccgcgaaccacaagtttacaccctcccaccctcacgcgacgaactcaccaaaaatcaagtctcactaacatgcctcgtcaaaggcttctacccctccgacatcgccgtggaatgggaatccaacggccaacccgaaaacaactacaaaaccacccctcccgtactcgactccgacggctcattcttcctatactcaaaactaaccgtcgacaaatcccgctggcagcaaggaaatgtcttcagctgctctgtcatgcacgaagccctccacaaccactacacccagaaatcactttcactcagccccggaaag

SEQ ID NO: 54391 - RNA, 654 nt, synthetic construct
  misc_feature 1..654: note = derived and/or modified sequence opt11 from Tregalizumab_LightChain1
  source 1..654: mol_type = other RNA
gacatcgtcatgacacaaagccccgactccctcgccgtatccttgggcgaacgagcaaccataaactgccgagcatccaaatccgtatccaccagcggatactcatacatctactggtaccaacaaaaacccggccaaccacccaaactcctaatctacctcgcctccatactcgaatccggagtccccgaccgattctcaggctcgggctccggaacagacttcaccctaaccatctcctccctccaagccgaagacgtagccgtatactactgccaacactcacgagaactcccctggacattcggccaaggcaccaaagtcgaaatcaaacgcaccgtcgccgcccccagcgtcttcatcttcccaccctcagacgaacaactcaaatcaggcaccgcctccgtcgtctgcctactcaacaacttctacccccgcgaagccaaagtccaatggaaagtcgataacgcactccaaagcggaaactcccaagaatccgtcaccgaacaagactccaaagactcaacctactccctatcctcaaccctaaccctctccaaagccgactacgaaaaacacaaagtctacgcatgcgaagtcacccaccaaggcctcagctcccccgtcaccaaatcattcaacagaggcgaatgc

SEQ ID NO: 54392 - RNA, 1353 nt, synthetic construct
  misc_feature 1..1353: note = derived and/or modified sequence opt11 from Tremelimumab_HeavyChain1
  source 1..1353: mol_type = other RNA
caagtccaactcgtcgaatcaggaggcggcgtcgtccaacccggccgctcactacgactctcctgcgcagcatcaggcttcaccttctcctcatacggcatgcactgggtccgtcaagccccaggcaaaggcctcgaatgggtagccgtcatctggtacgacggatccaacaaatactacgccgactccgtcaaaggccgcttcaccataagccgcgacaacagcaaaaacaccctctacctccaaatgaacagcctccgcgccgaagacaccgccgtctactactgcgcccgagacccccgcggcgccactctctactactactactacggtatggacgtatggggccaaggaaccaccgtcacagtctcctccgcctccacaaaaggcccatcagtcttcccacttgcaccctgctcacgctccacatccgaatcaacagccgcactaggctgcctcgtaaaagactactttcccgaacccgtcacagtcagttggaactcaggcgccctcacctccggagttcacaccttccccgcagtcctccaatcgtccggactatactccctgtcctccgtcgtaaccgtcccctcctccaacttcggcacccaaacctacacatgcaacgtcgaccacaaaccatccaacacaaaagtcgacaaaacagtcgaacgcaagtgttgcgtcgaatgccctccctgccccgccccacccgtcgcaggccccagcgtattcctattccctcccaaacccaaagacaccctcatgatctcccgaacgcccgaagttacctgcgtcgtcgtcgacgtatcacacgaagatcccgaggtccaattcaactggtacgtcgacggagtcgaagtacacaacgccaaaactaagcccagagaagaacaattcaactcaacgttccgagtcgtatcagtcctaaccgttgtacaccaagattggctgaacggaaaagaatacaaatgcaaagtctccaacaaaggattacccgcacccatagagaaaacaatatccaaaacaaaaggccaaccccgtgaaccccaagtctacacactcccgccctcccgcgaagaaatgaccaaaaaccaagtctccctaacctgcctagtcaaaggcttctacccctctgacatcgccgtcgaatgggaatctaacggccaaccagaaaacaactacaaaacgactcccccaatgctagactccgacggctccttcttcctctactcgaaactcaccgttgacaaatccagatggcaacagggaaacgtattctcctgctccgtaatgcacgaagccctacacaaccactacacacagaaatccctgagcctctcccccggcaaa

SEQ ID NO: 54393 - RNA, 642 nt, synthetic construct
  misc_feature 1..642: note = derived and/or modified sequence opt11 from Tremelimumab_LightChain1
  source 1..642: mol_type = other RNA
gacatccaaatgacacaatccccctcatccctctccgcctccgtcggcgaccgcgtaaccataacctgccgcgcctcccaaagcatcaactcctacctagactggtaccaacaaaaacccggcaaagcccccaaactcctcatctacgccgcctcctcactccaatccggagtcccctcccgcttctccggctccggctccggcaccgacttcaccctcaccatatcctccctccaaccagaagacttcgccacatactactgccaacaatactactccacccccttcacattcggccccggcaccaaagtcgaaatcaaacgcaccgtcgccgccccctccgtattcatcttcccaccctccgacgaacaactcaaatccggcaccgcctccgtcgtctgcctccttaacaacttctacccccgcgaagccaaagtccaatggaaagtcgataacgccctccaatcaggaaactcccaagaatccgtaaccgaacaagactccaaagactccacctactccctctcctcaaccctcaccctcagcaaagccgactacgaaaaacacaaagtctacgcctgcgaagtcacccaccaaggcctctcctcccccgtcaccaaatccttcaaccgcggagaatgc

SEQ ID NO: 54394 - RNA, 1341 nt, synthetic construct
  misc_feature 1..1341: note = derived and/or modified sequence opt11 from Trevogrumab_HeavyChain1
  source 1..1341: mol_type = other RNA
gaagtccaagtcctcgaaagcggaggcgacctcgtacaacccggcggttcattaagactaagctgcgcagcctccggattcacattctccgcctacgccatgacctgggttagacaagcccccggcaaagggctcgaatgggtctcagccatatccggctccggcggttctgcatactacgccgacagcgtaaaaggccgcttcaccatctccagagacaacagtaaaaacaccgtctacttacaaatgaactccctgcgtgcagaagacacagcagtctactactgcgccaaagacggcgcctggaaaatgtcgggcctcgatgtctggggccaaggaacaactgtaatcgtctcctccgcctccacaaaaggcccatccgtcttccccctcgcgccctgctcacgcagcacaagcgaatccactgccgcactcggctgcctagtcaaggactacttccccgaaccagtcacagtaagctggaactcaggggcactcacctccggcgtccacacctttcccgccgtactccagtcctccggactctacagcctatcctccgtagtaaccgtcccctcctcttccctcggaaccaaaacatatacctgcaacgtcgaccacaaaccctcgaacacaaaagtagacaaacgcgtcgaatccaaatacggacccccttgcccgccctgccccgcacccgagttcctcggaggacccagcgtattcctcttccctcccaagcccaaagacacactcatgatctcccgaacaccagaagtcacatgcgtcgtcgtagacgtaagccaagaagacccagaagtccaattcaactggtacgtcgacggcgtggaagtccacaacgccaaaaccaaaccccgcgaagaacaattcaactcaacataccgggtcgtctccgttctgaccgtactccaccaagactggcttaacggaaaagaatacaagtgcaaagtatccaacaaaggcctcccatcctccatcgaaaagacgattagcaaagccaaaggccaaccacgagaaccacaagtatacaccctcccaccctcccaagaagaaatgaccaaaaaccaagtctcactcacctgtcttgtcaaaggcttctacccctccgacatagccgtcgaatgggaatccaacggtcaacccgaaaacaactacaaaaccacacccccagtcctggactccgacggctccttcttcctgtactcacgcctcaccgtagacaaaagtagatggcaagaaggcaacgtattctcatgctccgtcatgcacgaagccctccacaaccactacacccaaaaatcactatccctctcgttaggaaaa

SEQ ID NO: 54395 - RNA, 642 nt, synthetic construct
  misc_feature 1..642: note = derived and/or modified sequence opt11 from Trevogrumab_LightChain1
  source 1..642: mol_type = other RNA
gacatccaaatgacccaatcccccgcctcactatccgcctccgtcggcgaccgcgtcaccatcacatgccgcgcctcccaagacatctcagactacctcgcctggtaccaacaaaaacccggcaaaataccccgcctcctcatctacacaacctccaccctccaatccggagtcccctcccgcttccgcggatccggctccggcaccgacttcaccctaaccatctcttccctccaacccgaagacgtcgccacatactactgccaaaaatacgactccgcccccctcaccttcggcggcggcaccaaagtcgaaatcaaacgcaccgtcgccgccccctccgtattcatcttcccaccctccgacgaacaactcaaatccggcaccgcctccgtcgtctgcctcctcaacaacttctacccccgcgaagccaaagtccaatggaaagtcgacaacgccctacaaagcggcaactcacaagaatcagttaccgaacaagacagcaaagactccacctactccctctcctccaccctaaccctctctaaagccgactacgaaaaacacaaagtctacgcctgcgaagtcacccaccaaggcctctcctcacccgtcacaaaatcattcaaccgcggcgaatgc

SEQ ID NO: 54396 - RNA, 1737 nt, synthetic construct
  misc_feature 1..1737: note = derived and/or modified sequence opt11 from Tucotuzumab_celmoleukin_HeavyChain1
  source 1..1737: mol_type = other RNA
caaatccaattagtccaatcaggcgccgaagtaaagaaaccaggcgaaactgtcaaaatctcatgcaaagcctcagggtacaccttcaccaactacggcatgaactgggttaaacaaacacccggaaaaggcctcaaatggatgggctggataaacacctacaccggcgaaccaacctacgccgacgactttaaaggacgattcgctttctccctcgaaacatccacttccaccgcgtttctccaaatcaacaaccttcgctcagaagacacagccacctatttctgcgtccgtttcatctcaaaaggcgattactggggccaaggcacatccgtaaccgtctcatccgcctcaacaaagggcccctccgtattccctcttgcccccagttcgaagtccacaagcggcggcaccgcggccctaggctgcctcgtaaaagattacttccccgaacccgtcaccgtctcatggaactccggcgctctaacctccggagtccacaccttccccgccgtactccaatcatccggtctctactccctctcatccgtagtcaccgtcccctccagctcactcggcactcaaacctacatctgcaacgtcaaccacaaaccctccaacacaaaagtagacaaaagagtcgaacctaagtcatgcgataaaacccacacctgtcccccatgccccgccccagaactactcggcggcccctccgtattcctgttccctccaaaacccaaagacacgctcatgatctcacgcacccccgaagttacctgcgtcgtcgtcgacgtttctcacgaagatcctgaagtcaaattcaactggtacgtcgacggcgtcgaagtacacaacgcaaaaaccaaacctcgagaagaacaatacaacagcacctatcgcgtagtatccgtcctcaccgtcctacaccaagactggctcaacggcaaagaatacaaatgcaaagtctcaaacaaggccctccccgcgccaatcgagaaaacaatctccaaagcaaaaggtcaaccccgcgaaccccaagtatacaccctcccacccagccgagaagaaatgaccaaaaaccaagtctccctaacgtgcctcgtcaaaggattttacccctccgacatagccgtagaatgggaatccaacggccaacccgaaaacaactacaagaccacaccacccgtcctagattcggacggctccttcttcctctactccaaactcactgtagacaaatcacgctggcaacaaggcaacgtcttcagctgctccgtaatgcacgaggccctacacaaccactacacccaaaaatcactctcactctcccccggaaaagcacccacaagctcctccaccaagaaaacccaactccaactcgagcatctcctccttgacctccaaatgatcctcaatggcatcaacaactataaaaaccccaaactaacacgaatgctcacattcaaattctacatgcccaaaaaggcaacagaactcaaacacctacaatgccttgaagaagaactgaaacccctcgaagaagtcctcaacctcgcccaatccaaaaacttccaccttcgaccccgcgaccttatctccaacataaacgtaatagttctagaactcaaaggatccgaaactacctttatgtgcgaatacgctgacgagaccgccaccatagtcgagttcctcaaccgatggataaccttctgccaatccatcatcagcacacttacc

SEQ ID NO: 54397 - RNA, 639 nt, synthetic construct
  misc_feature 1..639: note = derived and/or modified sequence opt11 from Tucotuzumab_celmoleukin_LightChain1
  source 1..639: mol_type = other RNA
gaaatcgtcctcacccaatcccccgccaccctctcactctcccccggcgaacgcgtcaccctaacctgctccgcctcctcctccgtctcatacatgctctggtaccaacaaaaacccggcagctcccccaaaccctggatcttcgacacctccaacctcgcctccggcttccccgcccgattctccggctcaggctccggaacctcctactccctcatcatctcctccatggaagccgaagacgcagccacctattactgccaccaacgctccggctacccctacacattcggcggcggaaccaaactcgaaatcaaacgaaccgtcgccgccccctcagtattcatcttcccgccctccgacgaacaactcaaatcaggcaccgcctcagtcgtctgcctcctcaacaacttctacccccgagaagccaaagtccaatggaaagtcgacaacgccctccaatccggcaactcccaagaatccgtcaccgaacaagactccaaagactccacctactccctctcctccaccctcaccctctccaaagccgactacgaaaaacacaaagtctacgcctgcgaagtcacacaccaaggcctctcctcccccgtaaccaaatccttcaaccgcggcgaatgc

SEQ ID NO: 54398 - RNA, 1344 nt, synthetic construct
  misc_feature 1..1344: note = derived and/or modified sequence opt11 from Ublituximab_HeavyChain1
  source 1..1344: mol_type = other RNA
caagcctacctacaacaatccggagctgaactcgtacgccccggcgcctcggtaaaaatgtcctgcaaagcctccggatacaccttcacctcatacaacatgcactgggtaaagcaaaccccacgtcaagggctcgaatggatcgggggaatttaccccggaaacggcgacacctcctacaaccaaaaattcaaaggcaaagcaaccctcactgtaggcaaatcatcctccaccgcctacatgcaactatcatccctcacttctgaagactcagccgtctacttctgcgcccgctacgactacaactacgcaatggactactggggccaaggcacctcagtaaccgtatcaagcgcctccaccaaaggaccctccgttttcccgctagccccctcatccaaatccaccagcggaggcaccgccgccctcggctgcctcgtaaaagactacttccccgaacccgtcaccgtatcctggaactccggcgcactaacctccggcgtccacaccttccccgccgtcctccaatcctccggactctacagcctctcatccgtcgtcacagtcccctcatcctccctaggcacccaaacctacatatgcaacgtaaaccacaaaccctccaacaccaaagtagataagaaagtagaaccaaaatcatgcgacaaaacccacacctgtcccccatgccccgcccccgaactcctcggtggcccatcagtcttcctcttcccacccaaacccaaagacaccctaatgataagccgcacccccgaagtaacctgcgtcgtcgtcgacgtcagccacgaagatccagaagtcaaattcaactggtacgtcgacggcgtcgaggtccataacgcaaaaaccaaaccacgtgaagaacaatacaactccacatacagagtcgtctccgtcttaaccgtcctacaccaagactggcttaacggcaaagaatacaaatgcaaagtctccaacaaagccctacccgcaccaatcgagaaaaccatctccaaagccaaaggtcaacctcgcgaaccacaagtttacaccctcccaccctctcgcgacgaactcaccaaaaaccaagtctcccttacctgcctcgtcaaaggattctaccccagcgacatcgccgtcgaatgggaatctaacggccagcccgaaaacaactacaaaaccacaccacccgtcctcgactcagacggatccttcttcctctactcaaaactaacagtagacaaatcccggtggcaacaaggcaacgtattctcctgctccgtcatgcacgaagccctccacaaccactacacccaaaaatccctctcccttagccccggcaaa

SEQ ID NO: 54399 - RNA, 639 nt, synthetic construct
  misc_feature 1..639: note = derived and/or modified sequence opt11 from Ublituximab_LightChain1
  source 1..639: mol_type = other RNA
caaatcgtcctatcccaatcacccgccatcctctccgcctcccccggcgaaaaagtcaccatgacctgccgcgcctcctcctccgtctcctacatgcactggtaccaacaaaaacccggctcttcccccaaaccctggatctacgccacctccaacctcgcctccggcgtccccgcccgcttctccggctccggctccggcacttcatactcattcaccatctcccgcgtagaggccgaagacgcagccacctactactgccaacaatggacattcaacccacccaccttcggcggcggcacccgcctcgaaatcaaacgcaccgtcgccgccccctccgtcttcatcttccccccctccgacgaacaactaaaatcaggcaccgcctccgtcgtctgcctcctcaacaatttctacccccgcgaagccaaagtccaatggaaagttgacaacgccctacaatccggcaactcccaagaatccgtcaccgaacaagactcaaaagactccacctactcactatcttccaccctcaccctctccaaagccgactacgaaaaacacaaagtctacgcctgcgaagtcacccaccaaggcctctcctcacccgtaaccaaatccttcaaccgcggcgaatgc

SEQ ID NO: 54400 - RNA, 1353 nt, synthetic construct
  misc_feature 1..1353: note = derived and/or modified sequence opt11 from Ulocuplumab_HeavyChain1
  source 1..1353: mol_type = other RNA
gaagtccaactcgtcgaatccggcggcggactcgtccaacccggcggctctctacgactatcctgcgctgcagccggctttaccttctcatcatattccatgaactgggtccgccaagcccccggtaaaggcctcgaatgggtctcctacatctcctcgcgctccagaaccatctactacgccgactcagtaaaaggccgcttcaccatttctcgagacaacgccaaaaactccctatatctacaaatgaactctctccgagacgaagacaccgcagtctactactgcgcacgcgactacggcggacaacccccatactactactactacggcatggacgtctggggtcaaggaaccaccgtcaccgtctcatccgcatccaccaaaggcccatcagttttcccactagccccctgctccagaagtacctccgaatctaccgcagccctaggctgcctagtaaaagactatttcccagaacccgtcaccgtttcctggaactccggcgcactcacttccggagtccacacattcccagccgtccttcaatcctcaggcctctactcactctcctccgtcgtcacagtcccctcatcctctctgggaaccaaaacatacacctgtaatgtcgaccacaaaccctccaataccaaagtagacaaacgcgtcgaatcaaaatacggacctccctgcccaccctgccccgccccagagttcctcggcggcccatccgtctttctcttcccacccaaacccaaagatacactcatgatctcacgcacacccgaagtaacctgcgtcgtcgttgacgtctcccaagaagaccctgaagtccaattcaactggtacgtagacggtgtcgaagtccacaacgcaaaaaccaaaccccgcgaagaacaattcaactccacctaccgcgtcgtttcagtcctaacagtcctccaccaagactggctcaacggcaaagaatacaagtgcaaagtctcaaacaaaggcctcccctccagcatcgaaaagacaatctccaaagccaaaggccaaccccgcgaaccccaagtatacaccctacccccttcacaagaagaaatgaccaaaaaccaagtctcacttacatgtctcgtcaaaggcttctacccctccgacatcgccgttgaatgggaatcaaacggccaacccgaaaacaactacaaaaccacccctcccgtcctcgactccgacggctccttcttcctatactcccgcctcaccgtagacaaatcaagatggcaagaaggaaacgtcttctcctgctccgtaatgcacgaagccctccacaaccactacacccaaaaatccctctcactctcactgggc

SEQ ID NO: 54401 - RNA, 642 nt, synthetic construct
  misc_feature 1..642: note = derived and/or modified sequence opt11 from Ulocuplumab_LightChain1
  source 1..642: mol_type = other RNA
gacatccaaatgacccaatccccctcatccctatccgcctccgtaggagaccgcgtaaccataacctgccgcgcctcccaaggaatctcctcatggctagcctggtaccaacaaaaacccgaaaaagcccccaaatccctcatctacgccgccagctccctccaatccggcgtcccctccaggttctctggctctggctccggcaccgacttcacactgaccatctcctcactccaacccgaagacttcgtaacctactactgccaacaatacaactcctacccccgcaccttcggacaaggcaccaaagtcgaaatcaaacgcaccgtcgccgccccctccgtattcatcttccctccctccgacgaacaactcaaatccggaaccgcctcagtcgtctgcctcctcaacaacttctacccccgcgaagccaaagtccaatggaaagtcgacaacgccctccaatccggcaactcccaagaatccgtcaccgaacaagactccaaagactcaacctactccctcagctcaaccctcaccctaagcaaggccgactacgaaaaacacaaagtctacgcctgcgaagtcacacaccaaggcctaagctcacccgtcaccaaatccttcaaccgcggcgaatgc

SEQ ID NO: 54402 - RNA, 1344 nt, synthetic construct
  misc_feature 1..1344: note = derived and/or modified sequence opt11 from Urelumab_HeavyChain1
  source 1..1344: mol_type = other RNA
caagtccaacttcaacaatggggcgcaggactcctaaaaccctccgaaacgctatccctgacctgcgccgtctacggcggctccttttccggatactactggtcctggatacgccaatccccggaaaaaggcctcgaatggatcggagaaatcaaccacggaggatacgtaacctacaacccatccctagaatcccgcgtcaccatcagcgtagatacatccaaaaaccaattctccctcaaactctcctccgtcaccgctgccgacaccgcagtatactactgcgcaagagactacggccccggcaactacgactggtacttcgacctctggggccgcggcacactcgtcaccgtcagctctgcctcaacaaagggcccgtctgtctttcccctcgcaccctgttccagatcaacaagcgaatccacagccgcactcggctgcctagtaaaagactacttccccgaaccagtcactgtctcatggaactccggcgccctcacctccggcgtccacaccttccccgccgtcctccagtcctccggcctttactccctctcctccgtcgtcacagtcccctcatccagcctcggaaccaaaacctacacatgcaacgtcgaccacaaaccatcaaacaccaaagtcgacaagcgcgtcgaatccaaatacggcccaccttgtcctccctgccccgcccccgagttcctcgggggcccctccgtctttctatttccacccaaacccaaagacaccctcatgatcagccgcacccccgaagtcacgtgcgtcgtagtagacgtttcccaagaagaccccgaagtacaattcaactggtacgttgacggcgtagaagtccacaacgcaaaaaccaaaccccgagaggaacaattcaactccacctaccgcgtcgtctcagtcctcaccgtcctccaccaagactggctcaacggcaaagaatacaaatgcaaagtctccaacaaaggactaccatccagcatcgagaaaaccatatccaaagcaaaaggccagcccagagaaccccaggtctacaccctcccaccctcccaagaagaaatgaccaaaaaccaagtctccctaacctgccttgtcaaaggcttctacccctctgacatcgcagtcgaatgggaaagtaacggccaacccgaaaacaattacaaaaccaccccacccgtcctagactccgacggctcctttttcctttactcccgactaaccgtcgacaaatcccgatggcaagaaggcaacgtattcagttgctccgtcatgcacgaagccctgcacaaccactacacccaaaaatcgctctcactctccctcggcaaa

SEQ ID NO: 54403 - RNA, 648 nt, synthetic construct
  misc_feature 1..648: note = derived and/or modified sequence opt11 from Urelumab_LightChain1
  source 1..648: mol_type = other RNA
gaaatcgtcctcacccaatcccccgccaccctctcactctcccccggagaacgcgccaccctctcctgccgcgcttcccaatccgtatcctcctacctcgcctggtaccagcaaaaacccggccaagcccccagactcctcatctacgacgcctccaaccgcgcaaccggcatcccagcccgcttctccggctccggctccggcacagacttcaccctcaccatatcctcactcgaacccgaagacttcgccgtctactactgccaacaacgctccaactggccccccgccctcaccttctgcggcggcaccaaagtcgaaatcaaacgcaccgtcgccgcccccagcgtcttcatattccccccctccgacgaacaactaaaatcaggcaccgcctcagtcgtctgcctcctcaacaacttctacccccgcgaagctaaagtccaatggaaagtcgacaacgccctccaatccggaaactcccaagaatccgtcaccgaacaagactccaaagactccacctactccctatcctccaccctaaccctctccaaagccgactacgaaaaacacaaagtctacgcatgcgaagtcacccaccaaggcctctcctcacccgtcaccaaatccttcaaccgcggcgaatgc

SEQ ID NO: 54404 - RNA, 1347 nt, synthetic construct
  misc_feature 1..1347: note = derived and/or modified sequence opt11 from Urtoxazumab_HeavyChain1
  source 1..1347: mol_type = other RNA
gaagtccaactcgttgaaagcggcggcggcctcgtccaacccggcggaagcctacgactcagctgcgccgcaagcggcttcacattctcttcctacggaatgtcatgggtccgccaagcacctggcaaaggactagaatgggtcgccactatttcaaccggcggctcctacacctactaccccgactccgtaaaaggacgattcaccatctcccgcgacaacgccaaaaacaccctttacctccaaatgaactccctccgagccgaagacaccgccgtctactactgcgcacgccgtggcgacgcctggggaaacctagactactggggacaaggcaccctagtcaccgtctcatcggcctctacgaaaggcccctcagttttcccactagcccccagcagtaaatccaccagcggcggaaccgccgctctcggctgcttagtcaaagactacttcccagaaccagtcaccgtaagctggaactccggcgcactcacatcaggtgtccacaccttcccagccgtcctacaatcctcaggcctctactcactctcctccgtcgtcaccgtaccgagcagctcactcggcacccaaacctacatctgcaacgtaaaccacaaacccagcaacacaaaagtcgacaagaaagtcgaaccaaaatcatgcgacaaaacccacacatgcccaccctgccccgccccagagctactcggaggcccctccgtattcctcttcccacccaaacccaaagacaccctcatgatctcccgcacacccgaagtaacatgcgtcgtcgtagacgtcagccacgaagaccccgaagtcaaattcaactggtacgtagatggcgtcgaagtccacaatgccaaaaccaaaccccgcgaagaacaatacaactcaacctacagagtcgtcagcgttctaaccgtcctacaccaagactggctcaacggcaaagagtacaaatgcaaagtctcgaacaaagccctacccgcccccatcgagaaaaccatctctaaagccaaaggccaaccccgcgaaccccaagtatacacactccctccctcccgcgacgaactcaccaaaaaccaagtatcactcacctgtctagtcaaaggcttctacccctccgacattgcagttgaatgggaatccaacggacaacccgaaaacaactacaaaaccaccccacccgtcttagattcggacggcagtttcttcctctactccaaactcaccgtcgacaaaagccgatggcaacaaggcaacgtattcagctgcagcgtcatgcacgaagcactacacaaccattacacccagaaaagcctaagcctaagccccggcaaa

SEQ ID NO: 54405 - RNA, 642 nt, synthetic construct
  misc_feature 1..642: note = derived and/or modified sequence opt11 from Urtoxazumab_LightChain1
  source 1..642: mol_type = other RNA
gaaatagtactcacccaatcacccgccaccctctccgtctcccccggcgaacgagccaccctatcctgccgagcctcccaaaccatctccaacaacctccactggtaccaacaaaaacccggccaagccccccgactactcatcaaatcagcatcccaatccatatccggaatccccgcccgcttctcaggctccggctccggcaccgacttcaccctaacaatctcctccctcgaatccgaagacttcgccgtctactactgccaacaatcctactcatggcccctcaccttcggccaaggcaccaaagtcgaaatcaaacgcacagtagcagcaccctccgtcttcatcttccccccctccgacgaacaactcaaatcaggcacagcctcagtcgtctgcctactaaacaacttctacccccgcgaagccaaagtccaatggaaagtcgacaacgccctccaatccggtaactcccaagaatccgtcaccgaacaagactccaaagactcaacctactccctctcctccacactaaccctctccaaagccgactacgaaaaacacaaagtctacgcctgcgaagtcacccaccaaggcctctcctcccccgtcaccaaatccttcaaccgcggcgaatgc

SEQ ID NO: 54406 - RNA, 1347 nt, synthetic construct
  misc_feature 1..1347: note = derived and/or modified sequence opt11 from Ustekinumab_HeavyChain1
  source 1..1347: mol_type = other RNA
gaagtacaactagtccaaagcggcgctgaagtaaaaaaacccggcgaatcgctcaaaatctcatgcaaaggctcaggctactctttcaccacatactggctcggctgggtccgccaaatgcccggcaaaggcctcgattggatcggcatcatgtcccccgtggactcagacatacgctactccccctccttccagggccaagtcaccatgtctgtcgacaaatccatcacaaccgcctacctgcaatggaactcactcaaagcctcggacaccgccatgtactactgcgcccgacggcgaccaggccaaggctacttcgacttttggggccagggcaccctggtcaccgtcagctcctcctccacaaaaggccccagcgtcttcccactcgccccctccagcaaaagcacctccggaggcacagccgccctaggctgcctcgtcaaagactacttccccgaaccagtaaccgtctcctggaactccggagccctaacctccggagtacacaccttccctgccgttctccagtcctcaggcctttactcactctcctccgtcgtcaccgtaccctcctcctccctcggcacccaaacctacatatgcaacgtcaatcacaaaccatccaacactaaagtcgacaaacgcgtagaaccgaaatcatgcgacaaaacccacacatgcccaccctgcccagccccagaactactcggcggcccatcggtctttctcttcccccctaaaccaaaagacaccctgatgatctcccgaacccccgaagtcacctgtgtcgtagtcgacgtatcccacgaagacccggaagtaaaattcaactggtacgtcgacggagtcgaagtccacaacgccaaaacaaaaccccgcgaagaacaatacaacagcacataccgagtagtctccgtactcacagtcctacaccaggactggctcaacggaaaagaatacaaatgcaaagtctccaataaagccctccccgccccgatcgaaaaaaccatctccaaagcgaaaggccaacccagagaaccacaagtctacacccttcccccctcacgcgacgaactaaccaaaaatcaagtatccctaacctgcctcgtgaaaggcttctacccctcagacatagccgtggaatgggaatccaacggacaaccagaaaacaactacaaaacaacaccacccgtcctagatagcgacggctcattcttcctatattccaagctaaccgtcgacaaatcccgctggcaacagggcaacgtcttctcctgcagcgtaatgcacgaagccctccacaatcactacacacaaaaatcccttagcctttcccccggcaaa

SEQ ID NO: 54407 - RNA, 642 nt, synthetic construct
  misc_feature 1..642: note = derived and/or modified sequence opt11 from Ustekinumab_LightChain1
  source 1..642: mol_type = other RNA
gacatccaaatgacccaatccccatcctccctctccgcctccgtcggcgaccgcgtcaccataacctgccgcgcctcccaaggcatctcctcctggctcgcctggtaccaacaaaaacccgaaaaagcccccaaatccctcatctacgccgcatcctcactccaatccggcgtcccatcccgcttctcaggctccggctccggcactgacttcaccctcaccatctcatcactccaacccgaagacttcgccacctactactgccaacaatacaacatctacccctacaccttcggacaaggcaccaaactcgaaatcaaacgcacagtcgccgccccctccgtcttcatcttcccaccctccgacgaacaactcaaatcaggaacagcttccgtcgtctgcctcctcaacaacttctacccccgtgaagccaaagtccaatggaaagtcgacaacgccctccaatcaggcaactcccaagaatccgtcaccgaacaagacagcaaagactccacctactccctctcctccaccctcaccctttccaaagccgactacgaaaaacacaaagtctacgcctgcgaagtcacccaccaaggcctctcctccccagtcaccaaatccttcaaccgcggcgaatgc

SEQ ID NO: 54408 - RNA, 1341 nt, synthetic construct
  misc_feature 1..1341: note = derived and/or modified sequence opt11 from Vadastuximab_talirine_HeavyChain1
  source 1..1341: mol_type = other RNA
caagtccagctagtccaatccggcgccgaagtcaagaaaccgggcgcatccgtaaaagtctcatgcaaagcctcaggctacaccttcaccaattacgacataaactgggtccgccaagcacccggccaaggactcgaatggatcggatggatatacccaggcgacggctcaaccaaatacaacgaaaaattcaaagcaaaagccacactcacagccgatacgtcaacaagcacagcctacatggaactccgctcactcagatccgacgacaccgccgtatactactgcgcctccggctacgaagacgccatggactactggggccaaggaacaaccgtaaccgtctcatcagccagcacaaaaggcccctccgtattccccctcgccccctcctccaaatccacctccggcggaactgccgcactcggctgcctcgtcaaagactacttccccgaaccagtcaccgtatcctggaactccggagcactaacatccggagtccacacattccccgctgtcctccaatcctccggactctactcactctcctccgtagtcaccgtccctagctcatccctcggcacccaaacatacatttgcaacgtcaaccacaaaccatcaaacaccaaagtcgacaagaaagtagaacccaaaagctgcgacaaaacccacacctgtccaccctgccccgcccccgaactcttaggcggcccctgcgtattcctcttcccacccaaacccaaagacactctcatgatctcacgaacccccgaagtaacctgcgtcgtcgttgacgtctcacacgaagaccccgaagtcaaattcaactggtacgtcgacggcgtcgaagtacacaacgccaaaaccaaaccccgcgaagaacaatacaactccacctaccgcgtagtatcagtcctaaccgtcctccaccaagactggctaaacggcaaagaatacaaatgtaaagtctccaacaaagcccttcccgcacccatagagaaaaccatctcaaaagcaaaaggacaaccccgcgaacctcaggtctacacacttccaccctcacgcgacgaactaactaaaaaccaagtctccttaacctgccttgtcaaaggattctacccctccgacatcgccgtagaatgggaaagcaatggacaacccgaaaataactacaaaaccacacccccggtcctagactccgacggctccttcttcctatactccaaactcaccgtcgacaaatctcgctggcaacaaggcaacgtcttctcctgcagcgtcatgcacgaagcactgcataaccactacacccaaaagtccctatctctctcaccaggcaag

SEQ ID NO: 54409 - RNA, 642 nt, synthetic construct
  misc_feature 1..642: note = derived and/or modified sequence opt11 from Vadastuximab_talirine_LightChain1
  source 1..642: mol_type = other RNA
gacatccaaatgacccaatccccctcctccctcagcgcatccgtcggcgaccgcgtcaccatcaactgcaaagcctctcaagacatcaactcctacctctcctggttccaacaaaaacccggcaaagcccccaaaaccctcatctaccgcgccaaccgcctcgtcgacggcgtcccctcacgcttctccggctcaggctctggccaagactacacactaaccatctcctcactccaacccgaagacttcgccacatactactgcctccaatacgacgaattccccctcaccttcggcggcggcaccaaagtcgaaatcaaacgcacagtcgccgccccctcagtcttcatcttccccccctcagacgaacaactcaaatccggcaccgcctccgtcgtctgcctcctcaacaacttctacccccgcgaagccaaagtccaatggaaagtcgacaacgccctccaatccggcaactcccaagaatccgtcaccgaacaagactccaaagactcaacttactccctctcctccaccctcaccctctccaaagccgactacgaaaaacacaaagtctacgcctgcgaagtcacccaccaaggcctatcctcccccgtcaccaaaagcttcaacagaggcgaatgc

SEQ ID NO: 54410 - RNA, 1362 nt, synthetic construct
  misc_feature 1..1362: note = derived and/or modified sequence opt11 from Vandortuzumab_vedotin_HeavyChain1
  source 1..1362: mol_type = other RNA
gaagtccaactcgtcgagtctggaggcggcctcgtccaacccggaggctccctccgactcagctgcgccgtctcaggatactccataacctcagactatgcgtggaactgggtacgacaggcccccggcaaaggactagaatgggtcggctacatctccaactccggttccacatcctataacccatccctcaaatccagattcacgatctcacgtgacacaagcaaaaacaccctctacttacaaatgaactccctacgcgcagaagacaccgccgtctactactgcgcacgagaacgcaactacgactacgacgattactactacgccatggactactggggacaaggcaccctcgtaaccgtatcctcagcttcaaccaaaggaccctccgttttccccctagcaccctcctcaaaatcaacatccggaggaaccgccgccctcggctgcctagtaaaagactacttccccgaaccagtcaccgtctcctggaacagtggcgccctcacctcgggcgtacacaccttccccgcagtcctacaatcatcaggcctctactccctatcctccgtggtcacagtcccctcctcatcactcggcacacaaacctatatctgcaacgtcaaccacaaaccatcaaacacaaaagtagacaagaaagtcgagcccaaaagctgcgacaaaacccacacctgtccaccctgccccgcccccgaactcctcggaggcccctccgtcttcctcttccctcccaaacccaaagacaccctcatgatttcccgcacccccgaagtaacctgcgtcgtcgtcgacgtctcccacgaagaccccgaagtcaaattcaactggtacgtagacggcgtcgaagtccacaatgccaaaaccaaaccccgcgaggaacaatacaacagcacctaccgtgtggtctccgtactaaccgtcctccaccaagactggctaaacggtaaagaatataaatgcaaagtctccaacaaagccctccccgcccccatcgaaaagaccatcagtaaggccaaaggacaaccccgcgaaccccaagtctacaccctccctcccagccgagaagaaatgaccaaaaaccaagtctcactgacctgcctcgtcaaaggattctacccgtccgacatagcggtagaatgggaatccaacggtcagcccgaaaacaactacaaaacaacaccacccgtcctagactccgacggctcctttttcctctacagcaaactaaccgtcgacaaatcccgctggcaacaaggcaacgtcttctcctgctccgtcatgcacgaagccctccacaaccactacactcaaaaatcactatccctctccccaggcaaa

SEQ ID NO: 54411 - RNA, 660 nt, synthetic construct
  misc_feature 1..660: note = derived and/or modified sequence opt11 from Vandortuzumab_vedotin_LightChain1
  source 1..660: mol_type = other RNA
gacatccaaatgacccaatcaccatcatccctctccgcatccgtcggcgaccgcgtcaccatcacctgcaaatccagccaatccctactctaccgctccaaccaaaaaaactacctcgcctggtaccaacaaaaacccggcaaagcacccaaactcctaatctactgggcatccacacgcgaatccggcgtcccctcccgcttctccggatccggctccggcaccgacttcaccctcaccatctcctccctccaacccgaagacttcgccacatactactgccaacaatactacaactatccccgcaccttcggccaaggcaccaaagtcgaaatcaaacgcacagtcgccgccccctccgtattcatcttccccccctcagacgaacaactaaaatcaggaaccgcctccgtcgtctgcctcctcaacaacttctacccacgcgaagccaaagtccaatggaaagtcgacaacgcactccaatccggcaactcacaagaatccgtcaccgaacaagactccaaagactcaacctactccctctcctcaaccctaaccctctccaaagccgactacgaaaaacacaaagtctacgcctgcgaagtcacacaccaaggcctatcctcccccgtcaccaaatcattcaacagaggcgaatgc

SEQ ID NO: 54412 - RNA, 1329 nt, synthetic construct
  misc_feature 1..1329: note = derived and/or modified sequence opt11 from Vantictumab_HeavyChain1
  source 1..1329: mol_type = other RNA
gaagtccaactcgtcgaatccggcggcggactcgtacagcccggcggatcactccgcctctcttgcgccgcatcgggctttaccttcagccactacactctctcatgggtccgccaagcaccaggcaaaggcctcgaatgggtctcagtcatcagcggcgacggatcctacacctactacgccgactcagtcaaaggccgattcaccatctcctccgacaactccaaaaacaccctctacctccaaatgaactcgctccgagccgaagacacagccgtctactactgcgcacgtaacttcataaaatacgtcttcgcaaactggggccaaggaaccctcgtcacagtctcctccgcctccaccaaaggcccctccgtcttccctctcgccccctgctcccgctcaacatcagaatcaacagccgccctcggctgccttgtaaaagactactttcccgaaccagtcacagtaagctggaactcaggagccctaacatccggagtccacaccttccccgccgtcctccaatcctccggcctctactccctttcctcagtcgtcactgtcccatcctctaacttcggcacccaaacatacacatgcaatgtcgaccacaaaccctccaacaccaaagtagacaaaaccgtcgaacgaaaatgctgcgtagaatgcccaccctgccccgcaccacccgtcgccgggccctccgtgttcctatttcccccaaaaccaaaagacacactcatgataagccgcacaccggaagtgacctgcgtcgtcgtcgatgtgagccacgaagaccccgaagtacagttcaactggtacgtcgacggcgtagaagtccacaacgcaaaaaccaaaccccgcgaagaacaattcaacagcacattccgcgtcgtctccgttctcaccgtagtccatcaagactggctcaacggcaaagaatacaaatgcaaagtatcaaacaaaggactccccgcacccatcgagaaaaccatctccaaaacaaaaggtcaaccacgtgaaccacaagtttacaccctcccaccctcccgagaagaaatgaccaaaaaccaagtatctctaacatgcctcgtcaaaggcttctacccctccgacatcgccgtcgaatgggaatccaacggccaacccgaaaacaactataaaaccacgccacccatgctagactccgacggatccttcttcctctactcaaaactcaccgtcgacaaatcccgatggcaacaaggtaacgtcttctcttgctccgtaatgcacgaagcactccataaccactacacccaaaaatccctctccctctcacccggg

SEQ ID NO: 54413 - RNA, 639 nt, synthetic construct
  misc_feature 1..639: note = derived and/or modified sequence opt11 from Vantictumab_LightChain1
  source 1..639: mol_type = other RNA
gacatcgaactcacccaacccccctccgtctccgtcgcccccggccaaacagcccgcatatcctgctcaggcgacaacatcggctccttctacgtccactggtaccaacaaaaaccaggccaagccccagtcctcgtcatctacgacaaatccaaccgcccatccggcatacccgaacgcttctccggctcaaactccggcaacaccgctaccctcaccatctccggcacacaagccgaagacgaagccgactactactgccaatcctacgccaacaccctctccctagtcttcggcggaggcaccaaactcaccgtcctaggacaaccaaaagccgccccctccgtcaccctcttccccccctcctccgaagaactccaagccaacaaagcaaccctcgtatgcctcatctcagacttctaccccggcgccgtcaccgtcgcctggaaagcagactcctcccccgtaaaagcaggcgtcgaaaccaccaccccctccaaacaatccaacaacaaatacgccgccagctcctacctctccctaacccccgaacaatggaaatcccaccgctcctactcctgccaagtcacccacgaaggatccaccgtcgaaaaaacagtcgcccccaccgaatgctcc

SEQ ID NO: 54414 - RNA, 1389 nt, synthetic construct
  misc_feature 1..1389: note = derived and/or modified sequence opt11 from Vanucizumab_HeavyChain1
  source 1..1389: mol_type = other RNA
caagtccaactcgtccaatccggcgcagaagtcaagaaacccggcgcctctgtcaaagtcagctgcaaagcctccggctacacattcacaggctactacatgcactgggtcagacaagccccaggccagggccttgaatggatgggctggatcaacccaaactccggcggtacaaactacgcacaaaaattccaaggccgagtgaccatgacacgcgacacctccatctccaccgcatacatggagctctcccgactccggtccgacgacaccgcagtctactactgcgcccgttcacccaacccctactactacgactcctccggctactactacccgggagccttcgacatttggggacaaggaaccatggtaacagtctcatcagcctccgtcgccgccccaagcgtcttcatcttcccaccctccgacgaacaactcaagtccggaacagcaagcgtagtatgtcttctgaacaacttctacccccgcgaggctaaagtccaatggaaagtcgacaatgccctccaatcgggcaactcacaagaatccgtcaccgaacaagactccaaagacagcacctactccctctcgtccactctaacactttccaaggccgactatgaaaaacacaaagtctacgcctgcgaagtaacccaccaaggcctatccagccccgtcaccaaatcattcaaccgcggcgaatgcgacaaaacacacacatgccctccctgccccgccccagaactcctcggcggcccctccgtattcctattcccacccaaacccaaagacacccttatgatatcacgaaccccagaagtcacatgcgtcgtcgttgacgtcagccacgaagaccccgaagtcaaattcaactggtacgtcgacggagtcgaagtccacaacgccaaaacaaaaccacgcgaagaacaatacaactccacctaccgcgtggtttccgtactcacagtcctccaccaagactggctaaacggtaaagaatacaaatgcaaagtatcaaacaaagcactccccgcacccatagagaaaaccatctccaaagcaaaaggacaaccccgagaacctcaagtctgcaccctcccaccctcacgcgacgaactaaccaaaaaccaagtctccctgtcctgcgccgtaaaaggcttctacccctccgacatcgcagtggaatgggaatcaaacggccaacccgaaaacaactacaaaaccaccccacccgtcctcgactccgacggttccttcttcctcgtttctaaactaacagtcgacaagtcccgctggcagcagggcaacgtcttctcctgctcagttatgcatgaagccctccacaaccactacacccaaaaatcactctctctctcccccggcaag

SEQ ID NO: 54415 - RNA, 1359 nt, synthetic construct
  misc_feature 1..1359: note = derived and/or modified sequence opt11 from Vanucizumab_HeavyChain2
  source 1..1359: mol_type = other RNA
gaagtccagctcgtcgaatccggcggtggactcgtacaaccaggcggaagcctacgcctctcttgcgccgcctctggatacaccttcaccaactacggaatgaactgggtacgacaagcccccggcaagggcctcgaatgggtcggctggattaacacatacaccggtgaacccacgtatgccgccgacttcaagcgccgcttcaccttctcactcgacacctccaaatccaccgcctacctccaaatgaacagcctccgcgcagaggacacagccgtttactactgcgccaaatacccccactactacggctcctcccactggtacttcgacgtctggggccagggaacactcgtaaccgtatcctcagcctccaccaagggcccctccgtcttcccactagcgccctcctccaaatccacatccggaggaaccgccgcccttggctgcctcgtcaaagactacttcccagaacccgtcaccgtctcctggaactccggcgccctcacctccggcgtacacaccttccccgccgtcctccaatcctcaggcctttactccctctcctccgtagtcaccgtcccctcctcttcccttggaacccagacatacatctgcaacgtcaaccacaaaccctcaaacaccaaagtagacaagaaagtcgaacccaaatcctgcgacaaaacccacacatgcccaccctgccccgcccccgaactactaggcggcccctcagttttcctattcccgcccaaaccaaaagacacacttatgatctccagaacacccgaagtaacctgcgtcgtcgtcgacgtatcccacgaagaccccgaagttaaattcaactggtacgtcgacggagtcgaagtacacaatgccaaaaccaaaccacgcgaagaacaatacaactcaacctaccgtgtcgtatccgtcctcacagtgctccaccaagactggctcaacggcaaagaatacaaatgcaaagtctccaacaaagctctcccagccccaatcgagaaaaccatatccaaagccaaaggacagccccgcgaaccccaagtatacacccttcccccatgccgcgacgaactcaccaaaaaccaagtatcactctggtgcctagtcaaaggcttctatccctccgacatcgcagtcgaatgggaatccaacggccaacctgaaaacaactacaaaactacacccccagtcctcgactcagacggctccttcttcctatacagcaaactaaccgtagacaaatcccgatggcaacaaggaaacgtcttctcctgcagcgtcatgcacgaagcactccacaaccactacacccaaaaatcactctctctctctcccggcaaa

SEQ ID NO: 54416 - RNA, 639 nt, synthetic construct
  misc_feature 1..639: note = derived and/or modified sequence opt11 from Vanucizumab_LightChain1
  source 1..639: mol_type = other RNA
caacccggactcacccaacccccatctgtctccgttgcccccggccaaacagcccgcatcacctgcggcggcaacaacatcggctccaaatccgtccactggtaccaacaaaaacccggccaagcccccgtcctcgtcgtctacgacgactccgaccgcccatccggcatccccgaacgcttctcaggttccaactccggcaacaccgccaccctcaccatatcacgcgtcgaagccggcgacgaagccgactactactgtcaagtctgggactcctcctccgaccactacgtattcggaaccggaaccaaagtcacagtcctatcctccgcctccaccaaaggcccctccgtcttcccactcgccccctcttccaaatccacctccggcggcacagccgccctcggctgcctcgtcaaagactacttccccgaaccagtcaccgtctcctggaactccggcgccctcacctccggcgtacacaccttccccgccgtcctccaatcatccggcctctactcactatcctccgtagttaccgtcccctcctcatcactaggcacccaaacctacatctgcaacgtcaaccacaaaccctccaataccaaagtcgacaaaaaagtcgaacccaaatcctgc

SEQ ID NO: 54417 - RNA, 642 nt, synthetic construct
  misc_feature 1..642: note = derived and/or modified sequence opt11 from Vanucizumab_LightChain2
  source 1..642: mol_type = other RNA
gacatccaaatgacccaatccccctcatccctatccgcctccgtcggcgaccgcgtaaccataacctgctccgcttcccaagacatctctaactacctcaactggtaccaacaaaaacccggaaaagcccccaaagtcctcatctacttcacctcctccctccactccggcgtcccatcccgcttctccggctccggctccggcacagacttcaccctcaccatctcctccctccaacccgaagacttcgccacctactactgccaacaatactccaccgtcccctggaccttcggccaaggcaccaaagtcgaaatcaaaagaacagtcgccgccccctccgtcttcatcttcccaccctccgacgaacaactcaaatccggcaccgcctccgtcgtctgcctcctcaataacttctacccccgcgaagccaaagtccaatggaaagtcgacaacgcactccaatccggcaactcccaagaatccgtcaccgaacaagactccaaagactccacctactcactatcctccaccctcaccctctccaaagccgactacgaaaaacacaaagtctacgcctgcgaagtcacccaccaaggcctctcctctcccgtcaccaaatccttcaacagaggcgaatgc

SEQ ID NO: 54418 - RNA, 1356 nt, synthetic construct
  misc_feature 1..1356: note = derived and/or modified sequence opt11 from Varlilumab_HeavyChain1
  source 1..1356: mol_type = other RNA
caagtccaactcgtagaatcaggcggcggcgtcgtccaacccggccgatcactacgacttagctgcgcagccagcggattcaccttctcatcctacgacatgcactgggtccgccaagcccccggaaaaggcctcgaatgggtcgcagtcatctggtacgacggatccaacaaatactacgccgactccgtcaaaggccgcttcactatctcccgcgacaacagcaaaaacaccctataccttcaaatgaactccctccgcgccgaagacaccgccgtctactattgcgccagaggctcaggaaactggggcttcttcgactactggggccaaggaaccctcgtaaccgtctcgtccgcctccaccaaaggcccctcagtcttccccctggcaccatcctcaaagtccacatccggaggaaccgccgccctaggctgccttgttaaagattacttccccgaaccggtcaccgtaagttggaactcaggcgctctcacctccggcgtacatacattccctgcagtactccagtcctcaggcctttactccctctcctccgtcgtaacagtaccctcctcctccctaggcacacaaacatacatatgcaacgtcaaccacaagccatcaaacaccaaagttgacaagaaagtcgaaccaaaatcctgcgacaaaacccacacctgtcccccatgcccagcccccgaactactcggcggcccatccgtcttcctcttcccacccaaacccaaagacaccctgatgatctcacgcacacccgaagttacctgcgtcgtcgtcgacgtatcccacgaagaccccgaagtcaaattcaactggtacgtcgacggcgtcgaagtacacaacgccaaaaccaaaccccgagaggaacaatacaactccacataccgtgtcgtctccgtcctcactgtactccaccaagactggcttaacggaaaagaatacaaatgcaaggtatctaacaaagccctcccagcacccatcgagaaaaccatctccaaagccaagggccaaccccgagaacctcaagtctacacactcccaccctcccgtgacgaactcaccaaaaatcaagtatcactaacctgcctcgtcaaaggcttctacccatctgacatagccgtcgaatgggaatcaaacggccaacccgaaaacaactacaaaaccacaccaccggtcctcgacagcgacggttccttcttcctctactccaaactcaccgtagacaaaagccgctggcaacaaggaaacgtcttcagctgcagcgtcatgcacgaggccctacacaaccactacacccagaaatccctatccctaagcccgggcaaaggttcttca

SEQ ID NO: 54419 - RNA, 642 nt, synthetic construct
  misc_feature 1..642: note = derived and/or modified sequence opt11 from Varlilumab_LightChain1
  source 1..642: mol_type = other RNA
gacatccaaatgacccaatccccctcctccctctccgcaagcgtcggcgaccgcgtaaccatcacgtgccgcgcctcccaaggcatctccagatggctcgcctggtaccagcaaaaacccgaaaaagcccccaaatccctcatctatgccgcctcctccctccaatccggcgtcccctccagattctcaggatcaggctccggcaccgacttcaccctcaccatcagctccctccaacccgaagacttcgccacctactactgccaacaatacaacacctacccccgcaccttcggccaaggaaccaaagtcgaaatcaaacgaacagtcgcagccccctccgtcttcatcttcccaccctccgacgaacaactcaaatccggcaccgcctccgtcgtctgcctcctcaacaacttctacccccgcgaagccaaagtacaatggaaagtcgataacgcactccaatccggcaactcacaagaatccgttaccgaacaagactccaaagactccacctactccctaagctccaccctcaccctctccaaagccgactacgaaaaacacaaagtctacgcctgcgaagtaacccaccaaggcctttcctcccccgtcaccaaatccttcaaccgcggcgaatgc

SEQ ID NO: 54420 - RNA, 1338 nt, synthetic construct
  misc_feature 1..1338: note = derived and/or modified sequence opt11 from Vatelizumab_HeavyChain1
  source 1..1338: mol_type = other RNA
caagtccaactccaagaatctggccccggcctcgtaaaaccaagcgaaacactaagcctaacatgcaccgtcagcggattcagcctaaccaactacggcatccactggatacgccagccacccggaaaaggactcgaatggctaggcgtaatttgggcccgaggctttaccaactacaactccgccctcatgtcccgcctaaccattagcaaagacaactctaagaaccaagtatccctcaaactctcctccgtaaccgccgccgacaccgccgtctactactgcgcaagagccaacgacggagtatactacgcaatggactactggggacaaggaaccttagtcaccgtctcctccgcttccacaaaaggcccctctgtcttccccctagcaccctgctcccgatccacatccgaatcgaccgcggccctaggctgcctcgtaaaagattacttccccgaacccgtcacagtctcctggaacagcggcgctctcacctccggagtccacaccttccccgccgtcctccaatcatccggactatacagcctatccagcgtagtcacagtcccctcatcctccctcggcaccaaaacttacacatgcaacgtagaccacaaacccagcaacaccaaagtcgataaacgggtcgaaagcaaatacggcccaccctgcccctcatgccccgcacccgagttcctaggcggaccatccgtcttcctcttcccgcccaaacccaaagacacactcatgatctcacgcacacccgaagtaacctgcgtcgtcgtcgacgtctcacaagaagacccagaagtacaattcaactggtacgtcgacggcgtcgaagtccacaacgccaaaaccaaaccaagggaagaacaattcaactccacctaccgcgtagtctcagtacttaccgtactccaccaagactggctcaacggcaaagaatacaaatgcaaagtatcaaacaagggcctgccctcatccatcgaaaagacaatttccaaagccaaaggtcaaccccgtgaaccccaagtctacaccctccctccctcacaagaagaaatgaccaaaaaccaagtatccctaacatgcctcgtcaaaggtttctacccctccgacatagccgtcgaatgggaatcaaacggccaacccgaaaacaattacaaaaccacaccccctgtcctagactcagacggctcctttttcctctactcccgactaaccgtcgacaaatcccgatggcaagaaggcaacgtcttctcctgctcggtcatgcacgaagccctccacaaccactatacccaaaagtccctttccctctccctaggcaaa

SEQ ID NO: 54421 - RNA, 639 nt, synthetic construct
  misc_feature 1..639: note = derived and/or modified sequence opt11 from Vatelizumab_LightChain1
  source 1..639: mol_type = other RNA
gacttcgtcatgacacaatcccccgccttcctatccgtcacccccggcgaaaaagtcaccatcacctgctccgcccaaagctccgtcaactacatccactggtaccaacaaaaacccgaccaagcccccaaaaaactcatctacgacacatccaaactcgcctccggagtcccctcccgcttctccggctcaggctccggcactgactacaccttcacaatctcctccctcgaagccgaagacgccgcaacctactactgccaacaatggaccaccaaccccctcaccttcggacaaggcaccaaagtcgaaatcaaacgcaccgtcgccgccccatccgtcttcatcttccccccctccgacgaacaactaaaatccggcaccgcctccgtcgtctgcctcctcaacaacttctacccccgcgaagccaaagtccaatggaaagtcgacaacgccctccaatccggcaactcccaagaatccgtcaccgaacaagactcaaaagactctacctactccctctcctccaccctcaccctctccaaagccgactacgaaaaacacaaagtatacgcctgcgaagtcacccaccaaggcctatcctcacccgtcaccaaatccttcaaccgcggcgaatgc

SEQ ID NO: 54422 - RNA, 1353 nt, synthetic construct
  misc_feature 1..1353: note = derived and/or modified sequence opt11 from Vedolizumab_HeavyChain1
  source 1..1353: mol_type = other RNA
caagtgcaactcgtccaatccggagcagaagtcaaaaaacccggtgcatccgtaaaagtatcatgcaaagggtccgggtacacattcacctcttactggatgcactgggtacgccaagcccctggccaacggctagaatggatcggcgagatagaccccagcgaatccaacacaaactacaaccaaaaattcaaaggccgcgtaaccctaaccgtcgacatttccgcctccacagcatacatggaactctcatccctacgctccgaagacacagccgtatactactgcgccagaggcggatacgacggctgggactacgccatcgactactggggtcaaggcacactcgtcaccgtctcaagcgcatctaccaaaggaccctccgtcttcccactcgccccctcctccaaatccacctccggcggcaccgccgccctcggatgcctcgtaaaagactacttcccagaacccgtaaccgtctcctggaactcgggcgccctcacatcaggcgtccacacattccccgccgtccttcaatcctcaggtctctactccctctcctcagtcgtaactgtcccctcgtcctcactcggcacacaaacctacatttgcaacgtcaaccacaaaccctcaaacaccaaagtcgacaaaaaagtggaacccaaatcatgcgacaaaacgcacacatgccccccttgcccggcacccgagctagctggagctccctccgtattcctcttcccacccaaacccaaagacaccctaatgatctcacgcacccccgaagtaacatgcgtcgtagtcgacgtatcacacgaagaccccgaagtcaaattcaactggtacgtagacggagtagaagtccacaacgccaaaaccaaaccacgagaagaacaatacaactcgacctaccgcgtcgtctccgtactcaccgtcctacaccaagactggctcaacggcaaagagtacaaatgcaaagtttccaataaagcactccccgccccaatcgaaaaaaccatctccaaagccaaaggccaacctcgcgaaccccaagtatacaccctcccaccctcccgcgacgaactcacaaaaaaccaagtcagcctcacctgcctagtcaaaggcttctacccatccgacatcgccgtcgaatgggaaagcaacggccagcccgaaaacaactacaaaaccaccccccccgtcctggattccgacggaagcttcttcctatactcaaaactcacagtcgacaaatcccggtggcagcaaggcaacgtcttctcatgctccgtcatgcacgaagccctccacaaccactacacccagaagtccctatccctctcacccggcaaa

SEQ ID NO: 54423 - RNA, 657 nt, synthetic construct
  misc_feature 1..657: note = derived and/or modified sequence opt11 from Vedolizumab_LightChain1
  source 1..657: mol_type = other RNA
gacgtcgtcatgacccaatcccccctatccctccccgtaacccccggcgaacccgcatccatctcctgccgctcctcccaatccctcgcaaaatcctacggcaacacctacctctcctggtacctccaaaaacccggccaatcaccccaactcctcatatacggcatctccaaccgcttctccggcgtccccgaccgattctcaggctccggctccggcaccgacttcacccttaaaatctcccgcgtcgaagccgaagacgtcggcgtatactactgcctccaaggcacccaccaaccctacaccttcggccaaggaaccaaagtcgaaatcaaacgcacagtcgccgccccctcagtcttcatcttccccccctccgacgaacaactaaaatctggcacagcctccgtcgtctgcctcctcaacaacttctacccccgcgaagccaaagtccaatggaaagtcgacaacgccctccaatccggcaactcccaagaatccgtcaccgaacaagactccaaagactccacatactccctctcttccacactcaccctctccaaagccgactacgaaaaacacaaagtctacgcctgcgaagtcacccaccaaggcctctcatcccccgtcaccaaatccttcaaccgcggcgaatgc

SEQ ID NO: 54424 - RNA, 1353 nt, synthetic construct
  misc_feature 1..1353: note = derived and/or modified sequence opt11 from Veltuzumab_HeavyChain1
  source 1..1353: mol_type = other RNA
caagtccaactacaacaatccggagccgaagtcaagaaacctggaagctccgtcaaagtatcctgcaaagcctccggctacacattcacctcatacaacatgcactgggtcaaacaagcacccggacaaggcctcgaatggatcggcgccatataccccggaatgggcgacacctcctataatcaaaaattcaaaggtaaagccaccctcaccgcagacgaaagcacaaacacagcctacatggaactctcaagcctccgttcagaagacacagccttctactactgcgcccgatcaacctattacggcggcgactggtattttgacgtatggggacaaggaaccactgtaaccgtctcttcggcctcaaccaaaggaccctccgtcttcccactagcgccatcctccaaaagcacatccggcggcacagcagccctcggctgcctcgtcaaagactacttccccgaacccgtcaccgtctcctggaactcaggcgccctcacctctggagtccacacctttcccgcagtcctacaatcctccggactctacagcctatcctccgtcgtaacagtcccctcatcctccctcggaacccaaacatacatctgcaacgtaaaccacaagccatccaacaccaaagtagacaagcgcgtagagcccaaatcctgcgacaaaacccacacctgtcccccatgccccgccccagaactactaggaggcccctccgtattcctattcccacctaagcccaaagacaccctaatgatctcccgcacacctgaagtcacttgcgtcgtcgtagacgtatcccacgaagacccagaagtaaaattcaactggtatgtagacggcgtcgaagtccacaacgcaaaaaccaaaccccgcgaagaacaatacaactcgacataccgagtagtcagcgtactaacagtactccaccaagactggctcaacggcaaagaatacaaatgcaaagtatccaacaaagccctacccgcaccaatagagaaaaccatatccaaagccaaaggccagccccgcgaaccccaagtttacaccctacccccatcccgcgaagaaatgaccaaaaaccaagtctcactcacatgcctcgtaaaaggcttctacccctccgacattgccgtcgaatgggaatcaaatggacaacccgaaaacaactacaaaacaacaccgcccgtactcgactccgacggctccttcttcctgtacagcaaactaaccgtcgacaaatcccgttggcaacagggcaacgtcttctcatgctccgtcatgcacgaagcccttcacaaccactacacccagaaaagcctttcactctcgccgggaaaa

SEQ ID NO: 54425 - RNA, 639 nt, synthetic construct
  misc_feature 1..639: note = derived and/or modified sequence opt11 from Veltuzumab_LightChain1
  source 1..639: mol_type = other RNA
gacatccaactcacccaatccccctcctccctatccgcctcagtcggcgaccgcgtcaccatgacctgccgcgcctcctcctccgtctcctacatccactggttccaacaaaaacccggcaaagcccccaaaccatggatctacgcaacctcaaacctcgcttccggcgtccccgtacgcttctccggctccggctccggcaccgactacaccttcaccatctcctccctccaacccgaagacatcgccacctactactgccaacaatggacctccaacccacccaccttcggcggcggcaccaaactcgaaatcaaacgaaccgtcgccgccccctccgttttcatcttcccaccctccgacgaacaactaaaatccggcaccgcctccgtcgtctgcctcctcaacaacttctacccccgcgaagccaaagtccaatggaaagtagacaacgccctccaatccggaaactcccaagaatccgttaccgaacaagactccaaagactccacctactccctctcctccaccctcaccctatccaaagccgactatgaaaaacacaaagtatacgcctgcgaagtcacccaccaaggcctctcctcccccgtcaccaaatccttcaaccgcggcgaatgc

SEQ ID NO: 54426 - RNA, 1359 nt, synthetic construct
  misc_feature 1..1359: note = derived and/or modified sequence opt11 from Vesencumab_HeavyChain1
  source 1..1359: mol_type = other RNA
gaagtacaactcgtcgaatccggcggcggccttgtccaacccggcggctccctccgactatcctgcgccgcaagcggcttcaccttctcaagctacgcgatgagctgggtccgccaagccccaggaaaaggcctcgaatgggtctcacaaatctcccccgcgggcggatacactaactacgccgactccgtcaaaggccgcttcaccatcagcgcggacacatccaagaacaccgcctaccttcagatgaactccctacgcgccgaagacaccgccgtctactattgcgccagaggcgaactcccctactaccgaatgagcaaagtcatggacgtgtggggccagggcaccctcgtcaccgtatcctccgcctccacaaaaggtccctctgtattccccctagcaccatcctcaaaatctacttccggcggtacagccgccctcggctgcctcgtaaaagactacttccccgaaccagtcacagtctcatggaactccggcgccctcaccagcggcgtccacaccttcccagccgtcctccaatcctccggactctacagcctctcctcagtagtcaccgtaccctcctcttctcttggcacgcaaacatatatctgcaacgtcaaccacaaacctagcaacaccaaagtagacaagaaagtcgaaccaaaatcctgcgacaaaacccacacctgtcccccatgcccagcccccgaactcctaggaggaccctccgtcttcctctttcccccaaaaccaaaagacaccctaatgatctcccgcacccccgaagtaacatgcgtcgtcgtagacgtctcccacgaagaccccgaagttaaattcaactggtacgtcgacggcgtcgaagtccacaacgccaaaaccaaaccccgcgaagaacaatacaactccacataccgagtcgtctccgtcctaacagtcctccaccaagactggctcaacggtaaagaatacaaatgcaaagtctcaaataaagccctacccgcaccaatagagaaaaccatctcaaaagctaaaggccaaccacgcgaaccccaggtctacaccctcccaccctcccgcgaagaaatgaccaaaaaccaagtctccctaacctgcctcgtcaaaggcttctaccccagcgatatagcagtcgaatgggaatcaaatggccaaccagaaaacaactacaaaaccactccacccgtcctagactccgacggatctttcttcctctactccaaactaacagtcgacaaatcacgatggcaacaaggcaacgtcttctcttgctccgtaatgcacgaagccctccacaaccactacacccagaaatccctatcgctatcaccaggaaaa

SEQ ID NO: 54427 - RNA, 642 nt, synthetic construct
  misc_feature 1..642: note = derived and/or modified sequence opt11 from Vesencumab_LightChain1
  source 1..642: mol_type = other RNA
gacatccaaatgacccaatccccctcctccctatccgcctccgtcggcgaccgcgtaaccatcacttgccgagcctcccaatacttctcctcctacctcgcctggtaccaacaaaaacccggcaaagccccaaaactcctcatctacggcgcctcctcccgcgcctccggcgtcccctcacgcttctccggctcaggctccggaaccgacttcacccttaccatctcctcactccaacccgaagacttcgccacctactactgccaacaatacctcggatccccacccaccttcggccaaggcaccaaagtcgaaatcaaacgcaccgtcgccgcaccctctgtcttcatcttcccaccctccgacgaacaactcaaaagcggcaccgcctccgtcgtctgcctcctcaacaacttctacccccgcgaagccaaagtccaatggaaagtcgacaacgccctccaatcaggcaactcccaagaatccgtcaccgaacaagactccaaagactcaacctactccctctcctccaccctaaccctctccaaagccgactacgaaaaacacaaagtctacgcctgcgaagtcacccaccaaggcctctcctcccccgtcaccaaatccttcaacagaggcgaatgc

SEQ ID NO: 54428 - RNA, 1338 nt, synthetic construct
  misc_feature 1..1338: note = derived and/or modified sequence opt11 from Visilizumab_HeavyChain1
  source 1..1338: mol_type = other RNA
caagtacaacttgtacaaagcggagccgaagtcaagaaacccggcgcctccgtcaaagtctcttgcaaagcatccggctataccttcatctcctacaccatgcactgggtccgccaagcccccggccaaggactagaatggatgggatacatcaaccctcgttccggctacacccactacaaccaaaaactaaaagacaaagccaccctcaccgccgacaaatccgcatccaccgcctacatggaactatcctccctccgcagcgaagacaccgccgtatactactgcgcccgctccgcatactacgactacgacggcttcgcctactggggacaaggcaccctcgtaaccgtctcttccgcatcaaccaaaggaccctccgtcttcccactcgctccctgctcccgctccacctcagaatcgacagccgccctcggctgcctagtcaaagactacttccccgaacccgtaaccgtcagctggaactctggcgccctcactagcggcgtccacacattccccgccgtcctgcaatcctctggcctctactcgctctcctccgtcgtcactgtaccctcctcaaacttcggcacccaaacctatacctgcaatgtcgaccacaaaccctccaacaccaaagttgacaaaaccgtcgaacgaaaatgctgcgtagaatgccctccctgcccagccccacccgcagccgccccctccgtcttccttttcccacccaaacccaaagacacccttatgatctcccgaacacccgaagtaacctgcgtcgtcgtcgacgtctctcacgaagaccctgaagtccaattcaactggtacgtcgacggcgtggaagtacacaacgccaaaaccaaacccagagaagaacaattcaactcaaccttccgagtcgtctcggtcctcaccgttgtccaccaagactggttaaacggcaaagaatacaaatgcaaagtttccaacaagggactacccgcacccatagagaaaaccatatcaaaaaccaaaggccaaccacgcgaaccccaagtatacaccctcccaccctccagagaagaaatgaccaaaaaccaagtctccctaacctgcctcgtaaagggcttctacccctcagacatcgcagtcgaatgggaatccaacggacaaccagaaaacaactacaaaaccacgcccccaatgctcgattcggacggctccttcttcctttactcaaaactcaccgtcgacaaatcacgatggcaacaaggaaacgtcttctcatgctccgtcatgcacgaagccctccacaaccactacacccaaaagtccctcagcctctccccctccaaa

SEQ ID NO: 54429 - RNA, 639 nt, synthetic construct
  misc_feature 1..639: note = derived and/or modified sequence opt11 from Visilizumab_LightChain1
  source 1..639: mol_type = other RNA
gacatccaaatgacccaatcaccctcctccctatccgcctcagtcggcgaccgcgtcaccatcacttgctccgcctcctcctccgtctcctacatgaattggtaccaacaaaaacccggcaaagcccccaaacgactcatctacgacacctccaaactcgcctccggcgtcccctcccgcttctcaggctccggttcaggcaccgacttcaccctcaccatctcctccctccaacccgaagacttcgccacctactactgccaacaatggtcctccaacccacccaccttcggcggcggcaccaaagtcgaaatcaaacgcaccgtcgccgccccctccgtcttcatcttccctccctcagatgaacaactaaaatccggcaccgcctcagtcgtctgcctactcaacaacttctacccccgcgaagccaaagtccaatggaaagtcgacaacgccctccaatccggcaattcacaagaatccgtcaccgaacaagactccaaagactccacctactcactctcctccaccctcaccctatccaaagccgactacgaaaaacacaaagtctacgcatgcgaagtcacccaccaaggcctctcctcccccgtcaccaaatccttcaaccgcggcgaatgc

SEQ ID NO: 54430 - RNA, 1353 nt, synthetic construct
  misc_feature 1..1353: note = derived and/or modified sequence opt11 from Volociximab_HeavyChain
  source 1..1353: mol_type = other RNA
caagtccaactcaaagagtccggccccggcctagtagccccaagccagtccctcagcataacctgcaccatctccggattctccctcacagactacggcgtccactgggtcagacaacccccaggcaaaggcctcgaatggctagtagtcatctggtcagacggctcctcaacatacaactctgccctcaagtccagaatgacaatccgaaaagacaactccaaatcccaagtcttcctaatcatgaactcactccaaaccgacgactcagccatgtactactgcgctcgccacggcacatactacggcatgaccactacaggcgacgccctcgactactggggccagggcactagcgttaccgtctcctccgcctccaccaaaggcccatccgtcttcccactagccccctgcagccgctcaacctccgaaagcacagccgccctcggatgcctagtcaaggattacttccctgaacccgtgaccgtctcctggaactccggagccctaaccagcggcgtacacaccttcccagctgtcctccagtcctcgggcctctactccctatcctcagtagtcaccgtcccttcatcctccctcggaaccaaaacatacacatgcaacgtcgaccacaaaccatccaacacaaaagtagacaaacgcgtcgaatccaaatacggcccaccctgcccctcctgccccgcccccgagttcctcggcggaccctccgtcttcctatttccacccaaacccaaagacacactcatgatctcgcgcacccccgaagtcacatgcgtcgtcgtagacgtgtcccaagaagaccccgaggtccaattcaactggtacgtcgacggcgtcgaagtccacaacgccaaaacaaaaccccgcgaagaacaattcaactcaacttaccgcgtagtctcagtcctcaccgtactccatcaagactggctaaacggcaaagaatacaaatgcaaagtttcaaacaaaggcctgccctcgagcatcgagaaaacaatctccaaggccaaaggccaaccccgcgaaccccaagtatacaccctcccaccctctcaagaagaaatgaccaaaaatcaggtttccctaacctgcctcgtcaagggcttctacccctccgacatcgcagtcgaatgggaaagcaacggccaaccagaaaacaactacaaaaccacacccccggtcctggactccgacggcagcttcttcctatactcccgcctcacagtagacaagtcccgctggcaggaaggcaacgtcttctcttgctcagtcatgcacgaggcccttcacaaccactacacccaaaagtccctatccctatccctcggcaaa

SEQ ID NO: 54431 - RNA, 645 nt, synthetic construct
  misc_feature 1..645: note = derived and/or modified sequence opt11 from Volociximab_LightChain
  source 1..645: mol_type = other RNA
caaatcgtcctcacacaatcccccgccataatgtccgcctccctcggcgaacgagtcaccatgacctgcaccgcctccagctccgtatcatccaactacctccactggtaccaacaaaaacccggctccgcccccaacctctggatctactccacctccaacctcgcctccggcgtacccgcccgcttctccggctccggctccggcacctcctactccctcaccatctcctccatggaagccgaagacgccgccacctactactgccaccaatacctccgctcaccccccaccttcggcggcggaaccaaactcgaaataaaacgcaccgtcgccgccccctccgtcttcatcttccccccatccgacgaacaactcaaatccggcaccgcctccgtagtatgcctcctaaacaacttctacccccgcgaagccaaagtccaatggaaagtcgacaacgccctccaatccggcaactcacaagaatccgtcaccgaacaagactcaaaagactccacctactccctctcctcaaccctaaccctctccaaagcagactacgaaaaacacaaagtctacgcctgcgaagtaacccaccaaggcctctcctcccccgtaaccaaatcattcaaccgcggcgaatgc

SEQ ID NO: 54432 - RNA, 1344 nt, synthetic construct
  misc_feature 1..1344: note = derived and/or modified sequence opt11 from Vorsetuzumab_HeavyChain1
  source 1..1344: mol_type = other RNA
caagtccaactcgtacaatccggagccgaagtcaagaaacccggcgcctccgttaaagtcagctgcaaagctagcggctacaccttcacaaactacggcatgaactgggtccgccaagccccaggccaaggcctaaaatggatgggctggataaacacatacaccggcgaacccacctacgcagacgcattcaaaggccgcgtcactatgacccgcgacacctcaatatcaacagcctacatggaactctcaagactacgctccgacgacaccgcggtctactactgcgcccgagactacggagactacggcatggactactggggccaaggaaccacagtcaccgtctcctccgcatcaaccaaaggaccctcggtcttccccctcgccccatcctccaaaagcacctccggcggcaccgccgcccttggctgcctagtaaaagactactttccagaacccgtcactgtctcctggaactccggggcactcacatccggagttcataccttccccgccgtcctacaatcctccggcctctactctcttagctccgtcgtcactgtcccaagctcatcactcggcacccaaacttacatatgcaacgtcaaccataaaccctccaataccaaagtcgacaagaaagtcgaaccaaaatcatgcgacaaaacacatacctgcccaccctgccccgcccccgaactactaggcggcccctccgtcttcctattcccacctaaacccaaagacaccctcatgatcagccgcaccccagaagtcacatgcgtcgtcgtagacgtctcacacgaagacccagaagtaaaattcaactggtatgtcgacggcgtagaagtccacaacgctaaaacaaaacctcgagaagaacaatacaactccacctaccgcgtcgtatctgtcctcaccgtcctacaccaagactggctcaacggcaaagaatacaaatgcaaagtctccaacaaagcactgcccgcacccattgagaaaactatctccaaagctaaaggccaaccccgcgaaccacaggtctacaccctacctccctcccgagacgaactaaccaaaaaccaagtatcactgacctgcctcgtcaaaggcttctacccaagcgacatagcggtcgaatgggaaagcaacggccaaccagaaaacaactacaaaacaaccccacccgtcctcgactccgacggctcattcttcctctacagcaaactcacagtcgacaagtcgcgatggcaacaaggcaacgtattctcatgcagcgtcatgcacgaagcgctccacaaccactacacacaaaaatcactctcactcagccccggaaaa

SEQ ID NO: 54433 - RNA, 654 nt, synthetic construct
  misc_feature 1..654: note = derived and/or modified sequence opt11 from Vorsetuzumab_LightChain1
  source 1..654: mol_type = other RNA
gacatcgtcatgacccaatcacccgactccctcgccgtaagcctaggcgaacgcgccaccatcaactgccgcgcctccaaatccgtcagcacatccggctactccttcatgcactggtaccaacaaaaacccggccaaccccccaagctcctcatctacctagcctccaacctcgaaagcggcgtccccgaccgcttctcaggctccggctccggcaccgacttcaccctaaccatctcctccctccaagccgaagacgtagccgtctactactgccaacactcacgcgaagtcccctggaccttcggccaaggcaccaaagtcgaaatcaaacgcaccgtcgccgccccctccgtcttcatattcccaccctccgacgaacaactaaaatccggcaccgcctccgtcgtatgcctcctcaacaacttctacccccgcgaagccaaagtccaatggaaagtcgacaacgcactccaaagcggaaactcccaagaatccgtcaccgaacaagacagcaaagactccacctactccctctcctccacactaaccctcagcaaagccgactacgaaaaacacaaagtctacgcctgcgaagtcacccaccaaggcctctcctcccccgtcacaaaatccttcaaccgcggcgaatgc

SEQ ID NO: 54434 - RNA, 1344 nt, synthetic construct
  misc_feature 1..1344: note = derived and/or modified sequence opt11 from Vorsetuzumab_mafodotin_HeavyChain1
  source 1..1344: mol_type = other RNA
caagtacagctagtccaatccggcgccgaagtcaagaaacccggcgcctcagtaaaagtctcctgcaaagcatcaggctacacattcactaactacggcatgaactgggtcagacaagcacccggccaaggcctaaaatggatgggatggatcaacacctacactggcgaaccaacatacgccgacgcattcaaaggccgcgtaaccatgacccgcgacacatccatttcaaccgcatacatggaactctcacgcctccggagcgacgacacagccgtctactactgcgcccgcgactacggagactacggcatggactactggggccaaggcacgaccgtcaccgtatcctccgcgtcaaccaagggcccatccgtattccccctagccccctcatcaaaatctacctccggaggcacagccgcactaggctgcctcgtaaaggactacttccccgaacccgtcaccgtatcctggaactccggagccctaacctccggcgtccacactttccccgccgtactccaatcaagcggcctatactcactctcctctgtcgtcaccgtcccttcatcctccctaggcacccaaacatacatctgcaacgtcaaccacaaaccctccaacacaaaagtcgacaagaaagtagaacccaaatcctgcgacaaaacccacacctgtcctccctgccccgcccccgaactactcggcggcccctcagtcttcttattcccacccaaacccaaagacacgctcatgataagccgcaccccagaagtaacctgcgtcgtcgtcgatgtatcccacgaagaccctgaggtcaaattcaactggtacgtcgacggagtcgaagtccacaacgcaaaaaccaaaccccgcgaagaacaatacaactccacctaccgagttgtctccgtcctcaccgtattacaccaagactggctcaacggcaaagaatacaaatgcaaagtctccaacaaagctctccccgcacccatcgagaaaaccatatccaaagccaaaggacaaccccgagaaccccaagtatacaccctaccacccagccgcgacgaactcaccaaaaatcaagtatccctgacctgcctcgtcaaaggcttctacccatcagacatagccgtagaatgggaatcaaacggccagccagaaaacaactacaaaaccacccctccagtcctagactcagacggttcattcttcctctactccaaactaaccgtcgataaatcccgttggcaacaaggcaacgtcttctcgtgctccgtcatgcacgaagccctgcacaaccactatacacaaaaatcactctcactctcccccggaaaa

SEQ ID NO: 54435 - RNA, 654 nt, synthetic construct
  misc_feature 1..654: note = derived and/or modified sequence opt11 from Vorsetuzumab_mafodotin_LightChain1
  source 1..654: mol_type = other RNA
gacatcgtaatgacacaatcacccgactccctagccgtgagcctaggcgaacgcgcaaccataaactgccgagcaagcaaaagcgtatccacaagcggatactcgttcatgcactggtaccaacaaaaacccggacaaccacccaaactcctgatctacctagcatccaacctcgaaagcggagtcccagacagattctcaggctcaggctcgggcacagacttcaccctaaccataagctcactccaggccgaagacgtagccgtctactactgccaacactcacgcgaagtcccatggacattcggacaagggaccaaagtcgaaatcaaacgcacagtcgcagccccaagcgtattcatattcccaccctcagacgaacaactaaaatcaggcacagcctcggtcgtatgcctgctcaacaacttctacccacgcgaagccaaagtccaatggaaagtcgacaacgcactccaatccggaaactcacaagaaagcgtaaccgaacaagacagcaaagactcgacctacagcctgagctcaaccctgaccctaagcaaagccgactacgaaaaacacaaagtatacgcgtgcgaagtcacacaccaaggactaagctcccccgtaaccaagagcttcaacaggggcgaatgc

SEQ ID NO: 54436 - RNA, 1347 nt, synthetic construct
  misc_feature 1..1347: note = derived and/or modified sequence opt11 from Yttrium_(90Y)_clivatuzumab_tetraxetan_HeavyChain1
  source 1..1347: mol_type = other RNA
caagtccaactacaacaatcgggcgccgaagtaaagaaacccggcgcctcagtcaaagtctcctgcgaagcatccggatacaccttcccctcctacgtcctccactgggttaaacaagcccccggacaaggactagaatggataggatacatcaacccctacaacgacggaacccaatacaacgaaaaattcaaaggaaaagccaccctcacccgcgacacctccatcaacacagcatacatggaactatcccgactccgctccgacgacaccgccgtttactactgcgcgagaggcttcggcggatcatacggattcgcctactggggccaaggcaccctagttacagtctcctccgcctcaaccaaaggcccctccgtctttcccctcgccccctcctccaaatccacctccggcggcacagccgcgctcggctgcctagtaaaagactacttccccgagcccgtcaccgtctcctggaactcaggcgcgctcacaagcggagtccacaccttccccgcagtactccaatcctcaggcctctactccctttcctcagtcgtaaccgtcccctcctcctcgctcggaacccaaacctacatctgcaacgtcaaccacaaaccctccaacacaaaagttgacaaacgagtagaaccaaaaagctgcgacaaaacccacacatgcccaccctgccccgccccagaactactcggcggaccttccgtattcttattcccacccaaacctaaagacacacttatgatctcccgaacacccgaagtaacctgcgtcgtagtcgacgtctcacacgaagaccccgaagtcaaattcaattggtacgtagacggcgtcgaagtgcacaacgcaaaaaccaaaccacgcgaagaacaatacaactcaacctaccgcgtcgtctccgtcctcacagtcctccaccaagactggctaaacggtaaagaatacaaatgcaaagtatcaaacaaagccctaccagcccccatagagaaaaccatctcaaaagccaaaggtcaaccacgcgaaccccaggtttacaccctcccgccctcccgagaggaaatgaccaaaaaccaagtctccctcacatgcctcgtcaaaggattctacccctccgacatcgcagtggaatgggagtctaacggccaacccgaaaacaactacaaaacaaccccacccgtcctcgactcagacggcagcttcttcctatactccaagctaaccgtagacaaatcacgatggcaacagggcaacgtcttctcctgctcagtcatgcacgaagcactccacaaccactacacacaaaaatccctcagcctatcacccggaaaa

SEQ ID NO: 54437 - RNA, 645 nt, synthetic construct
  misc_feature 1..645: note = derived and/or modified sequence opt11 from Yttrium_(90Y)_clivatuzumab_tetraxetan_LightChain1
  source 1..645: mol_type = other RNA
gacatacaactcacccaatccccctcttccctttccgcctccgtcggagaccgagtcaccatgacctgctcagcctcctcctccgtatcctcctcctacctctattggtaccaacaaaaacccggcaaagcccccaaactctggatctactccacctccaacctagcctccggcgtacccgcccgtttctcaggatccggctccggcaccgacttcaccctcaccatctcctccctccaacccgaagactccgcctcctacttctgccaccaatggaaccgctacccctacaccttcggcggcggcacccgcctcgaaatcaaacgaaccgtagccgccccctccgtcttcatcttcccaccctcagacgaacaactcaaatccggcaccgcctccgtcgtctgcctcctaaacaacttctaccccagagaagcaaaagtccagtggaaagtcgacaacgccctccaatcgggcaactcccaagaatctgtaaccgaacaagactccaaagactccacatactccctctcctccaccctcaccctatccaaagccgactacgaaaaacacaaagtctacgcctgcgaagtcacacaccaaggcctatcatcacccgtcaccaaatcattcaaccgaggcgaatgc

SEQ ID NO: 54438 - RNA, 1338 nt, synthetic construct
  misc_feature 1..1338: note = derived and/or modified sequence opt11 from Yttrium_Y_90_epratuzumab_tetraxetan_HeavyChain1
  source 1..1338: mol_type = other RNA
caagtccaacttgtccaatcaggcgccgaagtcaagaaacccggttcctccgtcaaagtatcatgcaaagcctctggctacacattcacttcctactggctacactgggtacgccaagcccccggccaaggcctagaatggataggatacatcaacccccgcaacgactacaccgaatacaaccaaaacttcaaagacaaagccacaatcaccgcagacgaatccacaaacacagcttacatggaactctcatcacttcgctccgaagacacggcattctacttctgcgcccggagagacataaccaccttctactggggccaaggaaccacagtcaccgtcagctcagcctcaaccaaaggacccagcgtcttccccctcgcaccaagctcaaaatcaacctcaggcggcaccgccgccttaggctgcctcgtaaaagactacttccccgaacccgtcaccgtctcctggaactccggcgcactaacatccggcgtacacaccttccccgcagtcctccaatcctccggcctgtactccctctcctcagtcgtcaccgtccccagcagctcactcggcacacaaacatacatatgcaacgtcaaccacaaaccctccaacactaaagtagacaaacgggtagaaccaaaatcctgcgacaaaacccacacatgcccaccctgcccagccccagaactcctaggcggaccatcagtattcctcttcccacccaaacccaaagacacgctgatgatctcccgcacccccgaagtaacatgtgtcgtcgtcgacgtatcacacgaagaccctgaagttaaattcaactggtacgtcgacggcgtagaagtccacaacgcaaaaaccaaaccccgcgaggagcaatacaactcaacttaccgcgtcgtctcagtactcacagtcctacaccaagactggctaaacggcaaagaatataaatgcaaagtctccaacaaagccctcccagctccaatagaaaagaccatctccaaagccaaaggccaacccagagaaccacaagtatacaccctacccccatcaagagaagaaatgaccaaaaaccaagtcagcttaacctgcctcgtaaaaggcttctacccctccgacatcgcagtagaatgggaatccaacggacaacctgaaaacaactacaaaacaaccccacccgtactcgattccgacggttcattcttcctctactccaaactcaccgtcgacaaatcccgctggcaacaaggcaacgtcttcagctgctcagtcatgcacgaagcactacacaaccactacacccaaaaatccctctccctatcccccgggaaa

SEQ ID NO: 54439 - RNA, 657 nt, synthetic construct
  misc_feature 1..657: note = derived and/or modified sequence opt11 from Yttrium_Y_90_epratuzumab_tetraxetan_LightChain1
  source 1..657: mol_type = other RNA
gacatccaactcacacaatccccctcctcactctccgcctccgtcggcgaccgagtcacaatgtcctgcaaatcctcccaatccgtcctatactcagccaaccacaaaaactacctcgcatggtatcaacaaaaacccggcaaagcccccaaacttctcatctactgggcctccacccgcgaatccggcgtcccctcccgcttctcaggctctggctccggcaccgacttcactttcaccatctcctccctccaacccgaagacatcgccacctactattgccaccaatacctctcctcatggaccttcggcggcggcaccaaagtccaaatcaaacgcaccgtcgccgccccctccgtcttcatcttccccccctcagacgaacaactcaaatccggcaccgcctccgtcgtctgcctactaaacaacttctacccccgcgaagccaaagtccaatggaaagtcgacaacgccctccaatcaggaaactcccaagaatctgtcaccgaacaagactccaaagactccacctactccctctcctctaccctcaccctctcaaaagccgactacgaaaaacacaaagtctacgcctgcgaagtcacccaccaaggcctctcctcccccgtcaccaaatccttcaaccgcggcgaatgc

SEQ ID NO: 54440 - RNA, 1326 nt, synthetic construct
  misc_feature 1..1326: note = derived and/or modified sequence opt11 from Yttrium_Y_90_epratuzumab_HeavyChain1
  source 1..1326: mol_type = other RNA
caagtccaactcgtccaatccggagcagaagtcaaaaagcccggctcctccgttaaagtctcctgcaaagcatcaggctacaccttcacctcctactggctccactgggtccgccaagcccccggacagggcctagaatggatcggctacatcaacccccgcaacgactacaccgaatacaaccaaaacttcaaagacaaagccacaatcaccgccgacgaatcaaccaacacagcctacgaactatcctccctacgatcagaagacaccgccttctacttttgcgcccgacgcgacatcaccaccttctactggggacaaggaactaccgtaaccgtcagctcagcatcaactaaaggacccagcgtcttcccactcgccccatcctccaaatcaacctccggcggcaccgccgcccttggatgcctcgtaaaggactacttcccggaacccgtcaccgtctcctggaactccggcgcactaacctccggtgtacacacattccccgccgtcctacaaagctccggcctgtactccctctccagcgtcgtcaccgtcccctcctcctcactcggaacccaaacctatatctgcaatgtaaaccacaaaccctccaacaccaaagtagacaaacgcgtcgaaccaaaatcctgcgacaaaacacatacctgcccaccctgccccgcccccgaactactcggtggtccctccgtattcctctttccccctaaacccaaagacactctaatctcacgcacccccgaagtaacctgcgtcgtcgtcgacgtatcccacgaagatcccgaagtcaaattcaactggtacgtagacggtgtcgaagtccacaacgccaaaaccaaaccccgcgaagaacaatacaactccacataccgcgttgtctccgtcctaacagtcctccaccaagactggcttaacgggaaagaatacaagtgcaaagtcagcaacaaagcactacccgcccctatagagaaaacaatatctaaggccaaaggccaaccccgcgaaccacaagtctacaccctcccaccctcccgggaagaaacgaaaaaccaagtctccctaacctgcctagtcaaaggattctacccctcagatatcgccgtagaatgggaatccaacggccaacccgaaaacaactacaaaaccacccctcccgtcctcgactccgacggctccttcttcctatactccaaactgacagtcgacaaatctcgctggcaacagggcaacgtcttctcctgctcagtacacgaagccctccacaaccactacacccaaaaatccctcagcctctcccccggcaaa

SEQ ID NO: 54441 - RNA, 654 nt, synthetic construct
  misc_feature 1..654: note = derived and/or modified sequence opt11 from Yttrium_Y_90_epratuzumab_LightChain1
  source 1..654: mol_type = other RNA
gatatccaactcacacaatccccctcctccctttccgcctccgtcggcgaccgcgtcacctcctgcaaatcctcccaatccgtcctttactcagccaaccacaaaaactacctcgcatggtaccaacaaaaacccggcaaagccccaaaactcctaatctactgggcctccacccgcgaatccggcgtcccctcccgcttctccggctccggctccggaaccgacttcaccttcacaatctcctcactccaacccgaagacatcgccacctactactgccaccaatacctatcctcatggaccttcggcggcggcaccaaagtacaaataaaacgcaccgtcgcagccccatccgtattcatattcccaccctccgacgaacaactcaaatccggcactgcatccgtcgtctgcctactaaacaacttctacccccgcgaagccaaagtccaatggaaagtcgacaacgccctccaatccggcaactcccaagaatccgtcaccgaacaagactccaaagactccacctactccctctcctccaccctcaccctttccaaagccgactacgaaaaacacaaagtctacgcctgcgaagtcacccaccaaggcctatcctcccccgtcacaaaatccttcaaccgcggcgaatgc

SEQ ID NO: 54442 - RNA, 1365 nt, synthetic construct
  misc_feature 1..1365: note = derived and/or modified sequence opt11 from Zalutumumab_HeavyChain1
  source 1..1365: mol_type = other RNA
caagtccaactcgtcgaaagcggcggaggcgtcgtccaacccggacgaagcctccgcctttcatgcgccgcatccggcttcaccttctccacctacggcatgcactgggtaagacaagcacccggcaaaggcctagaatgggtcgccgtcatctgggacgacggctcatacaaatactatggcgactccgttaaaggaagattcacaatctcccgagacaacagcaaaaacacactctacctccaaatgaactccctccgtgccgaggacaccgctgtatactactgcgcacgggacggcatcaccatggtccgcggcgtcatgaaagactacttcgattactggggccaaggaaccctagtcacagtttcatccgcctcaacaaaaggcccatccgtctttcccctagccccctcatccaaatccacatccggcggcacagccgcactcggctgcctagtaaaggactacttccctgagcccgtcaccgtgtcatggaactcaggagcactaacatccggcgtccataccttcccagccgtcctccaaagcagcggactctacagcctctcctcagtagtcacagtaccctcctcctcccttggcactcaaacctacatctgcaatgtcaaccacaaaccatcaaacacaaaagtcgacaaacgcgtcgaaccaaaatcatgcgacaaaactcacacatgtccaccatgtccagccccagaacttcttggcggaccatccgtcttcctctttccacccaaacccaaagacaccctcatgatctcccgcacacctgaagtaacctgcgtcgtcgtcgacgtctcccacgaagaccccgaagtcaaattcaactggtatgtcgatggagttgaagtccacaacgccaaaacaaaaccaagggaagaacagtataactctacctaccgagttgtgtccgtcctcaccgtactacaccaagactggctaaacggcaaagaatacaaatgcaaggtcagcaacaaagccctacccgcccccatcgaaaagaccatcagcaaagccaagggacaaccccgcgaaccccaagtctacaccctaccaccatcacgcgaagaaatgaccaaaaatcaagtctctctcacatgcctcgtcaaaggcttctacccatcagacatcgccgtcgagtgggaaagcaacggccaacccgaaaacaactacaaaacaaccccacccgtcctcgactccgacggatcctttttcctctactccaaactcaccgtcgacaaaagccgctggcaacaaggcaacgtcttctcctgctccgtcatgcacgaagccctacacaaccactatacccaaaaatccctctccctcagccccggcaaa

SEQ ID NO: 54443 - RNA, 642 nt, synthetic construct
  misc_feature 1..642: note = derived and/or modified sequence opt11 from Zalutumumab_LightChain1
  source 1..642: mol_type = other RNA
gccatccaactcacccaatccccctcctccctttccgcctccgtcggcgaccgcgtcaccataacctgccgcgcctcccaagacatctcctccgccctcgtatggtaccaacaaaaacccggaaaagcccccaaactcctcatctacgacgcctcctcactcgaatccggcgtcccctcccgcttctctggctcagaatcaggcaccgacttcaccctcaccatctcctccctccaacccgaagacttcgccacctactactgccaacaattcaactcctaccccctcaccttcggcggcggcaccaaagtcgaaatcaaacgcaccgtcgccgccccctccgtcttcatcttcccaccctccgacgaacaactcaaatccggcaccgcctccgtcgtctgcctcctcaacaacttctacccccgtgaagccaaagtccaatggaaagtcgacaacgcactccaatccggcaactcccaagaatccgtaaccgaacaagactccaaggactccacctactccctatcctccaccctcaccctatccaaagccgactacgaaaaacacaaagtatacgcctgcgaagtcacccaccaaggcctctcatcccccgtcaccaaatccttcaaccgcggcgaatgc

SEQ ID NO: 54444 - RNA, 1332 nt, synthetic construct
  misc_feature 1..1332: note = derived and/or modified sequence opt11 from Zanolimumab_H0_HeavyChain
  source 1..1332: mol_type = other RNA
caagtccaactacaacaatggggcgccggactactcaagccctccgaaaccctctcactaacatgcgcagtttacggcggctccttctctggttactactggtcctggatccgccaaccacccggaaaaggcctcgaatggatcggcgaaatcaaccactccggatccaccaactacaacccctcactcaaatcccgcgtcaccatatccgtcgacacctccaaaaaccagttctccctaaaactctcctccgtcaccgctgccgacaccgcagtctactactgcgcccgcgtcatcaactggttcgacccctggggacaaggcacactcgtcaccgtctcatccgcctccactaaaggcccctcagtcttccccctcgccccctcctccaaatccacctcaggaggcaccgccgcactaggctgcctagtcaaagactacttccccgaaccagtcaccgtctcttggaactcaggggccctaacctccggagtccacaccttccccgccgtactacaatcatcaggactatactctctctcatcgtggacagtcccatcatcatccctcggcacccaaacctacatatgcaacgtcaacttcatcaaaccctccaacacaaaagtcgacaagaaagtcgaaccaaaatcatgcgacaaaacccacacatgcccaccatgcccagcaccagaactcctcggaggcccctccgtcttcctcttcccacccaaacccaaagacaccctcatgatctctcgcacaccagaggtcacttgcgtctgggacgtctcccacgaggatcccgaagtcaaattcaactggtacgtcgacggagtagaagtccacaacgcaaaaaccaaaccccgagaagaacaatataactcaacctaccgcgtagtctccgtcctcacagtcctccaccaggactggctcaacggaaaagaatacaaatgcaaagtctccaacaaagccttacccgccccaatcgagaaaacaatctccaaagccaaaggacaaccccgcgaaccccaagtctacaccctcccaccatcacgcgaagaaatgaccaaaaaccaagtctcactcacatgcctcgttaaaggcttctacccatccgacatcgccgtagaatgggaatccaacggccaacccgaaaacaactacaaaaccactcccccagttctcgactccgacggatccttcttcctctactcgaaactcaccgtggacaaatcccgatggcaacaaggcaacgtattctcctgcagcgtcatgcacgaagccctccacaaccactacacccaaaaatctctctccctttcacccggcaaa

SEQ ID NO: 54445 - RNA, 642 nt, synthetic construct
  misc_feature 1..642: note = derived and/or modified sequence opt11 from Zanolimumab_L0_LightChain
  source 1..642: mol_type = other RNA
gacatccaaatgacccaatccccatcctccgtctcagcctccgtcggcgaccgcgtcaccatcacatgccgagcctcacaggacatctccagctggctagccgtcgtctaccaacacaaacccggcaaagcccccaaactcctcatctacgcagcctcttcactccaatccggcgtcccctcccgcttctccggctcaggctccggcaccgacttcaccctcaccatctcctccctccaacccgaagacttcgccacctactactgccaacaagccaactccttcccatacaccttcggcggaggcaccaaactcgaaatcaaacgcacagtcgccgccccctccgtcttcatcttcccaccctccgacgaacaactaaaatccggcaccgcctccgtcgtctgcctcctcaacaacttctacccccgcgaagccaaagtacaatggaaagtcgacaacgccctccaatccggcaactcccaagaatcagtcaccgaacaagactccaaagactccacctactcactctcctccaccctcaccctctccaaagccgactacgaaaaacacaaagtctacgcctgcgaagtcacccaccaaggcctttcctcacccgtcaccaaattcaaccgcggcgaatgc

SEQ ID NO: 54446 - RNA, 1344 nt, synthetic construct
  misc_feature 1..1344: note = derived and/or modified sequence opt11 from Zatuximab_HeavyChain1
  source 1..1344: mol_type = other RNA
caagtccaactccaacaacccggcgccgagctagtcgaacccggcggctccgtcaaactctcatgcaaagcctcaggctacacgttcacatcccactggatgcactgggtcaaacaacgccccggacagggcctggaatggatcggagaaatcaatccaagctcaggccgcaacaactacaatgaaaaattcaaatccaaggccaccctaaccgttgacaaatcgtcctccacagcctacatgcaattctcctcactcacctccgaagactccgcagtctactactgcgtacgctactacggctacgacgaagccatggactactggggccagggaacctccgtcacagtgtcctcagcctcaaccaaaggcccctccgtcttccccctcgccccctcatccaaatccaccagcggcggcaccgccgccctcggatgcctcgtgaaagactactttcccgaacccgtaacagtctcctggaacagcggcgccctaaccagcggagtacatacattccccgcggtcctacaatcctccggcctctactccctatcaagcgtagtaaccgtcccctcctcatcccttggaacccaaacttacatctgcaacgtaaaccacaaaccatcaaacaccaaagtcgacaaacgcgtcgaaccaaaatcgtgcgataaaacccacacatgcccaccctgccccgcccccgaactcctcggcggccccagcgtcttcctctttcccccaaaacccaaagacaccttaatgatctcccgaacccccgaagtcacatgcgtcgtcgtagacgtatcccacgaagacccagaagtcaaattcaactggtacgtcgacggcgtcgaggtccacaacgccaaaaccaaaccacgcgaggaacaatacaacagcacctaccgagtcgtctcagtactcaccgtgctacaccaagactggctcaacggcaaagaatacaaatgtaaagtctccaacaaagccctccccgcccccatcgagaaaaccatctcaaaagccaaaggccaaccacgcgaacctcaagtatacaccctaccaccctcccgcgaagaaatgaccaaaaaccaagtctctctaacttgcctcgtcaaaggattctaccccagcgacatagctgtcgaatgggaatccaacggccaacccgagaacaactataagaccacacccccagtactagactccgacggctccttcttcctgtactccaaactaaccgtagacaaatcccgctggcagcaaggcaacgtattcagctgctcagtcatgcacgaagccctacacaaccactacacccaaaaatccctatctctctcccccgga

SEQ ID NO: 54447 - RNA, 657 nt, synthetic construct
  misc_feature 1..657: note = derived and/or modified sequence opt11 from Zatuximab_LightChain1
  source 1..657: mol_type = other RNA
gacatcgtcatgacccaagccgccttctcaaaccccgtcaccctcggcacctcagcctccatctcctgccgcagctccaaatccctcctccactccaacggcatcacctacctctactggtacctccaaaaacccggacaatccccccaactcctaatctaccaaatgtccaacctcgcctccggagtacccgaccgattctcatcatctggctcgggcacagactttaccctacgcatcagccgagtcgaagccgaagacgtcggcgtctactactgcgcccaaaacctcgaactcccctacaccttcggcggcggcacaaaactcgaaatcaaacgcaccgtcgccgcccccagcgtcttcatcttccccccctccgacgaacaactcaaatccggcacagcctcagtcgtctgcctgctcaacaacttctacccccgcgaagccaaagtccaatggaaagtcgacaacgccctccaatccggtaactcccaagaatccgtaaccgaacaagactccaaagactcaacctactccctctcctcaaccctcaccctctccaaagccgactacgagaaacataaagtctacgcctgcgaagtcacacaccaaggcctatcctcacccgtcaccaaatcctttaaccgcggcgaatgt

SEQ ID NO: 54448 - RNA, 1356 nt, synthetic construct
  misc_feature 1..1356: note = derived and/or modified sequence opt11 from Actoxumab_HeavyChain
  source 1..1356: mol_type = other RNA
caagtccaactcgtcgaatcagggggcggcgtagtacaacccggccgctcacttcgcctctcatgcgcggcctccggcttcagcttctccaactacggaatgcactgggtccgccaagcccccggaaaaggactagaatgggtcgccctcatctggtacgacggctccaatgaagactacaccgactccgtcaaaggccggttcaccatatcccgtgacaactccaaaaacaccctatacctccaaatgaactccctccgcgccgaagacaccgccgtctactactgcgcacgttggggcatggtcagaggagtaatcgacgttttcgacatctggggacaaggaaccgtcgtaaccgtatccagcgcctcaaccaaaggaccctccgtattcccactagcacccagctccaaatccacctccggcggaaccgccgccctcggctgcctcgtaaaagactacttcccagaacccgtaaccgtatcctggaactccggagccctaaccagtggcgtccacacatttcccgcagtcctacagagctccggactctactccctatcatccgtcgtcaccgttccctcctcatccctcggcacccaaacatacatctgcaacgtaaaccacaaaccaagcaacacgaaagtggacaaacgcgtcgaacccaaatcatgcgacaaaacacatacctgcccaccctgccccgcccccgaactactcggcggcccctcagtattcctcttcccacccaaacccaaagacacactcatgatctcacgaacacccgaagtgacctgcgtcgtcgtcgacgtctcccacgaagaccccgaagtcaaattcaactggtacgttgacggagtcgaagtccacaatgcaaaaacaaaaccccgcgaagaacaatacaactcgacctaccgggtcgtctcagtcctcacagtcctccaccaagactggctcaacggaaaagagtacaaatgcaaagtatccaacaaagccctcccagcccccatagagaaaacaataagcaaagccaaaggacaaccacgcgaaccccaagtctacacactcccaccctcccgcgaagaaatgaccaaaaaccaagtctctctaacctgcctcgtgaaaggattctaccccagcgacatcgcagtcgagtgggaatccaacggacagccagaaaacaattacaaaaccacccctcccgtactagactccgacggctccttcttcctatactccaagctaaccgtcgacaaatcccgctggcaacaaggcaacgtcttctcctgctccgtaatgcacgaagccctccacaaccactacacccaaaagtccctcagcctcagccccggcaaa

SEQ ID NO: 54449 - RNA, 642 nt, synthetic construct
  misc_feature 1..642: note = derived and/or modified sequence opt11 from Actoxumab_LightChain
  source 1..642: mol_type = other RNA
gacatccaaatgacccaatccccctcctcagtctccgcctccgtcggcgaccgcgtcaccataacctgccgcgcctcccaaggcatctcctcatggctcgcctggtaccaacacaaacccggcaaagcccccaaactcctcatctacgccgcctcctccctacaatccggcgtcccctcccgcttctccggctccggctccggcaccgacttcaccctaaccatctcctccctccaacccgaagacttcgccacatactactgccagcaagccaactccttcccctggaccttcggacaaggcaccaaagtcgaaatcaaacgcaccgtcgcagcccccagcgtattcatcttcccaccctcagacgaacaactaaaatccggaaccgcctccgtcgtctgcctactcaacaacttctacccccgcgaagccaaagtacaatggaaagtcgacaacgccctccaatccggcaactcccaagaatccgtcaccgaacaagacagcaaagactccacctactctctctcatcaaccctaaccctctcaaaagccgactacgaaaaacacaaagtttacgcctgcgaagtcacccaccaaggcctctcctcacccgtcaccaaatccttcaaccgaggcgaatgc

SEQ ID NO: 54450 - RNA, 1326 nt, synthetic construct
  misc_feature 1..1326: note = derived and/or modified sequence opt11 from Andecaliximab_HeavyChain
  source 1..1326: mol_type = other RNA
caagtccaactacaagaatccggccccggcctcgtaaaaccctccgaaaccctctcccttacctgcaccgtctcaggcttcagcctcctatcctacggcgtacattgggtccgacaaccaccaggcaaaggcctagaatggctcggagtcatctggaccggcggcacaaccaattacaactccgccctcatgtcacgcttcaccatctccaaagatgactccaaaaacaccgtctaccttaaaatgaactccctcaagaccgaagataccgcaatttactactgcgctcgatactactacggcatggactactggggccaaggcacactcgtcaccgtaagcagcgcatcaaccaagggaccctctgtcttcccactcgcaccttgctcacgatccacctccgaaagcacagccgcccttggctgccttgtgaaagactacttccccgaaccagtcaccgtctcatggaactcaggagccctaacatcaggcgtccacaccttccccgctgtcctccaatccagcggcctctactcactatccagcgtcgtcaccgtaccatcctcttccctaggaaccaaaacctatacctgcaacgtcgaccacaaaccctccaatacaaaagtcgacaaacgagtcgaatccaaatacggacctccctgcccaccctgccccgcccccgagttcctcggcggcccctcagtcttcctcttcccacctaaacctaaagacacacttatgatatcccgtacccccgaagtaacctgcgtcgtcgtcgacgtctcccaagaagaccccgaagtccaattcaactggtacgtcgacggcgtcgaagtccacaacgcaaaaaccaaacccagagaagaacaattcaattccacataccgcgtcgtctcagtactcacagtcctccaccaagactggctcaacggcaaagaatacaaatgcaaagtatcaaacaaaggcctaccatcctccatcgaaaagaccatatcaaaagcgaaaggccaaccacgcgaaccacaagtctataccctccctccctcccaagaagaaatgaccaaaaaccaagtatcactaacctgcctcgtcaaaggcttctatccctcagatatcgccgtcgaatgggaaagcaacggccaacccgaaaacaactacaaaaccacacccccggtcctcgacagcgacggcagcttcttcctctactcccgcctcaccgtcgacaaatcacgatggcaagaaggcaacgttttctcatgcagcgtcatgcacgaagccctccacaaccactatacccaaaaatccctctccctatccctcgggaaa

SEQ ID NO: 54451 - RNA, 642 nt, synthetic construct
  misc_feature 1..642: note = derived and/or modified sequence opt11 from Andecaliximab_LightChain
  source 1..642: mol_type = other RNA
gacatccaaatgacccaatccccctcctccctctccgcatccgtcggcgaccgcgtaaccatcacatgcaaagccagtcaagacgtccgcaacaccgtcgcctggtaccaacaaaaacccggcaaagcccccaaactcctcatctactcctcctcctaccgcaacaccggcgtcccagaccgcttctcaggctccggctccggcaccgacttcaccctcaccatctcctccctccaagccgaagacgtcgccgtctactactgccaacaacactacatcaccccctacacattcggcggcggcaccaaagtcgaaatcaaacgcaccgtcgccgccccctccgtcttcatcttcccaccctccgacgaacaactaaaatccggcaccgcctccgtcgtctgcctactaaacaacttctacccccgcgaagccaaagtccaatggaaagtcgacaacgccctacaatccggtaactcccaagaatccgtcaccgaacaagactccaaagactccacctattccttatcctcaaccctaaccctctccaaagccgactacgaaaaacacaaagtatacgcctgcgaagtaacccaccaaggcctctcctcccccgtaaccaaatccttcaaccgcggagaatgc

SEQ ID NO: 54452 - RNA, 1353 nt, synthetic construct
  misc_feature 1..1353: note = derived and/or modified sequence opt11 from Aprutumab_HeavyChain
  source 1..1353: mol_type = other RNA
gaagtccaactacttgaaagcggcggaggtctcgttcaacccggcggctcactccgactctcctgcgccgcctcaggcttcaccttctcctcttacgccatgtcatgggtccgacaagccccaggcaagggactcgaatgggtctccgccatctccggctctggcacaagcacctattacgccgactccgtaaaaggccgcttcaccatcagccgcgacaactccaaaaacactctatacctccaaatgaactccctccgcgccgaagacaccgccgtctactactgcgcccgcgtccgctacaactggaaccatggcgactggttcgacccctggggacaaggcacactcgtcaccgtctcctccgcctccactaaaggcccctctgtcttccccctagctccatcatcaaaatccacctccggcggcaccgccgccctcggctgcctagtcaaggactacttcccagaacccgtcaccgtctcatggaacagcggcgcccttacctcaggcgtacacaccttccccgccgtccttcaatcatcgggcctctactccctctcatcagtcgtcacagtcccctcctcctcactaggcacccaaacatacatctgcaacgtcaaccacaaaccctccaacactaaagtagataagaaagtcgaacccaaaagttgcgacaaaacccacacatgccctccctgccccgcccccgaactcctcggaggcccttccgtctttctcttcccgcccaaacccaaagacacactgatgatctcccggacccccgaagtaacttgcgtcgtcgtcgacgtatcccacgaagaccccgaagtcaaattcaactggtacgtagacggagtagaagtccacaacgccaaaactaaaccacgcgaagaacaatacaactccacataccgagtcgtatcagtcctcaccgttctacaccaagactggctcaacggcaaagaatacaaatgcaaagtatcaaacaaagccctacctgcaccaatcgagaaaaccataagcaaagccaaaggccaaccccgcgaaccccaagtctacactcttcccccttcccgagacgaactcaccaaaaaccaagtatccctaacctgcctcgtcaaaggattctacccatccgacatcgccgtcgaatgggaaagcaacggccaacccgaaaacaactacaaaacaacaccacccgtccttgactcagacggatcattctttctatactccaaactaacagtcgataaatcaagatggcaacaaggcaacgtcttctcatgctctgtaatgcacgaagccctccacaaccactacacccaaaaatccctctccctctcccccggc

SEQ ID NO: 54453 - RNA, 648 nt, synthetic construct
  misc_feature 1..648: note = derived and/or modified sequence opt11 from Aprutumab_LightChain
  source 1..648: mol_type = other RNA
caatccgtcctcacccaacccccctcagcctccggcacccccggccaacgagtcacaatctcatgctccggctcctcctccaacatcggaaacaactacgtatcctggtaccaacaactccccggcaccgccccaaaactcctcatctacgaaaactacaaccgccccgcaggcgtacccgaccgattctccggctccaaatccggcacctccgcctccctagcaatctccggactacgctccgaagacgaagccgactactactgctcctcctgggacgactccctcaactactgggtattcggcggcggaaccaaactcaccgtactcggccaacccaaagcagccccctccgtcaccctattcccgccatcatccgaagaactacaagccaacaaagccaccctcgtatgcctcatatccgacttctaccccggcgccgtcaccgtcgcctggaaagccgactcctcccccgtcaaagccggcgtcgaaaccaccaccccctccaaacaatccaacaacaaatacgccgcctcctcatacctctccctcacccccgaacaatggaaatcccaccgctcctactcatgccaagtcacccacgaaggcagcaccgtcgaaaaaaccgtcgcacccaccgaatgctcc

SEQ ID NO: 54454 - RNA, 1341 nt, synthetic construct
  misc_feature 1..1341: note = derived and/or modified sequence opt11 from Azintuxizumab_HeavyChain
  source 1..1341: mol_type = other RNA
gaagtccaactcgtagaatccggaggcggactcgtccaaccaggcggctcccttcgtctaagctgcgcagcctccggattcaccttctcagactactacatggcctgggttcgtcaagcccccggcaagggcctcgaatgggtagcatccatcaattacgacggctcatccacctactacgtagactccgtcaaaggacgcttcaccatctccagagacaacgccaaaaactccctatacctccaaatgaactccctccgcgcagaagacaccgcagtatattactgtgcccgcgaccgcggctactacttcgactactggggccaaggtacaacagtcaccgtctcctcagcctcaaccaaaggcccctctgtcttccccctcgcaccatcctccaaatccacctcaggtggaaccgccgcactaggctgcctcgtaaaagactacttccctgaacccgtcaccgtctcctggaactccggagccctcacctccggagtacacaccttcccagcagtcctccaatcatccggactctactccctctcctctgtcgtgacagtcccaagcagctcactcggcacccaaacctacatctgcaacgtcaaccacaaaccctccaacaccaaagtagacaagaaagtcgaacccaaatcctgcgacaaaacccacacatgcccaccctgccccgcccccgaactcctcggcggcccctctgtctttctattccctcccaaacccaaagacaccctcatgatctcccgaacccccgaagtaacctgcgtcgtagtagacgtctcccacgaagaccccgaagtaaaatttaactggtacgtagacggcgttgaagtccacaacgccaaaactaaaccccgagaagaacaatacaactccacctaccgggtcgtatccgtactaacagtcctacaccaagactggttaaacggaaaagaatacaaatgcaaagtctccaacaaagcactccccgcccccatcgaaaagaccatatccaaagccaaaggccaaccccgcgaaccccaagtatacaccctaccaccctcacgcgaagaaatgaccaaaaaccaagtatccctgacctgcctcgtaaaaggcttctacccctccgacatcgccgtcgaatgggaatccaacggccaaccagaaaacaactacaaaaccacaccgcctgtcctagactccgatggatcctttttcctatactctaagctcaccgttgacaaatcccgctggcaacaaggcaacgtcttctcctgctccgtcatgcacgaagcactccacaaccactacactcaaaaatccttatccctctcccccggcaaa

SEQ ID NO: 54455 - RNA, 660 nt, synthetic construct
  misc_feature 1..660: note = derived and/or modified sequence opt11 from Azintuxizumab_LightChain
  source 1..660: mol_type = other RNA
gacgtcgtcatgacacaaacccccctctccctctccgtaacacccggccaacccgcctccatcagctgccgctcctcccaatccctcgtccactccaacggcaacacctaccttcactggtacctccaaaaacccggccaatccccccaactactcatctacaaagtctcaaaccgcttctccggcgtccccgaccgcttctccggctccggctccggcaccgacttcaccctaaaaatctcccgcgtcgaagccgaagacgtcggcgtatacttctgcagccaatccacccacgtcccccccttcaccttcggaggcggcaccaaagtcgaaataaaacgaaccgtcgccgccccctccgtcttcatcttcccaccctccgacgaacaactcaaatccggcaccgcctccgtcgtctgcctcctcaacaacttctacccccgagaagccaaagtccaatggaaagtcgacaacgccctccaatcaggaaactcacaagaatcagtcaccgaacaagactccaaagactccacctactccctctcctccaccctcaccctctccaaagccgactacgaaaaacacaaggtctacgcatgcgaagtcacccaccaaggcctatcctcccccgtcaccaaatccttcaaccgcggagaatgc

SEQ ID NO: 54456 - RNA, 366 nt, synthetic construct
  misc_feature 1..366: note = derived and/or modified sequence opt11 from Blinatumomab_HeavyChain1
  source 1..366: mol_type = other RNA
caagtgcaattgcaacagagcggggccgagctagtgcgcccgggctcgagcgtgaaaataagctgtaaagcgagcgggtacgcgttctcgagctattggatgaactgggtcaagcaaaggccagggcaagggctcgagtggataggccagatctggcccggggacggggacacgaactataacgggaaatttaaagggaaagcgaccttgaccgcggacgagagctcgagcacggcctatatgcagctctcgagcttggcctcggaagacagcgcggtctatttctgtgccaggcgcgagaccacgaccgtgggcaggtactattacgcgatggattactggggccagggcacgaccgtgaccgtg

SEQ ID NO: 54457 - RNA, 363 nt, synthetic construct
  misc_feature 1..363: note = derived and/or modified sequence opt11 from Blinatumomab_HeavyChain2
  source 1..363: mol_type = other RNA
gacatcaaactccaacaatccggcgccgaactcgcccgccccggcgcctccgtcaaaatgtcctgcaaaacctccggctacaccttcacccgctacaccatgcactgggtcaaacaacgccccggccaaggcctcgaatggatcggctacatcaacccctcccgcggctacaccaactacaaccaaaaattcaaagacaaagccaccctcaccaccgacaaatcctcctccaccgcctacatgcaactctcctccctcacctccgaagactccgccgtctactactgcgcccgatactacgacgaccactactgcctcgactactggggccaaggcaccaccctcaccgtctcctccgtcgaa

SEQ ID NO: 54458 - RNA, 1494 nt, synthetic construct
  misc_feature 1..1494: note = derived and/or modified sequence opt11 from Blinatumomab_LightChain_HeavyChain_HeavyChain_LightChain
  source 1..1494: mol_type = other RNA
gacatacagctaacccaatcacccgcaagcctagcagtcagcctgggccagcgcgccactataagctgcaaagcaagccaaagcgtagattacgacggcgactcgtacctgaactggtaccaacaaatcccaggccaaccacccaagctactcatctacgacgcaagcaacctcgtatccggcatcccaccccgattctcgggcagcggctcaggtacagacttcacactcaacatacacccagtcgaaaaagtcgacgcagccacataccactgccaacagtcaacagaggacccgtggacattcgggggagggaccaagctcgaaatcaaaggaggaggcgggagcgggggcgggggctcaggcgggggcgggagccaggtccagttacaacaatcaggcgcggaactcgtgcgacccggaagctcggttaaaatctcatgtaaggcatcaggctacgccttctcctcctactggatgaactgggtaaaacaacgacccggccaaggcctagaatggataggacaaatatggccaggcgacggcgacaccaactacaacggcaagttcaaaggaaaagccacactaaccgccgacgaaagcagctcgaccgcatacatgcaattgtcctcactagcaagcgaggattcagccgtatacttctgcgcccgcagggaaacaaccaccgtaggacgatactactacgccatggactactggggccaagggaccacagtcacagtctcaagcggcggcggaggctcggacataaaactacaacagagcggagcagaattagcgcgcccgggagcgagcgtaaaaatgagctgcaaaactagcgggtatacattcacccgctacacaatgcactgggtcaagcaaaggcccggacaaggactcgaatggataggctatatcaacccctcacgaggatacacaaactacaaccaaaaattcaaagacaaagccacactaaccacagacaagagctcgagcacggcatacatgcaactctcatcactcacctcggaagacagcgcggtctactactgcgcccgatactatgacgatcactactgcctggactactggggacaaggaacaacactcacagtctcgagcgtagaaggaggctcgggcggaagcggaggctcaggcggaagcggaggcgtggacgacatacaactaacgcaatcaccagcgatcatgagcgcaagcccaggcgaaaaagtaacgatgacctgtcgagcaagctcatccgtaagttacatgaactggtaccagcaaaaatcaggcacaagccccaaaagatggatatacgacacctcgaaagttgcctcgggcgtcccataccgcttctccggtagcggaagcggaacctcatactcacttacgatctcatcgatggaagcagaagacgccgcgacctactattgccaacaatggagcagcaatcccctaacattcggagcgggtacaaaactggaactgaaa

SEQ ID NO: 54459 - RNA, 333 nt, synthetic construct
  misc_feature 1..333: note = derived and/or modified sequence opt11 from Blinatumomab_LightChain1
  source 1..333: mol_type = other RNA
gacatccaactcacccaatcccccgcctccctcgccgtctccctcggccaacgcgccaccatctcctgcaaagcctcccaatccgtcgactacgacggcgactcctacctcaactggtaccaacaaatccccggccaaccccccaaactcctaatctacgacgcctccaacctcgtctccggcatccccccccgcttctcaggctccggctccggcaccgacttcaccctcaacatccaccccgtcgaaaaagtcgacgccgccacctaccactgccaacaatccaccgaagacccctggaccttcggcggcggcaccaaactcgaaatcaaa

SEQ ID NO: 54460 - RNA, 324 nt, synthetic construct
  misc_feature 1..324: note = derived and/or modified sequence opt11 from Blinatumomab_LightChain2
  source 1..324: mol_type = other RNA
gtcgacgacatccaactcacccaatcccccgccatcatgtccgcctcccccggcgaaaaagtcaccatgacctgccgcgcctcctcctccgtctcctacatgaactggtaccaacaaaaatccggcacctcccccaaacgctggatctacgacacctccaaagtcgcctccggcgtcccctaccgcttctccggctccggctccggcacctcctactccctcaccatctcatccatggaagccgaagacgccgccacctactactgccaacaatggtcctccaaccccctcaccttcggcgccggcacaaaactcgaactcaaa

SEQ ID NO: 54461 - RNA, 1350 nt, synthetic construct
  misc_feature 1..1350: note = derived and/or modified sequence opt11 from Brazikumab_HeavyChain
  source 1..1350: mol_type = other RNA
caggtccaactcgtcgaatccggcggcggagtcgtccaaccaggccgctcactacgcttatcatgcgccgcctccggctttaccttctcatcatacgggatgcactgggtccgacaagcaccaggcaaaggactcgaatgggtcgccgtcatatggtacgacggatccaacgaatactacgccgactcagtcaaaggccggtttactatctccagagataattccaaaaacaccctatacctacaaatgaactctctcagagccgaagacacagccgtctactactgcgcccgtgaccgcggatacacctcctcttggtacccagacgcattcgacatctggggccagggcacaatggtcaccgtatcatccgcaagcaccaaaggcccctccgtcttcccactcgccccctgctcccgaagcacctcagaatccaccgccgccctaggatgcctcgtcaaagactacttccccgaacccgtaaccgtctcctggaactccggcgccctaacaagcggcgtccacaccttccccgccgtactccaatcttctggactctactccctcagctcggtagtcacagtcccctcatcaaacttcggcacccaaacctacacatgcaacgtcgaccacaaaccaagcaacaccaaagtcgacaaaaccgtcgaacgcaaatgctgcgtcgaatgcccaccctgccccgccccacccgtcgcaggaccctccgtcttcctcttcccacccaaacccaaagacaccctcatgatctcccgcacccccgaagtaacctgcgtcgtcgtcgatgtcagccacgaagaccccgaagtccaattcaactggtacgtcgacggcgtcgaagtccacaatgccaagacaaaaccccgtgaagaacaattcaactcaacattccgagtcgtctccgtccttactgtcgtccaccaagactggctaaacggcaaagaatacaaatgcaaagtatcaaacaaaggcctacctgcgcccatcgagaaaaccatctccaaaacaaagggacagccacgagaacctcaagtatacaccctcccaccctcacgtgaagaaatgaccaaaaaccaagtctcactaacctgcctcgtcaaaggattctacccctccgacatcgctgtcgaatgggaatcaaacggccaacccgaaaacaactacaaaacaaccccacccatgctggactctgatggcagcttcttcctatactccaaactaaccgtcgacaaaagccgctggcaacaaggcaacgttttctcctgctccgtcatgcacgaagccttacacaaccactacacccaaaaatccctctccctatcacccggcaaa

SEQ ID NO: 54462 - RNA, 651 nt, synthetic construct
  misc_feature 1..651: note = derived and/or modified sequence opt11 from Brazikumab_LightChain
  source 1..651: mol_type = other RNA
caatccgtcctcacccaacccccctccgtatcaggcgcccccggccaacgcgtcaccatctcctgcacaggctcctcatccaacactggcgccggctacgacgtccactggtaccaacaagtacccggcaccgcccccaaactacttatctacggctccggaaaccgaccctccggcgtccccgaccgcttctccggctccaaatctggcacatccgcctccctcgccatcaccggcctccaagccgaagacgaagccgactactactgccaatcctacgactcctccctctcaggctgggtcttcggaggcggcacccgcctcaccgtcctaggacaaccaaaagccgccccctcagtcaccctcttcccaccctcctccgaagaactccaagccaacaaagccaccctagtctgcctcatctccgacttctaccccggcgccgtcaccgtcgcctggaaagccgactcctccccagtcaaagccggcgtcgaaaccaccaccccctccaaacaatccaacaataaatacgccgcctcctcatacctctccctcacccctgaacaatggaaatcccaccgctcctactcctgccaagtaacccacgaaggctccaccgtagaaaaaaccgtcgcccccaccgaatgctcc

SEQ ID NO: 54463 - RNA, 363 nt, synthetic construct
  misc_feature 1..363: note = derived and/or modified sequence opt11 from Brolucizumab_HeavyChain
  source 1..363: mol_type = other RNA
tccgaagtccaactcgtcgaatcaggaggcggcctcgtccaacccggcggctccctccgcctctcctgcaccgcctccggcttctccctcaccgactactactacatgacctgggtccgacaagcccccggcaaaggcctcgaatgggtcggcttcatcgaccccgacgacgacccctactacgccacctgggccaaaggccgcttcaccatctcacgcgacaactccaaaaacaccctctacctccaaatgaactcactccgcgccgaagacaccgccgtctactactgcgccggcggagaccacaactccggctggggcctcgacatctggggccaaggcaccctcgtcaccgtctcctcc

SEQ ID NO: 54464 - RNA, 333 nt, synthetic construct
  misc_feature 1..333: note = derived and/or modified sequence opt11 from Brolucizumab_LightChain
  source 1..333: mol_type = other RNA
atggaaatcgtcatgacccaatccccctccaccctctccgcctccgtcggagaccgcgtcatcatcacctgccaagcctccgaaatcatccactcctggctcgcctggtaccaacaaaaacccggcaaagcacccaaactcctcatctacctcgcctccaccctcgcctccggcgtcccctcccgcttctccggctccggctccggcgccgaattcaccctcaccatctcctccctccaacccgacgacttcgccacctactactgccaaaacgtctacctcgcctccaccaacggcgccaacttcggccaaggcaccaaactaaccgtcctc

SEQ ID NO: 54465 - RNA, 1347 nt, synthetic construct
  misc_feature 1..1347: note = derived and/or modified sequence opt11 from Cabiralizumab_HeavyChain
  source 1..1347: mol_type = other RNA
caagtccagctagtccaatccggagccgaagtcaagaaacccggctcctccgtcaaagtctcttgcaaagcctccggctacactttcaccgacaactacatgatctgggtaagacaagcccccggacaaggactcgaatggatgggcgacatcaacccatacaacggcggcaccacctttaaccaaaaattcaaaggccgcgtcaccataacagccgacaaaagcacctccaccgcctacatggaactctcatccctacgctccgaagacacagctgtctactactgtgcccgcgaatccccctacttctccaacctatacgtcatggactactggggccaaggcaccctcgtcacagtctcatccgcctccaccaaaggcccatctgtcttccccctcgcaccctgcagcagatcaaccagcgaatccacagcagccctcggctgcctcgtcaaagactacttcccagaacccgtaaccgtctcatggaactccggggcactcacttccggcgtccacaccttccccgctgtcctacaatcatccggcctctactccctctcttctgtcgttacagtcccctcttcctctctaggcaccaaaacctacacatgcaacgtagaccacaaaccttccaacaccaaagtcgacaaacgcgtagaatccaaatacggccctccctgcccaccctgccccgcccccgagttcctcggcggccccagcgtcttcctcttcccacccaaacccaaagacacactcatgatctcccgcacccccgaagttacctgcgtcgtcgtggacgtcagccaagaagaccccgaagtccaatttaactggtacgtagacggtgtcgaagtccacaacgccaagaccaaaccccgcgaagaacaattcaatagcacataccgcgtagtgtccgtcctaaccgtcctgcaccaagattggctaaacggcaaagaatacaaatgtaaagtcagtaacaaaggacttcccagctccatcgaaaagaccatctccaaagctaaaggccaaccccgcgaaccccaagtatacaccctaccaccatcccaagaagaaatgactaaaaatcaagtctcgctcacatgcctcgtcaaaggcttttacccctccgacatcgccgtcgaatgggaatccaacggccaacccgaaaataattacaaaacaacacctcccgtcctcgactcggacggctcattcttcctatactcccgcctaaccgtcgacaaaagccgctggcaagaaggaaacgtcttctcctgctccgtcatgcatgaagccctccacaaccactacacccaaaaatcactctcactctcactcggcaaa

SEQ ID NO: 54466 - RNA, 654 nt, synthetic construct
  misc_feature 1..654: note = derived and/or modified sequence opt11 from Cabiralizumab_LightChain
  source 1..654: mol_type = other RNA
gaaatcgtcctcacccaatcccccgccaccctaagcctctcacccggcgaacgcgccacactctcctgcaaagcctcacaatcagtagactacgacggcgacaactacatgaactggtaccaacaaaaacccggccaagcccccagactcctcatctacgccgcctccaacctcgaatccggcatcccagcccgcttctcaggctccggctcaggcaccgacttcaccctaaccatctcctccctcgaacccgaagacttcgcagtctactactgccacctctcaaacgaagacctctccaccttcggcggcggcaccaaagtcgaaatcaaacgcaccgtcgccgccccctccgtcttcatattcccgccctccgacgaacaactcaaatccggcaccgcctccgtcgtctgcctcctcaacaacttctacccccgcgaagccaaagtccaatggaaagtcgacaacgcactccaatccggaaactcccaagaatccgtcaccgaacaagactccaaagactccacctactccctctcctccaccctaaccctctccaaagccgactacgaaaaacacaaagtctacgcctgcgaagtcacacaccaaggcctatcatcgcccgtcacaaaatcattcaaccgcggcgaatgc

SEQ ID NO: 54467 - RNA, 1329 nt, synthetic construct
  misc_feature 1..1329: note = derived and/or modified sequence opt11 from Camrelizumab_HeavyChain
  source 1..1329: mol_type = other RNA
gaagtccaactcgtcgagtcaggcggcggactcgtacaacccggcggctccctccgcctaagctgcgcagcctccggtttcaccttctcctcctacatgatgtcctgggtccgccaagccccaggcaaaggcctcgaatgggtcgcaaccatctctggcggaggtgccaacacctactacccagactccgtcaaaggacgcttcaccatctcccgcgacaacgccaaaaactcgctctacctacaaatgaactccctacgcgccgaagacaccgccgtctactactgcgcccgccaactctactacttcgactactggggccagggcactaccgtcactgtctcctccgcctccaccaaaggcccctccgttttccccctcgccccctgcagccgatccacatcagaatccaccgccgccctaggctgcctagtcaaagactacttccccgaaccagtcaccgtctcctggaactctggcgccctcacctccggtgtacacaccttccctgccgtactccaatcctcaggactctactctctctcatcagtcgtaaccgtaccctcctcatcactcggaactaaaacctatacctgcaacgtcgaccacaaaccctctaacacaaaagtagacaaacgagtcgaatcgaaatacggcccaccctgcccaccctgccccgcaccagagttcctgggaggaccctccgttttcctattcccgcccaaacccaaggacacactcatgatatcccgcacccccgaagtaacatgcgtcgtagtcgacgtctcacaagaagatcccgaggtacaattcaattggtacgtagacggcgtagaagtccacaacgcaaaaaccaaaccccgagaagaacaattcaactcaacctaccgcgtcgtctccgtactcaccgtccttcaccaggactggctcaacggcaaagaatacaaatgcaaagtatcaaacaaaggactgccctcatccatcgagaagaccataagcaaagccaaaggccaaccccgcgaaccccaagtctacaccctcccaccatctcaagaagaaatgaccaaaaaccaagtatctctaacgtgcctcgtcaaaggtttctacccctccgacatagcggtcgaatgggagtccaacggccaacccgagaacaactacaaaaccacacccccagtcctcgactcagacggctcattcttcctttactcccgcctcacagtagacaagtcccgttggcaagaaggcaacgtcttcagctgctccgtaatgcacgaagctctccacaaccactacacccagaaatcactctccctctcgctcggaaaa

SEQ ID NO: 54468 - RNA, 642 nt, synthetic construct
  misc_feature 1..642: note = derived and/or modified sequence opt11 from Camrelizumab_LightChain
  source 1..642: mol_type = other RNA
gacatccaaatgacccaatccccctcctcactctccgcctccgtaggcgaccgcgtcaccataacctgcctcgcatcccaaaccatcggcacatggctcacctggtaccaacaaaaacccggcaaagcacccaaactcctcatctacactgccacctccctagcagacggagtcccctcccgattctccggatccggctccggcaccgacttcaccctaaccatctcctcactccaacccgaagacttcgccacctactactgccaacaagtctactccatcccctggaccttcggtggcggcaccaaagtcgaaatcaaacgcacagtcgcagccccctccgtcttcatcttcccaccctccgacgaacaactcaaatccggcaccgcctccgtcgtctgcctcctaaacaacttctacccccgcgaagccaaagtccaatggaaagtcgacaacgccctccaatccggcaactcccaagaatccgtcaccgaacaagactcaaaagactccacctacagcctcagctccaccctgaccctcagcaaagccgactacgaaaaacacaaagtctacgcctgcgaagtcacacaccaaggcctgagctcacccgtaaccaaatccttcaaccgcggcgagtgc

SEQ ID NO: 54469 - RNA, 777 nt, synthetic construct
  misc_feature 1..777: note = derived and/or modified sequence opt11 from Caplacizumab_HeavyChain
  source 1..777: mol_type = other RNA
gaggtgcagctggtagagagcgggggaggactggtgcaaccggggggaagcctgaggttaagttgcgcagcatcggggagaacgtttagctataacccgatggggtggtttaggcaggcgccggggaagggaagggagttggtagcggcaataagtaggaccggggggagcacctattacccggatagtgtagagggaaggttcacgataagtagagacaacgcgaagaggatggtgtacctgcagatgaatagtctgagggcggaggacacggcggtgtactattgcgcagcggcgggggtgagggcggaggatgggagggtgaggacgctaccgagtgagtacacgttctgggggcaggggacacaggtaacggtgagcagcgcagcggcggaggtacagctggtggagagcgggggggggctggtacagccgggggggagcctgaggctgagctgtgcagcgagcgggaggacgttcagctacaatccaatggggtggttcagacaagcaccggggaaagggagagagttggtagcagcgataagcaggacgggggggagcacgtattatccggatagcgtggaggggaggtttacgataagcagggacaacgcgaagaggatggtatatctgcagatgaatagcctaagagcggaggatacggcggtgtactactgtgcggcggcaggggtgagggcggaggacgggagggtgaggacgctaccgagtgagtacacgttctgggggcaggggacgcaggtgacagtaagtagt

SEQ ID NO: 54470 - RNA, 657 nt, synthetic construct
  misc_feature 1..657: note = derived and/or modified sequence opt11 from Citatuzumab_bogatox_HeavyChain
  source 1..657: mol_type = other RNA
gaagtccaactagtccaatccggccccggactcgtccaacccggcggctccgtacgcatctcatgcgccgcctccggatacaccttcaccaactacggcatgaactgggtcaaacaagcccccggcaaaggcctagaatggatgggatggatcaacacctacaccggcgaatccacctacgccgactccttcaaaggccgcttcaccttctccctagacacctcagcctccgccgcctacctccaaattaactccctccgcgccgaagataccgccgtctactactgcgcccgcttcgccatcaaaggagactactggggccaaggaaccctcctcaccgtctcctccgcctcaaccaaaggaccctccgtcttcccactcgccccctcctccaaatccacctcaggcggcaccgccgccctcggatgcctcgtcaaagactacttccccgaacccgtcacagtctcctggaactccggcgccctaacctccggcgtccacaccttccccgccgtcctccaatcatcaggcctctactccctctcatccgtcgtcaccgtcccctcctcctccctcggcacacaaacctacatatgcaacgtcaaccacaaaccctccaacaccaaagtcgacaaaaaagtcgaacccaaatcctgc

SEQ ID NO: 54471 - RNA, 1356 nt, synthetic construct
  misc_feature 1..1356: note = derived and/or modified sequence opt11 from Cosfroviximab_HeavyChain
  source 1..1356: mol_type = other RNA
gacgtcaaactcctcgaatcaggcggcggattagtccaaccaggcggctccctaaagctcagctgcgccgcatccggcttcagcctatccacctccggtgttggcgtaggctggttccgccaaccttccggcaaaggcctcgaatggctcgcccttatctggtgggacgacgacaaatactacaacccctctctaaaatcccaactttctatatccaaagacttctcccggaatcaagtcttcctcaaaatctccaacgtcgacatcgccgacaccgccacatactactgcgcacgcagagatcccttcggatacgacaacgccatgggctactggggccaaggaacctcggtcacagtatcctccgcctccaccaaaggcccatcagtcttcccacttgccccatcctccaaatcaacctccggcggcacagccgccctaggttgcctcgtaaaagactacttccccgaaccagtgaccgtatcatggaactccggcgccctcacttcaggcgtccacacattccccgccgtcctccaaagcagcggtctctattccctcagctccgtcgtcaccgtaccatcaagctccctcggcacccaaacctacatatgcaacgtaaaccacaaacccagcaacaccaaagtcgacaaacgagtcgaaccaaaatcatgcgacaaaacccacacatgcccaccctgcccagccccagaactcctcggcggcccctcggtattcctcttccctcccaaacccaaagataccctcatgatctcccgcacccccgaagttacctgcgtcgtcgtcgacgtgtcccacgaagacccggaagtgaaattcaactggtacgtcgacggagtcgaagtccacaacgccaaaaccaaaccccgagaagaacaatacaactccacctaccgcgtcgtctccgtcctgaccgtcctgcaccaagactggctcaacggcaaagaatacaaatgcaaagtctccaacaaagccctccccgccccaatcgaaaagacaatctcaaaagccaaaggccaacctcgcgaaccccaagtctacacactacccccatcccgagacgaacttaccaaaaaccaagtctcactaacctgcctcgtgaaaggattctacccatcagacatagcagtagaatgggaatccaacggccagcccgaaaacaactacaaaacgacccctcccgtcctcgactccgacggctcattcttcctctactccaaactcaccgtcgacaaatccagatggcaacaaggcaacgtcttttcctgctccgtcatgcacgaagccctccacaaccactacacacaaaaatcactctccctgagtcccggaaaa

SEQ ID NO: 54472 - RNA, 639 nt, synthetic construct
  misc_feature 1..639: note = derived and/or modified sequence opt11 from Cosfroviximab_LightChain
  source 1..639: mol_type = other RNA
gacatcgtcatgacccaatcacccctctccctctccacatccgtcggcgaccgcgtctccctaacatgcaaagcctcccaaaacgtcggcacagcagtcgcctggtaccaacaaaaacccggacaatcccccaaactcctcatatactcagcctccaaccgatacaccggcgtccccgaccgcttcaccggatcaggctctggcaccgacttcacactcaccatctccaacatgcaatccgaagacctagcagactacttctgccaacaatacagctcctaccccctcaccttcggagccggcaccaaactcgaactccgcaccgtcgccgcaccctccgtattcatcttcccaccctcagacgaacaactaaaatccggcaccgcctccgtcgtttgcctcctcaacaacttctacccccgcgaagccaaagtccaatggaaagtcgacaacgccctacaatccggcaactcccaagaatcagtcaccgaacaagactccaaagactccacctactctctctcctccaccctcaccctctccaaagccgactacgaaaaacacaaagtctacgcctgcgaagtcacccaccaaggcctctcctcacccgtcaccaaatccttcaaccgcggcgaatgc

SEQ ID NO: 54473 - RNA, 1344 nt, synthetic construct
  misc_feature 1..1344: note = derived and/or modified sequence opt11 from Crizanlizumab_HeavyChain
  source 1..1344: mol_type = other RNA
caagttcaactcgtacaatccggcgccgaagtcaagaaacccggcgcctccgtaaaagtctcatgcaaagtctcaggctacaccttcacatcctacgacataaactgggtacgccaagccccaggcaaaggactcgaatggatgggatggatctacccaggagacggttccatcaaatacaacgaaaaattcaaaggacgggtaacaatgacggtcgacaaatccaccgacacagcatacatggaactaagctcactccgcagcgaagacacagccgtatactactgcgcacgccgcggcgaatacggaaactacgaaggcgcaatggactactggggccaaggcaccctagtaaccgtcagcagcgcctcaacgaaagggccctcagtattcccactcgccccctgctcacgctcaacctcagaaagcactgccgccctcggctgcctcgtcaaagactacttcccagaacctgtaacagtctcctggaactcaggcgcactaacctcaggagtacacacattccccgcagtcctacaaagcagcggcctgtattccctctcctcggtcgtcaccgtaaccagcagcaacttcggcacccaaacatacacatgcaacgtggaccacaaaccctccaacaccaaagtcgacaaaaccgtagaacgaaaatgttgcgtcgaatgcccaccctgtcccgcccctccagtcgccggcccctccgtattcctctttcccccaaaaccaaaagacaccctcatgatctcccgcacccccgaggtaacctgcgtcgtcgtcgacgtctcccacgaagaccccgaagtacaattcaactggtacgtcgacggcatggaagtacacaacgccaaaaccaaaccgagagaagaacagttcaactcaacattccgtgtcgtatcagtcctaaccgtagtccaccaagactggctcaacggaaaagaatacaaatgcgcagtctcaaacaaaggtctacccgccccaatcgaaaagaccataagcaaaacaaaaggccaaccacgagaaccccaggtctacacgctcccaccctcacgcgaagaaatgaccaaaaaccaagtctcactcacatgcctcgtcaaaggcttctaccccagcgacatcgccgtcgaatgggaatctaacggccaacccgaaaacaactacaaaaccacaccacccatgcttgactcggacggatcattcttcctctactcaaaactaaccgtcgacaagtcccgctggcaacaaggaaacgtcttctcctgctcagtaatgcacgaagcacttcacaaccactacacccaaaaatcactctcactctcacccgggaag

SEQ ID NO: 54474 - RNA, 654 nt, synthetic construct
  misc_feature 1..654: note = derived and/or modified sequence opt11 from Crizanlizumab_LightChain
  source 1..654: mol_type = other RNA
gacatccaaatgacacaatccccctcatccctcagcgcctcagtcggcgaccgcgtcacaatcacatgcaaagcatcccaatccgtcgactacgacggccactcctacatgaactggtaccaacaaaaacccggcaaagcacccaaactcctcatctacgccgcctccaacctcgaatccggcgtcccctcccgattctccggatccggatccggcaccgacttcaccctcaccatctcctcactccaacccgaagactttgccacctactactgccaacaatccgacgaaaaccccctcacattcggcggcggcacaaaagtcgaaatcaaacgtacagtagccgccccctccgtcttcatcttcccaccatccgacgaacaactaaaatccggcaccgcctcagtagtctgcctcctaaacaacttctacccccgcgaagccaaagtccaatggaaagtcgacaacgccctccagtccggaaactcacaagaaagcgtcaccgaacaagactccaaagactccacctactccctctcctcaaccctcaccctctccaaagccgactacgaaaaacacaaagtctacgcctgcgaagtaacccaccaaggcctctcctcccccgtcacaaaatccttcaaccgcggcgaatgc

SEQ ID NO: 54475 - RNA, 1365 nt, synthetic construct
  misc_feature 1..1365: note = derived and/or modified sequence opt11 from Crotedumab_HeavyChain
  source 1..1365: mol_type = other RNA
gaagtccagctagtcgaatccggcggcggccttgtccaacccggcggctcgctacgcctaagctgcgcagcatctggcttcaccttcagcaactacctaatgaactgggtccgccaagcccccggaaaaggcctcgaatggctcgctaacatccaagaagacggcatagaaaaatactacgtagactcagtaaaaggccgcttcaccatcagccgcgataacgccaaaaactcactatacctccaaatgaactcactacgagccgaagacaccgcagtctactactgcgcccgcgaaccctcccattacgacatcctcaccggatacgactactactacggcatggacgtctggggccaaggcaccaccgtaaccgtcagcagcgcctccactaaaggccccagcgtcttcccccttgcaccatgcagccgctccacatcagaatcaaccgcagccctcggctgcctcgtcaaagattatttccccgaacccgtcaccgtctcatggaactccggcgccctcacctccggtgtacacaccttccccgccgtcctacaatcctcaggactctattcactcagcagcgtcgtcaccgtaccaagctcctccctcggcaccaagacctacacatgcaacgtcgaccacaaacccagcaatacaaaagtagacaaacgagtcgaatcaaaatacggaccgccctgcccaccctgccccgcccccgagttcctcggaggcccctcagtattcctattcccacccaaacccaaagacacactaatgatcagccgcacccccgaagtcacttgcgtcgtcgtagacgtctcccaagaagacccggaagtccagttcaactggtacgtagacggcgtcgaagtacataacgccaaaacaaaaccacgagaagaacaattcaactcaacctaccgcgtagtcagcgtcctaaccgtccttcaccaagactggctgaacggcaaagaatacaaatgcaaagtctccaacaaaggcctaccctcctccatcgagaaaactatctccaaggcaaaaggtcaaccccgcgaaccccaggtctacacactccctccttcccaagaagaaatgaccaaaaaccaagtctccctaacctgccttgtaaaaggcttctatccctcggacatcgctgtcgaatgggaatccaacggacaacccgaaaacaactacaagaccactccacccgtactcgactccgacggctccttcttcctatactccagactcaccgtagacaaatcccgatggcaggaagggaacgtcttctcatgctccgtaatgcatgaagccctccacaaccactatacacaaaaatcactctccctctccctcggcaaa

SEQ ID NO: 54476 - RNA, 642 nt, synthetic construct
  misc_feature 1..642: note = derived and/or modified sequence opt11 from Crotedumab_LightChain
  source 1..642: mol_type = other RNA
gacatccaaatgacccaatccccatcctcactctccgcctccgtcggcgaccgcgtcaccatcacatgccgtgcctcccaaggcatccgcaacgacctcggctggtaccaacaaaaacccggcaaagcccccaaacgcctaatctacgccgcctcctccctccaatcaggcgtcccatcccgattctccggctccggctccggcaccgaattcatcctcaccgtctcttccctccaacccgaagacttcgccacctactactgcctccaatacaactcaaacccattcaccttcggccccggcaccaaagtcgacataaaacgcaccgtcgcagccccctccgtcttcatcttccccccctccgacgaacaactcaaatccggcaccgcctcagtagtctgcctcctcaacaacttctacccccgcgaagcaaaagtccaatggaaagtcgacaacgccctccaatccggcaactcccaagaatccgtcaccgaacaagactccaaagactccacctactccctttcctccaccctcaccctctccaaagccgactacgaaaaacacaaagtctacgcctgcgaagtcacacaccaaggtctctcctcacccgtcaccaaatccttcaaccgcggcgaatgc

SEQ ID NO: 54477 - RNA, 1356 nt, synthetic construct
  misc_feature 1..1356: note = derived and/or modified sequence opt11 from Dezamizumab_HeavyChain
  source 1..1356: mol_type = other RNA
caagtccagctagtccaatccggtgcagaagtcaagaaacccggctcctcagttaaagtctcctgcaaggcatccggcttcaccttcgctacatataatatgcactgggtccgccaagcccccggccaaggcctcgaatggatgggctacatctatccaggcgacggcaacgctaactacaaccaacaattcaaaggccgcgtcaccataactgccgacaaaagcacctctaccgcatacatggaactatcctcccttcgatccgaagatacagccgtctattactgcgcccgcggcgacttcgactacgacggcggctactacttcgatagctggggacaaggcacccttgtcacagtatcctccgcctccaccaaaggccctagcgtgttccctctagccccctcctccaaatccacctccggcggcaccgccgccctcggctgcctagtaaaagactacttcccggaacccgtcaccgtatcctggaactccggtgcactcacctccggagtacacaccttccccgccgtcctccaatcctctggcctctactccctctcatccgtggtcactgttccctcctcatccctcggcacacaaacctacatctgcaacgtcaaccacaaaccctccaacacaaaagtagacaagaaagtcgaacccaaatcctgcgacaaaacccacacctgtccaccctgccccgcccccgaactcctcggcggcccatcagtctttctctttccccctaaacccaaagacaccctcatgatatcccgcacacccgaagtaacctgcgtcgtcgtagatgtaagccacgaagaccccgaagtcaaattcaactggtacgttgacggcgtagaagtccacaacgcaaaaaccaaaccaagagaagaacaatacaactcaacctaccgcgtcgtatcagtcctcacagtccttcaccaagactggctaaacggcaaagaatacaaatgcaaagtatccaataaagccctccctgccccaatcgagaaaaccatctccaaagccaaaggacagccccgagaaccccaagtctacactttaccaccctcccgcgacgaactaaccaaaaaccaagtctcccttacatgcctcgtcaaaggcttctatccctccgacatcgcagttgaatgggaatcaaacggccaacctgaaaacaactataaaaccaccccgcccgtcctcgacagtgacggctccttcttcctttacagcaagctcaccgtcgacaaatctcgatggcaacaaggaaacgtcttcagctgctctgtcatgcacgaagccctccacaaccactacacccaaaaatccctctcactctcccccggcaag

SEQ ID NO: 54478 - RNA, 642 nt, synthetic construct
  misc_feature 1..642: note = derived and/or modified sequence opt11 from Dezamizumab_LightChain
  source 1..642: mol_type = other RNA
gacatccaaatgacccaatccccctccagcctctccgccagcgtaggcgaccgcgtaacaatcacctgccgcgctagcgaaaacatctactcatacctagcctggtaccaacaaaaacccggcaaagcccccaaactactaatccacaacgccaaaaccctcgccgaaggcgtcccctcccgtttctccggctccggctcaggcaccgacttcaccctcaccatctcctcactccaacccgaagacttcgccacctactactgccaacaccactacggcgcccccctcaccttcggacaaggaaccaaactcgaaatcaaacgcaccgtcgcagcccccagcgtcttcatattccccccctccgacgaacaactaaaatccggcaccgcctcagtcgtctgcctactcaacaacttctacccccgcgaagccaaagtccaatggaaagtcgacaacgccctccaatccggcaactcccaagaatccgtcaccgaacaagactccaaagactccacctactccctatcatcaaccctcaccctgagcaaagccgactacgaaaaacacaaagtctacgcctgcgaagtcacccaccaaggcctctcatcacccgtcaccaaaagcttcaaccgaggcgagtgc

SEQ ID NO: 54479 - RNA, 1506 nt, synthetic construct
  misc_feature 1..1506: note = derived and/or modified sequence opt11 from Duvortuxizumab_Chain1_scFv
  source 1..1506: mol_type = other RNA
gaaaacgtactcacgcaatccccagcaaccctgagcgtcacccccggcgaaaaagcaaccataacctgccgcgcatcccaatccgtatcctacatgcactggtaccaacaaaaaccaggccaagcacctcgccttctaatctacgacgcctcgaatcgtgcatccggcgtaccctcaagattctccggaagcggaagcggcaccgaccacacactaaccatctccagcctcgaagccgaagacgccgcaacctactactgcttccaaggctcagtctacccattcaccttcggccaaggaacaaaactcgaaataaaaggtggtggcagcggcggcggcggcgaggtacaactcgtcgaatccggcggcggcctagtgcaacccggaggctcactccgcctatcatgcgccgccagcggattcaccttcagcacatacgcaatgaactgggtccgccaagccccaggcaaaggactagaatgggtagggcgcatccgaagcaaatacaacaactacgccacctactacgcagactccgtcaaaggaagattcacaatatcccgcgacgactctaaaaattcactatacctacaaatgaactcacttaaaaccgaagacaccgcagtatactactgcgtccgccacggaaacttcggcaattcctacgtcagctggttcgcctactggggacaaggaaccctagtaacagtctccagcgcatcgacaaaaggagaagtcgcagcatgcgaaaaggaagtagctgcactcgaaaaagaagtcgccgccctggaaaaagaagtcgccgccctcgaaaaaggaggcggagacaagacgcatacctgcccaccctgcccagcccccgaagcggccggcggaccaagcgtattcctgttcccacccaaacccaaagacaccctaatgatatcacgcaccccagaagtaacctgcgtcgtagtagacgtgagccacgaagaccccgaagtaaagttcaactggtacgtcgatggcgtagaagtccacaacgccaaaacaaaacccagagaagaacaatacaactcaacctatcgagtcgtcagcgtactgaccgtgctacaccaagactggcttaacggaaaagaatataaatgcaaagtctcaaacaaagcactccccgcccccatcgagaaaaccatcagcaaagcaaaaggacagcccagggaaccccaagtctacacactcccaccatcccgagaagaaatgaccaagaaccaagtctcactctggtgcctagtcaagggcttctacccttccgacatcgccgtcgaatgggaaagcaacggccaacccgaaaacaactacaagaccaccccaccggtcctcgactcagacggctcattcttcctatactcaaaactaaccgtcgacaaatcccgctggcaacaaggaaacgtattctcatgctccgttatgcacgaagccctgcacaaccactacacccaaaaatcactctccctgtcacccggaaaa

SEQ ID NO: 54480 - RNA, 813 nt, synthetic construct
  misc_feature 1..813: note = derived and/or modified sequence opt11 from Duvortuxizumab_Chain2_scFv
  source 1..813: mol_type = other RNA
caagcagtagtaacccaagaacccagcctcaccgtaagccccggcggaaccgtaaccctaacctgccgctcaagcacaggcgcagtcaccacctcaaactacgccaactgggtacaacaaaaaccaggccaagcgcccagaggcctcatcggcggaaccaacaaacgagccccctggacccccgcacgcttctccggaagcctactcggaggcaaagcagccctcaccatcaccggcgcccaagccgaagacgaagcagactactactgcgccctgtggtacagcaacctctgggtcttcggcggcggaacaaaactaaccgtcctcggcggcggcggcagcggaggcggcggacaagtaaccctccgcgaaagcggccccgcactcgtcaaacccacccaaacactaaccctaacctgcaccttctccggattctcactctccacctccggcatgggcgtaggctggatcagacaaccacccggcaaagccctcgaatggctagcccacatctggtgggacgacgacaaacgatacaaccccgccctaaaatcacgactcacaatctccaaagacacctccaaaaaccaagtattcctaacaatgaccaacatggaccccgtggacacagcaacatactactgcgcacgcatggaactatggtcatactacttcgactactggggacaaggaaccacagtaacagtctcatcagcctcaaccaaaggcaaagtcgccgcctgcaaagaaaaagtagcagcactcaaagaaaaagtcgccgccctcaaagaaaaagtcgccgcactcaaagaa

SEQ ID NO: 54481 - RNA, 681 nt, synthetic construct
  misc_feature 1..681: note = derived and/or modified sequence opt11 from Duvortuxizumab_Chain3_h-CH2-CH3
  source 1..681: mol_type = other RNA
gacaaaacccacacctgccccccctgcccagcccccgaagcagccggcggcccatccgtcttcctcttcccccccaaacccaaagacactctcatgatcagccgcacccccgaagtcacctgcgtcgtcgtcgacgtctcccacgaagaccccgaagtcaaattcaactggtacgtcgacggcgtcgaagtccataacgctaaaaccaaaccacgcgaagaacaatacaactccacttaccgagtcgtctccgtcctcaccgtcctccaccaagactggctcaacggcaaagaatacaaatgcaaagtctccaacaaagccctcccagcacccatcgaaaaaaccatctccaaagcaaaaggccaaccacgcgaaccccaagtctacaccctccccccctcccgcgaagaaatgacaaaaaaccaagtctccctctcctgcgccgtcaaaggcttctacccctccgacatcgccgtcgaatgggaatccaacggacaacccgaaaacaactacaaaaccaccccccccgtcctcgactccgacggctcattcttcctcgtctccaaactcaccgtcgacaaaagccgatggcaacaaggcaacgtcttctcatgctccgtcatgcacgaagccctccacaaccgctacacacaaaaatccctctccctatcccccggcaaa

SEQ ID NO: 54482 - RNA, 360 nt, synthetic construct
  misc_feature 1..360: note = derived and/or modified sequence opt11 from Efungumab_HeavyChain
  source 1..360: mol_type = other RNA
atggcggaagtgcaattggtcgagagcggggccgaggtcaagaaaccgggcgagagcttgcgcataagctgtaaagggagcgggtgcataatctcgagctattggataagctgggtcaggcaaatgcccgggaaagggctcgagtggatgggcaagatcgatcccggggactcgtacataaactatagcccgagctttcaagggcacgtgaccataagcgcggacaagagcataaacacggcctatctccagtggaatagcttgaaagcgagcgataccgcgatgtattactgtgccaggggcggacgcgatttcggggactcgttcgattactggggccagggcacgctagtgaccgtg

SEQ ID NO: 54483 - RNA, 750 nt, synthetic construct
  misc_feature 1..750: note = derived and/or modified sequence opt11 from Efungumab_HeavyChain_LightChain
  source 1..750: mol_type = other RNA
atggcggaagtccaattagtagagagtggggcagaggtcaagaaaccgggcgagagcttgcgcataagctgtaaagggagcggatgcataatctcgagctattggataagctgggtaagacagatgcccgggaaagggctcgagtggatgggcaagatagaccccggggactcgtacataaactatagcccgagcttccaaggacacgtgaccataagcgcggacaagagcataaacacggcctatctacagtggaatagcttgaaagcgagcgatacagcgatgtactactgtgcaagaggcgggcgcgacttcggggactcgttcgactactggggccagggcacgctcgtgaccgtgagctcaggcgggggcgggagcgggggcggaggctcgggagggggcgggagcgatgtcgtgatgacgcaatcgccctcgttcttgagcgcgttcgtgggcgatcgaataaccataacctgtcgcgcgagctcgggcataagcaggtacttggcctggtaccagcaagcacccgggaaagcacccaagctcctaatctatgccgcgagcacactacaaaccggggtcccgagcagattctcaggatcgggctcgggaacggaatttaccttgaccataaactcgctccaacccgaggacttcgccacgtactactgccagcacttgaactcgtacccactaacgttcggaggcggaaccaaggtcgatatcaagcgcgcggccgcgctcgag

SEQ ID NO: 54484 - RNA, 339 nt, synthetic construct
  misc_feature 1..339: note = derived and/or modified sequence opt11 from Efungumab_LightChain
  source 1..339: mol_type = other RNA
gacgtcgtcatgacccaatccccctccttcctctccgccttcgtcggcgaccgcatcaccatcacctgccgcgcctcctccggcatctcccgctacctcgcctggtaccaacaagcccccggcaaagcccccaaactcctcatctacgccgcctccaccctccaaaccggcgtcccctcccgcttctccggctccggctccggcaccgaattcaccctcaccatcaactccctccaacccgaagacttcgccacctactactgccaacacctcaactcctaccccctcaccttcggcggcggcaccaaagtcgacatcaaacgcgccgccgccctcgaa

SEQ ID NO: 54485 - RNA, 1350 nt, synthetic construct
  misc_feature 1..1350: note = derived and/or modified sequence opt11 from Elezanumab_HeavyChain
  source 1..1350: mol_type = other RNA
gaagtccaacttgtccaatccggtgccgaagttaagaaacccggagcatccgtaaaagtctcctgcaaagcatccggctacacattcacctctcacggcatctcctgggtccgccaagccccaggccagggcctcgactggatgggttggatttccccctactccggcaataccaactacgcccaaaaactacaaggccgtgtcaccatgaccaccgacacctccacctccacagcatacatggaactctcatctctccgatccgaagacacagccgtatactactgcgcccgcgtcggttcaggcccctactactacatggacgtatggggacaaggcacactggtcaccgtatcctcagccagtaccaaaggcccctccgtcttcccactcgccccctcctcaaaatccacctccggcggaaccgctgccctcggctgcctcgtcaaagactactttcccgaacccgtcaccgtgtcatggaactcaggcgccttaacctccggcgtccacaccttccccgccgtcctccaatcatccggcctctactccctatcttctgtcgtaacagtcccctcatcctccctcggaacacaaacctacatatgcaatgtcaatcacaaaccctcaaacacaaaagtcgacaagaaagtagaacccaaatcctgcgacaaaacacatacctgcccaccctgccccgcccccgaagcagccggaggcccctcagtcttcctattcccacccaaacccaaagaccaactcatgatatcacgcacccccgaagtaacctgcgtcgtcgtagacgtaagccacgaagaccccgaagtcaaattcaactggtacgtcgacggagtcgaggttcacaatgcaaaaaccaaaccccgagaggaacaatacaactctacataccgagtcgtctctgtcctcaccgtcctccaccaagactggcttaacggcaaagaatacaaatgcaaagtctctaacaaagccctccccgcacccatcgagaaaaccatatccaaagccaaaggccaaccccgcgaaccccaagtctacacgctacccccatcacgagaagaaatgacaaagaaccaagtctcccttacctgcctcgtcaaaggcttctaccccagcgacatcgccgtcgaatgggaatccaacggccaacccgaaaacaactacaaaaccacccctcccgttctcgactccgacggctccttcttcctatactccaaacttactgtcgacaaatcccgatggcaacaaggaaacgtcttctcctgcagcgtattacacgaagcacttcacaaccactacactcaaaaatccctcagcctctcccccggtaaa

SEQ ID NO: 54486 - RNA, 645 nt, synthetic construct
  misc_feature 1..645: note = derived and/or modified sequence opt11 from Elezanumab_LightChain
  source 1..645: mol_type = other RNA
caatccgccctcacccaaccccgctccgtctccggctcacccggccaatcagtaaccatctcctgcaccggcacctcctcctccgtcggcgactccatctacgtctcttggtaccaacaacaccccggcaaagcccccaaacttatgctctacgacgtcacaaaacgcccctctggcgtacccgaccgcttctccggctccaaatcaggcaacaccgcctcacttaccatctccggactccaagccgaagacgaagccgactactactgctactcatacgccggcaccgacaccctattcggcggcggcaccaaagtcaccgtcctcggccaacccaaagcagcaccttccgtcaccctattccccccctcatccgaagaactacaagccaataaagccaccctcgtatgcctcatctccgacttctaccccggcgccgtcaccgtagcctggaaagccgactcctcccccgtcaaagccggcgtcgaaaccactaccccctccaaacaatcaaacaacaaatacgcagcctcctcatacctctccctcacccccgaacaatggaaatcccaccgctcatactcctgccaagtcacacacgaaggctcaacagtcgaaaaaacagtcgcccccaccgaatgctcc

SEQ ID NO: 54487 - RNA, 1359 nt, synthetic construct
  misc_feature 1..1359: note = derived and/or modified sequence opt11 from Emapalumab_HeavyChain
  source 1..1359: mol_type = other RNA
gaagtccaacttctcgaatccggaggcggcctggtccaaccaggcggctcactccgactgtcctgcgccgcctccggcttcaccttctcctcctacgccatgtcctgggtcagacaagcccccggcaaaggactcgaatgggtctccgccatcagcggatccggcggaagcacctactacgccgacagcgtaaagggccgtttcaccatctcacgcgacaactccaaaaataccctctacctacaaatgaactcattacgcgccgaagacactgccgtatactattgcgcaaaagacggctcctcaggctggtacgtcccccactggttcgacccctggggccaaggcaccctcgtcaccgtctcttcagcatcaaccaaaggcccctcggtgttccccctagcacccagcagcaaatccacctctggcggaaccgccgccctaggctgcctcgtcaaagactacttcccagaaccggtcacagtatcctggaactcgggagccctaacctccggcgtccacaccttccccgctgtactacagtcgtccggactatactcattatcctctgtcgtcaccgtcccctcaagctccctcggcacgcaaacatacatctgcaatgtaaatcataaaccctccaacacaaaagtcgacaaacgcgtcgaacccaaatcatgcgacaaaacccatacctgcccaccatgccccgccccagaactcctaggcggccccagcgtcttcctattcccacccaaacccaaggataccctaatgatatcacgcacacccgaagtaacctgcgtcgtcgtcgacgtctctcacgaagaccccgaagtcaaattcaactggtacgtcgacggcgtcgaagtccacaacgcaaaaacaaaaccacgcgaagaacaatacaactccacctaccgcgtcgtctccgtcctcaccgtccttcaccaagactggctcaacggcaaggaatacaaatgcaaagtatccaacaaagccctccccgccccaatcgaaaagaccatatccaaagcaaaaggacaaccccgagaaccccaagtatacaccctccctccctcacgcgaagaaatgaccaaaaaccaggtctccctaacctgcctcgtcaaaggcttctacccctcagacatagccgtcgaatgggaatccaacggccaacccgaaaacaactacaaaaccaccccacccgtcctcgactcagacggcagcttcttcctctactcaaaactgaccgtagacaaatctcgctggcaacaaggcaacgtcttctcctgctccgtaatgcacgaggccctacacaaccactatacccaaaagtccttatcgctatcccccggaaaa

SEQ ID NO: 54488 - RNA, 651 nt, synthetic construct
  misc_feature 1..651: note = derived and/or modified sequence opt11 from Emapalumab_LightChain
  source 1..651: mol_type = other RNA
aacttcatgctcacacaaccacactccgtctccgaatcccccggcaaaaccgtcaccatctcctgcacccgctcctccggctccatcgcatccaactacgtccaatggtaccaacagcgacccggatcctcccccaccaccgtcatctacgaagacaaccaacgcccctccggcgtcccagacagattctccggctccatcgactcctcctccaactccgcctccctaaccatatccggcctcaaaaccgaagacgaagccgactattactgccaatcctacgacggctccaaccgctggatgttcggcggcggcaccaaactaaccgtcctcggacaaccaaaagccgcaccctccgtcaccctcttccccccctcctcagaagaactccaagccaacaaagccaccctcgtctgcctcatctcagacttctaccccggcgctgtcaccgtcgcctggaaagccgactcctcccccgtcaaagccggcgtcgaaaccaccaccccctcaaaacaatccaacaacaaatacgccgcctcctcctacctctccctaacccccgaacaatggaaatcccaccgctcctactcctgccaagtaacccacgaaggatccaccgtcgaaaaaaccgtagcacccacagaatgctcc

SEQ ID NO: 54489 - RNA, 1341 nt, synthetic construct
  misc_feature 1..1341: note = derived and/or modified sequence opt11 from Enoblituzumab_HeavyChain
  source 1..1341: mol_type = other RNA
caagtcgaattagtcgaatccggcggcggtctagtacaacccggcggctcactccgcctcagctgcgccgccagcggctttaccttcacttcctactggatgagctgggtacgccaagcccccggcaaaggtctcgaactcgtttcctccatcacctcctacggatccttcacctactacgccgactctgtcaagggtcgtttcaccatctctcgagacaacagcaaaaacacactatacctccaaatgaactcactccgcgccgaagacacagccgtctactattgcgcacgcaacatgtacacccacttcgactcatggggccaaggaaccctagtaaccgtctcttccgcctcaacaaaaggcccctccgtattccccctcgccccctcctcaaaatccacatcaggcggcaccgccgcactcggatgtcttgtcaaagactacttccccgaacccgtaaccgtctcctggaactctggcgccctcacatcaggcgtccacaccttccccgccgtcctgcaatcctccggcctatactccctgtcctccgtagtcaccgtcccctcctcctccctcggaacccaaacatacatctgcaacgtcaaccacaaacccagtaacaccaaagttgacaagaaagtcgaacccaaatcctgcgacaaaacccacacatgcccaccatgccccgcccccgaactactcggaggtccctcagtgttcctctttcccccaaaaccaaaagacacccttatgatctcccgaacacccgaagtaacctgcgtcgtcgtcgacgtctcccacgaagaccctgaagtcaaattcaactggtacgtcgacggcgtcgaagtccacaacgccaaaaccaaaccaagagaagaacaatacaactcaacctaccgagtagtctccgtcctaaccgttctccaccaagactggctcaacggtaaagaatacaaatgcaaagtcagcaacaaagccctccccgcacccatcgaaaagaccatctccaaagccaaaggccaaccccgcgaaccccaagtatacaccctcccaccatctcgcgacgaactcaccaaaaaccaagtctccctaacatgcctagtcaaaggcttctaccccagcgacatcgccgtcgaatgggaaagcaacggccaacccgaaaacaactacaaaaccacaccacccgtcctcgactctgacggcagcttcttcctatactccaaactcacagtcgacaaatcccgatggcaacaaggaaacgtattctcctgttcagtcatgcacgaagccctccacaaccactacacccaaaaatccctctccctatcccccggcaaa

SEQ ID NO: 54490 - RNA, 648 nt, synthetic construct
  misc_feature 1..648: note = derived and/or modified sequence opt11 from Enoblituzumab_LightChain
  source 1..648: mol_type = other RNA
gacatcgtactaacccaaccaccctccgtctccggagcccccggccaacgcgtcaccatatcctgctccggatcctcctccaacatcggctccaactcagtctcctggtaccaacaactcccaggaaccgcccccaaactcctcatctacgacaactccaaacgcccatccggcgtccccgaccgcttctccggctcaaaatctggcacctcagcctccctagcaatcaccggcctacaatccgaagacgaagccgactactactgccaatcccgagacacctacggctactactgggtcttcggcggcggcaccaaactcaccgtcctaggacaaccaaaagccgccccctccgtaaccctattccccccctcatccgaagaactacaagccaacaaagccaccctcgtctgcctcatctccgacttctacccaggcgccgtcaccgtcgcctggaaaggcgactcctcccccgtcaaagccggtgtcgaaaccaccaccccctccaaacaatcaaacaacaaatacgccgcatcctcctacctctctctcacccccgaacaatggaaatcacaccgctcctactcctgccaagtcacccacgaaggctccaccgtcgaaaaaaccgtagcccccaccgaatgctcc

SEQ ID NO: 54491 - RNA, 1323 nt, synthetic construct
  misc_feature 1..1323: note = derived and/or modified sequence opt11 from Eptinezumab_HeavyChain
  source 1..1323: mol_type = other RNA
gaagtccaacttgtcgaatccggcggcgggctcgtccaacccggcggctccctccgcctctcctgcgccgtcagcggaatcgacctatcaggatactacatgaactgggtccgccaagcccccggcaaaggcctcgagtgggtcggcgtcatcggaatcaacggcgcaacctattacgcctcctgggcaaaaggccgattcaccatctcccgcgacaactcaaaaacaactgtctacctacaaatgaactcactacgcgctgaagacaccgcagtctacttctgcgcgcgcggagacatctggggccaaggcaccctcgtaacagtctcctcagcctcaaccaaaggaccatcagtattcccattagccccttcctcaaaatccacatccggcggcaccgccgcactaggatgcctcgttaaagactacttcccagagcccgtaacggtctcatggaacagcggcgccctcaccagcggagtccacaccttccccgccgtcctccaatcctcaggactctactccctatcctccgtagtaaccgtaccctccagcagcctcggcacccaaacctatatctgcaacgtcaaccacaaaccatccaacactaaagtggacgcccgcgtagaacccaaatcttgcgacaaaacccacacatgcccgccctgccctgcaccagaactcctaggaggtccatccgtaaccctattcccacccaagcccaaagacaccctaatgatcagccgtacccccgaagtcacatgcgttgtagtcgacgtctcccacgaggaccccgaagtaaaattcaactggtacgtagacggagtagaagtccacaacgccaaaaccaaaccaagagaagaacaatatgcctccacctaccgcgtcgtctccgtcctcaccgtcctgcaccaagactggctgaacggcaaagaatacaaatgcaaagtctccaacaaagctctccccgcacccatagagaaaacaatctcaaaagccaaaggccagccacgtgaaccccaagtctacacccttcccccatcccgcgaagaaatgaccaaaaaccaagtctctcttacctgcctcgtaaaaggcttctacccctccgacatcgccgtggaatgggaatccaacggccaaccggaaaacaactacaaaaccaccccacccgtactagactccgacggctccttcttcctctactccaagttaaccgtagacaaaagccgatggcagcagggcaacgtattctcatgctccgtaatgcacgaagccctccacaaccactacactcaaaaatcactatccctatcacccggaaaa

SEQ ID NO: 54492 - RNA, 657 nt, synthetic construct
  misc_feature 1..657: note = derived and/or modified sequence opt11 from Eptinezumab_LightChain
  source 1..657: mol_type = other RNA
caagtcctcacccaatccccctcctccctctctgcctccgtcggcgaccgcgtcaccatcaactgccaagcctcccaatccgtctaccacaacacctacctcgcctggtaccaacaaaaacccggcaaagtccccaaacaactaatctacgacgcctccaccctcgcctccggcgtcccctcccgcttctccggatccggctcaggcaccgacttcacactaaccatctcctcactccaacccgaagacgtcgccacctactactgcctcggctcatacgactgcaccaacggcgactgcttcgtcttcggcggcggcaccaaagtagaaatcaaacgaaccgtcgccgccccctccgtcttcatcttccccccctccgacgaacaactaaagtccggcacagcctccgtcgtctgcctactcaacaacttctacccccgcgaagccaaagtccaatggaaagtcgacaacgccctccaatcaggcaactcccaagaatctgtcaccgaacaagactccaaagactcaacctactccctctcctcaaccctcaccctctccaaagccgactacgaaaaacacaaagtctacgcctgcgaagtaacccaccaaggcctctcttcccccgttacaaaatccttcaaccgaggcgaatgc

SEQ ID NO: 54493 - RNA, 1368 nt, synthetic construct
  misc_feature 1..1368: note = derived and/or modified sequence opt11 from Erenumab_HeavyChain
  source 1..1368: mol_type = other RNA
caagtccaactcgtcgaatccggcggaggcgtcgtccaacccggccgctcactccgtctctcctgcgcagcctccggcttcacattctcatcattcggcatgcactgggtccgccaagcccccggcaagggactagaatgggtcgcagtcatctcctttgacggctcaatcaaatacagcgtagattccgtcaaaggccgattcaccatctcacgcgacaactccaaaaatacacttttcctgcaaatgaactcactccgcgccgaagacaccgccgtatactactgcgcccgagaccgcctcaactactacgactcctcaggatattaccactacaaatactacggcatggccgtctggggccaaggaaccaccgtaactgtctcctccgcctccaccaaaggaccctccgtctttcccctcgctccctgctcccgctcaacctcggaatccacagccgccctaggctgcctcgtcaaagattactttcccgaaccagtcaccgtcagctggaactctggcgcactaacctccggggtccatactttccccgcagtcctccaatcatccggcctctattccctctcctccgtcgtaaccgtcccctcttccaacttcggcacccaaacctacacgtgcaacgttgaccacaaaccctccaacaccaaagtcgacaagaccgtcgaacgcaaatgctgcgtcgaatgcccaccctgccccgccccacccgtcgccggacctagcgtattcctcttcccgcccaaacccaaagacactctcatgatctcacgcacccccgaagtgacctgcgtcgtcgtagacgttagccatgaagaccccgaagtccagttcaactggtacgtcgacggcgtcgaagtacacaacgcaaaaaccaaaccccgcgaagaacaattcaattcaacattccgcgtcgtctctgtcctcaccgtcgtccaccaagactggctcaacggcaaagaatacaagtgcaaagtcagcaacaaaggactacccgctccaatcgaaaagaccataagcaaaaccaaaggccaacccagagaaccgcaagtatacaccctaccaccctcacgcgaggaaatgaccaaaaaccaagtatccctaacctgcctcgtaaaaggcttctatccctccgacatagcagtcgaatgggaatccaacggccaacccgaaaacaactataaaaccactcctcccatgctcgactcagacggatccttcttcctctactcaaaactcacagtagacaagtcccgatggcaacaaggcaacgtcttctcctgctcagtaatgcacgaggccctccacaaccactacacacaaaaatccctctccctatcccccggcaaa

SEQ ID NO: 54494 - RNA, 648 nt, synthetic construct
  misc_feature 1..648: note = derived and/or modified sequence opt11 from Erenumab_LightChain
  source 1..648: mol_type = other RNA
cagtccgtcctcacccaacccccctccgtctccgccgcccccggccaaaaagtcacaatctcctgctccggctcctcctccaacatcggcaacaactacgtctcctggtaccaacaactccctggcaccgcccccaaactactcatctacgacaacaacaaacgcccctccggcatccccgaccgcttctccggctcaaaatccggcacctccaccaccctaggcatcaccggcctccaaaccggcgacgaagccgactactactgcggcacctgggactcccgcctctccgccgtagtcttcggcggcggcaccaaactcacagtcctcggccaaccaaaagccaaccccaccgtcacactattccccccctcctccgaagaactccaagccaacaaagccaccctcgtctgcctcatctcagacttctaccccggcgcagtcacagtcgcatggaaagcagacggctcacccgtcaaagccggcgtcgaaaccaccaaaccctccaaacaatccaacaacaaatacgccgcctccagctacctctctctcacccccgaacaatggaaatcccaccgctcctactcctgccaagtcacccacgaaggctccaccgtcgaaaaaaccgtcgcccccaccgaatgctcc

SEQ ID NO: 54495 - RNA, 1344 nt, synthetic construct
  misc_feature 1..1344: note = derived and/or modified sequence opt11 from Fremanezumab_HeavyChain
  source 1..1344: mol_type = other RNA
gaagtccaactcgtagaatccggcggaggcctcgtccaacccggcggttcactccgtctctcgtgcgccgcctcaggcttcaccttctccaactactggatctcttgggtacgacaagcccccggcaaaggcctggaatgggtcgcagaaatccgatcagaatccgacgcctccgcaacccactacgccgaagccgtcaagggccgctttaccatctcacgcgacaacgcgaaaaactcactatacctccaaatgaactcgcttcgagctgaagacaccgcagtgtactactgcctcgcctacttcgactacggactcgcaatacaaaactactggggccaaggtaccctagtcacagtctcctccgcctccacaaaaggaccctccgtcttccccctagctccatgctcacgctccacatccgaatccacagcagcacttggctgcctcgtcaaagactacttccccgaaccagtcaccgtcagctggaactccggagccctaacctccggagtccacaccttccccgcagtactacaatcatccggactctatagcctctcctcagtagtcacagtcccctccagcaacttcggtactcaaacctatacatgcaacgtcgaccacaaaccaagcaacaccaaagtcgacaaaaccgtcgaacgaaaatgctgcgtcgaatgccctccctgccccgccccacccgtagctggacccagcgtcttcctattccctcccaaacccaaagacacgctaatgatctcacgaacccccgaagtaacctgcgtcgtagtcgacgtatcccacgaagaccctgaagtccaattcaactggtacgtagacggcgtcgaagtacacaacgcaaagaccaaaccaagagaagaacagttcaactccaccttccgcgtcgtctccgtcctcacagtcgtccaccaagactggctcaacggcaaagaatacaagtgcaaagtctccaacaaaggcctcccttcctccatcgagaaaacaataagcaaaaccaaaggccaaccccgcgaaccacaagtgtacaccctaccaccatcccgcgaagaaatgaccaaaaaccaagtctccctcacatgcttagtcaaaggattctacccctccgacatcgcagtcgaatgggaatccaacggccaacccgaaaacaactacaaaacaacaccacccatgcttgactcagacggtagctttttcctttactcaaaactcaccgtcgacaagtcccgttggcaacaaggaaacgtcttctcctgctccgtcatgcatgaagcactacacaaccactacacacagaaaagcctctccctcagccccggtaaa

SEQ ID NO: 54496 - RNA, 642 nt, synthetic construct
  misc_feature 1..642: note = derived and/or modified sequence opt11 from Fremanezumab_LightChain
  source 1..642: mol_type = other RNA
gaaatcgtcctcacccaatcccccgccaccctctccctctcccccggcgaacgagcaaccctctcctgcaaagcctcaaaacgagtcaccacctacgtatcctggtaccaacaaaaacccgggcaagctccccgcctcctaatctacggcgcctccaaccgctacctcggaatccccgcccgcttctccggctccggctccggcaccgacttcaccctcaccatctcctccctcgaacccgaagacttcgccgtctactactgctcccaatcctacaactacccctacaccttcggccaaggcaccaagctcgaaatcaaacgcaccgtcgccgccccatccgtcttcatcttcccaccctcagacgaacaactcaaatccggcaccgcctccgtcgtatgcctactcaacaacttctacccccgcgaagccaaagtccaatggaaagtcgacaacgccctccaaagcggcaactcccaagaatccgtcaccgaacaagactccaaagactcaacctactccctctcctcaaccctcaccctctccaaagcagactacgaaaaacacaaagtctacgcctgcgaagtcacccaccaaggcctatcatcccccgtcaccaaatccttcaaccgcggagaatgc

SEQ ID NO: 54497 - RNA, 1371 nt, synthetic construct
  misc_feature 1..1371: note = derived and/or modified sequence opt11 from Frunevetmab_HeavyChain
  source 1..1371: mol_type = other RNA
caagtccagctagtagagtccggagccgagctagtccaacccggcgaatccctcagactcacatgcgccgcatccggattctccctaactaacaacaacgtaaactgggtacgccaagcccccggaaaaggcctcgaatggatgggaggcgtctgggcaggcggcgccaccgactacaactcagcactcaaatcacgtctcaccatcacacgcgacacatccaaaaacaccgtcttcctacaaatgcactcactccaatccgaagacacagccacctactactgcgcccgagacggcggatactcctcctccaccctctacgccatggacgcctggggacaaggcactaccgtcacagtcagcgccgcctctaccacagcaccctccgtcttccccctcgccccctcctgcggaaccacatctggcgccaccgtcgcgctcgcctgcctcgtcctcggctacttcccagaaccagtcaccgtctcctggaactccggcgccctaacatccggcgtacacaccttccccgcagtactccaagcatcaggcctctactccctctcctccatggtcaccgtcccgtcatcacgctggctatccgacaccttcacgtgcaacgtagctcacccaccctccaataccaaagtcgataaaacggtccgcaaaacagaccatcccccaggacccaaaccctgcgactgccccaaatgccctccgcccgaaatgctcgggggcccctcaatcttcatcttcccgcccaaacccaaagacaccctctcaatctcacgaaccccagaagtcacatgcctcgtcgtcgacctgggccccgatgactcagatgtccaaatcacctggttcgtcgacaacacgcaagtctacaccgccaaaacctcgccccgtgaagaacaattcaactccacctaccgagtcgtctccgtcctgcccatcctccaccaagactggctcaaaggaaaagagttcaagtgcaaagtcaactccaaatcactaccatcccccatagaacgcacaatctccaaagccaaaggccaaccacacgaaccacaagtttacgtgctaccacccgcccaagaagaactatcccggaacaaagtctcagtaacctgcctcataaagagcttccacccacccgatatcgccgtagaatgggaaatcacaggtcaacccgaacccgaaaacaactaccggaccacaccaccccaactagactcagacggcacctacttcgtatactcaaaactctccgtagaccgctcacactggcaacgaggcaacacatacacatgcagcgtctcccacgaagccctacactcccaccacacacaaaaatccctcacccaatcccccggcaag

SEQ ID NO: 54498 - RNA, 651 nt, synthetic construct
  misc_feature 1..651: note = derived and/or modified sequence opt11 from Frunevetmab_LightChain
  source 1..651: mol_type = other RNA
gacatcgaaatgacccaatccccactctccctatccgtcaccccaggcgaatccgtctccatatcctgccgagcctccgaagacatctacaacgccctcgcctggtacctccaaaaacccggccgctcaccccgcctcctcatctacaacaccgacaccctccacacaggcgtacccgaccgattctccggctccggctccggcaccgacttcaccctcaaaatctcccgcgtccaaaccgaagacgtcggcgtctacttctgccaacattacttccactacccccgcaccttcggccaaggcaccaaactcgaactcaaacgatccgacgcccaaccctccgtcttcctattccaaccctccctagacgaactccacaccggctccgcctccatcgtctgcatactcaacgacttctaccccaaagaagtcaacgtcaaatggaaagtcgacggcgtcgtacaaaacaaaggcatccaagaatccaccaccgaacaaaactccaaagactccacctactccctctcctccaccctaaccatgtcctccaccgaataccaatcccacgaaaaattctcctgcgaagtcacccacaaatccctcgcctccaccctcgtcaaatccttcaaccgctccgaatgccagcgcgaa

SEQ ID NO: 54499 - RNA, 1341 nt, synthetic construct
  misc_feature 1..1341: note = derived and/or modified sequence opt11 from Gatipotuzumab_HeavyChain
  source 1..1341: mol_type = other RNA
gaagtccaactcgtcgagtcaggaggcggactcgtccaacccggcggctccatgcgcctcagctgcgtagcctctggtttccccttttccaactactggatgaactgggtacgccaagcccccggcaaaggactcgaatgggtcggcgaaatacgcctaaagagcaacaactacaccacccactacgccgaatccgttaaaggccgcttcaccatctcccgagacgacagcaagaactcactctacctgcaaatgaactcacttaaaacagaagacaccgccgtctactactgcacccgacactactacttcgactactggggtcaaggcaccctcgtaacagtctcatccgcctccacaaaaggaccctccgtattccccctcgccccctcctccaaatcaacatccggcggaacagctgccctaggctgccttgtcaaagattacttccccgaacccgtcacggtatcctggaactccggcgcactcacatccggcgtccacaccttccccgcagtcctacagtccagcggtctctactccctaagctccgtagtcacagtcccctcatcctcactgggcacacaaacatacatctgcaacgtcaaccacaaaccctccaacaccaaggtcgacaaaaaggtcgaacccaagtcatgcgacaaaacccatacctgcccaccctgccccgcccccgaactcctaggcggaccctcagtcttcctattcccacccaaacccaaagacaccctcatgatctcccgaaccccagaagtaacctgcgtagtggtcgacgtaagccacgaagacccagaagtcaaattcaactggtacgtcgacggcgtcgaagtacacaacgccaagacaaaaccccgcgaggaacaatacaacagcacctaccgagtagtctccgtcctcacagtactacaccaagactggcttaacggcaaggaatacaaatgcaaggtctccaacaaagccctccccgcccccatcgagaaaaccatatccaaagcaaaaggacaacccagagaaccccaagtctacaccctgccacccagccgtgatgaactcaccaagaaccaagtatcactaacctgcctcgtcaagggattttacccctccgacatcgccgtcgaatgggaatcaaacggacaacccgaaaacaactacaaaacaacccctcccgtcctcgactcggacggcagcttctttctctacagcaaactcaccgttgacaaatcacgttggcagcaaggcaacgtcttctcatgctccgtcatgcacgagggcctccacaaccattacacccaaaagtccctctccctctcacccggtaaa

SEQ ID NO: 54500 - RNA, 657 nt, synthetic construct
  misc_feature 1..657: note = derived and/or modified sequence opt11 from Gatipotuzumab_LightChain
  source 1..657: mol_type = other RNA
gacatcgtcatgacccagtcacccctctccaaccccgtcacccccggcgaacccgcctccatctcctgccgatcctccaaatccctcctccactcaaacggcatcacctacttcttctggtacctccaaaaacccggccaatcaccccaactcctaatctaccaaatgtccaacctagcctcaggcgtccccgaccgcttctccggctccggctccggcaccgacttcacccttcgcatctccagagtcgaagccgaagacgtcggcgtctactactgcgcccaaaacctcgagctaccacccaccttcggccaaggtaccaaagtcgaaatcaaacgcaccgtcgcagccccctccgtcttcatattcccaccctcagacgaacaactcaaatccggcaccgcctccgtcgtctgcctcctcaacaacttctacccccgagaagccaaagtccaatggaaagtcgacaacgccctccaatccggcaactcccaagaatccgtcaccgaacaagactccaaagactccacctactccctatcctccacactcaccctctccaaagccgactacgaaaaacacaaagtatacgcctgcgaagtaacccaccaaggcctttcctcccccgtcaccaagtccttcaaccgtggcgagtgc

SEQ ID NO: 54501 - RNA, 1365 nt, synthetic construct
  misc_feature 1..1365: note = derived and/or modified sequence opt11 from Gedivumab_HeavyChain
  source 1..1365: mol_type = other RNA
gaagtccaactcgtagaatccggaggaggcgtcgtccaaccaggcaaatccctccgcctctcatgcgccgcatccggcctcaccttctcctcctacgcagtccactgggtccgccaagcaccgggcaaaggcctcgaatgggtaactctaatctcctacgacggcgcaaaccaatactacgcagactcagtcaagggacgcttcacaatctcccgtgacaactccaaaaacactgtctacctccaaatgaactccctacgcccagaagacactgccgtctactactgcgccgtccccggccccgtattcggcatcttcccaccctggtcctacttcgacaattggggtcaaggcatcctcgtcacagtctcctccgcatcaactaaaggcccctccgtattccccctcgccccctcctcgaaaagcacctccggaggcacagccgcactaggatgcctcgtcaaagactacttccccgaacccgtcaccgtatcctggaactccggagccctcacctcaggcgtccataccttcccagcagtcctccaatcatccggtctctactccctaagctctgtcgtaacagtaccctcctcctccctaggtacacaaacctacatatgcaacgtcaaccacaaaccatccaacaccaaagtagacaagaaagtcgaacccaaatcctgtgacaaaacccacacctgtccaccctgccccgcccccgaactcctcggaggcccctccgtattcctcttcccacccaaacctaaagacacactaatgatctcccgaaccccagaagtaacctgcgtcgtcgtcgacgtctcccacgaagaccccgaagtcaaattcaactggtatgtcgacggcgtcgaagtacataacgcaaaaaccaaaccgcgcgaagaacaatacaactccacatatcgcgtcgtctccgtcctaaccgtccttcaccaagactggctgaacggcaaagagtacaaatgcaaagtcagcaacaaagccttaccagcccccatcgagaaaaccatctccaaagctaagggccaaccccgcgaaccccaagtctacactctaccgccctcgcgagaagaaatgaccaaaaaccaagtatccctaacctgcctcgtcaaaggcttctacccctccgatatcgcagtcgaatgggaatccaacggacagcctgaaaacaactacaaaaccaccccaccagtcctcgattccgacggcagcttcttcctctactccaaattaaccgtagacaaatcccgatggcaacaaggcaacgtattctcctgctccgtcatgcacgaagcactccacaaccactacacccaaaaatcactctccctctcccccggaaag

SEQ ID NO: 54502 - RNA, 648 nt, synthetic construct
  misc_feature 1..648: note = derived and/or modified sequence opt11 from Gedivumab_LightChain
  source 1..648: mol_type = other RNA
gaaatcgtcctcacccaatctcccgccaccctctccgtctcacccggcgaacgcgccaccctatcctgccgcgcctcccaagtcatctcccacaacctcgcctggtaccaacaaaaacccggccaagcaccccgcctcctaatctacggcgcctccacccgcgcctccggaatccccgcccgcttctccggatcaggctccggcacagactacaccctcaccatcacctcactccaatccgaagacttcgccgtctactactgccaacactactccaactggcccccccgcctcaccttcggcggcggcaccaaagtcgaaatcaaacgtaccgtcgcagccccctccgtcttcatcttccccccctccgacgaacaactcaaatccggaaccgcttccgtcgtctgcctcctcaacaacttctacccccgagaagccaaagtccaatggaaagtcgacaacgccctccaatccggaaactcacaagaatccgtaaccgaacaagactccaaagactccacctactccctatcctccaccctcaccctctccaaagccgactacgaaaaacacaaagtctacgcctgcgaagtcacacaccaaggactatcctcccccgtcaccaaatcattcaaccgcggcgaatgc

SEQ ID NO: 54503 - RNA, 1329 nt, synthetic construct
  misc_feature 1..1329: note = derived and/or modified sequence opt11 from Gemetuzumab_HeavyChain
  source 1..1329: mol_type = other RNA
gaggtccaactcgtgcaatccggagccgaagtcaagaaacccggctccagcgtcaaagtctcctgcaaagcctcaggatacaccataaccgactccaacatccactgggtccgacaagcccccggtcaatccctcgaatggatcggatacatctacccctacaacggaggaactgattacaaccaaaaattcaaaaatcgcgccaccctaacagttgacaaccccaccaacaccgcctacatggaactatcatcccttcgctccgaagacaccgccttctactactgtgtcaacggcaacccctggttagcctactggggccaaggaaccctcgtcaccgtctcctcagcatcaaccaaaggcccctccgtcttcccactagctccctgctcacgaagcacctccgaatccacagccgcccttggatgcctcgtcaaagactacttccccgaacccgttaccgtatcatggaactccggcgcattaacctccggcgtccacaccttcccagcagtcctccaatcctcaggcctttattccctttcaagcgtagttaccgtcccctccagctcactcggaaccaaaacctacacatgcaacgtagaccacaaaccttcaaatacaaaagtcgataaacgagtcgaatccaaatacgggcccccatgtcccccatgcccggcccccgagttcctcggcggcccctccgtcttcctattcccgcccaaacccaaagacacacttatgatctcacgcacccccgaagtaacatgcgtcgtcgtcgacgtctcccaagaagaccccgaagtccagttcaactggtacgtcgacggcgtcgaagttcacaacgccaaaacaaaaccccgcgaagaacaattcaactccacctaccgcgtcgtttccgtcctcacagtactccaccaagactggctcaacggcaaagaatacaaatgcaaagtctcaaacaaaggcctcccctcatccatcgaaaagaccatcagcaaagccaaaggacaaccccgagaaccacaagtatacactcttccaccctcccaagaagaaatgaccaaaaaccaagtctcactcacgtgccttgtcaaaggcttctacccctcagatattgccgtcgagtgggaatccaacggtcaacccgaaaacaactacaaaacaaccccacccgtcctcgactccgacggcagcttcttcctctactcacgactcaccgtagacaaatcccgctggcaagaaggcaacgtcttctcctgctcagtaatgcacgaagccctccacaaccactacacccaaaaatccctatcactctcccttggcaaa

SEQ ID NO: 54504 - RNA, 654 nt, synthetic construct
  misc_feature 1..654: note = derived and/or modified sequence opt11 from Gemetuzumab_LightChain
  source 1..654: mol_type = other RNA
gacatccaactaacccaatccccctccaccctatccgcctccgtcggcgaccgcgtaaccatcacctgccgcgcatccgaatcccttgacaactacggcatccgcttcctaacatggttccaacaaaaacccggcaaagccccaaaactcctaatgtacgcagcctcaaaccaaggctccggagtaccctcccgcttctccggctccggctcaggcacagaattcaccctaaccatctcctccctccaacccgacgacttcgccacctactactgccaacaaacaaaagaagtcccatggtccttcggccaaggcaccaaagtcgaagtcaaacgcacagtagcagccccctccgtcttcatcttccctccctccgacgaacaactcaaatccggcaccgcctcagtcgtctgcctactcaacaacttctacccacgcgaagccaaagtccaatggaaagtcgacaacgccctccaatccggcaactcccaagaatccgtcaccgaacaagactccaaagactccacctactccctctcctccaccctcaccctctcaaaagccgactacgaaaaacacaaagtatacgcctgcgaagtcacccaccaaggcctgtcctcccccgtcaccaaatccttcaaccgaggcgaatgc

SEQ ID NO: 54505 - RNA, 1365 nt, synthetic construct
  misc_feature 1..1365: note = derived and/or modified sequence opt11 from Gilvetmab_HeavyChain
  source 1..1365: mol_type = other RNA
gaagtccaactcgttcaatccggcggagacctagtcaaacccggcggcagcgtacgcctctcctgcgtagcgtcaggcttcaacatcaagaacacatacatgcactgggttcggcaagcccccggcaaaggcctccaatggatcggccgcatcgcccccgcaaacgtcgatactaaatatgcccccaagttccaaggcaaagccaccatctccgccgacacagccaaaaacacagcctacatgcaactaaatagcctacgcgcagaagacaccgccgtctactactgcgtcctaatctactacgactacgacggagacatcgacgtctggggccagggcacactcgtcacagtctcatcagcatccactaccgcaccctccgtcttccccctcgccccctcatgcggctccacctccggatcaacagtcgcgctcgcctgtcttgtatccggctatttccccgaacccgtcaccgtctcctggaactcaggctcgttaacctccggcgttcacaccttcccatccgtactccaatcctcaggactctactcactatcatctatggtcacagtcccaagctcacgctggcccagcgaaacctttacctgcaacgtcgcccacccggcctctaaaacaaaagtcgataaacccgtccccaagcgcgaaaacggccgcgtacccagaccacccgactgccccaaatgccccgccccagaaatgctcggcggccccagcgtattcatcttcccacccaaacccaaagacaccctactcatcgcccgcacccccgaagtcacatgcgtggtagtcgccctcgacccagaagaccctgaagtccaaatctcctggttcgtagacggcaaacaaatgcaaaccgccaaaacacaaccccgcgaagaacaattcgccggaacctaccgagtagtatccgtcctccccataggccatcaagattggctaaaaggcaaacagttcacatgcaaagtaaacaacaaagccctcccctcacccatcgaacgcacaatatccaaggcccgtggacaagcccaccaaccatccgtctacgtcctacctccatcacgcgaagaactatccaaaaacacagtttcactcacatgccttatcaaggacttcttcccacccgacatcgatgtcgaatggcagagcaacggccaacaagaacccgaatccaaataccgcaccactccaccccaactagacgaggacggctcatatttcctatactccaagctctctgtcgacaagtctcgatggcaacgcggcgataccttcatctgcgccgtcatgcacgaagccctccacaaccactacacccaagaatctctatcccactcccccggcaaa

SEQ ID NO: 54506 - RNA, 654 nt, synthetic construct
  misc_feature 1..654: note = derived and/or modified sequence opt11 from Gilvetmab_LightChain
  source 1..654: mol_type = other RNA
gacatcgtaatgacccaaacacccctctccctctccgtctcactcggcgaacccgcctccatctcctgccacgcctcccaaaacataaacgtctggctctcctggtaccgccaaaaacccggccaaatcccacaactcctcatatacaaagcctcacacctacacaccggcgtccccgaccgcttctccggctccggctccggcaccgacttcaccctccgcatctcccgcgtagaagccgacgacgccggcgtatactactgccaacaaggccaatcctggccactcaccttcggccaaggaaccaaagtcgaaatcaaacgcaacgacgcccaacccgccgtctacctcttccaaccctcccccgaccaactccacacaggctccgcctccgtcgtctgcctcctcaactccttctacccaaaagacatcaacgtcaaatggaaagtcgacggcgtcatccaagacaccggcatacaagaatccgtcaccgaacaagactccaaagactcaacctactccctctcctccaccctaacaatgtcctccaccgaatacctctcacacgaactatactcctgcgaaatcacccacaaatccctcccctccaccctcatcaaatccttccaacgctccgagtgccaacgcgtcgac

SEQ ID NO: 54507 - RNA, 1344 nt, synthetic construct
  misc_feature 1..1344: note = derived and/or modified sequence opt11 from Ifabotuzumab_HeavyChain
  source 1..1344: mol_type = other RNA
caagtacaactcgtccaaagcggagccgaagtcaagaaacccggcgcctccgtaaaagtctcctgcaaagcctccggctacacattcaccggctactggatgaattgggtccgccaggcccccggacaagggctcgaatggatgggcgacatctaccccggctcaggcaacaccaactacgacgaaaaattccaaggcagagtcaccatgacccgagatacgtcaatctcaacggcctacatggaactaagccggctcagatctgacgacaccgccgtatactactgcgcccgaggcggctactacgaagacttcgactcctggggacaaggaaccaccgtcaccgtttcatccgcaagcaccaaaggcccctccgtattccccctcgccccctcgtcaaaaagcacctccggcggcaccgccgcactcggatgcctcgtcaaagactacttccccgaacccgtaaccgtctcctggaactccggcgccctaaccagcggcgtacacaccttccccgccgtcctccaatcttcaggactgtactccctttccagcgttgtcaccgtaccaagcagctccctaggaactcaaacctacatatgcaacgtcaaccacaaaccaagcaacacaaaagtcgacaaacgagtagaaccaaaatcatgcgacaaaacacacacatgcccaccctgccccgcacccgaactactcggcggaccctcagtcttcctcttcccacccaaacccaaagacaccctcatgatcagccgaacacccgaagtcacatgcgtcgtcgtcgacgtgtcacacgaagaccccgaagtaaaattcaactggtacgtcgacggcgtcgaagtccacaacgcaaagaccaagccccgcgaagaacaatacaacagcacctaccgcgtcgtcagcgtccttaccgtcttacaccaggactggctcaacggcaaagaatacaaatgcaaagtgtccaacaaagcactccccgcccccatcgaaaagaccatctccaaagccaaaggacaaccccgagaaccacaagtctacaccctacccccaagtcgagaagaaatgaccaaaaaccaagtctccctcacatgcctcgtcaaaggcttctacccctcagacatcgcagtcgaatgggaatccaacggccagcccgaaaacaactacaaaaccaccccacccgtactcgacagcgacggctccttcttcctctacagcaaactcacagtagacaaaagccgctggcaacagggcaacgtcttctcctgctcagtcatgcacgaagcactccacaatcactacacccaaaaatccctgtctctctcccccggcaaa

SEQ ID NO: 54508 - RNA, 642 nt, synthetic construct
  misc_feature 1..642: note = derived and/or modified sequence opt11 from Ifabotuzumab_LightChain
  source 1..642: mol_type = other RNA
gacatccaaatgacccaatcaccctccttcctatcagcctccgtaggcgaccgcgtcaccatcacctgccgcgcatcccaaggcatcatctcatacctcgcctggtaccaacaaaaacccgaaaaagcccccaaacgcctaatctacgccgccagctccctccaatccggcgtccccagccgcttctccggctccggctcaggcaccgaattcaccctcaccatctcctcgctccaacccgaagacttcgccacctactactgcggccaatacgccaactacccctacaccttcggccaaggcaccaaactcgaaatcaaacgcaccgtcgccgcccccagcgttttcatcttccccccatcagacgaacaactcaaatccggcaccgcctccgtcgtctgcctcctcaacaacttctacccccgcgaagccaaagtccaatggaaagtcgacaacgccctccaaagcggcaactcacaagaatccgtaaccgaacaagacagcaaagactccacctactcactctcctccaccctcaccctctccaaagccgactacgaaaaacacaaagtctacgcctgcgaagtcactcaccaaggcctatcctcccccgtcaccaaatccttcaaccgaggcgaatgc

SEQ ID NO: 54509 - RNA, 1323 nt, synthetic construct
  misc_feature 1..1323: note = derived and/or modified sequence opt11 from Iratumumab_HeavyChain
  source 1..1323: mol_type = other RNA
caagtacaactccaacaatggggcgccggtttactcaaacccagcgaaaccctatccctaacctgcgccgtatacggcggctcattctccgcctactactggtcctggatccgccaaccgcccggcaaaggcctcgaatggataggcgacatcaatcacggcggaggcaccaactacaacccctccctaaaatcccgagtaacaatctccgtagacacctccaaaaaccaattctccctaaaactaaactccgtaaccgccgccgacacagccgtctattactgcgcctcactcaccgcctattggggccaaggctccctagtcaccgtctcatccgcctcaaccaagggcccctcagtcttccccctcgccccctccagtaaatccacctcaggcggaacagcagccctaggctgcctcgtaaaagactacttccccgaacccgtcacagtctcctggaactcaggcgccctcacttcaggcgtccacaccttccccgccgtacttcaaagctccggcctctactcactctcctccgtcgtaacagtcccttcctcttcactaggcacccagacctacatatgcaacgtcaaccacaaaccttccaacaccaaagtcgacaagaaagtcgaacccaaaagctgcgacaaaacccacacctgtccaccctgccccgcccccgagctcctaggcggcccctccgtcttcctcttcccacccaaacccaaagacaccctcatgatctcacggacccccgaagtcacatgcgtcgttgtcgacgtctcacacgaagacccagaagtcaaattcaactggtacgtggatggagtcgaagtccacaacgcaaaaaccaagccacgcgaggaacagtacaactcaacctaccgcgtcgttagcgtcctcacagtactacaccaagactggctcaacggcaaagaatacaaatgcaaagtcagcaacaaagcactccccgcccccatagagaaaaccatctcaaaagcaaaaggtcaaccccgtgaaccccaagtatacaccctcccaccctcccgcgacgaactaaccaaaaatcaagtatccctaacctgcctcgtcaaaggcttctacccctcagacatcgccgtcgaatgggaatccaacggtcaacccgaaaacaattacaaaacaacccctcccgtcctagactccgacggctcattcttcctctactccaaactgacggtagacaaatcccgatggcaacaaggcaacgtctttagctgttccgttatgcacgaagcccttcacaaccacacccaaaagtcactctcactctcccccggcaaa

SEQ ID NO: 54510 - RNA, 642 nt, synthetic construct
  misc_feature 1..642: note = derived and/or modified sequence opt11 from Iratumumab_LightChain
  source 1..642: mol_type = other RNA
gacatccaaatgacccaatcccccacctcactctccgccagcgtcggcgaccgcgtcaccatcacctgccgcgcctcccaaggcatctcctcctggctaacctggtaccaacaaaaacccgaaaaagcccccaaatccctaatctacgccgccagctccctccaatccggagtcccctcacgtttctccggctcaggctccggcaccgacttcaccctcacaatctcctccctccaacccgaagacttcgcaacctactactgccaacaatacgactcctaccccatcaccttcggccaaggcacccgcctcgaaatcaaacgcacagtcgccgccccctccgtcttcatcttccccccctctgacgaacaactaaaatccggcacagcctccgtcgtctgcctcctcaacaacttctacccccgcgaagctaaagtccaatggaaagtcgacaacgcactccaatccggcaactcccaagaatccgtcaccgaacaagacagcaaagactccacctactcactctcctcaaccctaaccctctcaaaagccgactacgaaaaacacaaagtatacgcctgcgaagtcacccaccaaggcctctcctcccccgtaaccaaatctttcaaccgaggcgaatgc

SEQ ID NO: 54511 - RNA, 1344 nt, synthetic construct
  misc_feature 1..1344: note = derived and/or modified sequence opt11 from Lacnotuzumab_HeavyChain
  source 1..1344: mol_type = other RNA
caagtccaactacaagaaagcggccccggcctcgtcaaaccctcccagacactttccctgacctgcacagtctccgactactccatcacatccgactacgcctggaactggatccgccaatttcccggcaagggcctagaatggatgggatacatatcttactctggttccacctcctacaacccatcgctcaaatcacgcatcacaatctcgcgcgacacctccaaaaaccaattctcactccaactcaattctgtcaccgcagccgacactgcagtctactactgcgcatcattcgactacgcacacgccatggattactggggccaaggaacaaccgtcaccgtctcctcagcctccaccaaaggaccctccgtattcccgctagccccctcctccaaatccacatccggcggcacagccgccctcggctgcctagtcaaagactatttcccagaacccgtaaccgtctcatggaactcaggagccctcacttcaggagtccacaccttccccgcagttctacaatcctccggactatattccctctcttccgtcgtcactgtcccctcctcctccctcggcacccaaacatacatctgtaacgtcaaccacaaaccctccaacaccaaagtcgacaaacgcgttgaaccaaaatcctgcgacaaaacccacacatgcccaccctgccccgcacccgaactcctcggcggaccctccgtctttctcttcccacccaaacccaaagacacactaatgatatcaagaacccccgaagtcacctgtgtcgtcgtcgacgtatcacacgaagaccccgaagtaaaattcaactggtacgtggacggcgtcgaagtacacaacgccaagaccaaaccccgtgaagaacaatacaactctacctaccgcgtcgtatccgtcctcaccgtcctccaccaagactggctaaacggcaaagaatacaaatgcaaagtctcaaacaaggccctcccagcccccatcgaaaagaccatctcaaaagcaaaaggacaaccccgagaaccacaagtctacacactcccaccctcccgagaagaaatgactaaaaaccaagtctcccttacctgcctcgtcaaaggattctacccctccgacattgctgtcgaatgggaatccaacggacaacccgaaaacaactacaaaaccaccccacccgtcctcgactctgacggatccttcttcctctactccaaactcacagtagacaaatcccgctggcaacaaggcaacgtcttctcatgctccgtaatgcacgaagcactccacaaccactacacccagaaatccctctcactatcacccggcaaa

SEQ ID NO: 54512 - RNA, 642 nt, synthetic construct
  misc_feature 1..642: note = derived and/or modified sequence opt11 from Lacnotuzumab_LightChain
  source 1..642: mol_type = other RNA
gacatcgtcctcacccaaagccccgccttcctgtccgtcacccccggcgaaaaagtcaccttcacgtgccaagcatcccaaagcataggcacctccatacactggtaccaacagaaaaccgaccaagcccccaaactcctcatcaaatacgcatccgaatccatatccggcatcccctccagattctcaggctccggctcaggcaccgacttcaccctaaccatctcctccgtcgaagccgaagacgcagccgattactactgccaacaaatcaactcatggcccaccaccttcggaggcggcaccaaactcgaaatcaaacgcaccgtcgccgccccctccgtcttcatattcccaccctccgacgaacaactcaaatcaggcaccgcctccgtcgtatgcctcctcaacaacttctacccacgcgaagccaaagtccaatggaaagtcgacaacgcactccaatccggcaactcccaagagtccgtaaccgaacaagactccaaagactcaacctactccctctcctccaccctcaccctctccaaagccgactacgaaaaacacaaagtatacgcatgcgaggtcacccaccaaggcctcagctcccccgtcaccaaatccttcaaccgcggcgaatgc

SEQ ID NO: 54513 - RNA, 1347 nt, synthetic construct
  misc_feature 1..1347: note = derived and/or modified sequence opt11 from Larcaviximab_HeavyChain
  source 1..1347: mol_type = other RNA
gaagtccaactccaggaatccggccccgaactagaaatgcctggagcatccgtcaaaatatcatgcaaagctagcggctcctcattcaccggcttctcaatgaactgggtcaaacaatccaacggaaaatctctcgaatggatcggcaacatcgacacctactatggcggcacaacctacaaccaaaaatttaaaggaaaagcaaccctcacagtcgacaaatcatcttccaccgcctacatgcaacttaaatccctcacctctgaagactccgccgtctactactgcgccagaagcgcctactacggctccaccttcgcctactggggccaaggtaccctcgttaccgtctccgcagcctcaaccaaaggcccatccgttttccccctagcaccctcctctaaatcaacctctggcggcacagcggcccttggctgtctcgtcaaagactacttccccgaacccgtcacggtatcctggaactctggagccctcacatccggagtccacaccttccccgccgtactacaatcctccggcctctacagtctatcctccgtcgttaccgtcccctccagctctctaggcacccaaacctacatatgcaacgtcaaccacaaaccttccaacaccaaagtagacaaacgcgtcgaacccaaatcctgtgacaaaacacacacatgcccaccctgccctgcccccgaactcctcggcggccccagcgtcttcctctttcccccaaaacccaaggacaccctcatgatctcccgaaccccagaagtaacctgcgtcgtcgtcgacgtctcccacgaagacccggaagtcaaattcaactggtacgtcgacggagttgaagtgcacaacgccaaaaccaagccccgtgaagaacaatacaactctacctaccgagtagtctccgtcctcaccgtcctacaccaagactggctcaacggcaaagaatacaaatgcaaagtttccaacaaagccctcccagccccaatcgaaaagaccatctcaaaagccaaaggacagccccgtgaaccccaagtatacactctccctccctcccgcgacgaactcaccaaaaaccaagtctccctgacctgcctcgtcaaaggattctacccctccgacatcgcagtagaatgggaatcaaacggacaacccgaaaacaactacaaaaccacaccacccgtactcgactcggacggctcgttcttcctatactcaaaactcaccgtcgacaaatcacgatggcaacaaggcaacgtcttctcttgcagcgtcatgcacgaagccctccacaaccactacacacaaaaatcactctccctctcccccggcaaa

SEQ ID NO: 54514 - RNA, 642 nt, synthetic construct
  misc_feature 1..642: note = derived and/or modified sequence opt11 from Larcaviximab_LightChain
  source 1..642: mol_type = other RNA
gacatccaaatgacccaatcccccgcctcactctctgcatcagtcggcgaaaccgtcaccatcacctgccgcgcctccgaaaacatctactcatacctagcctggtaccaacaaaaacaaggaaaatcaccccaactcctcgtctacaacgcaaaaaccctcatcgaaggcgtcccctcccgattctcaggctcaggctccggcacccaattctccctaaaaatcaactccctacaacccgaagacttcggctcctacttctgccaacaccacttcggcacccccttcaccttcggctccggaaccgaactcgaaatcaaacgcaccgtcgccgccccctccgtattcatcttccccccctccgacgaacaactcaaatccggcaccgcctccgtcgtctgcctcctcaacaacttctacccccgcgaagccaaagtccaatggaaagtcgacaacgccctccaatccggcaactcacaagaatccgtcaccgaacaagactccaaagactccacctactccctatcctccacactaaccctatccaaagccgactacgaaaaacacaaagtctacgcatgcgaagtcacccaccaaggcctctcctcccccgtcaccaaatccttcaaccgcggcgaatgc

SEQ ID NO: 54515 - RNA, 1338 nt, synthetic construct
  misc_feature 1..1338: note = derived and/or modified sequence opt11 from Lendalizumab_HeavyChain
  source 1..1338: mol_type = other RNA
caagtacaactcgtccaatcaggcgcggaagtcaagaaacccggcgcctccgtcaaagtctcatgcaaagcctccggctacaccttcaccgattactccatggactgggtacgccaagcccccggacaaggcctcgaatggatgggagccatacacctcaacacaggatacacaaactacaaccaaaaattcaaaggccgcgtcaccatgacccgagacacctccacctcaaccgtctatatggaactaagctcactacgctcagaagacacagccgtctactactgcgcccgcggcttctacgacggttattcccccatggactactggggccaaggcaccaccgtaacggtctcctccgcctccaccaaaggtccctccgtcttcccactagcaccatgctcccgctccacctccgaaagcaccgccgccctaggatgcctagtcaaagactacttccccgagccagtcaccgtctcctggaactccggcgcactcacctccggcgtacacaccttcccagccgtactccagtcctcaggactctactccctctcctccgtcgtaaccgtaccctcatccaacttcggcacccaaacctatacatgcaacgtcgaccacaaaccgtctaacacaaaagtcgacaagaccgtagaacgaaaatgctgcgtagagtgccctccctgcccagccccaccagtcgccggccccagcgtcttcctcttcccacccaagcccaaagacacactcatgatctctcgcacacccgaagtaacctgcgtcgtcgtcgacgtctcccaagaagaccctgaggtacaattcaactggtacgtcgacggcgtagaagtccacaacgccaaaactaaacccagagaagaacaattcaactccacctacagagtcgtctccgtactcacagtcctacaccaagattggctcaacggcaaagaatacaaatgcaaggtctccaacaaaggcctcccatccagtatagagaaaacaatcagcaaagccaaaggacaaccacgcgaaccccaagtctacaccctacccccatcacaagaagaaatgaccaaaaaccaagtttccctaacttgcctcgtcaaaggattctacccatccgacatcgccgtcgaatgggaatccaacggccaacccgaaaacaactacaagaccacccctcctgtattagactccgacggatcattcttcctctactcacgcctaacagtcgacaaatcacgttggcaggaaggcaatgtcttctcttgctccgtcatgcacgaagccctccacaaccactacacccaaaaatccctctccctctcgctaggcaaa

SEQ ID NO: 54516 - RNA, 654 nt, synthetic construct
  misc_feature 1..654: note = derived and/or modified sequence opt11 from Lendalizumab_LightChain
  source 1..654: mol_type = other RNA
gatatccagatgacgcaatcgcccagctcattgagcgcgagtgtgggcgaccgtgtaaccataacctgtcgagcgagcgagagcgtggactcgtacgggaactcgttcatgcactggtaccagcaaaagcctggtaaagcgcccaagctattgatctatcgcgcgagcaatctcgagagcggggtcccgagcagattctcgggatcgggctcgggcacagacttcaccctgaccattagctcactccagcccgaagactttgccacgtactactgccagcaatcgaacgaggacccgtacacattcggaggcgggaccaaggtcgagataaagcgcacggtcgcggccccaagcgtgttcatattcccgccctcggacgagcaactgaaatcaggcacggcctcggtcgtatgcctgctcaacaacttttacccgcgcgaggccaaggtccagtggaaggtcgataacgcgctccagagcgggaactcgcaagagagcgtgaccgagcaagatagcaaggactcgacctacagcctgagctcgaccctgaccttgagcaaggccgactacgagaaacataaagtgtacgcatgcgaggtcacgcaccaaggattgagctcacccgtgaccaagagctttaacaggggagaatgc

SEQ ID NO: 54517 - RNA, 1359 nt, synthetic construct
  misc_feature 1..1359: note = derived and/or modified sequence opt11 from Lesofavumab_HeavyChain
  source 1..1359: mol_type = other RNA
gaagtccaactcgtccaatccggcgccgaagtcaagaaacccggcgaatccctaaaaatcagctgcaaagtctcaggctactccttcaccagccaatggatcggatgggtccgacaaatgccaggcaaaggcctcgaatggatcggtatgatgtacccaggcgaatccgaaaccatatactccccctccttccaaggccaagtaacaatctccgcagacaactccatctccaccgcctacctccaatggtcctcgctaaaagcatccgacacggccatatactactgcgcctccggccccggatactccggctatcactacggctggttcgacacctggggccaaggaaccctcgtcacagtcagttccgcatccaccaaagggccttccgtattccccctcgccccctcctccaaatccacatccggtggcacagctgcactaggttgcctcgttaaagactacttccccgaacccgtaacagtctcctggaactccggcgccctcacctcaggagtccatactttccccgcagtactccaatcctccggactctactcactctcaagcgtcgtcaccgtcccctcctcatccctcggcacccaaacctacatctgcaacgtcaaccacaaaccatccaacactaaagtcgacaagaaagtcgaaccaaaatcgtgcgacaaaacccacacatgccctccctgccccgcccccgagctcctcggcggaccctctgtcttcctctttccacccaaaccaaaagacacactcatgatctcccggacacccgaagtaacctgcgtcgtagtcgacgtatcacacgaagaccccgaagtcaaattcaactggtacgtagacggcgtcgaagtacacaacgccaaaacaaaaccccgcgaagaacaatataactcaacctaccgagtagtcagcgtcctaaccgtactccaccaagactggctcaacggcaaagaatacaaatgcaaagtctccaacaaagcactcccagcccctattgagaaaacaatctccaaagccaaaggccaacccagggaaccccaagtctacaccctcccaccaagcagagaagaaatgaccaaaaaccaagtatccctaacctgcctagtcaaaggcttttacccctctgacatcgcagtcgaatgggaatcaaacggtcaacccgaaaacaactacaaaaccaccccacccgtactcgactcagacggctccttcttcctatactccaaactcactgtagacaaatcccgctggcaacaaggaaacgtcttctcctgcagcgtaatgcatgaagccctacacaaccactacactcagaaatccctcagcctctcccccggcaaa

SEQ ID NO: 54518 - RNA, 657 nt, synthetic construct
  misc_feature 1..657: note = derived and/or modified sequence opt11 from Lesofavumab_LightChain
  source 1..657: mol_type = other RNA
gacatcgtcatgacccaaagccccctctcactccccgtaacccccggcgaacccgcctcaatctcatgccgctcctcccaatcactcctccgctccaacggctacaactacctcgactggtacctccaaaaacccggccaatcaccccaactcctcatctacctcggctccaaccgcgcctccggagtcccagaccgattctccggctccggctccggcaccgacttcaccctcaaaatatcccgcgtcgaagccgaagacgtcggcgtctactactgcatgcaagccctacaaaccccatacaccttcggccaaggcaccaaactcgaaatcaaacgaaccgtcgccgccccctccgtcttcatcttccctccctccgacgaacaactcaaatccggcaccgcctccgtagtctgcctcctcaacaacttctacccccgcgaggccaaagtacaatggaaagtcgacaacgccctccaatccggaaactcacaagaatcagtcaccgaacaagactccaaggactcaacctactccctctcctccaccctaaccctctcaaaagccgactacgaaaaacacaaagtctacgcctgtgaagtcacacaccaaggcctctcctcccccgtcactaaatccttcaaccgcggcgaatgc

SEQ ID NO: 54519 - RNA, 1059 nt, synthetic construct
  misc_feature 1..1059: note = derived and/or modified sequence opt11 from Letolizumab_HeavyChain
  source 1..1059: mol_type = other RNA
gaagttcaactactcgaatccggcggcggcctagtacaacccggcggctccctgcgcctctcctgcgccgcctccggcttcacattcaactgggaactcatgggctgggcccgccaagcccccggaaaaggactcgaatgggtcagcggaatcgaaggccccggtgacgtcacctactacgccgactccgtcaaaggtcgattcaccatctcccgcgacaactccaaaaacaccctatacctccaaatgaactcactccgtgcagaagacaccgccgtctactactgcgtcaaagtcggaaaagacgccaaatccgactaccgcggccaaggcaccctcgtcaccgtttcctccgcctcaaccgaacccaaaagctccgataaaacacacacatccccaccctcccccgcccccgaactgcttggcggctcatccgtcttcctattcccacccaaacccaaagacaccctcatgataagccgcacccccgaggtcacatgcgtagtcgtagacgtctcccacgaagaccccgaagtcaaattcaactggtacgtcgacggcgtagaagtccacaatgctaaaaccaagccccgcgaagaacaatacaactcaacataccgcgtagtatccgtcctaaccgtcctccaccaagactggctcaacggaaaagaatacaagtgtaaagtctccaataaagccctccccgcacccatagagaaaactatctccaaagcaaagggccaaccccgagaaccccaagtctacaccctcccaccctcccgcgacgaactcaccaaaaaccaagtctcactcacatgcctcgtaaaaggattctacccatccgacatcgccgtcgaatgggagtccaacggacaacccgaaaacaactacaaaacaaccccacccgtcctcgactccgacggcagcttcttcctatactcaaaactcaccgtggacaaaagccgatggcaacaaggcaacgtcttctcctgctcagtcatgcacgaagccctacataaccactacacacaaaaatccctatcactctcacccggcaaa

SEQ ID NO: 54520 - RNA, 1338 nt, synthetic construct
  misc_feature 1..1338: note = derived and/or modified sequence opt11 from Losatuxizumab_HeavyChain
  source 1..1338: mol_type = other RNA
gaagtccaactacaagaatccggacccgggctcgtcaaacccagccaaaccctctccctcacctgtaccgtatccggatacagcatatcccgagacttcgcctggaactggatcagacaaccacccggcaaaggcctcgaatggatgggctacatcagctacaacggcaacacccgataccaaccctccctcaaatcccgcatcaccatctcgcgcgacacctccaaaaaccaattcttcctcaaactaaactccgtaacagccgccgacaccgccacctactactgcgttaccgcctcccgcggcttcccctactggggccaaggcaccctagtaaccgtatcatcagcatctaccaaaggcccatccgtcttccccctcgcaccctcctccaaatccacctcaggcggcaccgccgccctaggctgcctcgtaaaagactacttccccgaacccgtcaccgtctcctggaactcaggcgccctcacatccggcgtccacaccttccccgccgtactccaatcaagcggactctattccctttcctcagtagtaacagtcccctcctcttcactcggaacccaaacctacatctgcaacgtcaaccacaaaccatccaacacaaaagtagacaagaaagtcgaacccaaatcctgcgacaaaacccatacctgcccaccgtgccccgcccccgaactactgggcggcccatccgtcttcctattcccacccaaacccaaagacaccctcatgatatctcgcacacctgaagtcacttgcgtcgtcgtagacgtctcccacgaagaccccgaagtaaaattcaactggtacgtcgacggcgtcgaagtccacaacgccaaaacaaaaccccgcgaagaacaatacaactcaacctacagagtcgtatcagtcctaaccgttctccaccaagactggcttaacgggaaagaatacaaatgtaaggtctctaacaaagccctaccagcaccaatcgagaaaaccatctccaaagccaaaggccaaccccgagaaccccaagtctacaccctaccaccctcacgcgaagaaatgaccaaaaaccaagtctccctaacctgcctagtcaaaggcttctacccatccgacattgccgtagaatgggaatcaaacggacaacccgaaaacaactacaaaacaaccccaccagtcctagactcagacggctccttcttcctatactccaaactcaccgtggacaagtcccgctggcaacaaggcaacgtcttctcgtgcagcgtcatgcatgaagctctccacaaccactacacccaaaaatccctatcactctcccccggcaaa

SEQ ID NO: 54521 - RNA, 642 nt, synthetic construct
  misc_feature 1..642: note = derived and/or modified sequence opt11 from Losatuxizumab_LightChain
  source 1..642: mol_type = other RNA
gacatccaaatgactcaatcaccctcctccatgtccgtctccgtcggcgaccgagtaaccatcacttgccactcctcccaagacatcaactcaaacatcggctggctccaacaaaaacccggcaaatccttcaaaggcctcatctaccacggcaccaacctcgacgacggcgtcccctcccgattctcaggatccggctccggcaccgactacaccctcaccatctcctcactccaacccgaagacttcgccacctactactgcgtccaatacgcccaattcccatggaccttcggaggcggcaccaaactagaaatcaaacgcaccgtcgccgcaccctccgtattcatcttcccaccctccgacgaacaactaaaatccggcacagcctccgtcgtctgcctcctcaacaacttctacccccgcgaggccaaagtccaatggaaagtcgacaacgccctccaatctggcaactcccaagaatccgtcaccgaacaagacagcaaagactccacctactccctctcttccaccctcaccctctccaaagccgactacgaaaaacacaaagtctacgcatgcgaagtcacccaccaaggcctctcctcccccgtcaccaaatccttcaaccgcggcgaatgc

SEQ ID NO: 54522 - RNA, 1338 nt, synthetic construct
  misc_feature 1..1338: note = derived and/or modified sequence opt11 from Lupartumab_HeavyChain
  source 1..1338: mol_type = other RNA
gaagtccagctcctcgaatccggcggcggactcgtccaaccaggcggctccctccgcctttcctgcgccgcctcaggtttcaccttctccaacgcttggatgtcctgggtccgacaagcgcccggcaaaggcctcgaatgggtctcatacatctcatcctcaggctccaccatatactacgcagactcagtcaaaggccgcttcacaatctctcgtgacaactccaaaaacacactctacctacaaatgaactcactacgcgccgaggacacagccgtctactactgcgcccgcgaaggcctatgggccttcgattactggggacaaggcaccctcgtcaccgtcagctccgcatccaccaaaggcccatcagtcttccccctcgctccctcatccaaatccaccagtggaggaaccgccgccctcggatgcctagtcaaagactactttccagaacccgtcaccgtcagctggaatagcggcgccctcacttccggagtccacaccttccccgccgtcctccaatcctcaggtctctactccctctcctccgtcgtcaccgtcccctccagctcacttggaacccaaacctacatctgcaacgtcaaccacaagccatccaacacaaaagtcgacaagaaggtcgaacccaaatcctgcgacaaaacccacacttgcccaccctgccccgcccccgaactactcggaggaccctccgtattcctcttcccacccaaacccaaagacactctcatgatctcccgtaccccagaagttacatgcgtagtcgtcgacgtctcccacgaagatcccgaagtcaaattcaactggtacgtcgacggcgtcgaagtccacaacgccaagaccaagccccgcgaagaacaatacaacagcacctaccgtgtcgtctcagtactaaccgtcctacaccaagactggcttaacggcaaagaatacaaatgcaaagtctccaacaaagccctcccagcccccatcgagaaaaccatctcaaaagccaaaggccagccccgcgaaccccaagtctacaccctacctccatcccgtgacgaacttaccaaaaaccaagtctcactaacctgcctcgtcaaaggcttctacccgtcagacatcgcagtcgaatgggaatccaacggtcaaccagaaaacaactacaaaaccacccctccagtcctcgactccgacggctctttctttctctactccaaactcacagtcgataaatcccgctggcagcaaggtaacgtcttctcctgctccgtcatgcacgaagcccttcacaaccactacacccaaaaatccctatccctctctcccgga

SEQ ID NO: 54523 - RNA, 651 nt, synthetic construct
  misc_feature 1..651: note = derived and/or modified sequence opt11 from Lupartumab_LightChain
  source 1..651: mol_type = other RNA
gaatcagtcctcacccaacccccctccgtctccggcgcccccggccaacgcgtcaccatctcctgcaccggctcctcctcaaacatcggcgccggctacgtcgtccactggtaccaacaactccccggcaccgcccccaaactcctcatctacgacaacaacaaacgaccctccggcgtccccgaccgcttctccggctcaaaatccggcacctccgcctccttagccatctcaggcctccgctccgaagacgaagccgactactactgcgccgcctgggacgaccgcctcaacggccctgtattcggcggcggcaccaaactcaccgtcctcggccaacccaaagccgccccctccgtaaccctcttccccccctcctccgaagaactccaagccaacaaagccaccctcgtctgcctcatctccgacttttaccccggagccgtcaccgtcgcctggaaagcagactcatcccccgtcaaagcaggcgtcgaaaccaccacaccctccaaacaatccaacaacaaatacgccgcctcctcctacctatccctcacccccgaacaatggaaatcccaccgatcctactcctgccaagtcacccacgaaggctccacagtcgaaaaaacagtcgcccccaccgaatgctcc

SEQ ID NO: 54524 - RNA, 1731 nt, synthetic construct
  misc_feature 1..1731: note = derived and/or modified sequence opt11 from Lutikizumab_HeavyChain
  source 1..1731: mol_type = other RNA
gaagtacaactcgttgagtccggtggaggcgtcgtccaaccaggccgctctctaagactgtcctgcagcgcctccggcttcatcttctcacgatacgacatgagctgggtacgacaagccccaggcaaaggcctagagtgggtcgcctacatcagccacggaggcgccgggacctactacccagactcagtcaaaggtcgtttcacaatatcccgcgacaactccaaaaacacactattccttcaaatggactccctccgcccagaagacaccggagtctatttctgcgcacgcgggggcgtcaccaaaggctatttcgacgtgtggggccagggcacacctgtcacagtaagctccgcctccacaaaaggaccgcaggtacaactcgtcgaatccggtggcggcgtcgtccaaccaggcagatcactacgcctctcctgcacagccagcggcttcaccttctcaatgttcggcgtacactgggtccgacaggccccaggcaaaggcctagaatgggtcgccgcagtctcctacgacggctcaaacaaatactacgcagagtccgtcaaaggccgcttcacgatatccagagataacagcaaaaacatcctattcctccaaatggactccttacgactagaggacacagcagtctactactgcgcccgaggccgccccaaagtagtcatacctgcacccctagcccactggggccagggcaccctagtcaccttctcctccgcctcaaccaaaggaccatccgtcttccctctagccccctcctcaaaatccacctcaggcggcactgccgcactaggctgcctagtcaaagactacttccccgaacccgtaaccgtatcctggaacagcggcgccctaacatcgggcgtccacaccttccccgcagttctccaatcctccggactctacagcctgtccagcgtggtcaccgtcccctcctccagccttggcacccagacatatatctgcaacgtaaatcacaaaccttccaacaccaaagtagacaagaaagtcgaaccaaaatcatgcgacaaaacccatacgtgcccaccctgcccagcccccgaggctgcaggaggaccgtcagtcttcctcttcccacccaaacccaaggacacactaatgatttcacgcacacccgaagtcacatgcgtcgtcgtcgacgtctcccatgaagaccccgaagtcaaattcaactggtacgtcgacggagtagaagtccacaacgccaaaaccaaaccccgcgaggaacaatacaactcgacctaccgcgtcgtgtcagtactgacagtcctacaccaagactggcttaacggcaaagagtacaaatgcaaggtcagcaacaaagccctccccgctcccatcgagaaaaccatctccaaagccaagggccaaccacgcgaaccccaggtatacaccctcccaccctcccgcgaagaaatgaccaaaaaccaagtatccctcacatgcctcgtcaaaggattctacccctcggacatagcagtagaatgggaatccaacggccaacccgaaaataactacaaaacgacgccacccgtcctagactccgacggcagcttctttctttactccaaactaaccgtagacaaatcacgctggcaacaaggcaacgtattcagctgctcagtcatgcacgaggctctgcacaaccactacacccaaaaatccctatccctctcccccggcaaa

SEQ ID NO: 54525 - RNA, 981 nt, synthetic construct
  misc_feature 1..981: note = derived and/or modified sequence opt11 from Lutikizumab_LightChain
  source 1..981: mol_type = other RNA
gacatccaaatgacccaatccccctcctccctatccgcctcagtcggtgaccgagtaaccatcacatgccgcgcatctggcaacatccacaactacctcacctggtaccaacaaacccccggcaaagcccccaaactcctcatctacaacgccaaaaccctagccgacggcgtcccctcacgcttctcaggctcaggctcaggcaccgactacaccttcacaatatcctcgctccaacccgaagacatcgccacctactactgccaacacttctggagcatcccttacacattcggccaaggcacaaaactccaaatcactcgcaccgttgcagcccccgacatccaaatgacccaatccccatcctccgtctcagcctccgtcggagaccgcgtcaccataacctgccgcgcctcccaaggcatctcatcatggctcgcctggtaccaacaaaaacccggcaaagcccccaaacttttaatctacgaagcctccaacctcgaaacaggcgtcccctcccgcttctccggctccggctccggctccgacttcaccctcaccatatcctcactccaacccgaagacttcgccacctactactgccaacaaacctcctccttcctcctctccttcggcggcggcactaaagtcgaacacaaacgcaccgtcgccgccccctccgtcttcatctttcccccatcggacgaacaactcaaatccggcaccgccagcgtcgtctgcctcctaaacaacttctaccctcgcgaagccaaggtccagtggaaagtcgacaacgccctccaatccggcaacagccaagaatccgtcactgaacaagactccaaagactctacctactcactctcctcaaccctcacactatccaaagccgactacgaaaaacacaaagtctacgcttgcgaagtcacacaccaaggcctctcatcaccagtcaccaaatcattcaaccgtggcgaatgc

SEQ ID NO: 54526 - RNA, 1341 nt, synthetic construct
  misc_feature 1..1341: note = derived and/or modified sequence opt11 from Oleclumab_HeavyChain
  source 1..1341: mol_type = other RNA
gaagtacaactcctcgagtcaggaggcggtctagtccaacccggaggctccctccgcctctcctgcgccgcctccggattcaccttctcctcctacgcctactcctgggtacgacaagccccaggcaaaggcctcgaatgggtctcagccatctcaggctcagggggccgcacctactacgcagactcagttaaaggccgcttcacaatctccagagacaactccaaaaacaccctgtaccttcaaatgaactcactccgcgccgaagacaccgccgtctactactgcgcacgtctaggctacggccgagtagacgaatggggccgcggcacccttgtcacagtctcctcagcatcaaccaaaggaccctccgtcttccccctcgccccctcaagcaaatccacctccggcggcaccgccgccctcggatgcctcgtcaaagactacttccccgaaccagtcacagtatcatggaactccggcgcactcacatccggcgtccacacattccccgctgtactacaatcctctggcctctactccctctcatcagtcgtcaccgtcccctcctcctcactcggaacccaaacctacatatgcaacgtaaaccacaaaccttcaaacaccaaagtcgacaaaagagtcgagcccaaatcttgcgacaaaacacacacatgcccaccatgcccggcccccgagttcgaaggaggcccctccgtattcctcttcccacccaaacctaaagacaccctaatgatctcccgcaccccagaagtaacctgcgtcgtcgtcgacgtcagccacgaagacccagaagtaaaattcaattggtacgtagacggcgtcgaagtccacaacgccaaaaccaaaccacgagaagaacaatacaactcaacataccgcgtagtctccgtcctaactgtgttacatcaagactggctcaacggcaaagaatacaaatgcaaagtatcaaacaaagcgctccccgcctccatcgagaaaaccatctccaaagccaaaggccaaccccgagaaccccaagtctataccctaccaccctcccgcgaagaaatgaccaaaaaccaagtctccctcacatgcctcgtcaaaggcttctacccctctgacatagctgttgaatgggaaagcaacggacaacccgaaaacaactataaaaccacacccccagtcctcgactcggacggatccttcttcctatactcaaaactcaccgtcgacaaatcacgctggcaacaaggcaacgtattctcctgctccgtcatgcatgaagccctccacaaccactacacccaaaagagcctctcactctccccaggcaaa

SEQ ID NO: 54527 - RNA, 648 nt, synthetic construct
  misc_feature 1..648: note = derived and/or modified sequence opt11 from Oleclumab_LightChain
  source 1..648: mol_type = other RNA
caatccgtcctcacacaaccaccctccgcctccggcacacccggccaacgcgtcacaatctcctgttccggctccctctccaacatcggccgcaacccagtcaactggtaccaacaactccccggcaccgcccccaaactcctaatctacctcgacaacctccgcctctccggcgtccccgaccgcttctcaggctccaaatccggcacctcagcctccctcgccatctccggcctccaatccgaagacgaagccgactactactgcgccacatgggacgactcccaccccggctggaccttcggcggcggcaccaaactcaccgtcctaggacaacccaaagccgcccccagcgtaaccctattcccaccctcctcagaagaactccaagccaacaaagccacactcgtctgcctcatctccgacttctaccccggcgccgtcacagtcgcctggaaagccgactcatcacccgtcaaagccggcgtcgaaaccaccaccccctccaaacaatccaacaacaaatacgccgcctcctcatacctctcactcacccccgaacaatggaaatcccaccgctcctactcctgccaagtcacccacgaaggctcaaccgtcgaaaaaaccgtcgcccccaccgaatgctca

SEQ ID NO: 54528 - RNA, 1449 nt, synthetic construct
  misc_feature 1..1449: note = derived and/or modified sequence opt11 from Otlertuzumab_HeavyChain
  source 1..1449: mol_type = other RNA
gaagtacaactcgtccaaagcggcgccgaggtcaagaaaccgggcgaaagcctaaaaatatcatgcaaaggttccggatactcattcacaggctacaacatgaactgggtccgacaaatgccagggaaaggcctcgaatggatgggaaacatagacccctactacggaggcacaacctacaacagaaaattcaaaggacaagtaaccataagtgcagacaaatccatctcaaccgcctacctacaatggtcatctctcaaagcgagcgacaccgccatgtactactgcgccagatccgtaggccccttcgacagctggggtcaaggcacactcgtcaccgtgtcatccggcggcggaggcagcggaggcggaggctcaggcggcggaggaagcggcggcggcggctccggcggaggcggctcagaaatagtactcacgcaatcacccgcaaccttgtccctaagcccaggcgaacgcgcgaccctcagctgcagagccagcgaaaacgtctactcctacctcgcctggtaccaacaaaaacctggacaagcgccccgactactgatatacttcgccaaaaccctcgcggaaggcatcccagcccgcttctctggctcaggatcaggcaccgacttcaccctaaccatatcctccctcgaaccagaagacttcgcagtctactactgccaacaccacagcgacaacccctggacattcggacaagggacaaaagtcgaaatcaagggagaccaggagccaaagtcgtcagacaagacccatacctcaccaccatgcccagcccctgaactgctcggcggaccaagcgtattcctcttcccacccaagcccaaggacacactcatgatctcccgaacccccgaggtcacatgcgtagtcgtagacgtctcccatgaagatcccgaagtcaaattcaactggtacgtcgatggtgtcgaagtccacaacgccaaaaccaaaccccgtgaagaacaatacaactccacctaccgagtagtctcagtcttaacagtcctccaccaagactggctcaacggcaaagaatacaaatgcaaagtatcaaacaaagccctacccgcacccatagagaaaaccatatccaaagccaaaggccagccccgcgaaccccaagtatacactctcccaccctcacgagacgaactcactaaaaaccaagtctctctcacatgccttgtcaaagggttctacccaagcgatatcgccgtcgaatgggaatccaacggccaacccgagaacaactacaaaacaaccccacccgtcctggactcggacggcagcttcttcctatattcaaaactgacggtcgacaaaagccggtggcaacaaggaaacgtattctcctgctcagtcatgcacgaagccctacacaaccactacacccaaaaatcactttccctcagccccggaaaa

SEQ ID NO: 54529 - RNA, 339 nt, synthetic construct
  misc_feature 1..339: note = derived and/or modified sequence opt11 from Ozoralizumab_HeavyChain
  source 1..339: mol_type = other RNA
gaagtgcaattggtcgagagcgggggcgggctcgtgcaaccgggcgggagcttgcgcttgagctgtgccgcgagcgggttcacgttctcagactattggatgtactgggtcaggcaagcgcccgggaaagggctcgagtgggtgagcgagatcaataccaatggcttgatcacgaaatatcccgatagcgtgaaagggcgctttaccataagcagggacaatgccaagaacacgctctatctccagatgaatagcttgcgcccggaagataccgcggtctattactgtgccaggagcccgagcgggttcaatcgagggcaagggaccttggtcacggtc

SEQ ID NO: 54530 - RNA, 1089 nt, synthetic construct
  misc_feature 1..1089: note = derived and/or modified sequence opt11 from Ozoralizumab_HeavyChain_HeavyChain_HeavyChain
  source 1..1089: mol_type = other RNA
gaggtacagctcgtagaatcgggagggggcctggtccaacccgggggctcgctcaggctatcgtgcgcggcatcgggatttacctttagcgattactggatgtattgggtgagacaggcaccgggcaagggactagaatgggtatcggaaataaacacaaacggactcataaccaagtacccagactcggtaaagggccggttcacaatttcgagagataacgcgaaaaatacattgtacctacagatgaactcgctcaggcccgaggacacggccgtgtactactgcgcacgctcgccatctggtttcaacaggggacagggcacgctcgtaacagtgagctcgggcgggggcggaagtggaggcgggagcgaggtccagctcgtggaatcgggcgggggcttggtacagccagggaactcgctcaggctctcgtgcgcggcatcgggattcacatttagctcgttcgggatgtcttgggtgcgccaggccccgggcaagggcctggaatgggtctcgagcataagcgggtccgggagcgacacactatacgcagattcggtcaagggcaggttcacgatctcgcgcgataatgcgaaaacaaccctgtacctgcaaatgaactcgctaaggccagaggacacggcagtatactattgcacgatcgggggatcgctctcgcgctcgagtcagggcacgctcgtgacagtaagctcgggcggaggcgggagtgggggcgggagcgaggtccagctcgtggaatcgggcggcggattggtccagcctgggggctcgctacggctctcgtgcgcggcatcaggattcacctttagcgattactggatgtactgggtgagacaggccccgggcaagggattagaatgggtatcagaaataaacacgaacggactaataaccaagtacccggacagtgtcaagggcaggttcacaatatcacgcgataacgcgaaaaatacactatacttacaaatgaactcactcagacccgaggacacggcagtgtactattgtgcgcgctcgccctcaggctttaacaggggccagggtacgctcgtaaccgtaagctcg

SEQ ID NO: 54531 - RNA, 1494 nt, synthetic construct
  misc_feature 1..1494: note = derived and/or modified sequence opt11 from Pasotuxizumab_HeavyChain_LightChain_HeavyChain_LightChain
  source 1..1494: mol_type = other RNA
caagtgcaactcgtagaaagtggaggagggctggtcaagcccggagaaagcctacgcctgagctgcgcagcatcgggattcacattcagcgattactacatgtactgggtaagacaagcaccaggaaaaggactagaatgggtagcaataatcagcgacgggggatactacacctactacagcgacatcatcaaaggaagattcaccatcagcagagacaacgcgaaaaacagcctgtacctacaaatgaactccctgaaagcagaagacacggcagtatactactgcgcccgcgggttccccctcctaagacacggagctatggactactggggacaaggcaccctagtaacagtatcatccggaggaggcggctcaggcggcggaggaagcggaggcggcggaagcgacatacaaatgacccaaagcccatcgtccctaagtgcctccgtaggagaccgagtaacaataacatgcaaagccagccaaaacgtagacacaaacgtcgcctggtaccaacaaaaacccggacaagcaccaaaaagcctcatctacagcgcaagctacagatacagcgacgtaccatcacgattcagcgggtccgcatccggcaccgacttcacactaacaatctccagcgtccaaagtgaagactttgcaacctactactgccaacaatacgactcatacccatacaccttcggcggcggaaccaaactagaaataaaaagcggcggcggagggtccgaggtccaactcgtagaaagcggcggcggtctcgtacaaccagggggatcactcaaactatcctgcgcagcatcaggattcacattcaacaaatacgccatgaactgggtccgacaagcccccggcaaagggctggaatgggtcgccaggatacgcagcaaatacaacaactacgccacctactacgccgacagcgtcaaagaccgcttcacaatcagcagagacgacagcaaaaacacagcatacctccaaatgaacaacctcaaaacagaagacacagccgtatactactgcgtaagacatggcaacttcggcaactcatacatatcatactgggcatactggggccaaggaacgctagtcacagtatcaagcggaggaggaggaagcggcggaggcggctcaggcggcggtggcagccaaaccgtagtaacacaagaaccctcgctaaccgtaagcccaggcggcaccgtaacgctaacatgcggctcatccacgggcgccgtcaccagcggcaactaccccaactgggtacaacaaaaaccagggcaagcaccccgcggcctcataggcggaacgaagttcctagccccagggacaccagcaagattcagcggaagcctcctcggcggcaaagcagcactgaccctgtccggcgtacaaccagaagacgaggccgaatactactgcgtactatggtacagcaaccgctgggtcttcggaggcgggacaaaactcaccgtccta

SEQ ID NO: 54532 - RNA, 357 nt, synthetic construct
  misc_feature 1..357: note = derived and/or modified sequence opt11 from Pasotuxizumab_HeavyChain1
  source 1..357: mol_type = other RNA
caagtccaactcgtcgaatccggcggcggcctcgtcaaacccggcgaatccctccgcctctcctgcgccgcctccggcttcaccttctccgactactacatgtactgggtccgccaagcccccggcaaaggcctcgaatgggtcgccatcatctccgacggcggatactacacctactactccgacatcatcaaaggccgcttcaccatctcccgcgacaacgccaaaaactccctctacctccaaatgaactccctcaaagccgaagacaccgccgtctactactgcgcccgcggcttccccctcctccgccacggcgccatggactactggggccaaggcacactcgtcaccgtc

SEQ ID NO: 54533 - RNA, 369 nt, synthetic construct
  misc_feature 1..369: note = derived and/or modified sequence opt11 from Pasotuxizumab_HeavyChain2
  source 1..369: mol_type = other RNA
gaggtccagctcgtggaatcgggcgggggcttggtccagcccgggggctcactcaagctctcgtgcgcggcctcgggctttacctttaacaagtacgcgatgaattgggtgcgccaggccccgggcaagggcttggaatgggtcgcgcgcatacgctcgaaatataacaattacgcgacctattacgcggactcggtcaaggacaggttcacgatctcgcgcgatgactcgaaaaataccgcgtacctgcaaatgaacaatctcaagaccgaggacacggccgtgtactattgcgtgcgccatggcaatttcgggaactcgtacataagctattgggcgtactggggccagggcacgctcgtgaccgtg

SEQ ID NO: 54534 - RNA, 321 nt, synthetic construct
  misc_feature 1..321: note = derived and/or modified sequence opt11 from Pasotuxizumab_LightChain1
  source 1..321: mol_type = other RNA
gacatccaaatgacccaatccccctcctccctctccgcctccgtcggcgaccgcgtcaccatcacctgcaaagcctcccaaaacgtagacaccaacgtcgcctggtaccaacaaaaacccggccaagcccccaaatccctcatctactcagcctcctaccgctactccgacgtcccctcccgcttctcaggctccgcctccggcaccgacttcaccctcaccatctcctccgtccaatccgaagacttcgccacctactactgccaacaatacgactcctacccctacaccttcggcggcggcaccaaactcgaaatcaaa

SEQ ID NO: 54535 - RNA, 327 nt, synthetic construct
  misc_feature 1..327: note = derived and/or modified sequence opt11 from Pasotuxizumab_LightChain2
  source 1..327: mol_type = other RNA
caaaccgtcgtcacccaagaaccctccctcaccgtctcccccggcggcaccgtcaccctcacctgcggctcctccaccggcgccgtcacctccggcaactaccccaactgggtccaacaaaaacccggccaagccccccgcggcctcatcggcggcaccaaattcctcgcccccggcacccccgcccgcttctccggctcactcctcggcggcaaagccgccctcaccctctccggcgtccaacccgaagacgaagccgaatactactgcgtcctctggtactccaaccgctgggtcttcggcggcggcaccaaactcaccgtcctc

SEQ ID NO: 54536 - RNA, 1023 nt, synthetic construct
  misc_feature 1..1023: note = derived and/or modified sequence opt11 from Placulumab_HeavyChain
  source 1..1023: mol_type = other RNA
gacatacaaatgacccaatcacccagctcactctccgccagcgtaggggaccgtgtcaccatcacatgccgagcctcccaagccatcgactcctacctccactggtaccaacaaaaacccggaaaagcacccaaactcctaatctactccgcctccaacctcgaaaccggagtcccctccagattctctggatccggctccggaaccgacttcacccttaccatctcatcactactccccgaagacttcgccacctactactgccaacaagtcgtctggcgccccttcaccttcggccaaggaaccaaagtcgaaatcaaacgagtcgaacccaaatcctcagacaaaacccacacctgtccgccctgccccgcccccgaactcctaggcggcccctccgtcttcctcttcccacccaaacccaaagacaccctcatgatctcccgaacccccgaagtaacctgcgtcgtcgtcgacgtatcacacgaagaccccgaagtcaaattcaactggtacgtcgacggagtagaagtacacaacgccaaaaccaaacccagagaagaacaatacaactccacctaccgagtcgtatcagtcctaaccgtgctacaccaagactggctcaacggaaaagaatacaaatgcaaagtctccaataaagccctccccgcccccatcgagaaaaccatctccaaagcaaaaggccaaccccgagaaccccaagtctacacactccctccatcacgcgacgaactaaccaaaaaccaagtatccctaacctgcctcgtcaaaggcttctacccctcagacatcgccgtcgaatgggaatccaacggccaacccgaaaacaactacaaaaccaccccacccgtcctcgactccgacggctccttcttcctctactcgaaactcaccgtcgataaatcccgctggcaacaaggaaacgtcttctcctgctccgtcatgcacgaagccctccacaaccactacactcaaaaatcactctcactatctcccggaaaa

SEQ ID NO: 54537 - RNA, 1353 nt, synthetic construct
  misc_feature 1..1353: note = derived and/or modified sequence opt11 from Porgaviximab_HeavyChain
  source 1..1353: mol_type = other RNA
gaagtccaactccaagaatcaggtggcggactcatgcaacccggcggctccatgaaactatcgtgtgtcgcctccggcttcacattctccaactactggatgaactgggtacgccaatccccagaaaaaggactcgaatgggtcgcagaaatccgactcaaaagcaacaactacgccacccactacgccgaatccgtaaaaggaagatttacaatatcacgcgacgattcaaaaagatcagtctacttacaaatgaacaccctccgcgccgaagacaccggaatctactactgcaccagaggcaacggcaactacagagccatggactactggggccagggcaccagcgtcaccgtcagctccgcctccaccaaagggccctccgtcttccccctcgccccctcctccaaatcgacttccggaggaacagccgccctgggctgcctagtcaaagactacttccccgaaccagtcacggtctcatggaactccggcgccctaacctccggcgtccacacgttccccgccgtactccaatcctccggactatactccctcagcagcgtagtcacagtcccaagctccagcctcggcacccaaacctacatctgcaatgtcaaccacaaacctagcaacacaaaagtcgacaaacgcgtcgaacccaaatcctgcgacaaaacccacacttgcccgccctgccccgcccccgaactccttggaggcccatccgtcttcctcttcccacccaaacccaaagacaccctcatgatctcccgcaccccagaagtcacctgtgtcgtagtcgacgtctcacacgaagatcccgaagtcaaattcaactggtatgtcgacggcgtcgaagtccacaacgcaaaaaccaagcccagagaagaacaatacaactccacctaccgcgtcgtttccgtactcaccgtcctccaccaagattggctaaacggcaaagaatacaaatgcaaggtcagcaacaaagccctccccgcccccatcgaaaagacaatctcaaaagccaaaggccaaccacgcgaaccccaagtatacaccctacccccatcccgtgacgaactcaccaaaaaccaagtatcactaacctgcctcgtaaaaggcttctacccctccgacatagccgtcgaatgggaaagcaacggccaacccgaaaacaattacaaaaccacaccaccagtcctcgactcagacggctccttcttcctctactccaaactaaccgtagacaaatcccgatggcaacaaggaaacgtcttctcctgctccgtcatgcacgaagccctccacaaccactacacgcagaaaagcctttcactatcacccggcaaa

SEQ ID NO: 54538 - RNA, 642 nt, synthetic construct
  misc_feature 1..642: note = derived and/or modified sequence opt11 from Porgaviximab_LightChain
  source 1..642: mol_type = other RNA
gacatccaaatgacacaaagccccgcaagcctgagcgtaagcgtaggcgaaaccgtaagcataacctgccgcgcaagcgaaaacatatactcaagcctagcctggtaccaacaaaaacaaggaaaatcaccccaactcctagtctacagcgccaccatactcgcagacggagtcccgtccagattctcaggctcaggctcaggcacacaatactccctaaaaatcaactcactccaaagcgaagacttcggcacatactactgccaacacttctgggggaccccatacacattcgggggcggaaccaaactcgaaatcaaacgcacggtcgcagccccaagcgtattcatcttcccgccctcagacgaacaactgaaatcaggcacagcctcagtcgtatgcctactcaacaacttctacccacgcgaggccaaagtccaatggaaagtcgacaacgcgctccagagcggaaactcacaagaaagcgtaaccgaacaagacagcaaagactcgacctacagcctcagctcaactctaaccctaagcaaagccgactacgaaaaacacaaagtatacgcatgcgaagtcacacaccaaggcctaagctcccccgtaaccaaatcgttcaacagaggcgaatgc

SEQ ID NO: 54539 - RNA, 1341 nt, synthetic construct
  misc_feature 1..1341: note = derived and/or modified sequence opt11 from Prezalumab_HeavyChain
  source 1..1341: mol_type = other RNA
gaagtacaactcgtcgaatccggaggcggcctagtccaaccaggaggatccctccgcctgtcctgcgccgctagcggattcactttctcctcctactggatgtcctgggtcagacaagcccccggaaaaggcctcgaatgggtagcctacatcaaacaagacggcaacgaaaaatactatgtcgactcagtaaaaggtcgcttcacaatcagccgcgacaacgccaaaaactccctatacctccaaatgaactcactacgagcagaagacaccgccgtctactactgcgcccgcgaaggaatcttatggttcggagacctccccacattctggggacaaggcaccctagtcaccgtctcctccgcatccacaaaagggccctccgtcttccccctagccccctgctcccgatccacttccgaatccaccgcagcactcggctgcctagtcaaagactacttccccgaacccgtaaccgtctcatggaactcaggagccctcaccagcggagtacacaccttcccagccgttctccaatctagcggcctctactcactctcttcagtcgtcacagtaccttcctcaaacttcggaactcaaacctacacatgcaatgtggaccacaaaccctccaacacaaaagtcgacaaaacagtcgaacgcaaatgctgcgtcgaatgcccaccatgccccgccccacccgtagccggcccatccgtattcctgttcccacccaagcccaaagacaccctcatgatctcacgcacccccgaagtaacctgcgtcgtcgtcgacgtatcacacgaagaccccgaagttcaattcaactggtacgtcgacggcgtagaggtacacaacgccaaaaccaaacccagagaggaacaattcaactccaccttccgagtagtcagcgtcctgacagtcgtccaccaggactggctcaacggcaaagagtacaaatgcaaagtctccaacaaaggcctccccgcccccatcgagaaaaccatctccaaaaccaaaggccaaccccgcgaaccccaagtctacaccctacccccatcgcgcgaagaaatgaccaaaaaccaagtctccctaacatgcctcgtcaaaggcttctacccctcagacatagcagtcgaatgggaatccaacggacaaccagaaaacaactacaaaaccaccccaccaatgctcgactcagacggatcattcttcctttactccaaactaactgttgacaaatcaagatggcaacaaggcaacgtcttctcctgctccgtcatgcacgaagcactccacaaccactacacccagaagtcgctatccctatctcccggcaaa

SEQ ID NO: 54540 - RNA, 642 nt, synthetic construct
  misc_feature 1..642: note = derived and/or modified sequence opt11 from Prezalumab_LightChain
  source 1..642: mol_type = other RNA
gacatccaaatgacccaaagcccctcctccctctccgcctcagtcggcgaccgcgtcaccatcacatgccgcgccagccaaggcatctccaactggctcgcctggtaccagcaaaaacccgaaaaagcccccaaatcactcatctacgccgccagctcacttcaaagcggagtcccttcccgcttctccggctcaggctcaggcaccgactttaccctcaccatctcatcactccaacccgaagacttcgccacctactactgccaacaatacgactcctacccccgcaccttcggccaaggcaccaaagtcgaaatcaaacgcaccgtcgccgcccccagcgtcttcatcttccctccctccgacgaacaactaaaatccggcaccgcctcagtcgtctgcctactcaacaacttctacccccgcgaagccaaagtccaatggaaagtcgacaacgccctccaatccggaaactcccaagaaagcgtaaccgaacaagacagcaaagactccacctactccctctcctccaccctaaccctatcaaaagccgactacgaaaaacacaaagtctacgcctgcgaagtcacccaccaaggcctaagctcccccgtcaccaaatccttcaaccgcggcgaatgc

SEQ ID NO: 54541 - RNA, 342 nt, synthetic construct
  misc_feature 1..342: note = derived and/or modified sequence opt11 from Radretumab_HeavyChain
  source 1..342: mol_type = other RNA
gaagtccaactcctcgaatccggcggcggcctcgtccaacccggcggctccctccgcctctcctgcgccgcctccggcttcaccttctcctccttctccatgtcttgggtccgccaagcccccggcaaaggcctcgaatgggtctcctccatctccggctcctccggcaccacctactacgccgactccgtcaaaggccgcttcaccatctcccgcgacaactccaaaaacaccctctacctccaaatgaactccctccgcgccgaagacaccgccgtctactactgcgccaaacccttcccctacttcgactactggggccaaggcaccctcgtcaccgtc

SEQ ID NO: 54542 - RNA, 1071 nt, synthetic construct
  misc_feature 1..1071: note = derived and/or modified sequence opt11 from Radretumab_HeavyChain_LightChain
  source 1..1071: mol_type = other RNA
gaagtccaactactcgaatccggcggcggcctcgtccaaccaggcggcagcctccgattatcatgcgccgccagcggattcacattctcttccttcagcatgtcctgggtccggcaagccccaggcaaaggcctcgaatgggtatcaagcatatccggctcctcaggcaccacctactacgccgactcagtcaaaggccgcttcaccatctcccgcgacaactccaaaaacactctctacctccaaatgaactcacttcgcgccgaagacaccgcagtatactactgcgccaaaccattcccatacttcgactactggggacaaggcaccctcgtcacagtctcctccggcgacggctcatccggcggctccggcggcgcatcagaaatcgtcctcacccagagcccaggcacactctcactctccccaggcgaacgagcaacactctcctgccgtgcatcccaatccgtctcctcaagcttcctcgcctggtaccaacaaaaacccggacaagccccccgcctcctcatctactacgcatcctcccgcgcaacaggaatccccgaccgcttctcaggatccggctccggcaccgacttcacactcaccatctcaagactcgaacccgaagacttcgcagtctactactgccaacaaaccggccgtatacctcccacattcggccaaggcacaaaagtcgaaattaaatcaggcggctccggcggaccccgtgccgcacccgaagtctacgcattcgcaaccccagaatggcccggctcccgtgataaacgaaccctcgcctgcctcatccaaaacttcatgcctgaagacatatccgtacaatggctccacaacgaagtacaactacccgacgccagacactcaaccacccaaccccgcaaaaccaaaggctcaggattcttcgtcttctcccgcctcgaagtcacccgcgccgaatgggaacaaaaagacgaattcatttgccgcgcagtccacgaagccgcctccccctcacaaaccgtacaacgagccgtctccgtaaaccccgaatcctcacgacgcggtggctgc

SEQ ID NO: 54543 - RNA, 693 nt, synthetic construct
  misc_feature 1..693: note = derived and/or modified sequence opt11 from Radretumab_LightChain
  source 1..693: mol_type = other RNA
gcatccgaaatagtactcacacaatcacccggcaccctcagcctctcccccggcgaacgcgccaccctctcttgccgcgcctcccaatccgtctcctcatcattcctcgcctggtaccaacaaaaacccggacaagcaccacgcctcctcatatactacgcctcctcccgcgccaccggcatacccgaccgcttctccggctcaggctccggtaccgacttcaccctcacaatctcacgccttgaacccgaagacttcgccgtctactactgccaacaaaccggccgcatcccacccaccttcggccaaggcacaaaagtcgaaataaaatccggcggctccggcggcccccgcgcagcccccgaagtctacgccttcgccacccccgaatggcccggctcccgcgacaaacgcaccctcgcctgcctaatccaaaacttcatgcccgaagacatctccgtccaatggctccacaacgaagtccaactacccgacgcccgtcactcaacaacgcaaccccgaaaaaccaaaggctcaggcttcttcgtcttctcccgcctcgaagtcacccgcgccgaatgggaacaaaaagacgaatttatctgccgcgccgtccacgaagccgcatccccctcccaaaccgtccaacgagccgtctccgtcaaccccgaatcctcccgacgcggcggctgc

SEQ ID NO: 54544 - RNA, 1359 nt, synthetic construct
  misc_feature 1..1359: note = derived and/or modified sequence opt11 from Ranevetmab_HeavyChain1
  source 1..1359: mol_type = other RNA
gaagtacaactcgtcgaaagcggcggcggcctcgtccaacccggcggctccctccgcttatcttgcgtagccagcggattctcactcaccaacaacaatgtcaactgggtccgacaagccccaggaaaaggactcgaatgggtcggcggcgtctgggccggcggagccaccgactacaatagcgccctaaagtcccgattcaccatctcacgcgacaacgcgaagaacaccgtattcctccaaatgcactcactccgttccgaagacaccgccgtctactactgcgcacgagacggcggatactcgagctccaccctctacgccatggacgcctggggccaaggcaccagtgtaaccgtaagctcagcctcaactacggccccctccgtcttcccactcgccccctcatgcggttccacctccgggagcaccgtcgcccttgcttgcctagtttccggctacttcccagaaccggtcaccgtctcctggaactccggatccctgacatcgggcgtgcacaccttcccatcagtactccagtcctccggcctacactcactttcatccatggtcaccgtcccctcctcgcgttggccctccgaaaccttcacttgcaacgtcgtacaccccgcctccaacaccaaagtagacaaacccgttttcaacgaatgccggtgtaccgataccccaccctgccccgtacccgaacccctcggcggcccctccgtcctcatcttcccacccaaacccaaagacatactacgcatcacccgaacccccgaagtaacctgcgtagtcctagacctcggccgcgaagaccccgaagtccaaataagctggttcgtggacggcaaagaagtaatcaccgcaaaaacccaatcccgcgaacaacagttcaacggcacataccaggtcgtctcagtactccccatcgaacaccaagactggctcaccggcaaagagttcaaatgccgcgtaaaccacatcgacctcccatcccccatagaacgaaccatctccaaagctcgcggtagagcgcacaaaccctcagtctacgtcctcccaccatccccaaaagaactatcctcctccgacacagtatcgataacatgccttatcaaggacttctacccacccgacatcgatgtcgaatggcagtcagtaggccagcaagaacccgaacgaaaacaccgcatgacccctccccaactcgacgaagacggcagctacttcctctactcaaaattaagcgtagacaaatcccgatggcaacaaggcgaccccttcacttgcgccgtcatgcacgaaaccctccaaaaccactacaccgacctatctctatcacactcacccggaaaa

SEQ ID NO: 54545 - RNA, 1359 nt, synthetic construct
  misc_feature 1..1359: note = derived and/or modified sequence opt11 from Ranevetmab_HeavyChain2
  source 1..1359: mol_type = other RNA
gaagtacaactcgtcgaaagcggcggcggcctcgtacaacccggcggatccctgcgcctcagctgcgtcgcctccggattctccctcaccaacaacaacgttaactgggtccgccaagctcccggcaaaggcctcgaatgggtgggcggcgtatgggccggcggagccacagattacaacagcgcactcaaatccagattcaccatctcccgcgacaacgccaaaaacacagtattcttgcaaatgcactccctccgatccgaagacaccgcagtctactactgcgcccgagacggcggatactcctcctccaccctatacgccatggatgcttggggccagggcacatccgtcactgtctcctccgcctccaccacagcaccctccgtattccccctcgcaccctcatgcggctctacgtccgggtccaccgtcgccctcgcctgcctagtctcaggctatttccccgaacccgtcactgtatcgtggaacagcggctctcttacctcaggcgtccacaccttcccctccgtcctccaatcctcgggcctccactccctctcctccatggtaacggtaccctcatcccgctggccctcagaaacgtttacctgcaatgtcgtccacccagcctccaacacaaaagtagacaaacccgtctttaacgaatgccgctgcaccgacacaccaccctgccccgtccccgagcccctcggcggcccttcagtcctcatctttcccccaaaaccaaaagacatcctacgcataacccggacaccagaagtaacctgcgtcgtactcgacctcggccgcgaagaccctgaagtacaaatatcctggttcgtcgacggaaaagaagtcctaaccgcaaaaacccaatcccgagaacaacagttcaacggcacctaccaagtcgtctccgtactccccatcgagcaccaagactggctcaccggcaaagagttcaaatgccgcgttaaccacatcgacttaccatctccaatcgaacgcacaatatccaaggcccgaggccgagcccacaaaccttcggtatacgtcctaccaccatcaccaaaagaactctccagctccgacaccgtctccattacctgcctcatcaaagacttttacccacccgacatcgacgtcgagtggcaatccgtcggtcaacaagaacccgaacgcaaacaccgcatgacgccaccccaactcgacgaggacggcagctacttcctctactcaaagctaagcgtcgacaaatcccgctggcaacaaggagaccccttcacatgcgcagtcatgcacgagaccctacaaaaccactacaccgatctctctctctcacactcgcccggaaaa

SEQ ID NO: 54546 - RNA, 651 nt, synthetic construct
  misc_feature 1..651: note = derived and/or modified sequence opt11 from Ranevetmab_LightChain
  source 1..651: mol_type = other RNA
gacatcgtcatgacccaatcccccgcctctctctccctttcccaaggagaaaccgtcaccataacctgccgtgcctccgaagacatctacaacgccctagcctggtaccaacaaaaacccggccaagcccccaaactcctcatctacaacaccgacaccctccacaccggcgtcccctcccgattctcaggatccggctccggcaccgacttctccctcacaatatcctccctcgaaccagaagacgtcgccgtctactactgccaacactacttccactacccccgcaccttcggccaaggcaccaaagtcgaactcaaacgcaacgacgcccaacccgccgtatacctcttccaaccctccccagaccaactccacaccggctccgcctccgtcgtatgcctcctcaactccttctaccccaaagacatcaacgtcaaatggaaagtcgacggcgtcatccaagacacaggcatccaagaatccgtcaccgaacaagacaaagactcaacctactccctctcctccaccctaaccatgtcctccaccgaatacctctcccacgaactctactcctgcgaaatcacccacaaatccctcccctccacactcatcaaatccttccaacgctcagaatgccaacgcgtcgac

SEQ ID NO: 54547 - RNA, 1761 nt, synthetic construct
  misc_feature 1..1761: note = derived and/or modified sequence opt11 from Remtolumab_HeavyChain
  source 1..1761: mol_type = other RNA
gaagtccaactcgtcgaaagcggcggcgggctcgtccagcccggccgctccctcagactatcatgcgccgcatcaggattcaccttcgacgactacgcaatgcattgggtacgacaagcaccaggcaagggcctcgaatgggtaagcgccatcacctggaactcaggccacatagactacgctgactccgtagaaggccgcttcacaatatcccgcgacaacgccaaaaacagcctctacctccaaatgaactcactacgtgcagaagacaccgccgtatactactgcgcaaaagtctcatacctctccaccgcatcctccctcgactactggggacaagggaccctagtcacagtctcttccggaggcggcggctcaggcggcggaggctcagaggtccaactcgtccaatctggcgccgaagtcaaaaagcccggaagctcagtcaaagtgtcctgcaaagcctccggaggctccttcggcggctacggaatcggatgggtccgacaagccccaggccaaggactcgaatggatgggaggaatcacccccttcttcggcttcgccgactacgcccaaaaattccaaggacgcgtaacgatcacagcagacgaatccacgacgacagcctatatggaactatcaggactaacctccgacgacacagcggtatactactgtgcacgagaccccaatgagttctggaatggttactactctactcacgatttcgactcctggggacaaggcaccaccgtcacagtatcatccgcctccaccaaaggcccatcagtattccccctcgccccctcgtctaaatcaacctcaggcggcaccgcggccctcggctgcctcgtaaaagactatttccccgaaccagtaaccgtctcctggaactccggagccctcacatccggagtccacacattcccagccgtcctccagtcctccggcctatactccctatcaagcgtcgtcaccgtaccctcctcctccctcggaacccagacctacatttgcaacgtaaaccacaaaccctccaacactaaagtcgacaagaaagttgaacccaaatcctgcgacaaaacacacacatgtcccccatgccccgctccggaacttctaggcggcccatctgtcttcctatttccacccaaacccaaagacaccctaatgatctcacgcacacctgaagtaacctgcgtagtagtcgacgtatcccacgaagaccccgaagtcaaattcaattggtacgtcgacggcgtggaagtccacaacgcaaaaaccaaaccccgcgaagaacaatacaacagcacatatagggtagtctcagtactcaccgtactccaccaagactggctcaacggcaaagaatacaaatgcaaggtctcgaacaaagcattgcccgcacccatcgaaaagaccatctccaaagccaaaggccaacccagagagccccaggtgtacacactacccccatcacgagacgagctcaccaaaaaccaagtatcactgacctgcctcgtcaaaggcttctaccccagcgacatagccgtagagtgggaatccaacggacaacccgaaaacaactacaaaacaaccccgcccgtcctcgactcagacggcagcttcttcctctactccaaactgaccgtagacaaaagccgctggcaacaaggcaacgtattcagctgctcagtcatgcacgaagcactccacaaccactacacccaaaaatccctctcattatcaccaggcaag

SEQ ID NO: 54548 - RNA, 993 nt, synthetic construct
  misc_feature 1..993: note = derived and/or modified sequence opt11 from Remtolumab_LightChain
  source 1..993: mol_type = other RNA
gacatacaaatgacccaatccccatccagcctatccgcatcagtcggcgaccgcgtcaccataacatgtcgagcatcacaaggcatccgcaactacctagcttggtaccagcagaaacccggaaaagccccaaaactcctcatctacgccgcctctacactacaatccggagtcccctccagattctcaggatccggctccggcacagacttcaccctcaccatatcatccctccaacctgaagacgtcgccacctactactgccaacgatacaaccgcgccccctacaccttcggccaaggcacaaaagtcgaaatcaaacgaggcggttcaggcggcggcggctccggcgaaatcgttctcacccaatcccccgacttccaaagcgtcacccctaaagaaaaagtcaccattacctgccgagcatcccaagacatcggctccgaactccactggtaccaacaaaaacccgaccaaccacccaagctactcatcaaatatgcctcccactccacctccggcgtcccctcccgcttcagcggctccggctccggcacagacttcaccctaaccataaacggcctcgaagccgaagacgccggaacatactactgccaccaaaccgactcccttccctacaccttcggccccggcaccaaagtcgacataaaacgcacagtagccgccccctctgtcttcatattcccaccctccgacgaacaactcaaatccggaaccgcctccgtcgtctgcctcctgaacaacttctacccaagagaagccaaagtccaatggaaagtagacaacgccctccaatcaggaaactcccaagaatcagtcaccgaacaagactcaaaagactccacctacagcctatcatcaactctcacactctccaaagccgactacgaaaaacacaaagtctacgcctgcgaagtcacccaccaaggactctcatcccccgtaaccaaatccttcaaccgaggcgaatgc

SEQ ID NO: 54549 - RNA, 1341 nt, synthetic construct
  misc_feature 1..1341: note = derived and/or modified sequence opt11 from Rosmantuzumab_HeavyChain
  source 1..1341: mol_type = other RNA
caagtccaactagtccaatcaggcgcagaagtcaaaaaacccggagcttcagttaaagtaagctgtaaagcctccggttacacattcaccgattactccatccactgggtccgccaagcaccaggacaaggcctcgaatggatcggctacatctacccctcaaacggcgactctggctataaccaaaaattcaaaaaccgagtcaccatgacccgagacacatccacctccaccgcatacatggaactatcacgcttacgatccgaagacaccgccgtctattactgcgccacctacttcgccaacaatttcgactactggggtcaaggtacaacactcaccgtctcctccgcaagcaccaaaggcccatcggtattccccctcgcccccagctctaaatccacctccggcggcaccgccgccctaggctgcctagtcaaagactacttccccgaacccgtaacagtctcctggaactccggcgccctcacaagcggagtccataccttccccgcagtcctacaatcatcaggcctctactcactctcatccgtcgtcaccgtcccctcctcctccctcggcacccaaacctacatctgcaacgtcaaccacaaaccctcaaacaccaaagtcgacaaacgcgtcgaaccaaaatcatgcgacaaaacccacacctgccccccctgccccgcccctgaactacttggcggcccctccgtattcctattccctcccaaacccaaagataccctcatgatctcccgcacacccgaagtcacctgcgtcgtcgtcgacgtctcccacgaagaccctgaagtaaaattcaactggtacgtcgacggcgttgaagtccacaacgccaaaaccaaaccacgcgaagaacaatacaactcaacctaccgcgtcgtctccgtcctaaccgtcctccaccaggactggctcaacggcaaagaatacaagtgcaaagtctccaacaaagcccttcccgctcccatcgaaaaaaccatatccaaagccaaaggccaaccccgcgaaccacaagtctacaccctgcccccctcacgcgaagaaatgaccaaaaaccaagtatccctcacctgccttgtaaaaggtttctaccccagcgacatcgccgtagaatgggaatctaacggccaaccagaaaacaactacaaaaccaccccaccagtccttgactccgacggctccttcttcctatactccaaactcaccgtcgacaaatcccgctggcaacaaggcaacgtcttctcatgcagcgtaatgcacgaagcactccacaaccattacacccaaaaatcgctctccctatccccgggcaaa

SEQ ID NO: 54550 - RNA, 654 nt, synthetic construct
  misc_feature 1..654: note = derived and/or modified sequence opt11 from Rosmantuzumab_LightChain
  source 1..654: mol_type = other RNA
gacatccaaatgacacaatcaccctcatctctctccgcctccgtcggcgaccgcgtaaccatcacatgcaaagcctcccaatccgtcgactacgacggagactcatacatgaactggtaccaacaaaaacccggcaaagcacccaaactcctcatctacgccgcctccaacctcgaatccggcgtcccctcccgcttctccggctccggatccggcaccgacttcaccctcacaatctcccccgtccaagccgaagacttcgccacctactactgccaacaatccaacgaagaccccctcacattcggagccggcaccaaactcgaactcaaacgcaccgtcgccgccccatccgtcttcatctttcccccatctgacgaacaacttaaatccggcacagcctccgtcgtctgcctcctcaacaacttctacccacgcgaagccaaagtccaatggaaagtcgacaacgccctccagtctggcaactcacaagaatcagtcaccgaacaagactccaaagactccacctactccctatcctccaccctcaccctatccaaagccgactacgaaaaacacaaagtctacgcatgcgaagtcacccaccaaggcctcagctcacccgtcaccaaatccttcaaccgaggcgaatgc

SEQ ID NO: 54551 - RNA, 1332 nt, synthetic construct
  misc_feature 1..1332: note = derived and/or modified sequence opt11 from Rozanolixizumab_HeavyChain
  source 1..1332: mol_type = other RNA
gaagtacccctcgtcgaatcaggcggcggcctcgtccaaccaggaggctccctcagactatcctgcgcagtctctggattcaccttctccaactacggaatggtctgggtccgtcaggccccaggcaaaggcctcgaatgggtcgcatacatcgactcagacggagacaacacttactaccgcgacagcgtcaaaggccgcttcacaatctcacgcgacaacgccaaatcatcactatacctccaaatgaactcactccgcgccgaagacaccgccgtatactactgcaccaccggcatagtccgcccattcctatactggggccaaggaaccctagtcacagtatcctccgcatccacaaaaggcccctccgtcttcccactcgcaccatgctctcgctccacctccgaatccaccgccgctcttggatgccttgtaaaagactacttccccgaaccggtcaccgtctcctggaactcaggcgccctcacctccggcgtccacacgttccccgccgtactccaaagctccggactctactccctctcatccgtcgtgacagtacccagctccagcctcggcaccaaaacctatacctgcaacgtcgaccacaaaccttccaacacaaaagtagacaaacgcgtcgaatccaaatacggacctccatgcccaccctgccccgcccccgagttcctcggcggaccctccgtcttcctcttcccacccaaacccaaagacaccctcatgatctcacgcacccccgaagtcacgtgcgtagtggtcgacgtcagccaagaagaccccgaagtccaattcaactggtacgtcgacggcgtcgaagtacacaacgccaaaaccaaaccccgggaagaacaattcaactcaacctaccgtgtagtttccgtcctcacagtacttcaccaagactggctcaacggcaaagaatataaatgcaaagtctcaaacaaaggcctcccctccagcatagaaaagaccatctctaaagcaaaaggccaaccccgagaaccccaagtctacacactaccaccctcccaagaagaaatgaccaaaaaccaagtctccctcacatgcctagtcaaaggattctacccctccgacatcgccgtcgaatgggaatcaaacggccaacccgaaaacaactacaaaaccaccccacccgtcctcgactccgacggatccttcttcctctacagccgcctcaccgtagacaaaagcagatggcaagaaggaaacgtcttctcatgctccgttatgcacgaagccctacacaaccactacacccaaaaatccctctcactatccttaggcaaa

SEQ ID NO: 54552 - RNA, 657 nt, synthetic construct
  misc_feature 1..657: note = derived and/or modified sequence opt11 from Rozanolixizumab_LightChain
  source 1..657: mol_type = other RNA
gacatccaaatgacccaatcccccagctcactctccgcctccgtcggcgaccgcgtcacaatcacctgcaaatcctcccaatcactcgtcggcgcctccggcaaaacctacctctactggctcttccaaaaacccggcaaagcccccaaacgcctcatctatctcgtctccacactcgactccggcatcccctcccgtttctccggctccggctcaggcaccgaattcaccctcaccatctcctcactccaacccgaagacttcgccacctactactgcctccaaggcactcacttcccccacaccttcggccaaggaaccaaactagaaatcaaacgaaccgtcgcagccccctccgtcttcatattccccccctccgacgaacaactcaaatccggcaccgcctccgtcgtctgcctcctcaacaacttctacccccgcgaagcaaaagtccaatggaaagtcgacaacgccctccaatccggcaactcacaagaatccgtcaccgaacaagactctaaggactccacctactccctctcatccaccctaacactctctaaagccgactacgaaaaacacaaagtctacgcctgcgaagtcacccaccaaggcctctcctcccccgtcaccaaatccttcaaccgcggcgaatgc

SEQ ID NO: 54553 - RNA, 1329 nt, synthetic construct
  misc_feature 1..1329: note = derived and/or modified sequence opt11 from Sapelizumab_HeavyChain
  source 1..1329: mol_type = other RNA
caagtccaactacaagaaagcggccctggcctcgtcaaaccatccgaaacactcagcctaacctgcgcagtctcgggccactccatctcccacgaccacgcctggtcctgggtccgacagcccccaggcgaaggcctggaatggataggctttatctcctactccggaataactaactacaacccctcactccaaggccgcgtcaccatctcacgtgacaactccaagaacaccctctacctacaaatgaactctctacgcgctgaagacacagccgtatactactgcgcacgctcattagccagaacaaccgccatggactactggggagaaggaaccctagtcaccgtttccagcgcctctaccaaaggcccctcagtctttcccctagccccctcttcaaaatcaacctccggaggcacagccgcactcggctgcctagtaaaagactacttcccggaaccagtcaccgtcagctggaactccggcgccctaacatctggcgtccataccttccccgctgtcctacaatcctctggactttactccctatcatccgtagtcactgtaccctcctccaatttcggtacccaaacatatacctgcaatgtcgaccacaaaccctccaacacaaaagtagataaaaccgtcgaacgcaaaagctgcgtcgaatgccctccctgtcccgccccacccgtcgcaggaccctccgtcttcctcttcccaccaaaacccaaagacaccctcatgatctcacgcacacctgaagtaacctgcgtcgtcgtcgacgtctcccaagaagaccccgaagtccagtttaactggtacgtcgacggcgtcgaagtacacaacgccaaaaccaaaccccgcgaagaacaatttaactccacctttcgcgtcgtctccgtcctcaccgtcgtacaccaagactggctcaacgggaaagaatacaaatgcaaagtttccaacaaaggcttgcccgcccccatagagaaaaccatatccaagaccaaaggacaaccccgcgaaccccaagtctacactctcccaccatcccaagaagaaatgaccaaaaaccaagtctccctaacctgcctcgtcaaaggcttctacccctccgacatagcggtcgaatgggaatcaaacggccaacccgaaaacaactacaaaaccacacccccgatgctcgactctgacggctccttcttcctctactccaaactcaccgtcgacaaatcccgctggcaagaaggcaatgtcttctcctgctccgtcatgcacgaagccctgcacgcccactacacgcaaaaatccctctccctctccccc

SEQ ID NO: 54554 - RNA, 642 nt, synthetic construct
  misc_feature 1..642: note = derived and/or modified sequence opt11 from Sapelizumab_LightChain
  source 1..642: mol_type = other RNA
gacatccaaatgacacaatcaccctcaagcctaagcgcaagcgtgggcgacagcgtaaccataacctgccaagcaagcacggacattagctcacacctaaactggtaccaacaaaagcccggaaaagcacccgagctcctaatctactacggaagccacctcctaagcggagtcccaagcagattctcaggctccggctcaggcacagacttcaccttcaccataagctcactagaggccgaagacgcggccacatactactgcgggcaaggcaacagactcccgtacacgttcgggcaagggaccaaagtcgagatcgagcgcacagtcgcggccccgagcgtgttcatattcccgccctcggacgaacaactcaaatcgggcacggcctcagtcgtatgcctgctcaacaacttctacccacgcgaggcaaaagtccagtggaaggtagacaacgcactccagagcggaaactcacaagaaagcgtaaccgagcaagacagcaaagactcaacctacagcctgagctcaaccctaaccctaagcaaggccgactacgaaaaacacaaagtgtacgcgtgcgaagtcacacaccagggcctaagctcacccgtaaccaagagcttcaacagaggcgaatgc

SEQ ID NO: 54555 - RNA, 1356 nt, synthetic construct
  misc_feature 1..1356: note = derived and/or modified sequence opt11 from Selicrelumab_HeavyChain
  source 1..1356: mol_type = other RNA
caagtccagctagtccaatcaggcgcggaagtcaagaaaccaggcgcctccgtcaaagtttcctgcaaagcctccggctacacatttaccggatactacatgcactgggtacgtcaagcccccggccaaggcctcgaatggatgggctggatcaaccccgactccggcggcaccaactacgcccaaaaattccaaggccgcgtcaccatgacccgcgacacatccatctcaaccgcttacatggaactaaaccgcctacgatccgacgacaccgccgtctactactgcgcccgagaccaacccctcggatactgcaccaacggcgtatgctcctacttcgactactggggacaaggcaccctagtcaccgtatcctccgcctcaaccaaaggaccatcagtcttccccctcgccccatgctcccgatctacctccgaatccaccgcagccctgggatgcctagtcaaagactacttccccgaaccagtaaccgtctcatggaactccggagcccttacatccggcgtccacacctttcctgcagtcctccaatcatcaggcctctactccctaagctcagtcgtcaccgtcccatcatccaatttcggaacccaaacctacacttgcaacgtcgaccacaaacccagcaacactaaagtcgacaaaacagtcgagcgcaaatgctgcgtcgaatgcccaccctgtcccgcaccacccgtcgcaggcccctccgtcttcctattcccacccaagcccaaggacaccctcatgatctcccgcacccccgaagtaacctgcgtcgtcgtagacgtgtctcacgaagaccccgaagtacagttcaactggtacgtcgacggcgtcgaagtccacaatgcaaaaaccaaaccccgcgaagaacagttcaactctaccttcagagtcgtatcagtcctaacagtagtacaccaggactggctcaacggcaaagaatacaaatgcaaagtcagcaacaaaggccttcccgcacctatagagaaaacaatctccaaaaccaaaggccagccccgagaacctcaagtctacacactaccaccctcccgcgaagaaatgaccaagaaccaagtctccctcacatgcctagtcaaaggcttctacccctccgacatcgccgttgaatgggaatcaaacggccaaccagaaaacaactacaaaaccacacccccaatgctcgactccgacggatccttctttctatactccaaactcaccgtcgacaaatcacgatggcaacaaggcaacgtcttctcctgctcagtaatgcacgaagcccttcacaaccactacacacaaaaatccctctccctatcacccggcaaa

SEQ ID NO: 54556 - RNA, 642 nt, synthetic construct
  misc_feature 1..642: note = derived and/or modified sequence opt11 from Selicrelumab_LightChain
  source 1..642: mol_type = other RNA
gacatccaaatgacccaatccccctcctccgtctccgcctccgtaggcgaccgcgtcacaataacctgccgcgcctcacaaggcatctactcctggctcgcctggtaccaacaaaagcccggcaaagcacccaacctcctcatctacaccgcatccaccctccaatctggcgtcccctcccgattctcaggctccggctctggcaccgacttcaccctcacaatctcctccctccaacccgaagacttcgccacatactactgccaacaagccaacatcttccccctcaccttcggaggcggcaccaaagtcgaaataaaacgcaccgtcgccgccccctccgtattcatcttccctccctccgacgaacaactcaaatccggcaccgcctccgtcgtctgcctcctcaacaacttctacccccgcgaagccaaagtccaatggaaagtcgacaacgcactccaatccggcaactcccaagaatccgtcaccgaacaagactccaaggactccacctactccctctcctccaccctcacactctccaaagccgactacgaaaaacacaaagtatacgcctgcgaagtaacccaccaaggcctatcctcccccgtaaccaaatccttcaaccgcggagagtgc

SEQ ID NO: 54557 - RNA, 354 nt, synthetic construct
  misc_feature 1..354: note = derived and/or modified sequence opt11 from Solitomab_HeavyChain1
  source 1..354: mol_type = other RNA
gaggtccagctcttggaacagagcggggccgagctcgtgcgaccgggcacgagcgtgaaaataagctgtaaagcgagcgggtacgcgttcacgaactattggttgggctgggtcaagcaaaggcccgggcacgggctcgagtggataggcgatatctttcccgggagcgggaacatacactataacgagaaatttaaagggaaagcgaccttgaccgcggacaagagctcgagcacggcctatatgcagctcagctcattgacctttgaagatagcgcggtctatttctgtgccaggctaaggaactgggacgagcccatggactattgggggcaagggaccacggtcacggtc

SEQ ID NO: 54558 - RNA, 375 nt, synthetic construct
  misc_feature 1..375: note = derived and/or modified sequence opt11 from Solitomab_HeavyChain2
  source 1..375: mol_type = other RNA
gacgtccaactcgtccaatccggcgccgaagtcaaaaaacccggcgcatccgtcaaagtctcctgcaaagcctccggctacacattcaccagatacaccatgcactgggtccgccaagcccccggccaaggcctcgaatggatcggctacatcaacccctcccgcggctacaccaactacgccgactccgtcaaaggccgcttcaccatcaccaccgacaaatccacctccaccgcctacatggaactctcctccctccgctccgaagacaccgccacctactactgcgcccgctactacgacgaccactactgcctcgactactggggccaaggcaccaccgtcaccgtctcctcaggcgaaggcacctccacc

SEQ ID NO: 54559 - RNA, 1488 nt, synthetic construct
  misc_feature 1..1488: note = derived and/or modified sequence opt11 from Solitomab_LightChain_HeavyChain_HeavyChain_LightChain
  source 1..1488: mol_type = other RNA
gaattggtgatgacgcaatcaccctcatccctgaccgtaacagccggcgaaaaagtaaccatgagttgcaaaagcagccaatcactgctcaactccgggaaccagaaaaactatctcacctggtaccaacaaaaacccggacaaccgcccaagctcttgatctactgggcaagcacacgcgaaagcggagtcccagacagattcacaggatccggctcaggcaccgacttcaccctaaccatcagctcagtacaagccgaagacctagccgtctactactgccagaacgactactcgtacccactcacattcggagccggcaccaaactcgaaataaagggaggcggcggaagtgggggagggggctctggcgggggaggcagcgaagtccaactactcgaacaaagcggggccgaactcgtgcgcccaggcacctccgtaaaaatatcctgtaaagcaagcggatacgcattcacgaactattggctaggatgggtcaagcaaagacccgggcacggcctagagtggataggagacatcttccccggaagcggaaacattcactacaacgagaaattcaaagggaaagccacgctaacagcagacaaaagctcaagcacggcatacatgcaactctcatcgctaaccttcgaagactccgcggtctacttttgcgcaagactcaggaactgggacgaaccgatggactactggggacaagggaccacggtcacggtctccagcggaggaggcggctccgacgtacaactggtccaaagcggcgcagaagtcaagaaacccggagcgagtgtaaaagtaagctgtaaagccagcggatacaccttcacacgatacaccatgcactgggtcagacaagcgcccgggcaaggactcgagtggatcggctacataaacccgtcacgaggatacacaaactacgccgacagcgtaaaaggacgattcaccataaccacagacaaaagcacaagcacggcctacatggagctctcaagcctacgcagcgaagacaccgccacctactattgcgcaaggtactatgacgatcactactgcctggactactggggacaaggaaccaccgtaacagtctcgagcggagaaggaacctcaacaggaagcggaggatcaggcggaagcggaggcgcggacgatatcgtactcacacaaagcccagcaaccctaagcctaagcccaggagaaagagcaaccctaagctgccgcgcaagccaaagcgtaagttacatgaactggtaccaacagaaaccaggcaaggccccaaaacgatggatctacgacacctcaaaagtggcctcaggcgtcccagcacgcttctccgggagcgggagtgggacagattactcgcttacgatcaacagcctagaagcagaagacgcagcgacctactactgccaacagtggtcgagcaacccactaaccttcggcggcggcacgaaagtggaaatcaaa

SEQ ID NO: 54560 - RNA, 339 nt, synthetic construct
  misc_feature 1..339: note = derived and/or modified sequence opt11 from Solitomab_LightChain1
  source 1..339: mol_type = other RNA
gaactcgtcatgacccaatccccctcctccctcaccgtcaccgccggcgaaaaagtcaccatgtcctgcaaatcctcccaatccctcctcaactccggaaaccaaaaaaactacctcacctggtaccaacaaaaacccggccaaccccccaaactactcatctactgggcctccacccgcgaatccggcgtccccgaccgcttcaccggctccggctccggcaccgacttcaccctcaccatctcctccgtccaagccgaagacctcgccgtctactactgccaaaacgactactcctaccccctcaccttcggcgccggcaccaaactcgaaatcaaa

SEQ ID NO: 54561 - RNA, 324 nt, synthetic construct
  misc_feature 1..324: note = derived and/or modified sequence opt11 from Solitomab_LightChain2
  source 1..324: mol_type = other RNA
gccgacgacatcgtcctcacccaatcccccgccaccctctccctctcccccggcgaacgcgccaccctctcctgccgcgcctcccaatccgtctcctacatgaactggtaccaacaaaaacccggcaaagcccccaaacgctggatctacgacacctccaaagtcgcctccggcgtccccgcccgcttctccggctccggctccggcaccgactactccctcaccatcaactccctcgaagccgaagacgccgccacctactactgccaacaatggtcctccaaccccctcaccttcggcggcggcaccaaagtcgaaatcaaa

SEQ ID NO: 54562 - RNA, 1359 nt, synthetic construct
  misc_feature 1..1359: note = derived and/or modified sequence opt11 from Suptavumab_HeavyChain2
  source 1..1359: mol_type = other RNA
gaagtccaactcgtagaaagtggaggagacctcgtacagcccggaagaagcctacgcctctcttgcgtcgcctccggattcaccttcgacgactacgccatgcactgggtccgacaagcccccggcaaaggactcgaatgggtatccggcgtcagctggtcaggcagcacagtcggctacgccgactccgtcaaaggccgattcaccgtctcccgagacaacgctcaaaaatctctttatctccagatgaacagtctccgcgcagaagacaccgccctatactactgcgtaaaagatgcctacaaattcaattactactactacggtctcgacgtctggggccagggaaccaccgtaaccgtatcctcagccagcaccaagggacccagcgtattccccctcgccccctcctccaagtccacctccggaggcacagctgcactcggctgcctcgtaaaagactacttccccgaacccgtcaccgtctcctggaactccggagcactaacctcaggagtccacaccttccccgcagtcctccaatcctcaggactatacagcctcagctccgtcgtcactgtcccctcctccagtctcggcactcaaacatacatctgtaacgtcaaccacaaaccctcaaacaccaaagtcgacaagaaagtcgaacccaaatcctgcgataaaacccacacatgcccaccctgccccgcacccgaactcctcggcggcccctccgtcttcctattcccacccaaacccaaagacactctcatgatctcccgcacccccgaagtaacctgcgtcgtcgtcgacgtctcccacgaagaccccgaagtcaaattcaattggtacgtcgacggcgtcgaagtccacaacgctaaaaccaaaccccgcgaagaacagtacaattcaacttaccgcgtcgtctcagtcctaacagtactccaccaggactggctaaacggaaaagaatacaaatgcaaagtctcaaacaaagcactccccgccccaatcgagaaaaccatctccaaagccaaaggccaaccacgcgaaccccaagtatacaccctcccaccaagccgtgacgaactcactaaaaaccaagtatccctaacctgcctcgtgaaaggattctacccgagcgacatcgcagtcgaatgggaatccaacggccaaccagaaaacaattacaaaaccactccacccgtactagacagcgacggcagcttcttcctctatagcaaactgacggtcgacaaatcccgctggcaacagggaaacgtattctcctgctcagtaatgcacgaagcactccacaaccactacacccaaaagtcactatccctctcccccggcaaa

SEQ ID NO: 54563 - RNA, 1356 nt, synthetic construct
  misc_feature 1..1356: note = derived and/or modified sequence opt11 from Suvratoxumab_HeavyChain
  source 1..1356: mol_type = other RNA
gaagtccaactcgtcgaatccggaggcggactagttcagcccggcgggtccctacgcctatcctgtgcagcatcaggattcaccttctcatcccacgacatgcactgggtcagacaagccaccggtaaaggcctagaatgggtatcaggcataggaactgcaggcgacacctattaccccgactccgtaaaaggccgcttcacaatctcccgagaaaacgccaaaaactcactctacctacaaatgaactcacttcgagcaggggacactgcagtctactactgcgcccgagacaggtactcccccacgggacactattacggcatggacgtatggggccaaggaaccaccgtaaccgtctcctcagcttcaaccaaaggcccatcagtcttccccctagcccccagctccaaaagcacatcaggaggcaccgcagccctaggctgcctcgtcaaagactacttccccgaaccagtcaccgtctcatggaacagcggagccctaacatcaggcgtccacacatttcccgctgttctccaatcatccggactatattcactctcatcagtcgttaccgtccccagctcctcactcggcacccaaacctatatctgcaacgtgaaccacaaaccctccaacaccaaagtcgacaaaagagtcgaacccaaatcctgcgacaaaacacacacctgccctccctgcccagcacctgaactcctcggaggcccctctgtattcctattcccaccaaaaccaaaagacaccctatacataacccgggaacccgaagtcacctgcgtcgtagtcgacgtatcccacgaagaccccgaagtaaaattcaactggtacgtagacggcgtggaagtccacaacgccaaaacaaaaccccgtgaagaacaatacaactccacctaccgagtcgtcagcgtcctcaccgtcctccaccaagattggctaaacggtaaagaatacaaatgcaaagtctccaacaaagccctcccagccccaatcgaaaaaaccatctcaaaagcaaaaggccaaccccgcgaacctcaagtctacaccctacccccctcccgtgaagaaatgaccaaaaaccaagtcagtctcacctgcctcgtaaaaggcttctacccatcggacatcgcagtcgaatgggaatcaaacggacaacccgaaaacaactacaaaacgaccccccccgtactcgactcagatgggtccttcttcctttactccaaactaaccgtagacaaatcaagatggcaacaaggcaacgtcttctcctgctctgtcatgcacgaagcactccacaaccactacacgcaaaaatccctctcactctcacccggcaaa

SEQ ID NO: 54564 - RNA, 639 nt, synthetic construct
  misc_feature 1..639: note = derived and/or modified sequence opt11 from Suvratoxumab_LightChain
  source 1..639: mol_type = other RNA
gacatacaaatgacccaatccccctccaccctctcagcatccgtcggcgaccgcgtcaccatcacatgccgagcctcccaatcaatctcatcctggctcgcctggtaccaacaaaaacccggcaaagcccccaaactcctaatctacaaagcctcctccctcgaatccggcgtcccctcacgcttctcaggctccggctccggaacagaattcaccctcaccatctcctccctacaacccgacgacttcgccacctactactgcaaacaatacgccgactactggaccttcggccaaggcaccaaagtcgaaatcaaacgcacagtagccgcccccagcgtcttcatcttccccccctcagacgaacaactaaaatccggcaccgcctccgtcgtctgcctactcaacaacttctacccccgcgaagccaaagtccaatggaaagtcgacaacgccctacaatccggcaactcccaagaatccgtcaccgaacaagactccaaagactccacctactccctctcctccaccctcaccctctccaaagccgactacgaaaaacacaaagtctacgcatgcgaagtcacccaccaaggcctctcctccccagtcaccaaatccttcaaccgcggcgaatgc

SEQ ID NO: 54565 - RNA, 642 nt, synthetic construct
  misc_feature 1..642: note = derived and/or modified sequence opt11 from Tadocizumab_LightChain
  source 1..642: mol_type = other RNA
gacatacaaatgacacaaaccccatccaccctctccgcctccgtaggcgaccgcgtcaccatatcctgccgcgcatcacaagacatcaacaactacctcaactggtaccaacaaaaacccggcaaagcccccaaactcctaatctactacacctccacacttcactccggcgtcccctcccgcttctccggctccggatccggcaccgactacaccctcaccatctcctccctacaacccgacgacttcgcaacctacttctgccaacaaggcaacacactaccatggaccttcggccaaggcaccaaagtcgaagtcaaacgcacagtagccgccccctccgtcttcatcttcccaccctccgacgaacaactcaaatccggcaccgcctccgtcgtctgccttctcaacaacttctacccccgcgaagccaaagtccaatggaaagtcgacaacgccctccaatccggcaactcccaagaatccgtcaccgaacaagactccaaagactcaacctattccctctcctccaccctcacactatccaaagccgactacgaaaaacacaaagtctacgcctgcgaagtcacccaccaaggcctctcctcccccgtcaccaaatccttcaaccgtggcgaatgc

SEQ ID NO: 54566 - RNA, 1341 nt, synthetic construct
  misc_feature 1..1341: note = derived and/or modified sequence opt11 from Tanezumab_HeavyChain
  source 1..1341: mol_type = other RNA
caagtccaactccaagaatccggccccggtttagtcaaaccctcagaaaccctcagcctaacctgcaccgtctctggcttttccctcataggctacgacctcaactggatccgacaacccccgggcaaaggactagaatggataggcatcatctggggagacggcaccaccgactacaactccgccgtcaaaagccgcgtaacaatatccaaagacacctctaaaaaccaattctcccttaaactatcctccgtcaccgcagcagacacagctgtatactactgcgcccgaggaggatactggtacgccacctcctattacttcgactactggggccagggaacactcgtaaccgtatcctccgcctcaaccaaaggcccctccgtcttccccctagcaccctgctcacgctccacctccgaatccaccgccgccctcggctgccttgtaaaagactacttcccagaaccggtcaccgtcagctggaactccggcgctctcacctcaggcgtccacacctttcccgccgttctccaaagctcaggcctctattccctctcatccgtagtaaccgtaccatcatcaaacttcggaacccaaacctatacctgcaacgtcgaccacaaaccctccaataccaaagtagacaagaccgtcgaacgaaaatgctgcgtcgaatgccctccctgccccgcaccacccgtcgccggcccctctgtattcctattcccacccaaacccaaagacaccctcatgatatcgcgaacccccgaagtcacatgcgtcgtcgtcgacgtatcccacgaagaccccgaagtacaattcaactggtacgtcgacggcgtcgaggtccacaacgccaaaaccaaaccccgcgaggaacaattcaactcaaccttcagagtcgtctcagtcctcaccgtcgtacaccaggactggctcaacggcaaagaatacaaatgcaaagtctccaacaaagggctaccctcctcaattgagaaaactatatccaagacgaaaggccaaccacgcgaaccacaagtctacactctccctccctcccgcgaagaaatgaccaaaaaccaagtctccctaacctgcctcgtcaaaggcttctacccctcagacatcgccgtggaatgggaatccaacggacaacccgaaaacaactacaaaaccaccccacccatgctcgactccgacggctctttcttcctctactccaaactcaccgtcgacaaatcacgctggcaacaaggcaacgtcttctcctgcagcgtcatgcacgaagccctccacaaccactacacccaaaaatcactatctctcagccccggcaaa

SEQ ID NO: 54567 - RNA, 642 nt, synthetic construct
  misc_feature 1..642: note = derived and/or modified sequence opt11 from Tanezumab_LightChain
  source 1..642: mol_type = other RNA
gacatccaaatgacacaatctccctcctccctctccgcctccgtcggcgaccgagtcaccatcacatgccgcgcctctcaatccatctccaacaacctcaactggtaccaacaaaaacccggcaaagccccaaaactcctcatctactacacctcccgcttccactccggtgtcccatcccgcttctccggctccggatccggcaccgacttcaccttcaccatctcatccctccaacccgaagacatcgccacctactactgccaacaagaacacaccctcccctacaccttcggccaaggcaccaaactcgaaatcaaacgcaccgtcgccgccccctctgtcttcatcttcccaccctccgacgaacaactaaaatccggcaccgcctccgtagtctgcctactcaacaacttctacccccgcgaagccaaagtccaatggaaagtcgacaacgccctccaatccggcaactcccaagaatccgtcaccgaacaagactctaaggactccacctattccctctcctccaccctcaccctctccaaagccgactacgaaaaacacaaagtctacgcctgcgaagtcactcaccaaggcctctcctcccccgtcaccaaatccttcaaccgcggcgaatgc

SEQ ID NO: 54568 - RNA, 1353 nt, synthetic construct
  misc_feature 1..1353: note = derived and/or modified sequence opt11 from Tavolixizumab_HeavyChain
  source 1..1353: mol_type = other RNA
caagtccaactacaagaatcaggaccgggcctcgtcaaaccatcgcaaaccctctccctaacctgcgccgtctacggcggatcattctcatcaggatactggaactggataagaaaacaccccggcaaaggcctggaatacatcgggtacatctcatacaacggaatcacataccacaacccatcactaaaatccagaatcaccatcaaccgcgatacctccaaaaaccaatactcactccaactcaactccgtcacccccgaagacaccgccgtctactactgcgccagatacaaatacgattacgatggcggacacgccatggactactggggacaaggcacactcgtcaccgtatcctctgcctccaccaaaggaccctccgtcttcccactcgcgccctcatccaaaagcacctcaggcggaaccgctgccctcggctgcctagtcaaagactacttccccgaaccagtcaccgtatcctggaactctggagcactcacctccggcgtccacaccttcccagcagtcctccaatcatcaggcctgtactcactctccagcgttgtcaccgttcccagctcctccctcggcacccaaacatacatctgcaacgtcaaccacaagccctcaaacaccaaagtcgacaagagagtcgaaccaaaatcatgcgacaaaacacacacctgtcccccatgccccgcacccgaactcctaggcggcccctctgtcttcctctttccacccaaacctaaagacaccctcatgatctcccgcacccccgaagtaacctgcgtcgtcgtcgacgtctcccacgaagaccccgaagtaaaattcaactggtacgtcgacggcgtcgaagtgcacaacgcaaaaaccaaaccccaagaggaacagtacaactccacctaccgcgtcgtctcagtcctcaccgtcctccaccaggactggctcaatggcaaagaatacaaatgcaaagtctccaacaaggcactacccgcccccattgagaaaaccatctccaaagccaaaggccaaccccgcgaaccccaagtctacacccttcccccttcccgcgaagaaatgaccaaaaaccaagtctcactaacctgcctcgtaaaaggcttctacccctctgacatcgcagtcgaatgggaatccaacggccaacccgaaaataactacaaaaccaccccaccagtcctcgactctgacggctcattcttcctctactcaaaactcactgtcgacaaatcccgctggcaacaaggaaacgtattctcctgctctgtcatgcacgaagcccttcacaaccactacacccaaaaatccctttcactatcccctggcaaa

SEQ ID NO: 54569 - RNA, 642 nt, synthetic construct
  misc_feature 1..642: note = derived and/or modified sequence opt11 from Tavolixizumab_LightChain
  source 1..642: mol_type = other RNA
gacatccaaatgacacaatccccctcctccctctcagcatcagtcggcgaccgcgtaaccatcacatgccgcgcctcacaagacatctccaactacctcaactggtaccaacaaaaacccggcaaagcccccaaactcctaatctactacacctccaaactccactcaggagtcccatccagattctccggctccggctccggcaccgactacaccctcaccatctcctccctccaacccgaagacttcgccacctactactgccaacaaggctccgccctcccctggaccttcggccaaggcaccaaagtcgaaatcaaacgcaccgtcgccgccccctccgtcttcatcttcccaccctcagacgaacaactgaaatccggcaccgcctcagtcgtctgcctactcaacaacttctacccccgcgaagccaaagtccaatggaaagtcgacaacgcactccaatcaggcaactcacaagaatccgtcaccgaacaagactccaaagactccacctactccctctcatccaccctaaccctctccaaagccgactacgaaaaacacaaagtctacgcctgcgaagtcacccaccaaggactctcctcccccgtcaccaaatccttcaaccgcggcgaatgc

SEQ ID NO: 54570 - RNA, 1335 nt, synthetic construct
  misc_feature 1..1335: note = derived and/or modified sequence opt11 from Telisotuzumab_HeavyChain
  source 1..1335: mol_type = other RNA
caagtccaactcgtccaatccggagcagaagttaaaaaacctggagcatcagtaaaagtctcctgcaaagcctccggatacatattcaccgcctacaccatgcactgggtcagacaagcccccggccaaggcctcgaatggatgggatggataaaacccaacaacggcctcgccaactacgcacagaaattccaaggcagagtcacaatgacccgcgacacttccatatcaaccgcctacatggaactctcccgcctaagatcagacgataccgcggtctactactgtgcccgctccgaaataaccaccgaattcgactactggggccaaggtaccctcgtcactgtatcctcagccagcacaaaaggcccctccgtcttccccctcgcaccatcctcaaaatccacctccggaggaacagccgcactcggctgcctcgtaaaggactacttccctgaaccagtcaccgtctcgtggaatagcggcgccctcaccagcggagtacacaccttccccgccgtcctccaatcatccggactctactccctgagctccgtcgtcaccgtcccctcctcatccctcggcacccaaacatacatctgcaacgtcaaccacaaacctagcaacaccaaagtcgacaaacgcgtcgaacccaaatcctgcgactgccattgccccccctgccccgcccccgaactcctcggaggcccatcagtcttcctattcccgcctaagcccaaggacaccctcatgatatcccgcacccccgaagtcacctgcgtagtcgttgacgtctcccacgaagacccagaagtcaagttcaattggtacgtcgacggcgtcgaagtccacaacgccaaaactaaacccagagaagaacaatataactcaacataccgggtggtctccgtacttaccgtactccaccaggactggctcaacggtaaagaatataaatgcaaagtctccaacaaagccctacccgcaccaatcgaaaaaactatctccaaggccaaaggccaaccccgagaaccccaagtctacactctgcccccctcccgagaagaaatgactaaaaaccaagtctcccttacctgcctcgtcaaaggcttctacccctccgacatcgccgtagaatgggaatccaacggccaacccgaaaacaactacaaaaccacaccccccgtcctcgactctgacggatcattcttcctgtactccaaactcaccgtcgacaaaagccgctggcaacaaggcaacgtcttctcctgctccgtaatgcacgaagccctccacaaccactacacccaaaaatctctctccctctccccaggc

SEQ ID NO: 54571 - RNA, 654 nt, synthetic construct
  misc_feature 1..654: note = derived and/or modified sequence opt11 from Telisotuzumab_LightChain
  source 1..654: mol_type = other RNA
gacatcgtaatgacgcaatcgcccgacagcctggccgtgagcttaggcgagcgcgcgaccataaactgcaaatcgagcgagagcgtagactcgtacgcgaactcattcctgcactggtaccagcaaaagcccgggcaaccgcccaaactcctgatctaccgcgcaagcacacgcgagagcggagtcccagaccggttctcgggctcgggctcgggcacggacttcaccttaaccatatcctcgctccaggccgaggacgtagccgtgtactactgccagcaatcgaaagaggacccgctcacgttcgggggagggaccaaggtcgagatcaagcgcacagtagcggccccgagcgtgttcatattcccgccctccgacgagcaactgaaatcgggcacggcctcagtcgtatgcctgctcaacaacttctacccgcgcgaggccaaagtccagtggaaagtagacaacgcgctccagagcggaaactcacaagaaagcgtgaccgagcaagacagcaaggactcaacctacagcctgagctcaaccctaaccctgagcaaagccgactacgaaaaacacaaagtatacgcatgcgaggtcacgcaccagggcctgagctcgcccgtaaccaagagcttcaacaggggcgagtgc

SEQ ID NO: 54572 - RNA, 1335 nt, synthetic construct
  misc_feature 1..1335: note = derived and/or modified sequence opt11 from Telisotuzumab_vedotin_HeavyChain
  source 1..1335: mol_type = other RNA
caagtccagctagtccaatcgggtgccgaagtaaagaaacccggcgcctccgtgaaagtctcatgtaaagcctccggttacatcttcacagcatacaccatgcactgggtccgccaagcacccggccaaggcctagaatggatgggctggataaaacccaacaacggcctagccaactacgcccaaaaattccaagggcgcgtcacaatgacccgcgacacatccatatccaccgcctacatggaactctcccgcctccgctcagatgacactgccgtctactactgcgccagatccgaaataaccaccgagttcgactactggggccaaggcaccctcgtcaccgtctcaagcgcctccaccaaaggaccctccgtcttccccctcgccccctcctccaaatccacctccggcggcaccgccgcccttggctgcctcgtaaaagactatttccccgaacccgtcacagtctcctggaactccggcgccctcacatccggcgtacacaccttcccagccgtccttcaatccagcggcctctattccctctcctccgtcgtcacagtcccaagctcctctctcggcacccaaacatacatctgtaacgttaaccacaaaccatcaaacaccaaagtcgacaaacgcgtcgaaccaaaatcatgcgactgccactgtccaccctgtcccgcccccgaactgctaggcggcccctccgtctttctatttccccctaaacccaaagacaccctaatgatcagccgaacccccgaagtcacatgcgtcgtagtagacgtctcccacgaagaccccgaagtcaaattcaactggtacgtcgacggcgtcgaagtacacaacgccaaaaccaaaccaagagaagaacagtacaactccacctaccgagtagtcagcgtactcacagtcctacaccaagactggctcaacggcaaagaatacaaatgcaaagtctccaataaagccctacccgcacccatcgaaaagaccatatcaaaagccaaaggccaaccccgcgaaccacaagtatacaccctcccacccagccgagaagaaatgaccaaaaaccaagtatccctaacatgcctagttaaaggcttctacccctccgacatagccgtcgaatgggaatccaacggccaacccgaaaacaactacaaaacaaccccgcccgtcctagactcagacggatcattcttcctatattccaaactaaccgtcgacaaatctagatggcaacaaggaaacgtcttctcctgctccgtaatgcacgaagccttacacaaccactacacacagaaaagcctttccctctcccccgga

SEQ ID NO: 54573 - RNA, 654 nt, synthetic construct
  misc_feature 1..654: note = derived and/or modified sequence opt11 from Telisotuzumab_vedotin_LightChain
  source 1..654: mol_type = other RNA
gacatcgtaatgacgcaatcgcccgacagcctggccgtgagcctgggcgaacgcgcgaccataaactgcaaatcaagcgaaagcgtggactcatacgcaaactcgttcctgcactggtaccagcaaaagcccgggcaaccacccaagctcctgatctaccgcgcaagcacacgcgaaagcggggtcccagacagattctcaggctcgggctcaggcacagacttcaccctaaccatcagctcgctccaggcagaagacgtagccgtatactactgccagcaatcgaaagaggacccactcacgttcgggggcggaaccaaggtcgaaatcaagcgcacagtcgcggccccgagcgtattcatattcccgccctcggacgaacaactgaaatcaggcacagcctcagtcgtatgcctacttaacaacttctacccgcgcgaggccaaagtccagtggaaagtcgacaacgcgctccaaagcgggaactcacaagaaagcgtgaccgaacaagacagcaaagactcaacatacagcctaagctcaaccctaaccctaagcaaggccgactacgagaaacacaaagtgtacgcgtgcgaagtcacacaccagggcctaagctcgcccgtgaccaagagcttcaacagaggagaatgc

SEQ ID NO: 54574 - RNA, 1350 nt, synthetic construct
  misc_feature 1..1350: note = derived and/or modified sequence opt11 from Timigutuzumab_HeavyChain
  source 1..1350: mol_type = other RNA
gaagtccaactcgtcgaatcagggggcggcctcgtccagccaggaggctcactccgcctctcctgcgccgcatccggcttcaacatcaaagacacctacatccactgggtccgccaagcccccggcaaaggcctcgagtgggtcgcacgcatataccccacgaacggctacacaaggtacgccgactcagtcaaaggccgattcacaatttcagcagacacctccaaaaacacagcctacctccaaatgaactcccttcgcgcagaagacaccgcagtctactactgctctcgctggggcggcgacggcttctacgcaatggactactggggccaaggcaccctcgtaaccgtctcatcagcctccaccaaaggcccctccgtctttcccctcgccccctcatctaaaagcacctccggcggcactgccgccctcggctgcctcgtcaaagactacttccccgaacccgtaacagtctcctggaactcaggcgccttaaccagcggcgtccacaccttccccgccgtcctccaatcctccggcctctactccctctcctcggtcgtaaccgtcccatcctcatctctcggaacacaaacatacatatgcaacgtcaaccacaaaccctccaacacaaaagtagacaagaaagtcgaaccaaaatcctgcgacaaaacccatacctgcccaccctgccccgcccccgaactcctcggcggacccagcgtattcctattcccgcccaaacccaaagacaccctcatgatctctcgtacccccgaagttacttgcgtcgtcgtcgacgtctcccacgaggaccccgaagtcaaatttaactggtacgtagacggcgtcgaggtccacaacgccaaaaccaaaccacgcgaagaacaatacaattccacataccgagtcgtcagcgtcctgacagtactccaccaagactggctaaacggcaaagaatacaaatgcaaagtaagcaacaaagcactccccgcacccatcgagaaaaccatctcaaaagccaaaggccaaccccgcgaaccacaagtatacacactacccccatcacgcgacgaactcaccaaaaaccaagtttccctaacctgcctcgtcaaaggtttctacccctccgatatcgccgtagaatgggaatccaacggccaacccgaaaacaactacaaaacgaccccacccgtactcgactctgacggatccttctttctctactccaaactcaccgtagacaaatcccgctggcaacaaggcaacgtcttctcctgctcagtaatgcacgaaggactccacaaccactacacccaaaaatcactctccctctcaccaggcaaa

SEQ ID NO: 54575 - RNA, 642 nt, synthetic construct
  misc_feature 1..642: note = derived and/or modified sequence opt11 from Timigutuzumab_LightChain
  source 1..642: mol_type = other RNA
gacatccaaatgacccaatcaccctcctccctatccgcctccgtaggcgaccgcgtaaccatcacctgccgcgcctcccaagacgtaaacaccgcagtcgcctggtaccaacaaaaacccggcaaagcccccaaactcctaatctactccgcctcattcctctactccggcgtcccctcccgcttctccggctcccgctccggcaccgacttcaccctcaccatatcctcactccaacccgaagacttcgccacctactactgccagcaacactacacaaccccccccaccttcggccaaggcaccaaagtcgagatcaaacgcaccgtcgccgcccccagcgtattcatattccccccctccgacgaacaattaaaatccggcaccgcctccgtcgtctgcctactcaacaacttctacccccgcgaagccaaagtccaatggaaagtcgacaacgcactccaatccggaaactcccaagaatccgtcaccgaacaagactccaaagactccacctactccctctcctccaccctcaccctctccaaagccgactacgaaaaacacaaagtatacgcatgcgaagtcacccaccaaggcctctcctcccccgtcactaaatccttcaaccgcggcgaatgc

SEQ ID NO: 54576 - RNA, 1332 nt, synthetic construct
  misc_feature 1..1332: note = derived and/or modified sequence opt11 from Timolumab_HeavyChain
  source 1..1332: mol_type = other RNA
caagtccaactcgtcgaaagtggcggaggcgtcgtccaacccggccgctccctacgcctctcctgcgcagcctccggattcacattcttctcctacgccatgcactgggtacgtcaaacacccggaaaaggcctcgaatgggtcgccgtaatatggttcgacgggtcaaacgaaaactacgttgactccgtaaaaggccgcttcaccatatcccgcgacaactccaaaaacaccctctacctacaaatgaacactttacgagccgaagacacagcagtctactactgcgcacgagacgcctggtcctacttcgactactggggccaaggcacactcgtgacagtctcctccgcctccaccaaaggcccctccgtcttcccactcgccccatgctcccgatcaaccagcgaatcaacagccgctctaggttgcctggtaaaagactacttccccgaaccagtaaccgtctcatggaactcaggagccctcacaagcggcgtccacaccttccccgccgtactacaatcctccggcctctacagcctctcatccgtcgtaacagtcccaagttccagcctaggcaccaaaacatacacatgcaacgttgaccataaaccctcaaataccaaagtcgacaaaagagtcgaatccaaatacggaccgccctgcccaccctgccccgcacccgagttcgccggcggaccctccgtattcctattccctcccaaacccaaagacaccctcatgatcagcagaacacccgaagtaacctgcgtcgtagtcgacgtctcccaagaagaccccgaagtccaattcaactggtacgtcgacggcgtcgaagtccacaacgccaaaaccaaaccccgcgaagaacaattcaactccacctacagagtcgtatcagtcctaaccgtactacaccaagactggctaaacggcaaagaatacaaatgcaaagtctcaaacaaaggcctaccctcctccatcgagaaaaccatcagcaaggcaaagggccaaccccgcgaaccacaagtatacaccctcccaccgtcacaagaagaaatgaccaagaaccaagtctccctaacctgcctcgtcaaaggcttctaccctagcgacatcgcagtcgaatgggaatccaacggccaaccagaaaacaactacaagaccacaccacccgtcctagactccgatggcagcttcttcctgtactcacgcctaaccgtagacaaatcacgatggcaggaaggaaacgtgttcagctgctcagtaatgcacgaagcactccacaaccattacacccaaaaatccctctccctatccctaggaaaa

SEQ ID NO: 54577 - RNA, 642 nt, synthetic construct
  misc_feature 1..642: note = derived and/or modified sequence opt11 from Timolumab_LightChain
  source 1..642: mol_type = other RNA
gtcatccaactcacccaatccccctcctccctctccgcctccgtcggcgaccgcgtcaccatcacatgccgcgcctcccaaggcatctccagagccctcgcatggtaccaacaaaaacccggcaaaggccccaaactcctcatctacgacgcctcatcactcgaatccggagtcccctcccgcttctccggctccggctccggcaccgacttcaccctcaccatctcctcactccaacccgaagacttcgccacctactactgccaacaattcaactcctacccactcacattcggaggcggcaccaaagtcgaaatcaaacgaacagtcgccgcccccagcgtcttcatcttcccaccctccgacgaacaactcaaatccggcaccgcctcagtcgtctgcctcctcaacaacttctacccccgcgaagccaaagtccaatggaaagtcgacaacgccctccaatccggcaactcccaagaatccgtcaccgaacaagactccaaagactccacctactccctctcctcaaccctcaccctctccaaagccgactacgaaaaacacaaagtatacgcctgcgaagtcacccaccaaggcctctcctcccccgtcaccaaatccttcaaccgcggcgaatgc

SEQ ID NO: 54578 - RNA, 1347 nt, synthetic construct
  misc_feature 1..1347: note = derived and/or modified sequence opt11 from Tomuzotuximab_HeavyChain
  source 1..1347: mol_type = other RNA
caggtccaactcaaacaatccggcccaggcctcgtacaaccctcccaaagcctcagcatcacgtgcaccgtctcgggcttctccctaaccaactacggcgtccactgggtccgccaatccccaggaaaaggcctcgaatggctcggagtcatctggtcaggcggcaacaccgattacaacacccccttcacaagccgtctctcaatcaacaaagacaactccaaatcccaagtcttcttcaaaatgaactccctccaatcaaacgacaccgccatctactactgcgcacgtgccctcacctactacgactacgaatttgcttactggggccaaggcacactcgtcacagtctcaaccgcctccaccaaaggcccctcagtcttcccactagccccttcctccaaatctaccagcggcggcaccgccgccttaggctgcctcgtgaaagactatttcccagaacccgtaacggtttcttggaactccggcgcactcacatccggtgtccacaccttccccgccgtccttcaatcatccggcctctactctctttcctcagtcgtcaccgttccctcctcctccctcggcacacaaacctacatctgcaacgtcaaccacaaaccctcgaacaccaaagtcgacaagaaagtagaacctaaatcctgcgacaaaacccatacctgccctccctgccccgcacccgaactcctcggcggcccatccgtattcctattcccacccaaacccaaagacaccctaatgatctcaaggacacccgaagtaacctgtgtagtagttgacgtctcccacgaagaccccgaagttaaattcaactggtacgtagacggcgtcgaagtccacaacgccaaaaccaaaccccgcgaggaacaatacaactcaacctaccgcgttgtctcagtcctaaccgtcctccaccaggactggctaaacggcaaagaatacaaatgcaaagtctccaacaaagcactccctgcacctatcgaaaagacaatctccaaagcaaaaggccaaccccgcgaaccccaggtctacaccctaccaccctcccgcgacgaactcaccaaaaaccaagtctccctcacctgtctcgtcaaaggcttctacccctcagacatcgcagtagaatgggaatcaaacggccagcccgaaaacaactataaaactaccccgcccgtcctcgacagcgacggctccttcttcctttactccaaactaaccgtagacaaatcccgctggcaacaaggcaacgttttctcctgctctgtcatgcacgaaggactccacaaccactacacccaaaaatcactatcactctcccccggcaaa

SEQ ID NO: 54579 - RNA, 642 nt, synthetic construct
  misc_feature 1..642: note = derived and/or modified sequence opt11 from Tomuzotuximab_LightChain
  source 1..642: mol_type = other RNA
gacatcctcctcacccaaagccccgtcatcctctccgtctcccccggcgaacgcgtatccttctcctgcagagcctcccaatcaatcggcaccaacatccactggtaccaacaaagaaccaacggctcaccccgcctcctcatcaaatacgcctccgaatccatctccggcatccccagccgattctccggctccggctccggcaccgacttcaccctctccatcaactccgtcgaaagcgaagacatcgccgactactactgccaacaaaacaacaattggccaaccacattcggcgccggaaccaaactcgaactcaaacgcaccgtcgccgccccatccgtcttcatcttcccaccctccgacgaacaactaaaatccggcaccgcctcagtcgtctgcctcctcaacaacttctacccccgcgaagccaaagtacaatggaaagtcgacaacgccctccaatccggcaactctcaagaatccgtcaccgaacaagactccaaagactccacctactcactaagctccaccctaaccctctccaaagccgactacgaaaaacacaaagtctacgcctgcgaagtcacccaccaaggcctctcctctcccgtcacaaaatccttcaaccgaggcgaatgc

SEQ ID NO: 54580 - RNA, 1347 nt, synthetic construct
  misc_feature 1..1347: note = derived and/or modified sequence opt11 from Trastuzumab_duocarmazine_HeavyChain
  source 1..1347: mol_type = other RNA
gaagtccaactggtcgaatccggcggcggcctcgtacaaccagggggatccctgagactatcatgcgccgcatccggcttcaacatcaaagacacatacatccactgggtccgtcaagcccccggcaaaggactcgaatgggtcgccagaatataccccaccaatggctatacccgctacgcagacagcgtcaaaggccgcttcactatctccgccgacacctccaaaaacacagcctacctccagatgaactcattacgcgccgaagacaccgccgtctactactgctcccgctggggcggtgacggcttctacgccatggactactggggccagggtaccctagtaaccgtaagctccgcctccactaaaggcccatccgtattccccctcgccccctcatccaagtccaccagcggcggcaccgcagccctaggctgcctcgtcaaagactacttccccgaaccagtcaccgtgtcttggaactcgggcgcccttaccagcggcgtccacacattccccgcagtcctccaatcttccggactctactcactatcctctgtagtcaccgttccctcatcctcactcgggacacaaacatacatctgcaacgtcaaccacaaaccaagcaacacaaaagtcgacaagaaagtcgaaccaaaatcctgcgacaaaactcatacatgtccaccctgccccgcacccgaactccttggcggcccctccgtattcctcttcccacccaaaccaaaagacaccctcatgatctccagaacacccgaagtgacatgcgtcgtcgtcgacgtctcacacgaagaccccgaagtcaaattcaactggtacgtcgacggcgtcgaggtacacaacgcaaaaactaaaccccgcgaagaacagtacaactccacctaccgagtcgtatccgtcctaaccgtcctccaccaagactggctcaacggaaaagaatacaaatgcaaagtaagcaataaagccctccccgccccaatagagaaaacaatatcaaaagcaaaaggccaaccccgggaaccccaagtctacaccctcccacccagccgagaagaaatgaccaaaaaccaagtctccttaacctgcctcgtcaaaggcttctacccatccgacatcgccgtcgaatgggaatccaacggccaacccgaaaataactacaaaaccaccccacccgtgctcgacagtgacggctcattcttcctttactccaaactaaccgtcgacaaatccagatggcaacaaggtaacgtattctcctgctctgtcatgcacgaagccctacacaaccactacacacaaaaatccctctccctcagtcccggc

SEQ ID NO: 54581 - RNA, 642 nt, synthetic construct
  misc_feature 1..642: note = derived and/or modified sequence opt11 from Trastuzumab_duocarmazine_LightChain
  source 1..642: mol_type = other RNA
gacatccaaatgacccaatccccctcctccctaagcgcatccgtcggcgaccgcgtcaccataacatgccgcgcctcccaagacgtcaacaccgccgtcgcctggtaccaacaaaaaccaggcaaagcccccaaactcctcatctactccgcatccttcctctacagcggcgtaccctcacgattctccggctcccgttcaggcaccgacttcaccctcaccatatcctcactccaacccgaagacttcgccacctactactgccaacaacactacaccaccccccccaccttcggacaaggcaccaaagtcgaaatcaaacgcaccgtcgcagccccctccgtcttcatcttccccccctcagacgaacaactcaaatccggcacagcctccgtcgtatgccttctcaacaacttctacccccgagaagccaaagtccaatggaaagtagacaacgccctccaatcaggcaactcccaagaatccgtcaccgaacaagactccaaagactccacctacagcctcagctccaccttaaccctctccaaagccgactacgaaaaacacaaagtctacgcctgcgaagtcacacaccaaggcctctcctcacccgtcacaaaatccttcaaccgcggcgaatgc

SEQ ID NO: 54582 - RNA, 1368 nt, synthetic construct
  misc_feature 1..1368: note = derived and/or modified sequence opt11 from Varisacumab_HeavyChain
  source 1..1368: mol_type = other RNA
caagtccaactcgtccaatccggcgccgaagtcaagaaaccaggcgcctccgtcaaagtctcatgcaaagcctccggaggcacattctcttcctacgccatctcctgggtccgccaagcccccggccagggcctcgaatggatgggtggcttcgaccccgaagacggcgaaacgatatacgcgcaaaaattccaaggccgcgtcaccatgaccgaagatacgtcaacagacaccgcctacatggaactatcctccctacgctccgaagacaccgcagtctactactgcgcaaccggccggagcatggtcagaggcgtcatcatccccttcaacggaatggacgtatggggccaaggcacaacagtaacagtctcctccgccagcacaaaaggaccatcagtattccccctagcaccctcctccaaatcaacctccggcggaaccgccgcactcggctgcctcgtaaaagactacttccccgaaccagtcaccgtatcatggaactcaggagcactcacctccggggtacacaccttccccgcagtcctccaatccagcggcctttactcactctccagcgtcgtaaccgtcccaagctccagcctcggcacacagacctacatctgcaacgtcaaccacaaaccctccaacaccaaagtagacaagaaagtcgaacccaaatcctgcgacaaaacacacacctgtcccccatgcccagcacccgaactactgggaggcccctcagtcttcctcttcccacccaaacccaaagacaccctcatgatctctcgcacccccgaagtgacctgcgtcgtcgtagacgtctcccacgaggaccctgaagtcaaattcaactggtacgtagacggcgtcgaagtccacaacgccaaaaccaaaccacgcgaagaacaatacaactcaacctaccgcgtagtatccgtactaaccgtcttacaccaagactggctcaacggcaaagaatacaagtgcaaagtctccaacaaagcccttcctgcccccatagagaaaacaatctcaaaagcaaaaggccagccccgcgaaccccaagtttacaccctaccgccctctcgagacgaactaaccaaaaaccaagtgtccctcacatgcctagtcaagggtttctacccctccgacatagccgtcgaatgggaatcaaacggacaacccgaaaataactacaaaacaacaccacccgtcctcgactcagacggctccttcttcctctattccaaactaaccgtagacaaatccagatggcaacaaggcaacgtcttctcctgttcagtcatgcacgaagcactccacaaccactatacccaaaagtcactctcactctcacccggcaaa

SEQ ID NO: 54583 - RNA, 642 nt, synthetic construct
  misc_feature 1..642: note = derived and/or modified sequence opt11 from Varisacumab_LightChain
  source 1..642: mol_type = other RNA
gacatccgaatgacccaatccccctcatccctctccgcctccgtcggcgaccgcgtcaccataacctgccgcgcctcacaatccatctcctcatacctcaactggtaccaacaaaaacccggcaaagcccccaaactcctcatctacgccgcctcctcactccaatcaggcgtaccctctcgcttctccggctccggctccggcaccgacttcaccctcaccatctcctccctccaacccgaagacttcgccacctactactgccaacaatcctactccacacccctcaccttcggtggcggaaccaaagtagaaatcaaacgcaccgtcgccgccccctcagtcttcatattcccaccctccgacgaacaactcaaatccggaaccgcctccgtcgtctgcctcctcaacaacttctacccccgcgaagccaaagtccaatggaaagtcgacaacgccctccaatccggaaactcccaagaatccgtcaccgaacaagactccaaagactccacctactccctatcctccaccctcaccctctcaaaagccgactacgaaaaacacaaagtatacgcctgcgaagtcacccaccaaggcctctcctcccccgtcaccaaatccttcaaccgaggcgaatgc

SEQ ID NO: 54584 - RNA, 1359 nt, synthetic construct
  misc_feature 1..1359: note = derived and/or modified sequence opt11 from Vunakizumab_HeavyChain
  source 1..1359: mol_type = other RNA
gaagtccagctagtccaatccggcgccgaagtcaagaaacccggcgcaagcgtcaaagtctcctgcaaagcctccggctacaccttcaccgactacgaagtccactgggtccgccaagcccccggacaaggactagaatggatgggagtcatcgaccccggaacaggtggcgtcgcatacaaccaaaaattcgaaggaagagtcacaatgactgccgacacctcgacctctaccgcctacatggagctacgctcactccgctccgacgacactgccgtctactactgcacccgctactccctcttctacggctcctccccttacgccatggactactggggccaaggcacattagttaccgtcagctccgcctccaccaaaggcccctccgtattccccctagcaccctccagcaaatccaccagcggaggcacagcagctctcggatgcctagtcaaagactacttcccagaacctgtcaccgtctcatggaactcaggcgccctcacctcaggcgtccacacgttccccgccgtactccaatcatcaggactctactccctctcctcagtagtcaccgtccccagctcaagcctcggcacccaaacctacatctgcaacgtaaaccacaaaccatccaacaccaaagtcgacaagaaagtagaacccaaatcctgcgataaaacccatacctgcccaccatgccccgctcccgaactactcggcggaccatcagtcttcctattcccacccaaacccaaagacaccctcatgataagcagaacccccgaagtgacctgcgtcgtagtcgacgtcagccacgaagaccccgaagtaaaattcaactggtacgtagacggcgtagaagtccacaacgcaaaaaccaaaccccgcgaggaacaatacaacagcacctaccgcgtagtatccgtactcacagtccttcaccaagactggctcaacggcaaggagtacaaatgcaaagtcagcaacaaagcactccccgcacccatagagaaaaccataagcaaagcgaaaggacaaccacgcgaaccccaagtctacaccctcccaccctcccgcgaagaaatgactaaaaaccaagtatcactgacctgcttggtcaaaggcttctacccatcagacatcgcagtcgaatgggaatccaacggacaacccgaaaacaactacaaaacaacacccccagtcctcgactccgatggctccttcttcctctactccaaactaaccgtcgacaaatcacgctggcaacaaggcaacgtcttctcctgctcagtgatgcacgaagccctacacaaccactacacccaaaagtccctctccctcagccctggcaaa

SEQ ID NO: 54585 - RNA, 639 nt, synthetic construct
  misc_feature 1..639: note = derived and/or modified sequence opt11 from Vunakizumab_LightChain
  source 1..639: mol_type = other RNA
gaaatcgtcctcacccaatcacccgacttccaatccgtcacccccaaagaaaaagtcaccatcacatgctcagcctcctcctcagtcaactacatgcactggttccaacaaaaacccgaccaatcccccaaactctggatctaccgcacctccaacctcgcctccggcgtaccctcccgcttctccggctccggctcaggcaccgactacaccctaaccatcaactccctcgaagccgaagacgccgccacctactactgccaacaacgctcctcatacccttggaccttcggccaaggcaccaaactcgaaatcaaacgcaccgtcgccgccccctccgtcttcatcttcccaccctccgacgaacaactcaaatccggcaccgcctccgtcgtctgcctactcaacaacttctacccccgcgaagccaaagtacaatggaaagtcgacaacgccctccaatccggcaactcccaagaatcagtcaccgaacaagactccaaagactccacctactccctctcctccaccctcaccctatccaaagcagactacgaaaaacacaaagtatacgcctgcgaagtcacacaccaaggcctctcctcacccgtcaccaaatccttcaaccgcggcgaatgc

SEQ ID NO: 54586 - RNA, 1341 nt, synthetic construct
  misc_feature 1..1341: note = derived and/or modified sequence opt11 from Xentuzumab_HeavyChain
  source 1..1341: mol_type = other RNA
caggtagaactcgtcgaatccggcggcggcctagttcaacccggaggatcactcaggctaagctgcgcagcatccggatttaccttcacctcctactggatgtcctgggtccgccaagcccccggcaaaggactcgaactcgtctcctccataaccagttacggctccttcacctactacgcagattccgtcaaaggccgattcaccatctcccgcgacaactctaaaaacaccctctacctccaaatgaactcactccgcgcggaagacaccgccgtatactattgcgcacgcaacatgtacacccacttcgattcctggggacaaggtaccctcgtcacagtctcctcggcctcaaccaaaggccccagcgtattccccctcgcaccctcctccaaatccacctcaggtggcaccgccgcactcggatgcctggtcaaagactacttccccgaacccgtcaccgtctcctggaactctggcgccctaacttccggagtccataccttccccgctgtcctacaatcatccggactctactccctctcttcagtcgtaaccgtcccctcctcctcactcggcactcaaacatacatctgcaacgtcaaccacaaaccatccaacacaaaagttgacaagaaagtcgaacccaaatcctgcgacaaaacccatacctgcccaccctgccccgcccccgaactccttggcggaccatccgtcttcctcttccctcccaaacccaaagacaccctaatgatctcacgcacccccgaagtaacctgcgtcgtcgtcgacgtttcccacgaagaccccgaagtaaaattcaactggtacgtcgacggcgttgaagtacacaacgcaaaaactaaaccccgcgaggaacaatacaactccacctatcgcgtcgtatccgtcctcaccgtcctccaccaagactggctcaacggcaaagaatacaaatgcaaagtctccaataaagcactccccgctcccatagagaaaaccatatccaaagccaaaggacaaccccgcgaaccacaagtatacacactccctccctcccgagacgaactaaccaaaaaccaagtctcactaacatgcctcgtcaaaggcttctacccctctgacatcgccgtggaatgggaatcaaacggccagcccgaaaacaactacaaaaccacaccacccgtcctagactccgacggcagctttttcctatattccaaactcaccgtagacaaatcccgatggcaacaaggcaacgtcttctcctgctccgttatgcacgaagccctccacaaccactacacccaaaaatcactctccctctcccccggcaaa

SEQ ID NO: 54587 - RNA, 648 nt, synthetic construct
  misc_feature 1..648: note = derived and/or modified sequence opt11 from Xentuzumab_LightChain
  source 1..648: mol_type = other RNA
gacatcgtactcacccaacccccctccgtctcaggcgcccccggccaacgcgtcacaatctcctgctccggctcctcctcaaacatcggctccaactccgtctcctggtaccaacaactcccaggaaccgcacccaaactactcatctacgacaactccaaacgcccctccggcgtccccgaccgcttctctggctccaaatccggcacctctgcctccctcgccatcaccggcctccaatccgaagacgaagccgactactactgccaatcccgcgacacctacggctactactgggtcttcggcggcggcaccaaactcaccgtactcggccaaccaaaagccgcaccctccgtcaccctcttccccccctcctccgaagaactccaagccaacaaagccaccctcgtctgcctcatctccgacttctaccccggcgccgtcaccgtcgcctggaaaggagactcatcccccgtaaaagcaggcgtcgaaaccaccacaccctcaaaacaatcaaacaacaaatacgcagcctcctcctacctctcactcacacccgaacaatggaaatcccaccgctcctactcatgccaagtcacccacgaaggctcaaccgtcgaaaaaaccgtcgcccccaccgaatgctcc

SEQ ID NO: 54588 - RNA, 726 nt, synthetic construct
  misc_feature 1..726: note = derived and/or modified sequence opt11 from anti-rabies_SO57_LightChain
  source 1..726: mol_type = other RNA
atgtccgtccccaccatggcctgggcactcctactactctccctcctcacacaaggcaccggctcctgggcccaatcagccctcacacaaccccgctccgtctccggctcccccggccaatccgtcaccatctcctgcaccggaacctcctccgacatcggaggctacaatttcgtctcttggtaccaacaacaccccggcaaagcccccaaactcatgatctacgacgccacaaaacgcccctctggcgtacccgaccgcttctccggctccaaatccggcaacaccgcctccctaaccatctccggactccaagccgaagacgaagccgactactactgctgctcctacgccggcgactacacccccggtgtcgtcttcggcggcggcaccaaactaaccgtcctcggacaacccaaagccgccccttcagtaaccctcttccccccttcatccgaagaactacaagccaacaaagccacactagtctgcctaatctccgatttctaccccggagccgtcaccgtagcctggaaagccgactcctcacccgtcaaagccggcgtagaaaccaccaccccctccaaacaatccaacaacaaatacgccgcctcctcctacctctccctcaccccagaacaatggaaatcccacagatcctactcctgccaagtcacccacgaaggctccaccgtcgaaaaaacagtcgcccccacagaatgctcc

SEQ ID NO: 54589 - RNA, 1428 nt, synthetic construct
  misc_feature 1..1428: note = derived and/or modified sequence opt11 from anti-rabies_SO57_HeavyChain
  source 1..1428: mol_type = other RNA
atggactggacctggcgcttcctcttcgtggtcgccgctgccaccggagtccaatcacaagtccaactcgtccaatctggagccgaagttaagaaacccggatcctccgtaaaagtctcctgcaaagcctccggcggtaccttcaaccgctacaccgtcaactgggtccggcaagcccccggccaaggtctcgaatggatgggaggcatcatacccatcttcggcaccgccaactacgcccaacgcttccaaggacgtctaaccataacagctgacgagtctaccagcaccgcttacatggaactctcctcactcagatccgacgacaccgccgtttacttctgcgcacgcgaaaaccttgacaactcaggaacctattactacttctcgggctggttcgacccctggggacaagggaccctagtcacagtctcctccgcctctacaaaaggcccctcggtattccccctcgcaccctcctcgaaatcaaccagcggaggaacagcagcactgggctgcctcgtcaaagactacttccccgaacccgtaaccgtctcctggaactccggagcccttacctccggcgtccacacattccccgccgtcctccaaagcagcggactatacagcctctcatccgtcgtaaccgtcccatcttcgtcactcggcacccaaacatacatctgtaacgtaaaccacaaaccaagcaacaccaaagtcgacaaacgagtcgaaccaaaatcctgtgacaaaacacacacatgcccaccttgccccgccccagaactcctcggcggcccgtccgtcttcctcttcccacccaaacccaaggacaccctgatgatatcacgcacacccgaagtaacctgcgtcgtagtcgatgtctcccacgaagaccccgaagtcaaattcaactggtacgttgacggcgtagaagtccacaacgccaagaccaaaccccgcgaagaacaatacaactccacataccgagtcgtctccgtactaaccgtcctacaccaggactggctcaacggcaaagagtacaaatgcaaagtctccaacaaagcactccccgcacccatcgagaaaaccatctccaaagcaaaaggacaaccccgagaaccacaggtatacaccctcccaccctcacgtgaagaaatgacgaaaaaccaagtctcactcacatgcctcgtaaaaggtttctacccaagcgacatcgccgtcgaatgggaatcaaacggccaacccgaaaacaactacaaaaccacacctcccgtcctagactccgacggcagcttcttcctgtacagcaaactcaccgttgacaaatctagatggcaacaaggcaacgtcttctcctgctctgtcatgcacgaagccctccacaaccactacacccagaaaagcctctcactctcccccggaaaa

SEQ ID NO: 54590 - RNA, 696 nt, synthetic construct
  misc_feature 1..696: note = derived and/or modified sequence opt11 from anti-rabies_SOJB_LightChain
  source 1..696: mol_type = other RNA
atggcctggacagtactcctcctcggcctcctctcccactgcaccggctccgtcacatcctacgtcctcacccaacccccctcagtctccgtagcccccggcaaaacagcccgaataaactgcggcggcaacaacatcgaataccgctccgtccactggtaccaacaaaaatccggccaagcccccgtcgccgtcatctacgacaactccgaccgcccctccggcatacccgaacgcttctccggatccaaatccggcaacaccgccaccctcacaatctcccgagtagaagccggcgacgaagccgactactactgtcaagtctgggacatctcctccgacgtcgtcttcggcggcggcaccaaactcaccgtcctaggccaacccaaagcagccccctccgtcacactcttccccccatcatccgaagaactccaagccaacaaagccacactcgtatgcctaatcagcgacttctaccccggagccgtcaccgtcgcctggaaagccgactcctcccccgtcaaagcaggcgtcgaaaccactaccccctccaaacaatccaacaacaaatacgcagcctcttcctacctctccctcacccccgaacaatggaaatcccaccgatcctactcctgccaagtcacccacgaaggctccaccgtcgaaaaaacagtcgcccccaccgaatgctcc

SEQ ID NO: 54591 - RNA, 1554 nt, synthetic construct
  misc_feature 1..1554: note = derived and/or modified sequence opt11 from anti-rabies_SOJB_HeavyChain
  source 1..1554: mol_type = other RNA
atggataccctgtgttctaccctgctcctcctaacaatcccatcttgggtattatcacaaatcaccctcaaagaaaccggcccaacactcgtcaaacccactcaaaccctcaccctaacctgcacattctccggattctcactctccacctcaggcgtcggcgtcggctggatccgccaaccacccggcaaagcactcgaatgggtcacactcatatactgggacgacgataaacgctactccccctcactagaaaaccgtgtaacaatccgcaaagacacctcaaagaatcaagtcgcactcaccatgaccaacatggaccccctagacaccggtacctactactgcgcccaccgccaacacatctccagcttcccctggttcgactcatggggccaaggtactctagtcaccgtctcatccgcctccacaaaaggcccctcagtcttccccctcgccccctgctcacgctccacctcaggaggcactgcagcacttggctgccttgtcaaagactatttccccgaacccgtcactgtctcatggaactccggcgccctcacctcaggcgtccacacattcccagccgtcctccaatcttcgggcctctactccctctccagcgtcgtaacagtcccatcctcatctctcggcacacaaacctacacgtgcaatgtaaaccacaaaccctcaaacaccaaagtcgacaagcgcgtcgaactcaaaactccccttggcgacaccacccacacttgcccccgctgccccgaacccaaatcctgcgacactcccccaccctgcccccggtgccctgagcctaaatcctgcgacaccccaccaccctgcccacgctgtccagaacccaaatcctgcgacaccccaccaccctgcccccgttgccccgcccccgaactccttggaggcccctccgtgttcctattcccacccaaaccaaaagacaccctaatgatctcacgcacccccgaagtcacctgtgtcgtagttgacgtctcccacgaagacccagaagtccaattcaaatggtacgtcgacggcgtcgaagtccacaatgcaaaaacaaagccccgtgaagaacaatttaactccacctttcgtgtagtttccgtcctcacagtgctccaccaagactggcttaacggcaaagaatataaatgcaaagtctccaacaaagccctcccagcccccattgagaaaacaatctccaaaaccaaaggccaaccccgagaaccccaagtatacaccctcccaccctcccgcgaagaaatgaccaaaaatcaagtctccctaacctgcctcgtcaaaggattctatccctccgatatcgccgtcgaatgggaatcctccggccaaccagaaaacaactacaacaccactccccctatgctcgactcagacggctccttcttcctctactctaaactcaccgtcgacaaatcccgctggcaacagggcaacatattctcctgctccgtaatgcacgaagccctccacaaccgcttcacccaaaaatccctctcactatcccccggcaaa

SEQ ID NO: 54592 - RNA, 702 nt, synthetic construct
  misc_feature 1..702: note = derived and/or modified sequence opt11 from anti-rabies_SOJA_LightChain
  source 1..702: mol_type = other RNA
atggaagcccccgcccaactcctcttcctactcctcctctggttacccgacaccaccggcgaaatcgtcctcactcaatcacccgccaccctctctctatcccccggagaacgcgccaccctagcttgccgcgcctcccaaaccgcttcccgctacctagcctggtaccaacaaaaacccggccaagccccacgcctcctcatctacgacacatccaaccgcgccaccggcatccccgccagattctcaggctcaggctccggcaccgacttcaccctctccatctcctccctcgaacccgaagacttcgccgtctactactgccaacaacgcttcaactggccatggaccttcggtcaaggcaccaaagtcgaatttaaacgcaccgtcgccgccccctccgtcttcatcttcccaccctcagacgaacaactcaaatccggcaccgcctcagtcgtctgcctcctaaacaacttctacccccgcgaagccaaagtccaatggaaagtagacaacgccctccaatccggcaactcccaagaatccgtcaccgaacaagactccaaagactccacctactccctttcctccaccctcaccctctctaaagccgactacgaaaaacacaaagtatacgcatgcgaagtcacccaccaaggcctctcctcccccgtcacaaaatccttcaaccgcggcgaatgc

SEQ ID NO: 54593 - RNA, 1422 nt, synthetic construct
  misc_feature 1..1422: note = derived and/or modified sequence opt11 from anti-rabies_SOJA_HeavyChain
  source 1..1422: mol_type = other RNA
atggaatttggcctctcctggctattcctcgtagcaatcctcaaaggcgtccagtgcgaagtccagctgctcgaaagcggcggaggcctagttcagcccggaggaagcctccgactctcatgcgccgcatctggtttcacattctccaactacgcaatgtcgtgggtccgccaagcccccggaaaaggacttgaatgggtatccgccatctccgcctcaggccactcgacctaccttgcagactccgtcaaaggccgattcacaatctcacgagacaactccaaaaatacactctacctacaaatgaactccctccgggccgaagacacagcagtctactactgcgcaaaagaccgagaagtcaccatgatcgtcgtcctcaacggcggcttcgactactggggacaaggcacacgcgtaaccgtatcctccgcctcaaccaaaggaccctccgtcttccccctcgccccctcatccaaatccacctcaggcggcacagcagccctcggctgcctagtaaaagactacttccccgaaccagtcacagtatcatggaactccggcgcactaaccagcggcgtacacacctttccagccgtcctccaatcaagcggactatactcacttagctccgtcgtaaccgtcccatcctcatccctcggcacccaaacctacatctgcaacgtcaaccacaagccctccaacaccaaagtggacaaacgcgtagaacccaaatcctgcgacaaaacacacacctgtcccccatgccccgccccagaactccttggaggcccctccgtcttcctattcccgcccaaacccaaagacacccttatgatctcacgaaccccagaagtcacatgcgtcgtcgtcgacgtctcccacgaagaccccgaagtaaaattcaactggtacgtcgatggcgtggaagtccacaacgccaaaactaaaccccgcgaagaacaatacaacagcacctaccgagtagtcagcgtcctaaccgtcctacaccaagactggttaaacggcaaggaatacaaatgcaaagtctccaacaaagccctcccagctcccatcgaaaagaccatatcaaaagccaaaggccaaccacgcgaaccccaggtctacaccctgccaccatccagagaagaaatgaccaaaaaccaagtctccctcacatgcctcgtcaaaggcttctaccccagcgacatcgcagtggaatgggaatccaacggccaacccgaaaacaactacaaaacaacacctcccgtactcgacagcgacggatcattcttcctctactctaaactcaccgtagacaaatcccgatggcaacaaggcaacgtcttctcctgctccgtcatgcacgaagccctccacaaccactacacccaaaaatccctgtccctgtcccccggcaaa

SEQ ID NO: 54594 - RNA, 321 nt, synthetic construct
  misc_feature 1..321: note = derived and/or modified sequence opt11 from anti-rabies_LightChain
  source 1..321: mol_type = other RNA
gtcatgacccaatcccccgccaccctctccctctcccccggcgaacgcgccaccctctcctgccgcgcctcccaatccgtccgcaactacctcgcctggtaccaacaaaaacccggccaagccccccgcctcctcatctacggcgcctccaaccgcgccaccggcatccccgcccgcttctccggctccggctccggcaccgacttcaccctcaccatctcctccctcgaacccgaagacttcgccgtctactactgccaacaacgctccgactggcccctctccttcggccaaggcaccaaactcgaaatcaaacgcacc

SEQ ID NO: 54595 - RNA, 333 nt, synthetic construct
  misc_feature 1..333: note = derived and/or modified sequence opt11 from anti-rabies_HeavyChain
  source 1..333: mol_type = other RNA
gggcccgcgtgggaggtcccggaaacgctcccggtccagcccttggactcgccctcggtcgcgatggcgtgcacgggcgtgcgccaggccccgggcaagggcctggaatgggtcgcggtcataagctatgacgggagcaataaatattacgcggactcggtcaagggcaggttcacgatctcgcgcgataactcgaaaaataccttgtacttgcaaatgaactcgctaagggccgaggacacggccgtgtactattgcgcgaaagatagcaatagcgggagctattacgcgcacgatctcgggtactggggccagggcacgctcgtgaccgtg

SEQ ID NO: 54596 - RNA, 342 nt, synthetic construct
  misc_feature 1..342: note = derived and/or modified sequence opt11 from anti-rabies_LightChain
  source 1..342: mol_type = other RNA
gaactcgtcatgacccaatcccccctctccctccccgtcacactcggccaacccgcctccatctcctgccgctcctcccaatccctcatccactccaacggcaacacctacctcaactggttccaacaacgccccggccaatccccccgccgcctcatctacaaagtctccgaccgcgactccggcgtccccgaccgcttctcaggctccggctccggcaccgacttcaccctcaaaatctcccgcgtcgaagccgaagacgtcggcgtctactactgcctccaaggcacccactggccccgcaccttcggccaaggcaccaaactcgaaatcaaacgcacc

SEQ ID NO: 54597 - RNA, 351 nt, synthetic construct
  misc_feature 1..351: note = derived and/or modified sequence opt11 from anti-rabies_HeavyChain
  source 1..351: mol_type = other RNA
gtcgtccaacccggccgctccctacgcctctcctgcgccgcctccggattcaccttctcctcatacgccatgcactgggtccgccaagcccccggcaaaggcctcgaatgggtcgccgtcatctcctacgacggctccaacaaatactacgccgactccgtcaaaggccgcttcaccatctcccgcgacaactccaaaaacaccctctacctccaaatgaactccctccgcgccgaagacaccgccgtctactactgcgcccgcgacaaagccctcgccgcccgccgcggctactactactactacggcaccgacgtctggggacaaggcaccctcgtcaccgtctcatcc

SEQ ID NO: 54598 - RNA, 648 nt, synthetic construct
  misc_feature 1..648: note = derived and/or modified sequence opt11 from anti-RSV_5ITB_LightChain
  source 1..648: mol_type = other RNA
tccgacatccaaatgacccaatccccctccaccctatccgcatccgtcggcgaccgcgtcaccatcacatgccgcgcctcccaatccatctcctcctggctagcctggtaccaacaaaaacccggaaaagcccccaaactcctcatctacgacgcctcatcactcgaatccggcgttccctcccgcttctcaggctccggctccggcaccgaatttaccctcaccatctccagcctccaacccgacgacttcgccacctactactgccaacaatacaacacctactcatggtggaccttcggccaaggcaccaaagtcgacatcaaacgcaccgtcgccgcaccatccgtcttcatcttcccaccctccgacgaacaactcaaatccggcaccgcctccgtcgtctgcctccttaacaacttctacccccgcgaagccaaagtccaatggaaagtcgacaacgcactccaatccggcaactcccaagaatccgtcaccgaacaagactccaaagactctacctactccctctcctcaaccctcaccctttccaaagccgactacgaaaaacacaaagtatacgcatgcgaagtcactcaccaaggcctatcctcccccgtaaccaaatcctttaaccgcggcgaatgc

SEQ ID NO: 54599 - RNA, 660 nt, synthetic construct
  misc_feature 1..660: note = derived and/or modified sequence opt11 from anti-RSV_5ITB_HeavyChain
  source 1..660: mol_type = other RNA
gtcgaatcaggcggcggcctaatccaacccggcggctccctccgcctctcctgcgccgtctccggcttcaccgtctcctcaaaatacatgacctgggtccgccaagcccccggcaaaggactcgaatgggtctctgtcatctacggcggcggctccacatactacgccgactccgtcgtcggccgcttcaccatctccagagacaactccaaaaacaccctatacctccaaatgaactccctccgcgccgaagacaccgccgtctactactgcgcctcccgcctcggcgtccgcgcaacaaccggcgacctcgactactggggccaaggcaccctagtaaccgtctcctccgcatcaaccaaaggcccctccgtattcccactcgcaccctcctcaaaatccacatccggcggcacagccgccctcggctgcctcgtcaaagactacttccccgaacccgtcaccgtctcctggaactccggcgcactcacctccggcgtccacaccttccccgccgtcctccaatcatccggcctatactcactatccagcgtcgtcacagtcccctcctcctccctcggcacccaaacctacatctgcaacgtcaaccacaaaccatccaacaccaaagtcgacaaacgcgtcgaaccaaaatcctgc

SEQ ID NO: 54600 - RNA, 639 nt, synthetic construct
  misc_feature 1..639: note = derived and/or modified sequence opt11 from anti-alpha-toxin_4U6V_LightChain
  source 1..639: mol_type = other RNA
gacatccaaatgacccaatccccctccaccctctccgcctccgtaggcgaccgcgtcacaatcacatgccgcgcctcccaatccatctcatcctggctagcctggtaccaacaaaaaccaggcaaagcccccaaactcctcatctacaaagcctcctcacttgaatccggcgtcccctcccgcttctccggctccggctccggcaccgaatttaccctcaccatctcttcactccaacccgacgacttcgccacctactactgcaaacaatacgccgactactggaccttcggccaaggcaccaaagtcgaaatcaaacgcaccgtcgccgccccctccgtcttcatcttcccaccctccgacgaacaactcaaatcaggcaccgcatccgtcgtctgcctcctcaacaacttctacccccgcgaagccaaagtccaatggaaagtcgacaacgccctccaatccggcaactcccaagaatccgtcaccgaacaagactccaaagactccacctacagcctatcctccacccttacactatccaaagccgactacgaaaaacacaaagtctacgcctgcgaagtcacccaccaaggcctctcctcacccgtcaccaaatccttcaaccgcggcgaatgc

SEQ ID NO: 54601 - RNA, 675 nt, synthetic construct
  misc_feature 1..675: note = derived and/or modified sequence opt11 from anti-alpha-toxin_4U6V_HeavyChain
  source 1..675: mol_type = other RNA
gaagtacaactcgtcgaaagcggcggcggactcgtacaacccggcggcagcctacgcctaagctgcgcagccagcggattcaccttctcatcccacgacatgcactgggtccgacaagcaaccggcaaaggactcgaatgggtcagcggaatcggcaccgccggcgacacctactacccagactccgtaaaaggccgattcacaatctcacgcgaaaacgccaaaaacagcctctacctacaaatgaactcactcagagcaggagacacagcagtatactactgcgcacgcgaccgctactccccaaccggacactactacggaatggacgtctggggccaaggcacaaccgtaaccgtcagctcagcctcaaccaaaggaccctccgtattcccactcgcaccctcaagcaaatccacaagcggcggcacagccgccctcggatgcctagtcaaggactacttcccagaacccgtaaccgtctcctggaacagcggcgccctaacctccggcgtacacacattccccgccgtcctccaatcatcaggcctatactcactatcgagcgtagtcacagtaccgagctcaagcctaggcacacaaacatacatatgcaacgtcaaccacaagccctccaacacaaaagtcgacaaacgcgtcgaaccaaaatcatgc

SEQ ID NO: 54602 - RNA, 879 nt, synthetic construct
  misc_feature 1..879: note = derived and/or modified sequence opt11 from anti-alpha-toxin_4U6V_Chain-A
  source 1..879: mol_type = other RNA
gcagactccgacatcaacataaaaaccggcaccaccgacatcggctccaacaccaccgtaaaaaccggcgacctagtaacctacgacaaagaaaacggcatgcacaaaaaagtcttctactccttcatcgacgacaaaaaccacaacaaaaaactcctcgtcatccgaaccaaaggcaccatcgccggacaataccgcgtatactccgaagaaggcgccaacaaatcaggcctcgcctggccctcagccttcaaagtccaactccaactcccagacaacgaagtcgcccaaatctccgactactacccaagaaactccatcgacacaaaagaatacatgtccaccctcacctacggcttcaacggcaacgtcacaggcgacgacacaggcaaaatcggcggactcatcggcgccaacgtttccatcggccacaccctcaaatacgtccaacccgacttcaaaaccatcctcgaaagccccaccgacaaaaaagtaggctggaaagtaatcttcaacaacatggtaaaccagaactggggcccctacgacagagactcctggaacccagtatacggcaaccaactcttcatgaaaacccgcaacggcagcatgaaagccgccgacaacttcctggaccccaacaaggcatcaagcctactctcatccggcttctcccccgacttcgccaccgtcatcacaatggaccgcaaagccagcaaacaacaaaccaacatcgacgtcatctacgaacgcgtacgagacgactaccaactccactggacctccacgaactggaagggcacaaacaccaaagacaaatggatcgaccgatcatcagaacgctacaaaatcgactgggaaaaagaggaaatgaccaac

SEQ ID NO: 54603 - RNA, 879 nt, synthetic construct
  misc_feature 1..879: note = derived and/or modified sequence opt11 from anti-alpha-toxin_4U6V_Chain-B
  source 1..879: mol_type = other RNA
gccgactccgacataaacataaaaaccggcaccaccgacatcggctcaaacacaacagtcaagaccggcgacctcgtaacctacgacaaagaaaacggaatgcacaaaaaagtcttctactcattcatcgacgacaaaaaccacaacaaaaaactactcgtcatacgaaccaaaggcacaatcgccggccaataccgcgtctactccgaagaaggcgccaacaaatccggcctcgcctggcccagcgccttcaaagtccaactccaactccccgacaacgaagtcgcccaaatctcagactactacccccgaaacagcatcgacacaaaagagtacatgtccacactcacctacggcttcaacggcaacgtcaccggcgacgacaccggaaaaatcggcggcctcatcggagccaacgtcagcatcggccacaccctcaaatacgtccaacccgacttcaaaaccatcctagaatcccccacagacaaaaaagtcggatggaaagtcatcttcaacaacatggtaaaccaaaactggggcccctacgaccgagactcatggaaccccgtctacggaaaccaactattcatgaaaacccgaaacggatcaatgaaagccgccgacaacttcctcgacccaaacaaagcatccagcctcctatcctccggcttctcccccgacttcgccaccgtcataaccatggaccgtaaagcatccaaacaacaaaccaacatcgacgtcatctacgaacgcgtacgcgacgactaccaactacattggacaagcaccaactggaaaggcaccaacacaaaggacaaatggatcgaccgatcctccgaacgctataaaatcgactgggaaaaagaagaaatgacaaac

SEQ ID NO: 54604 - RNA, 642 nt, synthetic construct
  misc_feature 1..642: note = derived and/or modified sequence opt11 from anti-IsdB_5D1Q_Chain-A
  source 1..642: mol_type = other RNA
gacatccaactcacacaatcaccctcatcagtatccgcctccgtcggcgaccgcatcacaatcacatgccgcgcctcccaagacatctccaactgggtcgcctggtaccaacaaaaacccggcaaagcccccaaactcctcatctacagcgcatcctcactccaatccggcgtcccaagccgcttctccggctccggctcaggcaccgacttcaccctcaccatctcctccctccaacccgaagacttcgccacctactactgccaacaagccaacaccttcccctggaccttcggccaaggaaccaaagtcgaaatcaaacgcaccgtcgcagccccctccgtattcatcttcccaccctcagacgaacaactcaaatccggcaccgcctctgtcgtctgtcttctcaacaacttctacccccgcgaagcaaaagtccaatggaaagtcgacaacgccctccaaagcggcaactcccaagaatccgtcaccgaacaagactccaaagactccacctactccctctcctcaaccctcaccctaagcaaagccgactacgaaaaacacaaagtctacgcctgcgaagtcacccaccaaggcctatcctcccccgtcaccaaatccttcaaccgaggcgaatgc

SEQ ID NO: 54605 - RNA, 783 nt, synthetic construct
  misc_feature 1..783: note = derived and/or modified sequence opt11 from anti-IsdB_5D1Q_Chain-B
  source 1..783: mol_type = other RNA
caagtacaactcgtccaatccggcgccgaagtaaaaaaacccgcctcctccgtcaaagtctcctgccaggcctccggcggctccttctccacacgcacaatctcatggctacgacaagcaccaggccaaggcctcgaatggatgggcggcatatcccccatcttcggagccgccaactacgcccaacgattccaaggccgcgtcacaatcaccgccgacaaatccacctcaaccgcctacatggaactcacctcactcacttccgaagacaccgccgtatactactgcgcccgcgaccgcccacccggcgcccaattcgacacatggggccaaggcaccctcgtcacagtctcctcagcctccaccaaaggcccctccgtcttccccctcgccccatcatcaaaatccacaagcggcggcacagccgccctcggctgcctcgtcaaagactacttccccgaaccagtcaccgtctcctggaactccggcgcactaacatccggcgtccacaccttccccgccgtcctccaaagctcaggcctctactccttatcctcagtcgtcaccgtcccatcatcctccctaggcacccaaacatacatctgcaacgtcaaccacaaaccatccaacacaaaagtagacaaaaaagtcgaaccaaaatcctgcggaggaggctctggccaccaccaccaccaccaccaccaccaccacggaggcgactacaaagaccacgacggagactacaaagaccacgacatcgactacaaagacgacgacgacaaa

SEQ ID NO: 54606 - RNA, 822 nt, synthetic construct
  misc_feature 1..822: note = derived and/or modified sequence opt11 from anti-IsdB_5D1Q_Chain-C
  source 1..822: mol_type = other RNA
gaagtccaactcgtcgaatccggcggtggcctcgtccaaccaggcggctcactaacactctcctgcgccgcctctggcctcatcttctccgactcaaccatgcactgggtccgccaagcctccggccgcggcctagaatgggtcgcccgaatccgctccaaagccaacaactacgcaacctcatccgacaaatccgcaaccgcctacctcgcctccgtcaaaggccgcttcaccatctcacgcgacgactccaaagacaccaccttccttgaaatgtcctccctcaaaatcgaagacaccgccgtctactactgcatcgcctcatccaccaccggctggtacgtacgcgaagacttcgattactggggccacggaacactcgtaaccgtatcctccgcatcaaccaaaggaccatccgtcttccccctcgccccctcctcaaaatccacctccggaggcaccgcagccctcggatgccttgttaaagactacttccccgaacccgtcaccgtctcctggaactccggagcactaacctccggcgtccacaccttccccgcagtactccaatcctccggcctctactccctgtcctccgtagtcacagtcccctcctcatccctcggaacacaaacctacatctgcaacgtaaaccacaaaccctccaacacaaaagtcgacaaaaaagtcgaacccaaatcatgcggaggcggctccggccaccaccaccaccaccaccaccaccaccacggaggcgactacaaagaccacgacggtgactacaaagaccacgacatcgactacaaagacgacgacgacaaa

SEQ ID NO: 54607 - RNA, 648 nt, synthetic construct
  misc_feature 1..648: note = derived and/or modified sequence opt11 from anti-IsdB_5D1Q_Chain-D
  source 1..648: mol_type = other RNA
gaaatcgtcctaacccaatcccccggcaccctctccctctctcccggcgaacgcgccaccctatcctgccgcgcctcccaatcagtctcctcctcctacctcgcctggtaccaacagaaacctggccaagcaccccgcctcctcatctacggcgcctcatcccgcgccacaggcatccccgaccgattctccggctccggctccggcaccgacttcaccctctcaatctcccgcctagaacccgaagacttcgccgtctattactgcctacactacggcacctccccaatgtacaccttcggacaaggaacaaaactagaaatcaaacgaaccgtcgccgccccatccgtcttcatcttcccaccctccgacgaacaactcaaatcaggcaccgccagcgtcgtctgcctactcaacaacttctacccccgcgaagccaaagtccaatggaaagtcgacaacgccctccaatccggcaactcccaagaatccgtcaccgaacaagactccaaagactccacctactccctatcttcaaccctcaccctctcaaaagccgactacgaaaaacacaaagtctacgcctgcgaagtcactcaccaaggcctttcctcccccgtcaccaaatccttcaaccgcggcgaatgc

SEQ ID NO: 54608 - RNA, 360 nt, synthetic construct
  misc_feature 1..360: note = derived and/or modified sequence opt11 from anti-IsdB_5D1Q_Chain-E
  source 1..360: mol_type = other RNA
cccggcaaaatgaccgacctccaagacaccaaatacgtcgtctacgaatccgtcgaaaacaacgaatccatgatggacaccttcgtcaaacaccccatcaaaaccggcatgctcaacggcaaaaaatacatggtcatggaaaccacaaacgacgactactggaaagacttcatggtcgaaggccaacgcgtccgcaccatctccaaagacgccaaaaacaacacccgcaccatcatcttcccctacgtcgaaggcaaaaccctctacgacgccatcgtcaaagtccacgtcaaaaccatcgactacgacggccaataccacgtccgcatcgtcgacaaagaagccttcaccaaagccaac

SEQ ID NO: 54609 - RNA, 657 nt, synthetic construct
  misc_feature 1..657: note = derived and/or modified sequence opt11 from anti-IsdB_5D1X_Chain-A
  source 1..657: mol_type = other RNA
gacatcgtcatgacccaatcgcccctctccctccccgtcaccctcggccaacccgcctccatctcctgctcctccgcccaatccctcgtacactcagacggcgactcataccttacttggttccaccaacgacccggtcaatcaccccgtcgcctaatctacaaagtctccatacgcgacgccggcgtccccgacagattctccggctccggatccggcaccgacttcaccctcaaaatctcccgcgtagaagccgaagacgtcggcgtctactactgtatgcaagccacccactggccatacaccttcggccaaggcaccaaactcgaaatcaaacgcaccgtcgcagcccccagcgtcttcatattcccaccctccgacgaacaactcaaatctggcaccgcctcagtcgtctgcctcctaaacaacttctacccccgcgaagcaaaagtccagtggaaagtcgacaacgccctccaatccggcaactcccaagaatccgtcaccgaacaagactccaaagactccacctactccctctcctcaaccctcaccctatccaaagccgactacgaaaaacacaaagtctacgcctgcgaagtcacccaccaaggcctctcatctcccgtaaccaaatcctttaaccgcggcgaatgc

SEQ ID NO: 54610 - RNA, 777 nt, synthetic construct
  misc_feature 1..777: note = derived and/or modified sequence opt11 from anti-IsdB_5D1X_Chain-B
  source 1..777: mol_type = other RNA
caagtccaactcgtccaatccggctccgaagtcaaaaaacccggctcatccgtcacactctcctgcaaagcatccggtgacaccttcaacacccacacctactcatgggtccgccaagccccaggccaacgcctcgaatggatcggtggcatcatgccaatcttcgccgcctccaaatcagccccacacctccaagacagactcaccatcaccgccaacaaagccacacgaaccgcatacatggaactcacctccctcacctccgacgactccggcgtctactactgcgcacgcgacggccgaggcgctctccagtactggggacaaggaacactagtcaccgtctcctccgcctccaccaaaggcccaagcgtcttcccactcgccccctcctccaaatccacatcaggaggcaccgccgccctaggatgcctagtcaaagactacttccccgaaccagtcaccgtctcttggaactccggcgccctaacctccggcgtccacacattccccgccgtcctacaatcatctggcctatactccctctcctcagtcgtcacagtcccttcatcctccctgggcacccaaacctacatctgcaacgtcaaccacaaaccctcaaacaccaaagtcgacaaaaaagtcgaacccaaatcctgcggcggcggctccggccaccaccaccaccaccaccaccaccaccacggcggagactataaagaccacgacggagactacaaggaccacgacatcgactacaaagacgacgacgacaaa

SEQ ID NO: 54611 - RNA, 822 nt, synthetic construct
  misc_feature 1..822: note = derived and/or modified sequence opt11 from anti-IsdB_5D1X_Chain-C
  source 1..822: mol_type = other RNA
gaagtccaactcgtcgaatccggcggcggcctcgtccaacccggcggctccctcactctctcctgcgccgcatccggcctcatcttctctgactcaaccatgcactgggtccgacaagcctccggccgcggcctagaatgggtcgcccgcatccgctccaaagcaaacaactacgccacctcctcagacaaatcagccaccgcatacctcgcctctgtaaaaggacgcttcaccatctcccgcgacgactcaaaagacaccaccttcctcgaaatgtcctccctcaaaatcgaagacaccgctgtctactactgcatcgcctcatccaccaccggatggtacgtccgcgaagacttcgactactggggccacggcaccctcgtcacagtatcatccgcctccacaaaaggcccctcagtattccccctcgccccctcctcaaaatcaacctccggcggcaccgccgccctcggatgcctcgtcaaagactacttcccagaacccgttaccgtctcctggaactcaggagcactcacctcaggcgtacacaccttccccgccgtcctacaatcctccggcctctactcactatcctccgtcgtaaccgtcccctcaagctccctcggcacccaaacatacatctgcaacgtaaaccacaaaccctccaataccaaagtcgacaagaaagtcgaacccaaatcctgcggcggcggctccggccaccaccaccaccaccaccaccaccaccacggcggcgattacaaagaccacgacggcgactacaaagaccacgacatagactacaaagacgacgacgacaaa

SEQ ID NO: 54612 - RNA, 648 nt, synthetic construct
  misc_feature 1..648: note = derived and/or modified sequence opt11 from anti-IsdB_5D1X_Chain-D
  source 1..648: mol_type = other RNA
gaaatcgtcctcacccaaacccccgccacactctccctaacacccggcgaacgcgccaccctcacctgccgcgcctcccaatctgtctcctcctcctacctcgcctggtaccaacaaaaacccggccaagccccccgcctcctcatctacggagcctcatcccgcgccaccggcatccccgaccgcttctccggctccggctccggaaccgacttcaccctctcaatctcacgcctcgaacccgaagacttcgccgtctactactgcctccattacggaacatccccaatgtacttcttcggccgcggcaccgtcctcgacatcaaacgaacagtcgccgccccctccgtcttcatcttccccccctcagacgaacaactcaaatccggcaccgcctccgtcgtctgcctcctcaacaacttctacccccgcgaagccaaagtccaatggaaagtcgacaacgccctccaatccggcaactcacaagaaagcgtcaccgaacaagactcaaaagactccacatactccctctcctccaccctcaccctctccaaagccgactacgaaaaacacaaagtctacgcctgcgaagtcacccaccaaggcctctcttcacccgtcaccaaatcattcaaccgaggcgaatgc

SEQ ID NO: 54613 - RNA, 354 nt, synthetic construct
  misc_feature 1..354: note = derived and/or modified sequence opt11 from anti-IsdB_5D1X_Chain-E
  source 1..354: mol_type = other RNA
aaaatgaccgacctccaagacaccaaatacgtcgtctacgaatccgtcgaaaacaacgaatccatgatggacaccttcgtcaaacaccccatcaaaaccggcatgctcaacggcaaaaaatacatggtcatggaaaccaccaacgacgactactggaaagacttcatggtcgaaggccaacgcgtccgcaccatctccaaagacgccaaaaacaacacccgcaccatcatcttcccctacgtcgaaggcaaaaccctctacgacgccatcgtcaaagtccacgtcaaaaccatcgactacgacggccaataccacgtccgcatcgtcgacaaagaagccttcaccaaagccaac

SEQ ID NO: 54614 - RNA, 792 nt, synthetic construct
  misc_feature 1..792: note = derived and/or modified sequence opt11 from anti-IsdB_5D1Z_Chain-B
  source 1..792: mol_type = other RNA
gccgaggtccagctcgtagaatcaggcgggggagtggtccagcccgggggatcactcaggctctcgtgcgcagcctcgggcttcaccttcaacaaattctggatgaactgggtgcgccaggccccgggcaagggcctagaatgggtcgcagacatacaagtagacgggagcgagaaaaactacgtggactcggtcaagggcagattcacaatctcccgagacaacgggaaaaacagcctgtacttgcaaatgaactcgctaagagccgaagacacaggcgtatactactgcgcgcgcgggcgctacgactactggtcgggctacctatcaccctggggccagggcacactcgtaacagtaagctcggcctcgaccaagggcccgagcgtgttcccgctcgcgccctcgagcaagagcaccagcgggggcacagcagcactcggatgcctggtcaaggattacttcccggaaccggtcacggtctcatggaacagcggggccctaacctcaggcgtgcacacgttcccggccgtgctccagagctcgggcctgtactcgctttcgagcgtcgtcacggtcccgagctcgagcctgggcacgcaaacgtacatatgcaacgtcaatcacaaaccctcgaacacgaaagtggacaagaaagtagaaccgaaatcatgcgggggagggagcgggcaccaccaccaccaccaccaccaccaccacggcggggactacaaagaccacgacggcgactacaaggaccacgacatagactacaaagacgacgacgacaag

SEQ ID NO: 54615 - RNA, 642 nt, synthetic construct
  misc_feature 1..642: note = derived and/or modified sequence opt11 from anti-IsdB_5D1Z_Chain-C
  source 1..642: mol_type = other RNA
gacatccaactcacccaatcaccctccttcctctccgcctccgtcgccgaccgcgttaccatcacttgccgcgcctcccaagccgtacgctcatccctcgcctggtaccaacaaaaacccggcaaagcaccccaactactcatctactccgcctccacactcgaaaacggcgtctcctcccgtttctctggctccggccccggcaccgagttcaccctcaccatatcctcactccaacccgaagacgtcggaacctactactgccaacaactcaacacctaccccttcaccttcggccccggcaccaaagtcgaaatcaaacgcaccgtcgccgccccctccgtcttcatattcccaccctccgacgaacaactcaaatcaggcaccgcctcagtcgtctgcctcctcaacaacttctacccacgcgaagccaaagtccaatggaaagtcgacaacgcccttcaatccggcaactcccaagaatccgtcaccgaacaagactccaaagactccacctactccctctcctccaccctcaccctatccaaagcagactacgaaaaacacaaagtctacgcctgcgaagtaacacaccaaggcctctcctcccccgtcaccaaatcattcaaccgcggcgaatgc

SEQ ID NO: 54616 - RNA, 810 nt, synthetic construct
  misc_feature 1..810: note = derived and/or modified sequence opt11 from anti-IsdB_5D1Z_Chain-D
  source 1..810: mol_type = other RNA
caagtccaactccaagaatccggccccggcctcgtcaaaccctccgagaccctatcactaatctgcacagtctcaggaggctcaatctcatcctcatcttactactggggctggatccgccaaacccccgaaagaaacctcgaatggatcggcatcatctacttctccggcaccacctactacaacccctccctccaatcccgcgtctccatgtccctcgaccgctcaaccaaccgattctccctccgcctatcctccgtcaccgccgccgacaccgccatatactactgcgcaaaaccaaaatcccgcgaccgcggcggacccggcgacgactacttcggaatggacgtctggggccaaggcatcatggtcaccgtctcatcagccagcaccaaaggcccaagcgtcttccccctcgccccctcctccaaatccacatcaggcggcaccgccgccctcggctgcctagtcaaagactacttccccgaacccgtaaccgtctcatggaactccggcgccctaacctccggcgtccacaccttccccgccgtcctccaatcctcaggcctctactccctctcctccgtcgtcacagtaccctcatcttccctcggaacacaaacctacatctgcaacgtaaaccacaaaccctccaacacaaaagtcgacaaaaaagtagaacccaaatcctgcggcggaggtagcggacaccaccaccaccaccaccaccaccaccacggaggcgactacaaagaccacgacggcgactacaaagaccacgacatcgactacaaagacgacgacgacaaa

SEQ ID NO: 54617 - RNA, 810 nt, synthetic construct
  misc_feature 1..810: note = derived and/or modified sequence opt11 from anti-IsdB_5D1Z_Chain-F
  source 1..810: mol_type = other RNA
caagtccaactccaagaatcaggccccggtctagtaaaaccctccgaaaccctcagcctcatctgcaccgtctccggcggatccatctcctcctcatcatactactggggctggatacgccaaacacccgaacgcaacctcgaatggataggcatcatatacttctccggcaccacctactacaacccctccctccaatcccgagtctccatgtcactcgacagatccaccaaccgcttctccctccgactatcatcagtcaccgccgctgacaccgccatatactactgcgccaaacctaaatcccgcgaccgcggaggccccggcgacgactacttcggcatggacgtctggggccaaggcatcatggtcaccgtctcctccgcctccaccaaaggaccctccgtcttccccctcgcaccctcctccaaatcaacctccggaggaaccgccgccctcggatgcctcgtcaaagactacttccccgaaccagtcacagtctcctggaattcaggcgcccttacctccggagtccacacattccccgccgtcctccaatcctcaggcctctactcactttcctcagtcgtcaccgtcccatcctcctccctcggcacccaaacctacatctgcaacgtcaaccacaaaccttccaacaccaaagtcgacaaaaaagtagaacccaaatcctgcggaggcggctccggccaccaccaccaccaccaccaccatcaccacggcggcgattacaaagaccacgacggcgactataaagaccacgacatagactacaaagacgatgacgacaaa

SEQ ID NO: 54618 - RNA, 792 nt, synthetic construct
  misc_feature 1..792: note = derived and/or modified sequence opt11 from anti-IsdB_5D1Z_Chain-G
  source 1..792: mol_type = other RNA
gcagaagtccaactagtcgaaagcggcggcggcgtcgtccaaccaggcggatccctcagactctcctgcgccgcctcaggcttcacattcaacaaattctggatgaactgggtacgccaagccccaggtaaaggcctcgaatgggtagccgacatccaagtcgacggatccgaaaaaaactacgtagactcagtcaaaggccgcttcaccatctcacgcgacaacggcaaaaacagcctttacctacaaatgaactcactccgcgccgaagacaccggcgtctactactgcgctcgcggacgctacgactactggtccggctacctatcaccctggggccaaggaaccctcgtcaccgtcagctccgcctcaacaaaaggcccctcagtattcccactcgcaccctccagcaaaagcaccagcggcggcaccgccgccctcggctgcctggtcaaagactacttccccgaacccgtcacagtctcctggaactccggcgccctcacctccggagtccacaccttccccgccgtcctccaatcctcaggactctactccctctccagcgtcgtcaccgtcccatccagcagcctcggcacccaaacatacatctgcaacgtcaaccacaaaccatccaacacaaaagtcgacaaaaaagtcgaacccaaatcctgcggaggcggctccggccaccaccaccaccaccaccaccaccaccacggaggcgactacaaagaccacgacggcgactacaaagaccacgacatcgactacaaagacgacgacgacaaa

SEQ ID NO: 54619 - RNA, 642 nt, synthetic construct
  misc_feature 1..642: note = derived and/or modified sequence opt11 from anti-IsdB_5D1Z_HeavyChain
  source 1..642: mol_type = other RNA
gacatccaaatgacacaatccccctccttcctctccgcatccgtcggcgaccgagtgactatcacctgccgcgcctcacaaggcatcaccacctacctcggctggtaccaacaacgccccggcaaagccccccaactcctaatctacgccgcctcttccctccagtccggcgtccccccccgcttctcaggctccggctccggcaccgaattcaccctaaccatctcctcactacaacccgaagacttcgccacctactactgccaacaactaaacacctacccatacaccttcggacccggcacccgcctcgaaatcaaacgcacagttgccgccccctcagtcttcatcttccccccatccgacgaacaacttaaatccggcaccgcctccgtcgtatgcctactcaacaacttctacccccgagaagccaaagtccaatggaaagtcgacaacgccctccaatccggcaactcacaagaaagcgtcacagaacaagactccaaagactccacctactccctctcctccacccttaccctatcaaaagccgactacgaaaaacacaaagtatacgcatgcgaagtcacccaccaaggcctctcctcccccgtcaccaaatccttcaaccgcggcgaatgc

SEQ ID NO: 54620 - RNA, 471 nt, synthetic construct
  misc_feature 1..471: note = derived and/or modified sequence opt11 from anti-IsdB_5D1Z_Chain-I
  source 1..471: mol_type = other RNA
ggccccgccaaagccaccaacaacacctaccccatcctcaaccaagaactccgcgaagccatcaaaaaccccgccatcaaagacaaagaccactccgcccccaactcccgccccatcgacttcgaaatgaaaaaaaaagacggcacccaacaattctaccactacgcctcatccgtcaaacccgcccgcgtcatcttcaccgactccaaacccgaaatcgaactcggcctccaatccggccaattctggcgcaaattcgaagtctacgaaggcgacaaaaaactccccatcaaactagtctcctacgacaccgtcaaagactacgcctacatccgcttctcagtctccaacggcaccaaagccgtcaaaatcgtctcctccacccacttcaacaacaaagaagaaaaatacgactacaccctcatggaattcgcccaacccatctacaactccgccgacaaattcaaaacc

SEQ ID NO: 54621 - RNA, 324 nt, synthetic construct
  misc_feature 1..324: note = derived and/or modified sequence opt11 from anti-HIV_b12_LightChain
  source 1..324: mol_type = other RNA
gaaatcgtcctcacccaatcccccggcaccctatccctctcccccggcgaacgcgccaccttctcctgccgctcctcccactccatccgctcccgccgcgtcgcctggtaccaacacaaacccggccaagccccccgcctcgtcatccacggcgtctccaaccgcgcctccggcatctccgaccgcttctccggctccggctccggcaccgacttcaccctcaccatcacccgcgtcgaacccgaagacttcgccctctactactgccaagtctacggcgcctcctcctacaccttcggccaaggcaccaaactcgaacgcaaa

SEQ ID NO: 54622 - RNA, 381 nt, synthetic construct
  misc_feature 1..381: note = derived and/or modified sequence opt11 from anti-HIV_b12_HeavyChain
  source 1..381: mol_type = other RNA
caagtgcaattggaacagagcggggccgaggtcaagaaaccgggcgcgagcgtgaaagtgagctgtcaagcgagcgggtacaggttctcgcactttaccgtgcactgggtcaggcaagcgcccgggcaaaggttcgagtggatgggatggatcaatccctataacgggaacaaggaatttagcgcgaaatttcaagatcgcgtgacctttaccgcggacacgagcgcgaacacggcctatatggagctcaggagcttgcgctcggcagataccgcggtctattactgtgccagggtcggggaatggggctgggacgatagcccgtacgataactattacatggacgtgtgggggaaagggaccacggtcatagtctcgagc

SEQ ID NO: 54623 - RNA, 633 nt, synthetic construct
  misc_feature 1..633: note = derived and/or modified sequence opt11 from anti-HIV_2G12_LightChain
  source 1..633: mol_type = other RNA
gtcgtaatgacacaatccccctccaccctctcagcctccgtcggcgacaccatcacaatcacctgccgcgcctcccaatccatcgaaacctggctcgcctggtaccaacaaaaacccggcaaagcccccaaactcctcatctacaaagcctccaccctcaaaaccggcgtcccatcccgcttctccggctccggctccggcaccgaattcaccctcaccatctccggcctccaattcgacgacttcgccacctaccactgccaacactacgccggctactccgcaaccttcggacaaggcacccgagtcgaaatcaaacgcaccgtcgccgccccatccgtattcatcttccccccctccgacgaacaactaaaatccggcaccgcctccgtagtctgcctcctcaacaacttctacccccgcgaagccaaagtccaatggaaagtcgacaacgccctccaatccggcaactcccaagaatccgttaccgaacaagactccaaagactccacctactccctctcctccaccctcaccctctcaaaagctgactacgaaaaacacaaagtctacgcctgcgaagtcacccaccaaggcctctcctcccctgtcaccaaatccttcaaccgcggc

SEQ ID NO: 54624 - RNA, 672 nt, synthetic construct
  misc_feature 1..672: note = derived and/or modified sequence opt11 from anti-HIV_2G12_HeavyChain
  source 1..672: mol_type = other RNA
gaagtacaactcgtcgaatccggcggcggcctcgtcaaagctggcggctccctcatcctatcctgcggcgtctccaacttccgcatctccgcccacaccatgaactgggtccgccgagtcccaggcggaggcctagaatgggtcgcttccatctccacctcctccacttaccgagactacgccgacgccgtcaaaggccgcttcacagtctcccgcgacgacctcgaagacttcgtctacctccaaatgcacaaaatgcgcgtcgaagacaccgccatctactactgcgccagaaaaggctccgaccgcctatccgacaacgaccccttcgacgcctggggccccggaaccgtcgtcaccgtatcacccgcctcaaccaaaggcccctccgtattccccctcgccccctccagcaaaagcacctcaggcggcaccgccgccctcggatgccttgtcaaagactacttccccgaacccgtaaccgtctcctggaactccggcgccctcacctcaggcgtacacaccttccccgccgtcctacaaagctcaggcctatactccctctcctccgtcgtcacagtcccctcctcctcactgggcacccaaacctatatctgcaacgtcaaccacaaaccctccaacaccaaagtcgacaaaaaagtcgaacccaaa

SEQ ID NO: 54625 - RNA, 642 nt, synthetic construct
  misc_feature 1..642: note = derived and/or modified sequence opt11 from anti-HIV_4E10_LightChain
  source 1..642: mol_type = other RNA
gaaatcgtcctaacccaatcccccggcacccaatccctctctcccggcgaacgcgccaccctctcctgccgagcctcccaatccgtcggcaacaacaaactagcctggtatcaacaacgacccggccaagccccacgcctcctcatctacggcgcctcatcccgcccctccggcgtagccgaccgcttctcaggatccggctccggcaccgacttcaccctaaccatctcccgcctcgaacccgaagacttcgccgtctactactgccaacaatacggacaatccctctcaacattcggccaaggcaccaaagtcgaagtcaaaagaaccgtcgccgcaccctccgtcttcatcttcccaccctccgacgaacaactaaaatccggcaccgcctcagtcgtctgcctactcaacaacttctacccccgagaagccaaagtccaatggaaagtcgacaacgccctccaatccggcaactctcaagaatccgtcaccgaacaagactccaaagactccacctactcactctcatccaccctcaccctctccaaagccgactacgaaaaacacaaagtctacgcctgcgaagtcacccaccaaggcctttcctcccccgtcaccaaatccttcaaccgcggagaa

SEQ ID NO: 54626 - RNA, 684 nt, synthetic construct
  misc_feature 1..684: note = derived and/or modified sequence opt11 from anti-HIV_4E10_HeavyChain
  source 1..684: mol_type = other RNA
caagtccagctagtccaatcaggcgcagaagtaaaacgacccggctcctccgtcaccgtctcctgcaaagcctccggcggctccttctcaacctacgccctctcctgggtccgccaagcccccggccgcggcctcgaatggatgggcggcgtcatccccctcctcaccatcaccaactacgcccctcgcttccaaggccgcatcaccataacagccgaccgctccacctccaccgcctacctcgaactcaactcactccgccccgaagacaccgccgtatactactgcgcccgcgaaggcaccaccggctggggctggctcggcaaacccatcggagcattcgcccactggggccaaggaacactcgtcaccgtctcctccgcctcaacaaaaggcccatcagtattccccctcgcaccctcatccaaatcaacctcaggcggcaccgccgccctcggctgcctagtcaaggactacttccccgaacccgtcaccgtctcatggaactccggcgccctcacctccggcgtccacacattccccgccgtcctccaatcttccggcctctactccctctcatccgtcgtcaccgtcccctcctcatccctcggcacccaaacctacatctgcaacgtcaaccacaaaccctcaaacacaaaagtcgacaagaaagtcgaacccaaa

SEQ ID NO: 54627 - RNA, 312 nt, synthetic construct
  misc_feature 1..312: note = derived and/or modified sequence opt11 from anti-HIV_VRC01_LightChain
  source 1..312: mol_type = other RNA
gaaatcgtcctcacccaatcccccggcaccctctccctctcccccggcgaaaccgccatcatctcctgccgcacctcccaatacggctccctcgcctggtaccaacaacgccccggccaagccccccgcctcgtcatctactccggctccacccgcgccgccggcatccccgaccgcttctccggctcccgctggggccccgactacaacctcaccatctccaacctcgaatccggcgacttcggcgtctactactgccaacaatacgaattcttcggccaaggcaccaaagtccaagtcgacatcaaacgc

SEQ ID NO: 54628 - RNA, 363 nt, synthetic construct
  misc_feature 1..363: note = derived and/or modified sequence opt11 from anti-HIV_VRC01_HeavyChain
  source 1..363: mol_type = other RNA
caggtgcagttggtgcagagcggggggcagatgaagaagccgggggagagcatgaggataagctgtagggcgagcgggtatgagtttatagactgtacgctgaattggataaggttggcgccggggaagaggccggagtggatggggtggctgaagccgagggggggggcggtgaattatgcgaggccgttgcaggggagagtgacgatgacgagggatgtgtatagtgatacggcgtttttggagttgaggagtttgacggtggatgatacggcggtgtatttctgtacgagggggaagaattgtgattataattgggactttgagcattgggggagggggacgccggtaatagtaagtagc

SEQ ID NO: 54629 - RNA, 330 nt, synthetic construct
  misc_feature 1..330: note = derived and/or modified sequence opt11 from anti-HIV_PG9_LightChain
  source 1..330: mol_type = other RNA
caatccgccctcacccaaccagcctccgtctccggctcccccggccaatcaatcaccatctcctgcaacggcacctccaacgacgtcggcggctacgaatccgtctcctggtaccaacaacaccccggcaaagcccccaaagtcgtcatctacgacgtctccaaacgcccctccggcgtctccaaccgcttctccggctccaaatccggcaacaccgcctccctaaccatctccggcctccaagccgaagacgaaggcgactactactgcaaatccctcacctccacccgccgccgcgtcttcggcaccggcaccaaactcaccgtcctc

SEQ ID NO: 54630 - RNA, 408 nt, synthetic construct
  misc_feature 1..408: note = derived and/or modified sequence opt11 from anti-HIV_PG9_HeavyChain
  source 1..408: mol_type = other RNA
cagcgcctagtcgagagcggaggcggggtcgtgcaaccgggctcaagcctgcgcctgagctgcgccgcgagcggattcgacttctcacgccagggcatgcactgggtcaggcaagcacccgggcaagggctcgagtgggtggccttcatcaagtacgacggctcggaaaagtaccacgccgacagcgtatgggggcgactaagcataagcagggacaacagcaaggacacactctacctccagatgaacagcctacgcgtagaagacaccgcgacctacttctgcgtcagggaagcaggcggacccgactacaggaacggatacaactactacgacttctacgacggctactacaactaccactacatggacgtatgggggaaaggaaccacggtcacagtctcgagc

SEQ ID NO: 54631 - RNA, 630 nt, synthetic construct
  misc_feature 1..630: note = derived and/or modified sequence opt11 from anti-HIV_VRC07_LightChain
  source 1..630: mol_type = other RNA
gaaatcgtactcacccaatcccccggcaccctctccctctcccccggcgaaacagccataatctcatgccgcacctcccaatacggctccctcgcctggtaccaacaacgccccggacaagccccccgcctcgtcatctactccggctccacccgagccgccggaatccccgaccgcttctcaggctcccgctggggccccgactacaccctcaccatctccaacctcgaatccggcgacttcggcgtctactactgccaacaatacgaattcttcggccaaggaaccaaagtacaagtcgacatcaaacgcaccgtcgccgccccctccgtattcatcttccccccatccgacgaacaactcaaatccggcaccgcctccgtcgtatgcctcctcaacaacttctacccccgcgaagccaaagtccaatggaaagtcgacaacgccctccaatccggcaactcacaagaatccgtaaccgaacaagactccaaagactcaacctactcactatcctccaccctcaccctctccaaagcagactacgaaaaacacaaagtctacgcctgcgaagtcacccaccaaggcctccgctcccccgtaaccaaatccttcaaccgaggcgaatgc

SEQ ID NO: 54632 - RNA, 375 nt, synthetic construct
  misc_feature 1..375: note = derived and/or modified sequence opt11 from anti-HIV_VRC07_HeavyChain
  source 1..375: mol_type = other RNA
caggtccagctcgtgcaatcgggcgggcaaatgaaaaagcccggggaatcgatgaggatctcgtgcagggcctcgggctatgaatttatcgattgcacgctcaattggatacgcctggccccgggcaagcgcccggaatggatggggtggctgaaaccgcgcgggggcgcggtaaattacgcgcgaccgctccagggcagggtcacgatgacgcgagatgtctatagcgataccgcgttcttggaattgcgatcgctcacgagcgatgacacggccgtgtacttttgcacgcgcgggaaatattgcacggccagggactattacaattgggatttcgagcactggggccagggcacgcccgtgatcgtgagctcg

SEQ ID NO: 54633 - RNA, 315 nt, synthetic construct
  misc_feature 1..315: note = derived and/or modified sequence opt11 from anti-HIV_3BNC117_LightChain
  source 1..315: mol_type = other RNA
gacatccaaatgacccaatccccctcctccctctccgcctccgtcggcgacaccgtcaccatcacctgccaagccaacggctacctcaactggtaccaacaacgccgcggcaaagcccccaaactcctcatctacgacggctccaaactcgaacgcggcgtcccctcccgcttctccggccgccgctggggccaagaatacaacctcaccatcaacaacctccaacccgaagacatcgccacctacttctgccaagtctacgaattcgtcgtccccggcacccgactcgacctcaaacgcaccgtcgccgccccc

SEQ ID NO: 54634 - RNA, 387 nt, synthetic construct
  misc_feature 1..387: note = derived and/or modified sequence opt11 from anti-HIV_3BNC117_HeavyChain
  source 1..387: mol_type = other RNA
caagtacaattgctccagagcggggccgcggtcacgaaaccgggcgcgagcgtgcgcgtgagctgtgaagcgagcgggtacaatatcagggactatttcatacactggtggaggcaagcgcccgggcaagggctccagtgggtgggctggatcaatcccaagaccgggcaaccgaacaatcccaggcaatttcaagggcgcgtgagcctgaccaggcacgcgagctgggactttgacacgttctcgttctatatggatctcaaggccttgcgctcggacgataccgcggtctatttctgtgccaggcaaaggagcgattactgggactttgacgtgtgggggagcgggacccaggtcacggtctcgagcgcgagcacgaaagggccc

SEQ ID NO: 54635 - RNA, 324 nt, synthetic construct
  misc_feature 1..324: note = derived and/or modified sequence opt11 from anti-HIV_10-1074_LightChain
  source 1..324: mol_type = other RNA
agctatgtcaggcccttgagcgtggccttgggcgagaccgcgcgcataagctgtggcaggcaagcgctcgggagcagggccgtgcaatggtaccagcacaggcccgggcaagcgcccatactcttgatctataacaatcaagatcgcccgagcgggatcccggaaagattctcgggcacgcccgatatcaatttcgggaccagggccacgctcacgatctcgggcgtggaagcgggcgatgaagcggactattactgtcacatgtgggatagcaggagcgggttctcgtggtcgttcgggggcgcgaccaggctcacggtcttg

SEQ ID NO: 54636 - RNA, 396 nt, synthetic construct
  misc_feature 1..396: note = derived and/or modified sequence opt11 from anti-HIV_10-1074_HeavyChain
  source 1..396: mol_type = other RNA
caagtccaactccaagaatccggccccggcctcgtcaaaccctccgaaaccctctccgtcacctgctccgtctccggcgactcaatgaacaactactactggacctggatccgccaatcccccggcaaaggcctcgaatggatcggctacatctccgaccgcgaatccgccacctacaacccctccctcaactcccgcgtcgtcatctcccgcgacacctccaaaaaccaactctccctcaaactcaactccgtcacccccgccgacaccgccgtctactactgcgccaccgcacgccgcggccaacgcatctacggcgtcgtctccttcggcgaattcttctactactactccatggacgtctggggcaaaggcaccaccgtcaccgtctcctcc

SEQ ID NO: 54637 - RNA, 633 nt, synthetic construct
  misc_feature 1..633: note = derived and/or modified sequence opt11 from anti-HIV_PGT121_LightChain
  source 1..633: mol_type = other RNA
tccgacatctccgtcgccccaggcgaaaccgcccgcatctcctgcggcgaaaaatccctcggctcccgcgccgtccaatggtaccaacaccgcgccggccaagccccctccctcatcatctacaacaaccaagaccgcccctctggcatcccagaacgattctcaggctcacccgactcacccttcggcaccaccgcaaccctcaccatcacctccgtcgaagccggcgacgaagcagactattactgccacatctgggactcccgagtccccaccaaatgggtcttcggcggcggcaccaccctaaccgtcctcggacaaccaaaagccgcaccatcagtcaccctcttccccccctcctccgaagaactacaagccaacaaagccaccctcgtctgcctaatctccgacttctaccccggcgccgtcaccgtcgcctggaaagccgactcctcccccgtcaaagccggcgtagaaaccaccaccccctccaaacaatccaacaacaaatacgccgcctcctcatacctctccctcacccccgaacaatggaaatcccacaaatcatactcctgccaagtcacccacgaaggctccaccgtcgaaaaaaccgtcgcccccaccgaatgctcc

SEQ ID NO: 54638 - RNA, 705 nt, synthetic construct
  misc_feature 1..705: note = derived and/or modified sequence opt11 from anti-HIV_PGT121_HeavyChain
  source 1..705: mol_type = other RNA
caaatgcaactccaagaatccggccccggcctcgtcaaaccctctgaaaccctctccctcacatgctccgtctccggcgcctccatctccgactcctactggtcatggatccgacgctcccccggcaaaggcctagaatggatcggttacgtccacaaatcaggcgacaccaactactccccctccctcaaatcccgcgtcaacctctccctcgacacctccaaaaaccaagtctccctctccctagtcgccgcaaccgccgcagactcaggaaaatactactgcgcccgcaccctccacggccgccgcatctacggaatcgtcgccttcaacgaatggttcacctacttctacatggacgtctggggcaacggcacccaagtcaccgtatcctccgcctccactaaaggcccatccgtcttccccctcgccccctcttccaaatccacctccggcggcaccgcagccctcggctgtctcgtcaaagactacttccccgaacccgtcaccgtctcctggaactccggcgccctcacctccggagtccacaccttccccgccgtactccaatcctccggcctctactccctatcatcagttgtaaccgtcccctcctcatccctaggcacccaaacatacatctgcaacgtcaaccacaaaccctccaacaccaaagttgataaacgcgtcgaacccaaatcatgc

SEQ ID NO: 54639 - RNA, 657 nt, synthetic construct
  misc_feature 1..657: note = derived and/or modified sequence opt11 from anti-HIV_PGDM1400_LightChain
  source 1..657: mol_type = other RNA
gacttcgtcctcacccaaagcccccactcactctccgtaacccccggagaatccgcctccatctcctgcaaatcctcccactccctcatccacggcgaccgaaacaactacctcgcctggtacgtacaaaaacccggccgctcaccccaactcctcatctacctcgcctcctcccgcgcctccggcgtccccgacagattctccggctccggctcggacaaagacttcacccttaaaatatcccgagtcgagaccgaagacgtcggcacctactactgcatgcaaggccgcgaatccccctggaccttcggacaaggcaccaaagtcgacatcaaacgaaccgtcgccgccccctccgtcttcatcttcccaccctcagacgaacaactaaaatccggcacagcttcagtcgtctgcctcctaaacaacttctacccccgcgaggccaaagtccaatggaaagtcgacaacgccctccaatccggaaactcacaagaatcagtaaccgagcaagactcaaaagactcaacctactccctctcctccaccctcaccctcagcaaagccgactacgaaaaacacaaagtatacgcatgcgaagtcacccaccaaggcctctcctcacccgtaaccaaatccttcaaccgaggcgaatgc

SEQ ID NO: 54640 - RNA, 735 nt, synthetic construct
  misc_feature 1..735: note = derived and/or modified sequence opt11 from anti-HIV_PGDM1400_HeavyChain
  source 1..735: mol_type = other RNA
caagcacaactcgtacaatccggccccgaagtccgaaaacccggcacatcagtaaaagtctcctgcaaagcccccggcaacaccctcaaaacatacgacctccactgggtccgctccgtccccggtcaaggcctccaatggatgggatggatctcccacgaaggcgacaaaaaagtaatcgtcgaacgcttcaaagccaaagtcaccattgactgggaccgctcaaccaacaccgcctacctccaactctcaggcctcacctcaggcgacaccgccgtatattactgcgccaaaggctccaaacaccgcctccgcgactacgccctctacgacgacgacggcgcactcaactgggcagtcgacgtcgactacctctctaacctcgaattctggggccaaggaaccgccgtcaccgtctcatcagcctccaccaaaggcccctccgtcttccccctagccccctcctccaaatccacctcaggcggcaccgccgccctcggatgcctagtcaaagactacttcccagaacccgtcacagtctcctggaactccggcgccctcacctccggagtccacacattcccagccgtcctccaatcctcaggcctctactccctttcctccgtagtcacagtcccctcctcatccctcggcacccaaacatacatctgcaacgtcaaccacaaaccctccaacacaaaagtcgacaaaaaagtcgaacccaaatcctgcgac

SEQ ID NO: 54641 - RNA, 630 nt, synthetic construct
  misc_feature 1..630: note = derived and/or modified sequence opt11 from anti-HIV_N6_LightChain
  source 1..630: mol_type = other RNA
tacatccacgtcacccaatccccctcctcactctccgtctctatcggcgaccgcgtcaccatcaactgccaaacatcccaaggcgtcggctccgacctccactggtaccaacacaaacccggccgcgcccccaaactcctcatccaccacacatcctccgtcgaagacggagtcccctcccgcttctccggctcaggcttccacacctccttcaacctaaccatctcagacctccaagccgacgacatcgccacctactactgccaagtcctccaattcttcggccgcggctcccgactccacatcaaacgcaccgtcgccgccccctccgtcttcatcttcccaccctcagacgaacaactcaaatccggcaccgcctccgtcgtatgcttactcaacaacttctacccccgcgaagccaaagtccaatggaaagtcgacaacgcactccaatccggcaactcccaagaatccgtcaccgaacaagactccaaagactccacctactccctctcctcaaccctaaccctatccaaagccgactacgaaaaacacaaagtctacgcctgcgaagtcacccaccaaggcctctcatcacccgtcaccaaatccttcaaccgcggcgaatgc

SEQ ID NO: 54642 - RNA, 675 nt, synthetic construct
  misc_feature 1..675: note = derived and/or modified sequence opt11 from anti-HIV_N6_HeavyChain
  source 1..675: mol_type = other RNA
cgcgcacacttggtccagagcgggacagcgatgaagaaaccgggcgcgagcgtgcgcgtaagctgtcaaacaagcggatacacgttcacggcccatatattattctggttcaggcaagcgcccgggcgcgggctcgagtgggtgggatggatcaagccacagtacggggccgtaaactttggcgggggctttcgcgatcgagtgaccttgaccagggacgtgtacagggaaatagcatatatggatatcaggggcttaaaaccggacgataccgcggtctactactgtgccagggacaggagctatggcgatagctcgtgggcgctagacgcatggggccagggcacgaccgtggtagtgagcgcggcctcgaccaagggcccaagcgtgttcccgctcgcgccctcaagcaagagcacgagcgggggcacggccgcgctcgggtgcctggtcaaggactatttcccggaaccggtcacggtctcatggaatagcggtgccttgacctcgggagtacacacgttcccggccgtgctccagagctcgggcttgtactcgctctcgagcgtagtcacggtcccgagctcgagcttgggcacacaaacgtacatatgcaatgtcaatcacaagccctcgaacacgaaagtggacaagaaagtggaaccgaaatcgtgc

SEQ ID NO: 54643 - RNA, 1080 nt, synthetic construct
  misc_feature 1..1080: note = derived and/or modified sequence opt11 from anti-HIV_N6_GChain
  source 1..1080: mol_type = other RNA
gcctgggaagacgccgacaccacactcttctgcgccagcgacgccaaagcgtacagcaccgaaaaacacaacgtatgggcaacccacgcctgcgtccccacagacccggacccacaggaaatcccactcgaaaacgtcaccgaaaacttcaacatgtggaaaaacaacatggtagaacaaatgcacgaagacatcatcagcctctgggacgaatcactaaagccctgcgtcatgctcaccggcggcagcaccatcaaacaagcatgcccaaaagtaaccttcgaacccatacccatacactactgcgcccccgccggcttcgcaattctcaaatgccgcgacgaagacttcaacggcacaggcccctgtaagaacgtctcaaccgtccaatgcacccacggaatcaaacccgttgtcagcacccaactcctactaaacggctccctcgcaaaaggagacatcgtcatccgctccgaaaatcttaccaacaacgccaaagtaatcatcgtccaactcaacgaacccgtccaaatagtctgcatccgcccaaacaacggcggctccggaagcggcggagacatacgccaagcacactgcaacgtcacccgcggcaaatgggtcaacattaccaaaaacgtcaaagaacaactctggaaaatcttcaacaaaaccacaaacatcaccttcaacaacacgatcttcaactcacccgccggcggagacctcgaaatcaccacacactccttcaactgcggaggcgagttcttctactgcaacacctccgacctcttcaacgaaaccaacctctccgccaaccacaccgacaccaacgaaaacataacacttcaatgccgcatcaaacaaattgtccgcatgtggcaacgagtcggccaagccatgtacgccccacccatcgcaggcaacatcacatgcatatcaaacatcacaggcttactactcacccgcgacggagtcaacgacacccacgacaaagaaaacgaaaccttccgcccaaccggcggtgacatgagagacaactggcgctccgaactatacaaatacaaagtaataaagctcaaa

SEQ ID NO: 54644 - RNA, 645 nt, synthetic construct
  misc_feature 1..645: note = derived and/or modified sequence opt11 from anti-HIV_10E8_LightChain
  source 1..645: mol_type = other RNA
tcctacgaactaacacaagaaaccggcgtctccgtcgccctaggccgcacagtcaccatcacctgccgcggcgactccctccgctcccactacgcctcgtggtaccaaaaaaaacccggccaagcccccatcctactcttctacggcaaaaacaaccgcccatcaggcgtacccgaccgattctcaggctccgcctccggcaaccgcgcctcactcaccatctccggcgcccaagccgaagacgacgccgaatactactgctcctcccgcgacaaatccggctcccgcctctcagtcttcggcggaggcaccaaactcaccgtactcagccaacccaaagccgccccatccgtcaccctattccccccctcctccgaagaactccaagccaacaaagccaccctagtctgcctcatctccgacttctaccccggagccgtcaccgtcgcatggaaagcagactcctcccccgtcaaagccggcgtcgaaaccaccaccccctccaaacaatcaaacaacaaatacgccgcctcctcatacctctcacttaccccagaacaatggaaatcacaccgctcctactcctgccaagtcacccacgaaggctccaccgtcgaaaaaaccgtcgcccccaccgaatgctcc

SEQ ID NO: 54645 - RNA, 708 nt, synthetic construct
  misc_feature 1..708: note = derived and/or modified sequence opt11 from anti-HIV_10E8_HeavyChain
  source 1..708: mol_type = other RNA
gaagtccaactcgtcgaatcaggaggaggcctagtcaaacccggcggatccctccgcctctcctgctccgcctccggcttcgacttcgacaacgcctggatgacctgggtacgccaaccacccggcaaaggcctcgaatgggtcggcagaatcaccggccccggcgaaggatggtccgtcgactacgccgcccccgtcgaaggccgattcaccatctcccgcctcaactccatcaacttcctatacctcgaaatgaacaacctaagaatggaagactccggcctctacttctgcgcccgcaccggcaaatactacgacttctggtccggatacccacccggagaagaatacttccaagactggggccgcggcaccctagtcaccgtctcttccgcctccaccaaaggcccctccgtcttccccctagctccctcctccaaatccacctcaggcggcacagcagcactcggctgcctcgtcaaagactacttccccgaacccgtcaccgtctcatggaactccggcgccctcacctccggcgtccacaccttccccgccgtcctccaatcctcaggcctctactccctctcctccgtcgtcaccgtcccctcctcctccctcggcacccaaacctacatctgcaacgtcaaccacaaaccatccaacacaaaagtcgacaagagagtcgaacccaaatcctgcgacaaa

SEQ ID NO: 54646 - RNA, 333 nt, synthetic construct
  misc_feature 1..333: note = derived and/or modified sequence opt11 from anti-HIV_12A12_LightChain
  source 1..333: mol_type = other RNA
gacatccaaatgacccaatccccctcatccctctccgcctccgtcggcgaccgcgtcaccatcacctgccaagccggccaaggcatcggctcctccctccaatggtaccaacaaaaacccggcaaagcccccaaactcctagtccacggcgcctccaacctccaccgcggcgtcccctcccgcttctccggctccggcttccacaccaccttctccctcaccatctccggcctccaacgcgacgacttcgccacctacttctgcgccgtcctcgaattcttcggccccggcaccaaagtcgaaatcaaacgcaccgtcgccgccccctccgtc

SEQ ID NO: 54647 - RNA, 381 nt, synthetic construct
  misc_feature 1..381: note = derived and/or modified sequence opt11 from anti-HIV_12A12_HeavyChain
  source 1..381: mol_type = other RNA
tcgcaacatctcgtgcaatcgggcacgcaagtgaaaaagcccggggcctcggtcaggatctcgtgccaggcctcgggctatagctttaccgattacgtgctccattggtggcgccaggcaccgggccagggcttggaatggatggggtggataaaaccggtctatggcgcgcgcaattacgcgcgcaggttccagggcaggatcaatttcgatcgagatatctatcgcgagatcgcgttcatggacttgagcgggctcaggagcgatgacacggccttgtacttttgcgcgcgcgatggctcgggcgatgacacgagctggcacttggacccgtgggggcaagggaccttggtcatagtctcggccgcgagcacgaaaggg

SEQ ID NO: 54648 - RNA, 315 nt, synthetic construct
  misc_feature 1..315: note = derived and/or modified sequence opt11 from anti-HIV_12A21_LightChain
  source 1..315: mol_type = other RNA
gacatccaaatgacccaatccccctcctccctctccgcctccgtcggcgaccgcgtcaccatcaactgccaagccggccaaggcatcggctcctccctcaactggtaccaaaaaaaacccggccgcgcccccaaactcctcgtccacggcgcctccaacctccaacgcggcgtcccctcccgcttctccggctccggcttccacaccaccttcaccctcaccatctcctccctccaacccgacgacgtcgccacctacttctgcgccgtcttccaatggttcggccccggcaccaaagtcgacatcaaacgcacc

SEQ ID NO: 54649 - RNA, 384 nt, synthetic construct
  misc_feature 1..384: note = derived and/or modified sequence opt11 from anti-HIV_12A21_HeavyChain
  source 1..384: mol_type = other RNA
tcccaacacctcgtccaatccggcacccaagtcaaaaaacccggcgcctccgtccgcgtctcctgccaagcctctggctacaccttcaccaactacatcctacactggtggcgccaagcccccggccaaggcctcgaatggatgggcctaatcaaacccgtcttcggcgccgtcaactacgcccgccaattccaaggccgcatccaactaacccgagacatctaccgagaaatcgccttcctcgacctctcaggcctccgctcagacgacaccgccgtctactactgcgcccgcgacgaatccggcgacgacctcaaatggcacctacacccatggggccaaggaacccaagtcatcgtctcccccgcctcaacaaaaggcccc

SEQ ID NO: 54650 - RNA, 648 nt, synthetic construct
  misc_feature 1..648: note = derived and/or modified sequence opt11 from anti-HIV_35022_LightChain
  source 1..648: mol_type = other RNA
caatccgtcctaacccaatccgcatccgtctcaggctcactcggccaatccgtcaccatctcatgcaccggccccaactccgtctgctgctcccacaaatccatctcatggtaccaatggccacccggccgcgcacccacactcatcatctacgaagacaacgaacgcgctccaggcatctcaccccgtttctccggctacaaatcatactggtccgcctacctaaccatctccgacctccgccccgaagacgaaacaacatactactgttgctcctacacccacaactccggctgcgtcttcggcaccggcacaaaagtctccgtcctcggccaatccaaagccaacccctcagtaaccctattccccccctcctccgaagaactccaagccaacaaagccaccctagtatgcctcatctccgacttctaccccggcgccgtcaccgtcgcctggaaagccgactcctcacccgtcaaagccggcgtcgaaaccaccacaccctcaaaacaatccaacaacaaatacgccgcctcctcctacctctccctcacccccgaacaatggaaatcccaccgctcatactcctgccaagtaacccacgaaggctccaccgtagaaaaaaccgtcgcccccaccgaatgctcc

SEQ ID NO: 54651 - RNA, 729 nt, synthetic construct
  misc_feature 1..729: note = derived and/or modified sequence opt11 from anti-HIV_35022_HeavyChain
  source 1..729: mol_type = other RNA
gaaggccaactcgtccaatccggcgccgaactgaaaaaacccggagcctccgtcaaaatctcatgcaaaacctccggataccgcttcaacttctaccacatcaactggatccgacaaaccgcaggccgaggaccggaatggatgggctggatctcaccctactccggcgacaaaaacctcgcccccgccttccaagaccgcgtcatcatgaccaccgacaccgaagtccccgtaacatccttcacctcaaccggcgccgcctacatggaaatccgaaacctcaaattcgacgacacaggcacctacttctgcgccaaaggcctactacgcgacggctcatccacctggctcccctacctctggggacaaggcaccctcctaaccgtctcatcagcctccaccaaaggcccctccgtcttcccactcgccccctcctccaaatccacctccggcggaaccgccgcactcggctgcctagtcaaagactacttcccagaaccagtcactgtctcctggaactccggtgccctcacctcaggcgtccacaccttccccgccgtcctacaatcctccggcctgtactcactatcctccgtcgtcacagtccccagctcctccctcggcacccaaacatacatctgcaacgtcaaccacaaaccatctaacacaaaagtagacaaacgcgtcgaacccaaatcatgcgacaaaggcctcgaagtactcttccaa

SEQ ID NO: 54652 - RNA, 648 nt, synthetic construct
  misc_feature 1..648: note = derived and/or modified sequence opt11 from anti-HIV_3BC176_LightChain
  source 1..648: mol_type = other RNA
caatccgtcctcacccaacccgcctccgtatccgcctcccccggccaatccatcaccgtctcctgcaccggctcccgcaacgacgtcggcggctacgacttcgtcagctggtaccaacgtcaccccggcggagtacccaaactcataatctacgaaatctccaaacgcccctccggaataccacaacgattctctggctcccgatccggcaacaccgcctcacttaccatctccggcctccaagacgacgacgaagccgactactactgctgctcctacgcctcctacgaccgcctcatcttcggcggcggcactcgcgtctctgtcctccgacaaccaaaagccgccccatccgtcaccctattcccaccctcctccgaagaactccaagccaacaaagccacccttgtctgcctaatctccgacttctaccccggcgccgtaaccgtcgcctggaaagccgacggctccccagtcaaagccggcgtcgaaaccaccaaaccctccaaacaatccaacaacaaatacgccgcatcctcctacctatccctcacacccgaacaatggaaatcccaccgctcctactcatgccaagtcacccacgaaggctccaccgtcgaaaagaccgtcgcccccacagaatgctcc

SEQ ID NO: 54653 - RNA, 699 nt, synthetic construct
  misc_feature 1..699: note = derived and/or modified sequence opt11 from anti-HIV_3BC176_HeavyChain
  source 1..699: mol_type = other RNA
gaacaagtccaactaatgcaatccggcgcccaacttcgcgaccccggcgactccctcaaaatatcctgcaaagcctccggttacaacttcatcgactaccacatccactgggtccgcctcgccccaggccgcggactcgaatggatgggctggatcgaccctgtcggcggcatcaccaaatacgccggccaattccaaggccgcctctccctaacacgcgacacctctacaaacaccctcttcctcgaactctcccgactcaccgccggcgacaccgccgtctacttctgcgcccgatcaatgcgccccgtagaccacggaatcgactactccggcctattcgtcttccacttctggggccgcggctccgacgtcctcgtctcctccgcctccaccaaaggcccctccgtcttccccctcgccccctcctccaaatccacctccggcggcaccgccgccctcggctgcctcgtcaaagactacttccccgaaccagtcaccgtctcatggaactcaggcgcactcacctccggcgtacacaccttccctgccgtcctccaatcctccggcctctactccctttcctccgtcgtcaccgtcccatcctcctccctcggcacccaaacctacatctgcaacgtcaaccacaaaccctccaacacaaaagtcgacaaaaaagtcgaacccaaatcatgcgac

SEQ ID NO: 54654 - RNA, 621 nt, synthetic construct
  misc_feature 1..621: note = derived and/or modified sequence opt11 from anti-HIV_3BNC55_LightChain
  source 1..621: mol_type = other RNA
gacatccaaatgacccaatccccatcctccctctccgcctccgtcggcgacaaagtcaccatcacctgccaaacctccgccggatacctcaactggtaccaacaacgccgcggccgagcccccaaactccttatgtacgacggctcacgactcgtcaccggcgtcccctcccgattctccggccgacgctggggcacccaatacaacctcaccatcggctctctacaacccgaagacatcgccacctactactgccaagtctacgaattcttcggcccaggcacccgcctcgacctcaaacgcacagtcgccgccccctccgtcttcatcttcccaccctcagacgaacaactcaaatccggcacagccagcgtcgtctgcctcctcaacaacttctacccccgcgaagcaaaagtccaatggaaagtcgacaacgccctccaatccggaaactcccaagaatccgtcaccgaacaagactccaaagactcaacttactccctctcatccaccctcaccctctccaaagccgactacgaaaaacacaaagtatacgcatgcgaagtcacccaccaaggactctcctcccccgtcaccaaatccttcaaccgaggcgaatgc

SEQ ID NO: 54655 - RNA, 675 nt, synthetic construct
  misc_feature 1..675: note = derived and/or modified sequence opt11 from anti-HIV_3BNC55_HeavyChain
  source 1..675: mol_type = other RNA
caagtccaacttgtccaatccggcaccgccgtcaaacgacccggagcctccgtcagagtctcatgccaagcctctggctacaccttcaccgactacttcatctactggtggcgccaagcccccggccaaggcctcgaatggctcggctggatcaaccccttaacctcccaaccctcctacccctccagattccaaggccgtctcacacttacacgcgacacctttgacgaaatgctctacatggacctccgcggactacgatctgacgacaccggcatctacttctgcgcccgccgccactccgactactgcgacttcgacatctggggctctggcacccaaatcatcgtctcctccgcctccaccaaaggaccttccgtcttccccctcgccccctcctccaaatccacctctggcggcaccgccgcactcggctgcctcgtcaaagactacttccccgaacccgtcacagtctcctggaactccggcgccctaacctccggcgtccacaccttccccgccgtcctccaatcctcaggcctctactccctctcttccgtcgtcaccgtcccctcatcttccctcggcacccaaacctacatctgcaacgtcaaccacaaaccctccaacaccaaagtcgacaaacgcgtagaacccaaatcctgcgacaaaacc

SEQ ID NO: 54656 - RNA, 618 nt, synthetic construct
  misc_feature 1..618: note = derived and/or modified sequence opt11 from anti-HIV_3BNC60_LightChain
  source 1..618: mol_type = other RNA
gacatccaaatgacccaatccccctcctccctctccgcccgcgtaggcgacaccgtcaccatcacctgccaagccaacggctacctcaactggtaccaacaacgccgcggaaaagcccccaaactcctcatatacgacggcagcaaactcgaacgcggagtccccgcccgcttctcaggccggcgctggggccaagaatacaaccttaccatcaacaacctccaacccgaagacgtcgccacttacttctgccaagtctacgaattcatcgtccccggcacccgtctcgacctcaaacgcaccgtagccgccccctccgtattcatcttccccccctccgacgaacaactcaaatccggcaccgcctcagtcgtctgcctcctcaacaacttctacccccgcgaagcaaaagtccaatggaaagtcgacaacgccctccaatccggcaactcccaagaatccgtcaccgaacaagacagcaaagactccacctactccctctcctccaccctcaccctctccaaagccgactacgaaaaacacaaagtctacgcctgcgaagtcacccaccaaggcctctcctcccccgtcaccaaatcattcaaccgcggcgaatgc

SEQ ID NO: 54657 - RNA, 687 nt, synthetic construct
  misc_feature 1..687: note = derived and/or modified sequence opt11 from anti-HIV_3BNC60_HeavyChain
  source 1..687: mol_type = other RNA
caagtccatctctcccaatcaggcgccgccgtcaccaaacccggcgcatcagtacgcgtctcctgcgaagcctccggctacaaaataagcgaccacttcatccactggtggcgccaagccccaggccaaggcctacaatgggtcggctggatcaaccccaaaacaggccaacccaacaaccctcgccaattccaaggccgcgtatccctaacccgacaagcctcatgggacttcgacacctactccttctacatggacctcaaagccgtccgatcagacgacaccgccatctacttctgcgcccgccaacgctccgacttctgggacttcgacgtctggggctcaggcacccaagtaaccgtcagctccgcctccaccaaaggcccctccgtcttcccactcgccccatcatccaaatccaccagcggcggcaccgccgccctcggctgcctcgtcaaagactacttccccgaacccgtcacagtatcctggaactcaggcgccctaacctccggcgtccacaccttccccgccgtcctccaaagctccggactctactcactctcatccgtcgtcaccgtaccctcctcctctctaggaacacaaacctacatctgcaacgtcaaccacaaaccctcaaacacaaaagtcgacaaacgcgtcgaacccaaatcctgcgacaaaaca

SEQ ID NO: 54658 - RNA, 687 nt, synthetic construct
  misc_feature 1..687: note = derived and/or modified sequence opt11 from anti-HIV_3BNC60_HeavyChain
  source 1..687: mol_type = other RNA
gaagtccacctctcccaatcaggcgcagccgtcaccaaacccggcgcctccgtccgagtctcatgcgaagcctccggctacaaaatttcagaccacttcatccactggtggcgccaagccccaggccaaggcctccaatgggtcggctggatcaaccccaaaaccggccaacccaacaacgcccgccaattccaaggccgcgtctccctcacccgccaagcctcatgggacttcgacacctactccttctacatggacctcaaagccgtccgctccgacgacacagcaatctacttctgcgcccgacaacgctccgacttctgggacttcgacgtctggggctccggcacccaagtcaccgtctcctcagcctccaccaaaggcccctcagtcttccccctcgccccctcctccaaatccacctccggcggcaccgccgccctcggctgcctcgtcaaagactacttccccgaacccgtcaccgtctcctggaactccggcgcactcacctctggagtccacacattcccagccgtcctccaatcctccggcctttacagcctctcatccgtcgtcaccgtccccagctcctcactaggcacacaaacctacatctgcaacgtcaaccacaaaccatccaacacaaaagtcgacaaacgcgtcgaaccaaaatcatgcgacaaaacc

SEQ ID NO: 54659 - RNA, 648 nt, synthetic construct
  misc_feature 1..648: note = derived and/or modified sequence opt11 from anti-HIV_447-52D_LightChain
  source 1..648: mol_type = other RNA
caatccgtcctcacccaacccccatccgtctccgccgcccccggccaaaaagtcacaatctcctgctctggctcctcctccaacatcggcaacaactacgtcctctggtaccaacaattccccggcaccgcccccaaactactcatctacggcaacaacaaacgcccctcaggcatccccgaccgcttctccggctcaaaatccggcacatcagccaccctcggcatcaccggcctccaaaccggcgacgaagccgactacttctgcgccacatgggactccggcctctccgccgactgggtcttcggcggaggcaccaaactcacagtcctctcacaacctaaagccgccccctccgtcaccctcttccccccctcctccgaagaactccaagccaacaaagcaaccctcgtctgcctcatctccgacttttacccaggcgccgtcaccgtcgcctggaaagccgactcctcccccgttaaagccggcgtcgaaaccaccaccccatccaaacaatccaacaacaaatacgcagcctcctcatacctatccctcaccccagaacaatggaaatcacaccgctcctactcctgccaagtcacacacgaaggctccaccgtcgaaaaaacagtcgcccccaccgaatgc

SEQ ID NO: 54660 - RNA, 693 nt, synthetic construct
  misc_feature 1..693: note = derived and/or modified sequence opt11 from anti-HIV_447-52D_HeavyChain
  source 1..693: mol_type = other RNA
gaagtccaactcgtcgaatcaggcggcggcctcgtcaaaccaggcggctccctccgcctaacctgcgtcgcctcaggcttcaccttctccgacgtctggctaaactgggtccgacaagcccccggcaaaggcctcgaatgggtaggccgcatcaaatcccgaaccgacggcggcaccaccgactacgcagcctccgtaaaaggccgcttcaccatctcacgcgacgactctaaaaacaccctctacctccaaatgaactcactcaaaaccgaagacaccgccgtctactcctgcaccaccgacggattcatcatgatccgaggcgtatccgaagactactactactactacatggacgtctggggcaaaggcaccacagtaaccgtctcctccgcctccaccaaaggcccctccgtattccccctcgccccatgttcccgatccacctccggcggcaccgccgccctcggctgcctcgtcaaagactacttccccgaacccgtcaccgtctcctggaactccggcgcactcacatccggcgtccataccttccccgccgtcctccaatcatcaggactctactccctctcctcagtcgtcaccgtcccctcatcctccctcggcacccaaacctacacatgcaatgtcaaccacaaaccctccaacaccaaagtagacaaacgcgtcgaactc

SEQ ID NO: 54661 - RNA, 645 nt, synthetic construct
  misc_feature 1..645: note = derived and/or modified sequence opt11 from anti-HIV_447-52D_LightChain
  source 1..645: mol_type = other RNA
caatccgtcctcacccaaccaccctccgtctccgccgcccccggccaaaaagtcaccatctcctgctcaggctcctcctccaacatcggcaacaactacgtcctctggtaccaacaattccccggaacagcccccaaactcctcatctacggcaacaacaaacgcccctccggcatccccgaccgcttctcaggctcaaaatccggcacatccgccaccctcggaatcacaggactccaaaccggcgacgaagccgactacttctgcgccacctgggactccggcctctccgccgactgggtcttcggcggcggcaccaaactcacagtcctatcccagcccaaagccgccccctccgtcaccctcttcccaccctcctccgaagaactccaagccaacaaagccaccctagtatgcctcatctccgacttctacccaggcgccgtcaccgtcgcctggaaagccgactcatcccccgtcaaagccggcgtcgaaaccaccaccccctccaaacaatccaacaacaaatacgccgcctcttcctacctctccctcacacccgaacaatggaaatcacaccgctcatactcctgccaagtaacacacgaaggctctaccgtcgagaaaaccgtcgcccccaccgaa

SEQ ID NO: 54662 - RNA, 705 nt, synthetic construct
  misc_feature 1..705: note = derived and/or modified sequence opt11 from anti-HIV_447-52D_HeavyChain
  source 1..705: mol_type = other RNA
gaagtccaactcgtcgaatccggcggcggcctagtaaagcccggcggctccctacgcctaacctgcgtcgcctcaggcttcaccttctccgacgtatggctcaactgggtccgccaagccccaggcaaaggcctcgaatgggtaggccgaatcaaatcacgcaccgacggcggcaccaccgactacgccgcctcagtaaaaggccgcttcaccatctcccgcgatgactccaaaaacaccctctacctacaaatgaactccctcaaaacagaagacaccgccgtctactcttgcaccaccgacggcttcatcatgatccgaggcgtttccgaagactactactactactacatggacgtctggggtaaaggcaccaccgtcacagtctcaagcgcctccaccaaaggaccctccgtcttccccctcgccccatgctcccgctcaacctccggcggcaccgccgccctaggctgcctcgtcaaagactacttcccagaacccgtcacagtatcctggaactccggcgccctcacctccggcgtccacacctttccagccgtcctccaatcctccggactctactccctctcctccgtcgtcaccgtccccagctcctccctaggcacacaaacctacacatgcaacgtcaaccacaaaccctcaaacaccaaagtagacaaacgcgtcgaactcaaaaccccaacc

SEQ ID NO: 54663 - RNA, 624 nt, synthetic construct
  misc_feature 1..624: note = derived and/or modified sequence opt11 from anti-HIV_5H/I1-BMV-D5_LightChain
  source 1..624: mol_type = other RNA
gacatccaaatgacccaatccccctccaccctctccgcctccatcggcgaccgcgtcaccataacctgccgcgcctccgaaggcatctaccactggctcgcctggtaccaacaaaaacccggcaaagcccccaaactcctaatctacaaagcatcctccctcgcctccggcgcaccatcccgcttctccggctcaggctcaggcaccgacttcaccctcaccatctcctccctccaacccgacgacttcgccacctactactgccaacaatactcaaactaccccctcaccttcggcggcggaacaaaactcgaaatcaaacgcaccgtagccgccccatccgtcttcatcttcccaccctcagacgaacaactcaaatcaggcaccgcgtccgtcgtctgcctcctcaacaacttctacccccgcgaagccaaagtccaatggaaagtcgacaacgccctccaatccggaaactcccaagaatccgtcaccgaacaagactccaaagactccacctacagcctctcatccaccctcaccctctccaaagcagactacgaaaaacacaaagtctacgcctgcgaagtcacccaccaaggcctctcctcccccgtcaccaaatcc

SEQ ID NO: 54664 - RNA, 651 nt, synthetic construct
  misc_feature 1..651: note = derived and/or modified sequence opt11 from anti-HIV_5H/I1-BMV-D5_HeavyChain
  source 1..651: mol_type = other RNA
caagtccaactcgtccaatccggcgccgaagtacgcaaacccggcgcctcagtaaaagtctcctgcaaagcctccggcgacaccttctcctcctacgcaatctcatgggtccgccaagcccccggacaaggcctcgaatggatgggcggcatcatcccaatcttcggcaccgccaactacgcccaagccttccaaggacgcgtcaccatcaccgccaacgaatccacctccaccgcatacatggaactctcatcactccgatcagaagacaccgccatctactactgcgcacgcgacaaccccaccctcctcggctccgactactggggtgccggaaccctcgtcacagtctcctccgcctcaaccaaaggcccatccgtcttccccctagccccctgctcccgctccacctccggcggcaccgccgccctcggatgcctagtcaaagactacttcccagaaccagtcaccgtctcctggaactccggcgccctcacctccggcgtccacaccttccccgcagtcctccaatcctcaggcctctactccctctcctccgtcgtaaccgtcccctcctcctccctcggcacccaaacctacatctgcaacgtcaaccacaaaccctccaacaccaaagtcgacaaacgcgtc

SEQ ID NO: 54665 - RNA, 657 nt, synthetic construct
  misc_feature 1..657: note = derived and/or modified sequence opt11 from anti-HIV_5H/I1-BMV-D5_A-Chain
  source 1..657: mol_type = other RNA
atgcaactactctcaggcatcgtacaacaacaaaacaacctcctccgcgccatcgaagcccaacaacacctactccaactaaccgtctggggcataaaacaactccaagcccgcatcctcgccggcggctccggcggccacaccacctggatggaatgggacagagaaatcaacaactacacctccctaatccactccctaatcgaagaatcccaaaaccaacaagaaaaaaacgaacaagaactcctcgaaggcagctccggcggacaactcctctccggcatcgtccaacaacaaaacaacctactccgcgccatcgaagcccaacaacacctcctccaactaaccgtctggggcatcaaacaactacaagcccgcatactcgcaggcggaagcggcggccacaccacatggatggaatgggaccgcgaaatcaacaactacacaagcctcatacacagcctaatcgaagaatcccaaaaccaacaagaaaaaaacgaacaagaactcctagaaggatcctcaggcggccaactactcagcggcatcgtccaacaacaaaacaacctcctccgcgccatcgaagcccaacaacacctcctacaactcacagtctggggcatcaagcaactacaagcccgcatcctcgcaggcggc

SEQ ID NO: 54666 - RNA, 390 nt, synthetic construct
  misc_feature 1..390: note = derived and/or modified sequence opt11 from anti-HIV_8ANC195_LightChain
  source 1..390: mol_type = other RNA
gacatccaaatgacccaatccccctccaccctctccgcctccatcggcgacaccgtccgcatctcctgccgcgcatcccaatccatcaccggcaactgggtcgcctggtaccaacaacgccccggcaaagccccccgcctcctcatctaccgcggcgccgccctcctcggcggcgtcccctcccgcttctccggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttcatcttccccccctccgacgaacaactcaaatccggcacc

SEQ ID NO: 54667 - RNA, 423 nt, synthetic construct
  misc_feature 1..423: note = derived and/or modified sequence opt11 from anti-HIV_8ANC195_HeavyChain
  source 1..423: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcccccggccaatccctcgaatacatcggccaaatctggcgctggaaatcctccgcctcccaccacttccgcggccgcgtcctcatctccgccgtcgacctcaccggctcctccccccccatctcctccctcgaaatcaaaaacctcacctccgacgacaccgccgtctacttctgcaccaccacctccacctacgacaaatggtccggcctccaccacgacggcgtcatggccttctcatcctggggccaaggcaccctcatctccgtctccgccgcctccaccaaaggaccctccgtcttc

SEQ ID NO: 54668 - RNA, 333 nt, synthetic construct
  misc_feature 1..333: note = derived and/or modified sequence opt11 from anti-HIV_CAP256-VRC26.01_LightChain
  source 1..333: mol_type = other RNA
caatccgtcctcacccaacccccctcagtctccgccgcccccggccaaaaagtcaccatatcctgctccggctcctcctccaccatcggcaacaactacgtctcctggtaccgactcctccccggcaccgcccccaaactcctcatctacaaaaacgacaaccgcccctcaggcatccccgaccgcttctccggctccaaatccggcacctccgccaccctcggcatctccggcctccaaaccggcgacgaagccgactactactgcggcacctgggacacctccctctccggcggcggcgtcttcggcaccggcaccaaagtcaccgtcctc

SEQ ID NO: 54669 - RNA, 432 nt, synthetic construct
  misc_feature 1..432: note = derived and/or modified sequence opt11 from anti-HIV_CAP256-VRC26.01_HeavyChain
  source 1..432: mol_type = other RNA
gaagtgcaagtggtcgagagcgggggcggggtcgtgcaaccgggcaggagcttgcgcttgagctgtaccgcgagcgggttcacgttctcgaactttgccatgggctgggtcaggcaagcgcccgggaaagggctcgagtgggtggcctttatctcgagcgatggctcgaacaagaactatggcgatagcgtaaaagggcgctttaccataagcagggacaatagcaagaacacggtctttctccagatgaatagcttgcgcgtggaagataccgcgctctattactgtgccaaggacgtgggcgattacaagagcgatgaatggggaacggaatattacgatatctcgatctcgtacccgatccaggacccgcgcgcgatggtgggcgcgttcgatctctggggccagggcacaatggtgaccgtgagcccg

SEQ ID NO: 54670 - RNA, 324 nt, synthetic construct
  misc_feature 1..324: note = derived and/or modified sequence opt11 from anti-HIV_CAP256-VRC26.02_LightChain
  source 1..324: mol_type = other RNA
caatccgtcctcacccaacccccctccgtctccgccgcccccggccaaaaagtcaccatctcctgctccggctccaactccaacatcggcaacaaagacgtctcctggtaccaacaaatccccgccaccgcccccaaactcctcatctacgaaaacaacaaacgcccctccggcatctcagaccgcttctccggctccaaatccggcacctccgccaccctagccatcaccggcctccaaaccggcgacgaagccgactactactgcgccacatgggacggccgcgtctccgtcatcggcaccggcaccaacgtcatcgtcctc

SEQ ID NO: 54671 - RNA, 432 nt, synthetic construct
  misc_feature 1..432: note = derived and/or modified sequence opt11 from anti-HIV_CAP256-VRC26.02_HeavyChain
  source 1..432: mol_type = other RNA
gaagtgcaattggtcgagagcgggggcggggtcgtgcaaccgggcaggagcctgcgcttgagctgtgccgcgagccagttctcgttcgggaactatggcatgcactgggtcaggcaagcgcccgggaaagggctcgagtgggtggccgcaatctcgttcgcgggcacgaaaacgaactatgccgatagcgtgaaagggcgctttaccataagcagggacaatagcaagaacacggtctatctccagatgaatagcttgcgcgcggaagataccgcgctatatttctgtgccaaggacatacgagagtacgagtgcgagtactggacctcggactattacgatttcgggcgcccgcaaccgtgcatagactcgcgcggggtcgtgggcacgttcgatgtctggggccagggcacgatggtgaccgtgagctca

SEQ ID NO: 54672 - RNA, 333 nt, synthetic construct
  misc_feature 1..333: note = derived and/or modified sequence opt11 from anti-HIV_CAP256-VRC26.03_LightChain
  source 1..333: mol_type = other RNA
caatccgtcctcacccaacccccctccgtctccgccgcccccggccaaaaagtcaccatctcctgctccggctcctcctccaacatcggcaacaacttcgtctcctggtaccaacaacgccccggcaccgcccccaaaatcctcatctacgaaaacaacaaacgcccctccgaaacccccgaccgcttctccggctccaaatccggcacctccgccaccctcgccatcaccggcctccaaaccgccgacgaagccgaatactactgcgccacctggtccgcctccctctcctcagcccgcgtcttcggcaccggcacccgcatcaccgtcctc

SEQ ID NO: 54673 - RNA, 432 nt, synthetic construct
  misc_feature 1..432: note = derived and/or modified sequence opt11 from anti-HIV_CAP256-VRC26.03_HeavyChain
  source 1..432: mol_type = other RNA
gaagtgcaattggtcgagagcgggggcggggtcgtgcaaccgggcaagagcttgcgactgagctgtgccgcgagcaggttctcgttcaatcgctatggcatgcactgggtcaggcaagcgcccgggaaagggctcgagtgggtggccgcgatctcgtacgatggcacggacaagtaccatgccgataaagtgtgggggcgctttaccataagcagggacaatagcaagaacacgctctatctccagatgaatagcttgcgcgcggaagataccgcgctctattactgtgccaaggacttgcgcgaggacgagtgcgaggaatggtggtcggactattacgatttcgggaaacagctcccgtgcaggaaatcgcgcggggtcgcgggcatattcgatggctggggccagggcacgatggtgaccgtgagctca

SEQ ID NO: 54674 - RNA, 333 nt, synthetic construct
  misc_feature 1..333: note = derived and/or modified sequence opt11 from anti-HIV_CAP256-VRC26.04_LightChain
  source 1..333: mol_type = other RNA
caacccgtcctcacccaaccaccctccgtctccgccgcccccggccaaaaagtcaccatctcctgctccggctcctcctccaacatcggcaacaacttcgtctcctggtaccaacaacgccccggcaccgccccctccctactcatctacgaaaccaacaaacgcccctccggcatccccgaccgcttctccggctccaaatccgccacctccgccaccctcgccatcaccggcctccaaaccggcgacgaagccgactactactgcgccacctgggccgcctccctcacctccgcccgcgtcttcggcaccggcaccaaagtcatcgtctcc

SEQ ID NO: 54675 - RNA, 432 nt, synthetic construct
  misc_feature 1..432: note = derived and/or modified sequence opt11 from anti-HIV_CAP256-VRC26.04_HeavyChain
  source 1..432: mol_type = other RNA
gaagtgcaattggtcgagagcggaggcggggtcgtgcaaccgggcaagagcttgcgcttgagctgtgccgcgagccagttctcgttcaatcgctatggcatgcactgggtcaggcaagcgcccgggaaagggctcgagtgggtggccgcgatctcgtacgatggaacggacaagtaccacgcagataaagtgtgggggcgctttaccataagcagagacaatagcaagaacacgctctatctccagatgaatagcttgcgcgcggaagataccgcgctctattactgtgccaaggacttgcgcgaggacgagtgcgaggaatggtggtcggactattacgatttcgggaaacagctcccgtgcaggaaatcgcgcggggtcgcgggcatattcgataaatggggccagggcacgatggtgatcgtgagctcg

SEQ ID NO: 54676 - RNA, 324 nt, synthetic construct
  misc_feature 1..324: note = derived and/or modified sequence opt11 from anti-HIV_CAP256-VRC26.05_LightChain
  source 1..324: mol_type = other RNA
cagagcgcgctcacgcaaccgccctcggtctcggccgcgcccgggcaaaaggtcacaatctcatgctcgggcaatatcgggaacaattacgtgagctggtaccagcaagtgcccgggaccgcgcccaagctattgatctatgaaaataacaagcgcccgagcgggatcccggacaggttctcgggctcgaaatcgggcacgagcgcgaccttggtcataaccgggctccagaccggggacgaggccgatttctattgcgggacctggggcgggagcttgcgcacgggcggggtcttgggcacgggcacgcgcgtgaccgtgctc

SEQ ID NO: 54677 - RNA, 432 nt, synthetic construct
  misc_feature 1..432: note = derived and/or modified sequence opt11 from anti-HIV_CAP256-VRC26.05_HeavyChain
  source 1..432: mol_type = other RNA
gaagtgcaattggtcgagagcgggggcggggtagtgcaaccgggcaggagcttgcgcttgagctgtgccgcgagccatttctcgctctcgagctatggcatgcactgggtcaggcaagcgccagggaaagggctcgagtgggtgaccgggatctcgttcgcgggcacgaaaacgtactatggagatagcgtgcgcgggcgctttaccgtgagcagggacataagcaagaacacgctatttctccagatgaatagcctgcgcccggacgataccgcgatgtattactgtgccagggaccagcgctattacgagtgcgaggaatgggcctcggactattacgatttcgggcgcgagcaaccgtgcttggacccgcgcggggtcgtgggcatattcgatctctggggccagggcacgatggtgaccgtgagctcg

SEQ ID NO: 54678 - RNA, 324 nt, synthetic construct
  misc_feature 1..324: note = derived and/or modified sequence opt11 from anti-HIV_CAP256-VRC26.06_LightChain
  source 1..324: mol_type = other RNA
caatcagtcctcacccaacccccctcagtctccgccgcccccggccaaaaagtcaccatctcctgctccggctccacctccaaaatcggccaaaactccgtctcctggtaccaacaactacccggcaccgcccccaaactcctcatctacgaaaacgaccgccgcccctccggcacccccgaccgcttctccggctccaaatccggcacctccgccaccctcgccatcaccggcctccaaaccggcgacgaagccgaatactactgcgaaacctgggacggctccggcggcgtcttcggcaccggcaccaaagtcaccgtcctc

SEQ ID NO: 54679 - RNA, 435 nt, synthetic construct
  misc_feature 1..435: note = derived and/or modified sequence opt11 from anti-HIV_CAP256-VRC26.06_HeavyChain
  source 1..435: mol_type = other RNA
gaagtgcaattgatagagagcgggggcggggtcgtgcaaccgggcaggagcttgcgattgagctgtggcgcgagcgggttctcgttcaataactatggcatgcactgggtaaggcaagcgcccgggaaagggctcgagtgggtggccgggatctcgttcgcgggcatcaaaaagtactatggcacgagcgtaaaagggagatttacaataagcagggacaatagcaagaacaatttctatctacagatgaatagcttgcgagtggaagataccgcgctatattactgtgccagggacttgcgcgagctcgagtgcgaggaatggaccttgtacaattactatgactttggctcgagagggccctgtgtcgatcccaggggcgtggccgggagctttgacgtgtgggggcaagggaccatggtcacggtctcgagc

SEQ ID NO: 54680 - RNA, 333 nt, synthetic construct
  misc_feature 1..333: note = derived and/or modified sequence opt11 from anti-HIV_CAP256-VRC26.07_LightChain
  source 1..333: mol_type = other RNA
caagccgtcctcacccaaccaccctccgtctccgccgcccccggccaaaacgtcaccatctcctgctccggctccggctcaaacatcggcaacaacttcgtctcctggtaccaacaacgccccggcaccgcccccaaactcctcatctacgaatccaacaaacgcccctccggcatccccgaccgcttctccggctccaaatccggcacctccgccaccctcgccatcaccggcctacaaaccggcgacgaagcctactactactgcgccacctgggccgcccgcctcaactccgcccgcgtcttcggcaccggaaccatggtcaccgtcctc

SEQ ID NO: 54681 - RNA, 432 nt, synthetic construct
  misc_feature 1..432: note = derived and/or modified sequence opt11 from anti-HIV_CAP256-VRC26.07_HeavyChain
  source 1..432: mol_type = other RNA
gaagtgcaattggtcgagagcggaggcggggtcgtgcaaccgggcaggagcttgcgcttgagctgtgtcgggagccagttctcgttcaatcgctatggcatgcactgggtcaggcaagcgcccgggaaagggctcgagtgggtggccgggatctcgttcgatggcacggacaggtaccatgccgataacgtgtgggggcgctttacaataagcagggacaatagtaagaacacgctctatctccagatgtcgagcttgcgcgcggaagataccgcgctctattactgtgccaaggacttgcgcgaggacgagtgcgaggaatggtggtcggactattacgatttcgggaaaaagctcccgtgcaggaaatcgcgcggggtcgcgggcgtgttcgataaatggggccagggcacgatggtgaccgtgagctcg

SEQ ID NO: 54682 - RNA, 333 nt, synthetic construct
  misc_feature 1..333: note = derived and/or modified sequence opt11 from anti-HIV_CAP256-VRC26.08_LightChain
  source 1..333: mol_type = other RNA
caatcagccttgacccagcccccaagcgtgagcgcggccccgggccagaaagtgaccataagctgtagcgggaactcgagcaatatcgggaacaatttcgtgagctggtaccagcaagtgcccgggaccgcgcccaagctcttgctctatgaaacgtacaggcgcccgagcgggatcccggacaggttctcgggctcgaaatcgggcacgagcgcgaccttggccataaccgggctccagaccggggacgaggccgattactattgcacggtctggggcgtgcgaaagggcgtgggcgcggtctttggcacgggcacgaaagtgaccgtgctc

SEQ ID NO: 54683 - RNA, 438 nt, synthetic construct
  misc_feature 1..438: note = derived and/or modified sequence opt11 from anti-HIV_CAP256-VRC26.08_HeavyChain
  source 1..438: mol_type = other RNA
gaagtgcaattggtcgagagcgggggcggggtcgtgcaaccgggcaggagcttgaccttgagctgtgccgcgagccagttcacgttctcgaactatggcatgcactgggtcaggcaagcgcccgggaaagggctcgagtgggtggcctcggtctcaaacgatggcacgaaaaagtaccatggcgatagcgtgtgggggcgctttaccataagcagggacaatagcaagaacacgctatttctccagatgtcgagcttgcgcgcggaagataccgcggtctatttctgtgtcagggaccagcgcgaggacgagtgcgaggaatggtggtcggactactacgatttcgggcgcgagctcccgtgcaggaaatttcgcgggctaggactcgcgggcatattcgatatctggggccatggcacgatggtgaccgtgagctcg

SEQ ID NO: 54684 - RNA, 333 nt, synthetic construct
  misc_feature 1..333: note = derived and/or modified sequence opt11 from anti-HIV_CAP256-VRC26.09_LightChain
  source 1..333: mol_type = other RNA
caatcggccttgacccagcccccgagcgtaagcgcggccccgggccagaaagtgaccataagctgtagcgggaactcgagcaatatcgggaacaatttcgtgagctggtaccagcaattgcccgggaccgcgcccaagctcttgatctatgaaaataacaggcgcccgagcgggatcccggacaggttctcgggctcgaaatcgggcacgagcgcgaccttggccataagcgggctccagaccggggacgaggccgattactggtgcgcggtctggggcgtgcgcaggggcgcaggcgcggtctttggcgcgggcacgaaagtgaccgtgctc

SEQ ID NO: 54685 - RNA, 438 nt, synthetic construct
  misc_feature 1..438: note = derived and/or modified sequence opt11 from anti-HIV_CAP256-VRC26.09_HeavyChain
  source 1..438: mol_type = other RNA
gaagtgcaattggtcgagagcgggggcggggtcgtgcaaccgggaaggagcttgaccttgagctgtgccgcgagccagttcaatttcgcgaactatggcatgcactgggtcaggcaagcgcccgggaaagggctcgagtgggtggcctcgatctcgaacgatggcacgaaaaagtaccatgaagagagcgtgtgggggcgctttaccataagcaaggacaatagcaagagcacgctctttctccagatgaatagcttgcgcatagaagataccgcgctctatttctgtgtcaaggaccagcgcgaggacgagtgcgaggaatggtggtcggactattacgatttcgggcgagagctcccgtgcaggaaatcgcgcgggctcgggctcgcgggaatattcgatatgtggggccatggcacgatggtgaccgtgagctcg

SEQ ID NO: 54686 - RNA, 333 nt, synthetic construct
  misc_feature 1..333: note = derived and/or modified sequence opt11 from anti-HIV_CAP256-VRC26.10_LightChain
  source 1..333: mol_type = other RNA
caatccgtcctcacccaacccccctccgtctccgccgcccccggccaaaaagtcaccatctcctgctccggctcctcctccaacatcggcgacaactacgtctcctggtaccaacacctccccggcaccgcccccaaactcctcatctacgaaaacacccgccgcccctccggcatccccgaccgcttctccggctccaaatccggcacctccgccaccctcgccatcaccggcctccaaaccggcgacgaagccgactactactgcggcacctgggacgtccgccccaaccgcggcgccgtcttcggcaccggcaccaaagtcaccgtcctc

SEQ ID NO: 54687 - RNA, 432 nt, synthetic construct
  misc_feature 1..432: note = derived and/or modified sequence opt11 from anti-HIV_CAP256-VRC26.10_HeavyChain
  source 1..432: mol_type = other RNA
caagcgatcttggtcgagagcgggggcggggtcgtgcaaccgggcaggagcttgcgcttgagctgtgccgcgagccagttcacgttctcgggccatggcttgcactgggtcaggcaagcgcccgggaaagggctcgagtgggtggcctcgatctcgttcgcgggcacgaaaatggactatgccgatagcgtgaaagggcgatttgccataagcagggacaatagcaagaacacgctctatctccagatgaatagcttgcgcgtggaagataccgcgctctattactgtgccaaggacatgcgcgagtacgagtgcgagtactggacctcggactattacgatttcgggcgcccgcaaccgtgcatagacaggcgcggggtcgtgggcatattcgatatgtggggccagggcacgatggtgaccgtgagcacg

SEQ ID NO: 54688 - RNA, 321 nt, synthetic construct
  misc_feature 1..321: note = derived and/or modified sequence opt11 from anti-HIV_CAP256-VRC26.11_LightChain
  source 1..321: mol_type = other RNA
caatccgtcctcacccaacccccctccgtctccgccgcccccggccaaaacgtcaccatctcctgctccggccccccctcccacatcgaaaaaaacgacgtctcctggtaccaacgcctccccggcatggcccccaaaatggtaatctacgaatccaaacgccgccccctcggcatccccgtccgcttctccgcctcccgctccggctcctccgccaccctcgtcatcaccggcctccaaacagccgacgaagccgactactactgcggcacctgggacggccgcatgaacttcggcaccggcacaaccgtctccgtcctc

SEQ ID NO: 54689 - RNA, 429 nt, synthetic construct
  misc_feature 1..429: note = derived and/or modified sequence opt11 from anti-HIV_CAP256-VRC26.11_HeavyChain
  source 1..429: mol_type = other RNA
gaggtgcagttggtggagagtggggggggggtggtgccgccggggaagagtttgacgttgagttgtgtggcgagtaggtttacgtttagtgcgtttgggatgcattgggtgaggcaggcgccggggaaggggttggagtgggtggcgagtataagttttgcggggataaagaagtattatgcggacagcgtgaaggggaggtttagtataagtagagataatagtaatacgttgtttttgcagatgaatgggttgaggggggaggatacggggttgtatcattgtgtgaaggatatgagggagttggagtgtgaggagtgggcgagtgattattatgattttgggaagccgcagccgtgtttggatagaaggggggtgagtgggataagtgcgtggtgggggccagggacgatggtgacggtgagtagt

SEQ ID NO: 54690 - RNA, 321 nt, synthetic construct
  misc_feature 1..321: note = derived and/or modified sequence opt11 from anti-HIV_CAP256-VRC26.12_LightChain
  source 1..321: mol_type = other RNA
caatcagtcctcacccaacccccctccgtctctaccgcccccggccaaaccgtcaccgtctcctgctccggaggcacctccaacaccggcaacaacttcgtctcctggtaccaacacctccccggcaccgcccccaaactcctcatctacgaaaacaacaaacgccccctcggcgtccccgaccgcttctccggcgccaaatccggcacctccgccaccctcgccatcaccggcctccaaaccggcgacgaaggcgactactactgcgccacctggtccggctccctcaacatcggcaccggcaccaaagtctccgtcctc

SEQ ID NO: 54691 - RNA, 432 nt, synthetic construct
  misc_feature 1..432: note = derived and/or modified sequence opt11 from anti-HIV_CAP256-VRC26.12_HeavyChain
  source 1..432: mol_type = other RNA
gaagtgcaattggtccagagcgggggcggggtcgtgcaaccgggcaggagcttgcgcttgagctgtgccgcgccctatttcgagttcgggcgctatggctttcactgggtcaggcaagcgcccgggaaagggctcgagtgggtggcatcgatctcgttcgcgggcagggactattaccatagcccgagtgtgtgggggcgctttaccataagcagggacaatagtaagaacacgctctatctccagatgaatagcctgcgcatagaagataccgcgctatatttctgtgccagggacttgcgcgagagcgagtgcgaggaatgggaatcggactattacgatttcgggaaaaagggcccgtgcgtgaaaccgcgcggggtcgcgggcgggctcgatctctggggccagggcacgatggtgatcgtgagctcg

SEQ ID NO: 54692 - RNA, 333 nt, synthetic construct
  misc_feature 1..333: note = derived and/or modified sequence opt11 from anti-HIV_CAP256-VRC26.I1_LightChain
  source 1..333: mol_type = other RNA
caatccgtcctcacccaacccccctccgtctccgcagcccccggccaaaaagtcaccatctcctgctccggctcctcctccaacatcggcaacaactacgtctcctggtaccaacaactccccggcaccgcccccaaactcctcatctacaaaaacaacgaacgcccctccggcatccccgaccgattctccggctccaaatccggcacctccgccaccctcggcatcaccggcctccaaaccggcgacgaagccgactactactgcggcacctgggacacctccctctccgccggcggcgtcttcggcaccggcaccaaagtaaccgtcctc

SEQ ID NO: 54693 - RNA, 432 nt, synthetic construct
  misc_feature 1..432: note = derived and/or modified sequence opt11 from anti-HIV_CAP256-VRC26.I1_HeavyChain
  source 1..432: mol_type = other RNA
caagtgcaactggtcgagagcgggggcggggtcgtgcaaccgggcaggagcctgcgcttgagctgtgccgcgagcgggttcacgttctcgaactatgccatggactgggtcaggcaagcgccagggaaagggctcgagtgggtagccgtgatctcaagcgatggctcgaacaagaactatgccgatagcgtgaaagggcgctttaccataagcagggacaatagcaagaacacgctctatctccagatgaatagcttgcgcgcggaagataccgcggtctattactgtgccaaggacttgggcgagaacaagaacgatgaatgggccacggactattacgatctctcgatcgcgtacccggtccaggacccgcgcgcggtcgtgggcgcgttcgatatctggggccagggcacgatggtgaccgtgagctcg

SEQ ID NO: 54694 - RNA, 333 nt, synthetic construct
  misc_feature 1..333: note = derived and/or modified sequence opt11 from anti-HIV_CAP256-VRC26.I2_LightChain
  source 1..333: mol_type = other RNA
caatccgtcctcacccaacccccctccgtctccgccgcccccggccaaaaagtcaccatctcctgctccggctcctcctccaccatcggcaacaactacgtctcctggtaccaactactccccggcaccgcccccaaactcctcatctacaaaaacgacaaacgcccctcaggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 54695 - RNA, 432 nt, synthetic construct
  misc_feature 1..432: note = derived and/or modified sequence opt11 from anti-HIV_CAP256-VRC26.I2_HeavyChain
  source 1..432: mol_type = other RNA
caagtgcaattggtcgagagcgggggcggggtcgtgcaaccgggcaggagcttgcgcttgagctgtgccgcgagcgggttcacgttctcgaactttgccatgggatgggtaaggcaagcgcccgggaaagggctagagtgggtggcctttatctcgagcgatggctcgaacaagaactatggcgatagcgtgaaagggcgctttaccataagcagggacaatagcaagaacacgctctttctccagatgaatagcctgcgcgcggaagataccgcgctctattactgtgccaaggacgtgggcgagtacaagagcgatgaatgggccacggactactacgatctctcgatcgcgtacccgatacaggacccgcgcgcgatggtgggcgcgttcgatatctggggccagggcacgatggtgaccgtgagctcg

SEQ ID NO: 54696 - RNA, 333 nt, synthetic construct
  misc_feature 1..333: note = derived and/or modified sequence opt11 from anti-HIV_CAP256-VRC26.UCA_LightChain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaacaggcgacgaagccgactactactgcggcacctgggactcctccctctccgccggcggcgtcttcggcacaggcaccaaagtcaccgtcctc

SEQ ID NO: 54697 - RNA, 432 nt, synthetic construct
  misc_feature 1..432: note = derived and/or modified sequence opt11 from anti-HIV_CAP256-VRC26.UCA_HeavyChain
  source 1..432: mol_type = other RNA
caagtgcaattggtcgagagcgggggcggggtcgtgcaaccgggcaggagcttgcgcttgagctgtgccgcgagcgggttcacgttctcgagctatggcatgcactgggtcaggcaagcgcccgggaaagggctcgagtgggtggccgtgatctcgtacgatggctcgaacaagtactatgccgatagcgtgaaagggcgctttacaataagcagggacaatagcaagaacacgctatatctccagatgaatagcttgcgcgcggaagataccgcggtctattactgtgcaaaggacttgggcgagagcgagaacgaggaatgggccacggactattacgatttctcgatcgggtacccgggccaggacccgcgcggggtcgtgggcgcgttcgatatatggggccagggcacgatggtgaccgtgagctcg

SEQ ID NO: 54698 - RNA, 324 nt, synthetic construct
  misc_feature 1..324: note = derived and/or modified sequence opt11 from anti-HIV_CH01_LightChain
  source 1..324: mol_type = other RNA
gaaatcgtactcgcacaatcacccggaaccctaagcctaagcccaggcgaacgcgcaaccctaagctgccgcgccagccacaacgtacacccaaaatacttcgcctggtaccaacaaaaaccaggccaaagcccacgcctactcatatacggaggctcaaccagagccgcaggcatacccggaaaattcagcggcagcggaagcggaaccgacttcacactcacaatctcacgcgtagacccagaagacttcgcagtctactactgccaacaatacggaggctcaccctacaccttcggccaaggcacaaaagtagaaataaaa

SEQ ID NO: 54699 - RNA, 399 nt, synthetic construct
  misc_feature 1..399: note = derived and/or modified sequence opt11 from anti-HIV_CH01_HeavyChain
  source 1..399: mol_type = other RNA
gaggtccagctagtggaatcgggcgcgaacgtggtcaggcccgggggctcgctcaggctctcgtgcaaggcctcgggctttatatttgaaaatttcgggttctcgtgggtgcgacaggccccgggcaagggcttgcaatgggtcgcgggcttgaactggaacgggggcgataccaggtacgcggactcggtcaagggcaggttcaggatgtcgcgcgataactcgcgcaatttcgtgtacttggacatggacaaggtcggggtcgatgacacggccttttactattgcgcgcgcgggaccgattacacgatcgatgacgcgggcatacactatcaagggagcgggaccttttggtatttcgatctctggggcaggggcacgctcgtgagcgtgagctcg

SEQ ID NO: 54700 - RNA, 324 nt, synthetic construct
  misc_feature 1..324: note = derived and/or modified sequence opt11 from anti-HIV_CH02_LightChain
  source 1..324: mol_type = other RNA
gaaatcgtactcacacaatcacccgcaaccctaagcgtcagcccaggcgaacgcgcaaccctaagctgccgcgccagccaaaacgtacacccacgctacttcgcctggtaccaacaaaaacgcggccaaagcccaagactactcatacactccggctcaaccagagccgcaggcatagccgaccgcttcagcggcggcggatccggaatgcacttcacactcacaatcacacgcgtagaaccagaagacttcgcagtctacttctgccaacaatacggaggctcaccctacaccttcggccaaggcacacgcgtagaactacgc

SEQ ID NO: 54701 - RNA, 399 nt, synthetic construct
  misc_feature 1..399: note = derived and/or modified sequence opt11 from anti-HIV_CH02_HeavyChain
  source 1..399: mol_type = other RNA
gaggtccagctcgtggaatcgggcgggagcgtggtcaggcccgggggctcgctcaggctctcgtgcagggcctcgggctttatctttgaaaattacgggctcacgtgggtgcgccaggtcccgggcaagggcttgcactgggtctcgggcatgaactggaacgggggcgataccaggtacgcggactcggtcaggggcaggttctcgatgtcgcgcgataactcgaacaatatcgcgtacttgcaaatgaacaatctcagggtcgaggacacggccttgtactattgcgcgcgcgggaccgattacacgatcgatgaccagggaaggttctatcaagggagcgggaccttttggtatttcgatttctggggcaggggcacgctcgtgaccgtgagctcg

SEQ ID NO: 54702 - RNA, 324 nt, synthetic construct
  misc_feature 1..324: note = derived and/or modified sequence opt11 from anti-HIV_CH03_LightChain
  source 1..324: mol_type = other RNA
gaaatcgtcctcacccaatcccccgccaccctctccctctcccccggcgaacgcgccaccctctcctgccgcgcctcccaatccgtccaccccaaatacttcgcctggtaccaacaaaaacccggccaatccccccgcctcctcatctactccggctccacccgcgccgccggcatcgccgaccgcttctccggcggcggctccggcatccacttcaccctcaccatcacccgcgtcgaacccgaagacttcgccgtctacttctgccaacaatacggcggctccccctacaccttcggccaaggcaccaaagtcgaactacgc

SEQ ID NO: 54703 - RNA, 399 nt, synthetic construct
  misc_feature 1..399: note = derived and/or modified sequence opt11 from anti-HIV_CH03_HeavyChain
  source 1..399: mol_type = other RNA
gaggtgcagttggtggagagcggggggggggtggtgaggccggggggaagcctgaggctgagctgtgcggcgagcgggttcatatttgagaattatgggttaacgtgggtgaggcaagtgccggggaaggggctgcattgggtgagcgggatgaattggaatgggggggacacgaggtatgcggatagcgtgagggggaggtttagtatgagcagagataatagcaataatatagcgtatctgcagatgaagaacctgagggtggacgatacggcgctgtattactgtgcgagggggacggattatacgatagacgatcaggggatattttataaggggagtgggacgttctggtactttgacctgtgggggagggggacgttggtgacggtgagtagt

SEQ ID NO: 54704 - RNA, 324 nt, synthetic construct
  misc_feature 1..324: note = derived and/or modified sequence opt11 from anti-HIV_CH04_LightChain
  source 1..324: mol_type = other RNA
gaaatcgtcctcacccaatcccccgacaccctatccctctcccccggcgaacgcgccaccctatcctgccgcgcctcccaatccgtccactcccgctacttcgcctggtaccaacacaaacccggccaacccccccgcctcctcatctacggcggctccacccgcgccaccggcatccccaaccgcttctccgccggcggctccggcacccaattcaccctcaccgtcaaccgcctcgaagccgaagacttcgccgtctactactgccaacaatacggccgctccccctacaccttcggccaaggcacaaaagtcgaaatccgc

SEQ ID NO: 54705 - RNA, 399 nt, synthetic construct
  misc_feature 1..399: note = derived and/or modified sequence opt11 from anti-HIV_CH04_HeavyChain
  source 1..399: mol_type = other RNA
gaggtgcagttggtggagagtgggggggggttgataaggccgggggggagtttgcggttgagttgtaaggggagtggatttatatttgagaattttgggtttgggtgggtgaggcaggggccggggaaggggttggagtgggtgagtgggacgaattggaatgggggggatagcaggtatggggatagtgtgaaggggaggtttacgataagtagggataatagtaataattttgtgtatttgcagatgaatagtttgaggccggaggatacggcgatatattattgtgcgagggggacggattatacgatagatgatcaggggataaggtatcaggggagcgggacgttttggtattttgatgtgtgggggagggggacgttggtgacggtgagtagt

SEQ ID NO: 54706 - RNA, 627 nt, synthetic construct
  misc_feature 1..627: note = derived and/or modified sequence opt11 from anti-HIV_CH103_LightChain
  source 1..627: mol_type = other RNA
tacgaactcacccaacccccctccgtctccgtctcccctggccaaaccgccaccatcacctgctccggcgcctccaccaacgtctgctggtaccaagtcaaacccggccaatcacccgaagtcgtcatcttcgaaaactacaaacgcccctccggcatcccagaccgcttctcaggctccaaatccggctccaccgccaccctcaccatccgcggaacccaagcaatcgacgaagccgactactactgccaagtctgggactccttctccaccttcgtcttcggatccggtacccaagtcaccgtcctccgccaaccaaaagccaaccccaccgtcaccctcttccccccctcctccgaagaactccaagccaacaaagccaccctcgtctgcctaatttccgacttctaccccggcgccgtcaccgtcgcctggaaagccgactcatcccccgtcaaagccggcgtcgaaaccaccaccccctccaaacaatccaacaacaaatacgccgcctcctcctacctctccctcacccccgaacaatggaaatcacaccgctcctactcctgccaagtcacacacgaaggctccaccgtagaaaaaaccgtagcccccaccgaatgctca

SEQ ID NO: 54707 - RNA, 678 nt, synthetic construct
  misc_feature 1..678: note = derived and/or modified sequence opt11 from anti-HIV_CH103_HeavyChain
  source 1..678: mol_type = other RNA
caagtacaactccaagaatccggccccggcgtcgtcaaatcctcagaaaccctctccctcacatgcaccgtatcaggcggctcaatgggcggcacctactggtcctggctccgcctctcacccggcaaaggcctcgaatggatcggctacatcttccacacaggcgaaaccaactactcaccctccctcaaaggccgcgtctccatttccgtcgacacctccgaagaccaattctccctccgccttcgctccgtaaccgccgccgacaccgccgtctacttctgcgcctccctaccccgcggccaactcgtcaacgcctacttccgaaactggggccgcggctccctcgtttccgtcaccgcagcatccaccaaaggcccctccgtcttccccctcgccccctcctccaaatccacctccggcggaaccgccgccctcggctgcctcgtcaaagactacttccccgaacccgtcaccgtctcctggaactccggcgccctcacctccggcgtccacaccttccccgccgtcctccaatcctccggcctctactcactctcctccgtcgtcaccgtcccctcctcatccctcggcacacaaacctacatctgcaacgtcaaccacaaaccctccaacactaaagtagacaaaaaagtcgaacccaaatcatgcgataaa

SEQ ID NO: 54708 - RNA, 321 nt, synthetic construct
  misc_feature 1..321: note = derived and/or modified sequence opt11 from anti-HIV_M66.6_LightChain
  source 1..321: mol_type = other RNA
gacatccaactcacccaatccccctcctccctctccgcctccgtcggcgaccgcgtcaccatcacctgccgcgcctcccaatccatcggctcctacctcaactggtaccaacaaaaacccggcaaagcccccaaactcctcatctacgccgcctccaccctccaatccggcgtaccctcccgcttctccggctccggctccggcaccgacttcaccctcaccatctcctccctccaacccgaagactccgccacctactactgccaacaatcctactccacccccttcaccttcggccccggcaccaaagtcgacatccgc

SEQ ID NO: 54709 - RNA, 390 nt, synthetic construct
  misc_feature 1..390: note = derived and/or modified sequence opt11 from anti-HIV_M66.6_HeavyChain
  source 1..390: mol_type = other RNA
caagtccaactcgtccaatccggcgccgaagtcaaaaaacccggcgaatccctaaaaatctcctgcaaagtctcaggctacaacttcgcctccgaatggatcggctgggtccgccaaatgcccggcaaaggcctcgaatggatgggcatcatctaccccggcgactccgacaccaaatactccccctccttccaaggccaagtcatcatctccgccgacaaatccatcaacaccgcctacctccaatggtcctccctcaaagcctccgacaccgccatctactactgcgcccgccaaaaccactacggctccggctcctacttctaccgcaccgcctactactacgccatggacgtctggggccaaggcaccaccgtcaccgtctcctcc

SEQ ID NO: 54710 - RNA, 327 nt, synthetic construct
  misc_feature 1..327: note = derived and/or modified sequence opt11 from anti-HIV_NIH45-46_LightChain
  source 1..327: mol_type = other RNA
gaaatcgtcctaacccaatcccccgccaccctctccctctcccccggcgaaaccgccatcatctcctgccgcacctcccaatccggctccctcgcctggtaccaacaacgccccggccaagccccccgcctcgtcatctactccggctccacccgcgccgccggcatccccgaccgcttctcaggctcccgctggggcgccgactacaacctctccatctccaacctcgaatccggcgacttcggcgtctactactgccaacaatacgaattcttcggccaaggcaccaaagtccaagtcgacatcaaacgcaccgtcgccgccccc

SEQ ID NO: 54711 - RNA, 399 nt, synthetic construct
  misc_feature 1..399: note = derived and/or modified sequence opt11 from anti-HIV_NIH45-46_HeavyChain
  source 1..399: mol_type = other RNA
caagtgcgcttgagccagagcgggggccagatgaagaaaccgggcgagagcatgcgcctgagctgtcgagcgagcgggtacgagttcctgaactgtcccataaactggatcaggctcgcgccagggcgcaggcccgagtggatgggatggctcaagcccaggggaggggccgtgaactatgcaaggaaatttcaagggagagtgacaatgaccagggacgtgtactcagacacggcatttctagagctcaggagcttgacctcggacgatacagcggtatatttctgtacaaggggcaagtactgtacggcgcgcgattactataactgggactttgaacattgggggcgcggggccccggtcacggtctccagcgcgagcacgaaagggccctcggta

SEQ ID NO: 54712 - RNA, 330 nt, synthetic construct
  misc_feature 1..330: note = derived and/or modified sequence opt11 from anti-HIV_PG16_LightChain
  source 1..330: mol_type = other RNA
caatccgccctcacccaacccgcctccgtctccggctcccccggccaaaccatcaccatctcctgcaacggcacctcctccgacgtcggcggcttcgactccgtctcctggtaccaacaatcccccggcaaagcccccaaagtcatggtcttcgacgtctcccaccgcccctccggcatctccaaccgcttctccggctccaaatccggcaacaccgcctccctcaccatctccggcctccacatcgaagacgaaggcgactacttctgctcctcactcaccgaccgctcccaccgcatcttcggcggcggcaccaaagtcaccgtcctc

SEQ ID NO: 54713 - RNA, 411 nt, synthetic construct
  misc_feature 1..411: note = derived and/or modified sequence opt11 from anti-HIV_PG16_HeavyChain
  source 1..411: mol_type = other RNA
caagagcaactggtcgagagcgggggcggggtcgtgcaaccgggagggagcttgcgcttgagctgtctcgcgagcgggttcacgttccataaatatggcatgcactgggtcaggcaagcgcccgggaaaggactcgagtgggtggccttgatctcggacgatggcatgcgcaagtaccatagcgatagcatgtgggggcgcgtgaccataagcagggacaatagcaagaacacgctctatctccagttctcgagcttgaaagtggaagataccgcgatgtttttctgtgccagggaagcgggcgggcccatatggcatgacgatgtcaagtactatgactttaacgatggctattacaactaccattacatggacgtgtgggggaaagggaccacggtcacggtctcgagc

SEQ ID NO: 54714 - RNA, 315 nt, synthetic construct
  misc_feature 1..315: note = derived and/or modified sequence opt11 from anti-HIV_PGT122_LightChain
  source 1..315: mol_type = other RNA
accttcgtatccgtcgcccccggccaaaccgcccgaatcacctgcggcgaagaatccctcggctcccgctccgtcatctggtaccaacaacgccccggccaagccccctccctcatcatctacaacaacaacgaccgcccctccggcatccccgaccgcttctccggctcccccggctccaccttcggcaccaccgccaccctcaccatcacctccgtcgaagccggcgacgaagccgactactactgccacatctgggactcccgacgccccaccaactgggtcttcggagaaggcaccaccctcatcgtcctc

SEQ ID NO: 54715 - RNA, 396 nt, synthetic construct
  misc_feature 1..396: note = derived and/or modified sequence opt11 from anti-HIV_PGT122_HeavyChain
  source 1..396: mol_type = other RNA
caagtccacctccaagaatccggccccggcctcgtcaaaccctccgaaaccctctccctaacctgcaacgtctccggcaccctcgtccgcgacaactactggtcctggatccgccaacccctcggcaaacaacccgaatggatcggctacgtacacgactccggcgacaccaactacaacccctccctcaaatcccgcgtccacctctccctagacaaatctaaaaacctagtctccctccgcctaaccggcgtcaccgccgccgactccgccatctactactgcgccaccaccaaacacggccgccgcatctacggcgtcgtcgccttcaaagaatggttcacctacttctacatggacgtctggggcaaaggcacctccgtcaccgtctcctcc

SEQ ID NO: 54716 - RNA, 315 nt, synthetic construct
  misc_feature 1..315: note = derived and/or modified sequence opt11 from anti-HIV_PGT123_LightChain
  source 1..315: mol_type = other RNA
tcctccatgtccgtctcccccggcgaaaccgccaaaatctcctgcggcaaagaatccatcggctcccgcgccgtccaatggtaccaacaaaaacccggccaacccccctcactcatcatctacaacaaccaagaccgccccgccggcgtccccgaacgcttctccgcctcacccgacttccgccccggcaccaccgccaccctcaccatcaccaacgtcgacgccgaagacgaagccgactactactgccacatctacgacgcccgcggcggcaccaactgggtcttcgaccgcggcaccaccctcaccgtcctc

SEQ ID NO: 54717 - RNA, 396 nt, synthetic construct
  misc_feature 1..396: note = derived and/or modified sequence opt11 from anti-HIV_PGT123_HeavyChain
  source 1..396: mol_type = other RNA
caactccacctccaagaatccggccccggcctcgtcaaaccccccgaaaccctctccctaacctgctccgtctccggcgcctccatcaacgacgcctactggtcctggatccgccaatcccccggcaaacgccccgaatgggtcggctacgtccaccactccggcgacaccaactacaacccctcactcaaacgccgagtcaccttctccctcgacaccgccaaaaacgaagtctccctcaaactcgtcgacctcaccgccgccgactccgccacctacttctgcgcccgcgcactccacggcaaacgcatctacggcatcgtcgccctcggcgaactcttcacctacttctacatggacgtctggggcaaaggcaccgccgtcaccgtctcctcc

SEQ ID NO: 54718 - RNA, 315 nt, synthetic construct
  misc_feature 1..315: note = derived and/or modified sequence opt11 from anti-HIV_PGT125_LightChain
  source 1..315: mol_type = other RNA
caatccgccctcacccaacccccctccgcctccggctcccccggccaatccatcaccatctcctgcaacggcaccgccaccaacttcgtctcctggtaccaacaattccccgacaaagcccccaaactcatcatcttcggcgtcgacaaacgcccccccggcgtccccgaccgattctccggctcccgctccggcaccaccgcctccctcaccgtctcccgcctccaaaccgacgacgaagccgtctactactgcggctccctcgtcggcaactgggacgtcatcttcggcggcggcacaaccctcaccgtcctc

SEQ ID NO: 54719 - RNA, 411 nt, synthetic construct
  misc_feature 1..411: note = derived and/or modified sequence opt11 from anti-HIV_PGT125_HeavyChain
  source 1..411: mol_type = other RNA
caatcccaactccaagaatccggcccccgcctcgtcgaagcctccgaaaccctctccctaacctgcaacgtctccggcgaatccaccggcgcctgcacctacttctggggctgggtccgccaagcccccggcaaaggcctcgaatggatcggctcactctcccactgccaatccttctggggctccggctggaccttccacaacccctccctcaaatcccgcctcaccatctccctcgacacccccaaaaaccaagtcttcctcaaactcacatccctcaccgccgccgacaccgccacctactactgcgcccgcttcgacggcgaagtcctcgtctacaaccactggcccaaacccgcctgggtcgacctctggggacgcggcatccccgtcaccgtcaccgtctcctcc

SEQ ID NO: 54720 - RNA, 315 nt, synthetic construct
  misc_feature 1..315: note = derived and/or modified sequence opt11 from anti-HIV_PGT126_LightChain
  source 1..315: mol_type = other RNA
caatccgccctcacccaacccccctccgcctccggctcccccggccaatccatctccatctcctgcaccggcacctccaaccgcttcgtctcctggtaccaacaacaccccggcaaagcccccaaactcgtcatctacggcgtcaacaaacgcccctccggcgtccccgaccgcttctccggctccaaatccggcaacaccgcctccctaaccgtctccggcctccaaaccgacgacgaagccgtctactactgctcctccctcgtcggcaactgggacgtcatcttcggcggcggcaccaaactcaccgtcctc

SEQ ID NO: 54721 - RNA, 411 nt, synthetic construct
  misc_feature 1..411: note = derived and/or modified sequence opt11 from anti-HIV_PGT126_HeavyChain
  source 1..411: mol_type = other RNA
caaccccaactccaagaatccggccccggactcgtcgaagcctccgaaaccctatccctaacctgcaccgtctccggcgactccaccgcagcctgcgactacttctggggctgggtccgccaaccacccggcaaaggcctcgaatggatcggcggcctatcacactgcgccggctactacaacaccggctggacctaccacaacccctccctcaaatcccgcctcaccatctccctcgacacccccaaaaaccaagtcttcctcaaactcaactccgtcaccgccgccgacaccgccatctactactgcgcccgcttcgacggcgaagtcctcgtctaccacgactggcccaaacccgcctgggtcgacctctggggccgcggcaccctagtcaccgtcaccgtctcctcc

SEQ ID NO: 54722 - RNA, 315 nt, synthetic construct
  misc_feature 1..315: note = derived and/or modified sequence opt11 from anti-HIV_PGT127_LightChain
  source 1..315: mol_type = other RNA
caatccgccctcacccaacccccctccgcctccggctcacccggccaatccatcaccatctcctgcaccggcacctccaacaacttcgtctcctggtaccaacaataccccggcaaagcccccaaactcgtcatctacgaagtaaacaaacgcccctccggcgtccccgaccgcttctccggctccaaatcaggctccaccgcctccctcaccgtctccggcctccaagccgacgacgaaggcgtctactactgctcctccctcgtcggcaactgggacgtcatcttcggcggcggcaccaaactcaccgtcctc

SEQ ID NO: 54723 - RNA, 405 nt, synthetic construct
  misc_feature 1..405: note = derived and/or modified sequence opt11 from anti-HIV_PGT127_HeavyChain
  source 1..405: mol_type = other RNA
caaccccaactccaagaatccggccccggcctagtcgaagcctccgaaaccctctccctcacctgcaccgtctccggcgactcaaccggccgatgcaactacttctggggctgggtacgccaaccccccggcaaaggcctcgaatggatcggctcactctcccactgccgctcctactacaacaccgactggacctaccacaacccctccctcaaatcccgcctcaccatctccctcgacacccccaaaaaccaagtcttcctccgcctcacatccgtcaccgccgccgacaccgccacctactactgcgcccgcttcggcggcgaagtcctcgtctaccgcgactggcccaaacccgcctgggtcgacctctggggccgcggcacactcgtcaccgtctcctcc

SEQ ID NO: 54724 - RNA, 315 nt, synthetic construct
  misc_feature 1..315: note = derived and/or modified sequence opt11 from anti-HIV_PGT128_LightChain
  source 1..315: mol_type = other RNA
caatccgccctcacccaacccccctccgcctccggctcccccggccaatccatcaccatctcctgcaccggcacctccaacaacttcgtctcctggtaccaacaacacgccggcaaagcccccaaactcgtcatctacgacgtcaacaaacgcccctccggcgtccccgaccgcttctccggctccaaatcaggcaacaccgcctccctaaccgtctccggcctccaaaccgacgacgaagccgtctactactgcggctccctcgtcggcaactgggacgtcatcttcggcggcggcaccaaactcacagtcctc

SEQ ID NO: 54725 - RNA, 405 nt, synthetic construct
  misc_feature 1..405: note = derived and/or modified sequence opt11 from anti-HIV_PGT128_HeavyChain
  source 1..405: mol_type = other RNA
caaccccaactccaagaatccggccccaccctcgtcgaagcctccgaaaccctctccctaacctgcgccgtctccggcgactccaccgccgcctgcaactcattctggggctgggtccgccaaccccccggcaaaggcctcgaatgggtcggctcactatcacactgcgcctcctactggaaccgcggctggacctaccacaacccctccctcaaatcccgcctcaccctcgccctcgacacccccaaaaacctcgtcttcctcaaactcaactccgtcaccgccgccgacaccgccacctactactgcgcccgattcggcggcgaagtcctccgctacaccgactggcccaaacccgcctgggtcgacctctggggccgcggcaccctcgtcaccgtctcctcc

SEQ ID NO: 54726 - RNA, 330 nt, synthetic construct
  misc_feature 1..330: note = derived and/or modified sequence opt11 from anti-HIV_PGT130_LightChain
  source 1..330: mol_type = other RNA
caatccgccctcacacaacccccctccgcctccggctcactcggccaatccgtcaccatctcctgcaacggcacctcctccgacatcggcggctggaacttcgtctcctggtaccaacaattccccggccgcgccccccgcctcatcatcttcgaagtcaacaaacgcccctccggcgtccccggccgcttctccggctcaaaatccggcaactccgcctccctcaccgtctccggcctccaatccgacgacgaaggccaatacttctgctcctccctcttcggccgctgggacgtcgtcttcggcggcggcaccaaactcaccgtcctc

SEQ ID NO: 54727 - RNA, 387 nt, synthetic construct
  misc_feature 1..387: note = derived and/or modified sequence opt11 from anti-HIV_PGT130_HeavyChain
  source 1..387: mol_type = other RNA
caagtccaactccaagaatccggccccggcctcgtcaaacccgccgaaaccctctccctaacctgctcagtctccggcgaatccatcaacaccggccactactactggggatgggtccgccaagtccccggcaaaggcctcgaatggatcggccacatccactacaccaccgccgtcctccacaacccctccctcaaatcccgcctcaccatcaaaatctacaccctccgcaaccaaatcaccctccgcctctccaacgtcaccgccgccgacacagccgtctaccactgcgtccgctccggcggcgacatcctctactactacgaatggcaaaaaccccactggttctccccctggggccccggcatccacgtcaccgtctcctcc

SEQ ID NO: 54728 - RNA, 330 nt, synthetic construct
  misc_feature 1..330: note = derived and/or modified sequence opt11 from anti-HIV_PGT131_LightChain
  source 1..330: mol_type = other RNA
caatccgccctcacccaacccccctcagcctccggctccctcggacaatcactcaccatctcctgctccggcaccggctccgacatcggctcctggaacttcgtctcctggtaccaacaattccccggccgcgcccccaacctcatcatcttcgaagtcaaccgccgccgctccggcgtccccgaccgcttctccggctccaaatccggcaacaccgcctccctcaccgtctccggcctccgctccgaagacgaagccgaatacttctgctcctccctctccggccgctgggacatcgtcttcggcggcggcaccaaagtcaccgtcctc

SEQ ID NO: 54729 - RNA, 387 nt, synthetic construct
  misc_feature 1..387: note = derived and/or modified sequence opt11 from anti-HIV_PGT131_HeavyChain
  source 1..387: mol_type = other RNA
caagtccaactccaagaatccggccccggcctcgtcaaaccctccgaaaccctctcccttacctgcaccgtctccggcgactccatcaacaccggccaccactactggggctgggtccgccaagtccccggcaaaggccccgaatggatcgcccacatccactacaacaccgccgtcctccacaaccccgccctcaaatcccgcgtcaccatctccatcttcaccctcaaaaacctcatcaccctctccctctccaacgtcaccgccgccgacaccgccgtctacttctgcgtccgctccggcggcgacatcctctactacatcgaatggcaaaaaccccactggttctacccctggggccccggcatcctagtcaccgtctcctcc

SEQ ID NO: 54730 - RNA, 321 nt, synthetic construct
  misc_feature 1..321: note = derived and/or modified sequence opt11 from anti-HIV_PGT135_LightChain
  source 1..321: mol_type = other RNA
gaaatcgtcatgacccaatcccccgacaccctctccgtctcccccggcgaaaccgtcaccctctcctgccgcgcctcccaaaacatcaacaaaaacctcgcctggtaccaatacaaacccggccaatccccccgcctcgtcatcttcgaaacctactccaaaatcgccgccttccccgcccgcttcgtcgcctccggctccggcaccgaattcaccctcaccatcaacaacatgcaatcagaagacgtcgccgtctactactgccaacaatacgaagaatggccccgcaccttcggccaaggcaccaaagtcgacatcaaa

SEQ ID NO: 54731 - RNA, 399 nt, synthetic construct
  misc_feature 1..399: note = derived and/or modified sequence opt11 from anti-HIV_PGT135_HeavyChain
  source 1..399: mol_type = other RNA
caattgcaaatgcaagagagcgggcccgggctcgtgaaaccgagcgagaccctgagcttgagctgtaccgtgagcggggactcgatcaggggcggggaatggggcgataaagattaccattgggggtgggtgcgccatagcgcgggcaagggcttggaatggatcgggagcatacactggcgcgggaccacacactataaagagagcttgcgaaggcgcgtgagcatgagcatagacacgagcaggaactggttctcgctcaggctcgcgagcgtgaccgcggcagataccgcggtctatttctgtgccaggcacaggcaccatgacgtgttcatgctagtgccaatagccgggtggtttgacgtgtgggggcccggggtccaggtcacggtctcgagc

SEQ ID NO: 54732 - RNA, 321 nt, synthetic construct
  misc_feature 1..321: note = derived and/or modified sequence opt11 from anti-HIV_PGT136_LightChain
  source 1..321: mol_type = other RNA
gaaatcgtcatgacccaatccccccccaccctctccgtctcccccggcgaaaccgccaccctctcctgccgcgcctcccaaaacgtcaaaaacaacctcgcctggtaccaactcaaacccggccaagccccccgcctcctcatcttcgacgcctcctcccgcgccggcggcatccccgaccgattctccggctccggctacggcaccgacttcaccctcaccgtcaactccgtccaatccgaagacttcggcgactacttctgccaacaatacgaagaatggccccgcaccttcggccaaggcaccaaagtcgacatcaaa

SEQ ID NO: 54733 - RNA, 402 nt, synthetic construct
  misc_feature 1..402: note = derived and/or modified sequence opt11 from anti-HIV_PGT136_HeavyChain
  source 1..402: mol_type = other RNA
caactccaactccaagaatccggacccggcctcgtcaaaccctccgaaaccctctccctcacatgcaccgtctccggcggctcaatgcgcggcaccgactggggcgaaaacgacttccactacggctggatccgacaatcctccgccaaaggcctcgaatggatcggctccatccactggcgcggccgcaccacccactacaaaacctccttccgctcccgcgccaccctctccatcgacacctccaacaaccgcttctccctcaccttctcattcgtcaccgccgccgacaccgccgtatactactgcgcccgccacaaataccacgacatcttccgcgtcgtccccgtcgccggctggttcgacccctggggccaaggcctcctcgtcaccgtctcctcc

SEQ ID NO: 54734 - RNA, 321 nt, synthetic construct
  misc_feature 1..321: note = derived and/or modified sequence opt11 from anti-HIV_PGT137_LightChain
  source 1..321: mol_type = other RNA
gagatcatgatgacgcaatcgcccgcgatcttgagcgtgagcccgggcgatcgcgcgaccttgagctgtcgcgcgagccagagcgtgaaaaataacctggcctggtaccagaaaaggcccgggcaagcgcccaggctcttgatctttgacacgagctcgcgcgcgagcgggatcccggccaggttctcgggcgggggctcgggcacggaatttaccttgaccgtgaactcgatgcagagcgaggactttgccacgtactattgccagcaatatgaagagtggccgcgcacgttcgggcaagggaccaaggtcgagatcaag

SEQ ID NO: 54735 - RNA, 399 nt, synthetic construct
  misc_feature 1..399: note = derived and/or modified sequence opt11 from anti-HIV_PGT137_HeavyChain
  source 1..399: mol_type = other RNA
gaagtgcacttggaagagagcgggcccgggctcgtgcgcccgagcgagaccttgagcctgacctgtaccgcgagcgggggctcaatcagaggcggagaatggggcgatagcgattaccattgggggtgggtgcgccatagcccggaaaagggcttggaatggatcgggagcatacactggcgcgggaccacgcactataacgcgccctttcgcgggcgcgggcgcctgagcatagacttgagcagaaaccagttctcgctcaggctcacgagcgtgacagcggaagatacagcggtctattactgtgtcaagcacaagtaccatgacatagtcatggtcgtgcccatagccgggtggtttgacccgtgggggcaagggctacaggtcacggtctcgagc

SEQ ID NO: 54736 - RNA, 336 nt, synthetic construct
  misc_feature 1..336: note = derived and/or modified sequence opt11 from anti-HIV_PGT141_LightChain
  source 1..336: mol_type = other RNA
gacaccgtcgtcacccaatcccccctctccctacccgtcacccccggcgaagccgcctccatgtcctgctcctccacccaatccctccgccactccaacggcgccaactacctcgcctggtaccaacacaaacccggccaatccccccgcctcctcatccgcctcggctcccaacgcgcctccggcgtccccgaccgcttctccggctccggctccggcacccacttcaccctcaaaatctcccgcgtcgaagccgaagacgccgccatctactactgcatgcaaggcctcaaccgcccctggaccttcggcaaaggcaccaaactcgaaatcaaa

SEQ ID NO: 54737 - RNA, 423 nt, synthetic construct
  misc_feature 1..423: note = derived and/or modified sequence opt11 from anti-HIV_PGT141_HeavyChain
  source 1..423: mol_type = other RNA
caagtgcaattggtccagagcgggcccgaggtcaagaaaccgggctcgagcgtgaaagtgagctgtaaagcgagcgggaacacgttctcgaaatatgacgtgcactgggtcaggcaagcgaccgggcaagggctcgagtgggtgggctggatgtcgcacgagggcgataaaacggaatcggcacagcgatttaaagggcgagtgacctttaccagggacacgagcgcgagcacggcctatatggagctcaggggcttgacctcggacgataccgcgatctattactgtaccaggggctcgaaacatcgattgcgcgattacgtgctctatgacgattacgggctcataaactatcaagagtggaatgactatctcgagttcttggacgtgtgggggcacgggaccgcagtaacggtctcgagc

SEQ ID NO: 54738 - RNA, 336 nt, synthetic construct
  misc_feature 1..336: note = derived and/or modified sequence opt11 from anti-HIV_PGT142_LightChain
  source 1..336: mol_type = other RNA
gacaccgtcgtcacccaatcccccctctccctccccgtcacccccggcgaagccgcctccatgtcctgctcctccacccaatccctccgccactccaacggcgccaactacctcgcctggtaccaacacaaacccggccaatccccccgcctcctcatccgcctcggctcccaacgcgcctccggcgtccccgaccgcttctccggctccggctccggcacccacttcaccctcaaaatctcccgcgtcgaagccgaagacgccgccatctactactgcatgcaaggcctcaaccgcccctggaccttcggcaaaggcaccaaactcgaaatcaaa

SEQ ID NO: 54739 - RNA, 423 nt, synthetic construct
  misc_feature 1..423: note = derived and/or modified sequence opt11 from anti-HIV_PGT142_HeavyChain
  source 1..423: mol_type = other RNA
caagtgcaactggtccagagcgggcccgaggtcaagaaaccgggctcgagcgtgaaagtgagctgtaaagcgagcgggaacacgttctcgaaatatgacgtgcactgggtcaggcaagcgaccgggcaagggctcgagtgggtgggctggatctcgcacgagcgcgataaaacggaatcggcccagcgctttaaagggcgcgtgacctttaccagggacacgagcgcgaccacggcctatatggagctcaggggcttgacctcggacgataccgcgatctattactgtaccaggggctcgaaacatcgcttgcgcgattacgtgctctatgacgattacgggctcataaactatcaagagtggaatgactatctcgagttcttggacgtgtgggggcacgggaccgcggtcacggtctcgagc

SEQ ID NO: 54740 - RNA, 336 nt, synthetic construct
  misc_feature 1..336: note = derived and/or modified sequence opt11 from anti-HIV_PGT143_LightChain
  source 1..336: mol_type = other RNA
gacaccgtcgtcacccaatcccccctctccctccccgtcacccccggcgaagccgcctccatgtcctgcacctccacccaatccctccgccactccaacggcgccaactacctcgcctggtaccaacacaaacccggccaatccccccgcctactcatccgcctcggctcacaacgcgcctccggcgtccccgaccgcttctccggctccggctccggcacccacttcaccctcaaaatctcccgcgtcgaacccgaagacgccgccatctactactgcatgcaaggcctcaaccgcccctggaccttcggcaaaggcaccaaactcgaaatcaaa

SEQ ID NO: 54741 - RNA, 423 nt, synthetic construct
  misc_feature 1..423: note = derived and/or modified sequence opt11 from anti-HIV_PGT143_HeavyChain
  source 1..423: mol_type = other RNA
caagtgcaattggaacagagcggggccgaggtcaagaaaccgggctcgagcgtgaaagtgagctgtaaagcgagcgggaacacgttctcgaaatatgacgtgcactgggtcaggcaagcgaccgggcaagggctcgagtgggtgggctggatgtcgcacgagggcgataaaacggaatcggcccagcgctttaaagggcgcgtgacctttaccagggacacgagcgcgagcacggcctatatggagctcaggggcttgacctcggacgataccgcgatctattactgtaccaggggctcgaaacatcgcttgcgcgattacgtgctctatgacgattacgggctcataaactatcaagagtggaatgactatctagagttcttggacgtgtgggggcacgggaccgcggtcacggtctcgagc

SEQ ID NO: 54742 - RNA, 336 nt, synthetic construct
  misc_feature 1..336: note = derived and/or modified sequence opt11 from anti-HIV_PGT144_LightChain
  source 1..336: mol_type = other RNA
gacaccgtcgtcacccaatcacccctctccctctccgtcacccccggcgaagccgcctccatgtcctgcacctccacccaatccctccgccactccaacggcgccaactacctcgcctggtaccaacacaaacccggccaatcaccccgcctcctcatccgcctcggctcccaacgcgcctccggcgtccccgaccgcttctccggctccggctccggcacccacttcaccctcaaaatctcccgcgtcgaagccgacgacgccgccatctactactgcatgcaaggcctcaaccgcccctggaccttcggcaaaggcaccaaactcgaaatcaaa

SEQ ID NO: 54743 - RNA, 423 nt, synthetic construct
  misc_feature 1..423: note = derived and/or modified sequence opt11 from anti-HIV_PGT144_HeavyChain
  source 1..423: mol_type = other RNA
caagtgcaattggtccagagcggggccgaggtcaagaaaccgggctcgagcgtgaaagtgagctgtaaagcgagcgggaacacgttcaggaaatatgacgtgcactgggtcaggcaagcgaccgggcaagggctcgagtgggtgggctggatgtcgcacgagggcgataaaacggaatcggcccagcgctttaaagggcgcgtgagctttaccagggacaatagcgcgagcacggcctatatcgagctcaggggcttgacctcggacgataccgcgatctattactgtaccgggggctcaaaacatcgcttgcgcgattacgtgctctatgacgattacgggctaataaaccagcaagagtggaatgactatctcgagttcctggacgtgtgggggcacgggacagcggtcacggtctcgagc

SEQ ID NO: 54744 - RNA, 336 nt, synthetic construct
  misc_feature 1..336: note = derived and/or modified sequence opt11 from anti-HIV_PGT145_LightChain
  source 1..336: mol_type = other RNA
gaagtcgtaatcacccaatcccccctattcctccccgtaacccccggcgaagccgcctccctatcctgcaaatgctcccactccctccaacactccaccggcgccaactacctcgcctggtacctccaacgccccggccaaaccccccgcctcctcatccacctcgccacccaccgcgcctccggcgtccccgaccgattctccggctccggctccggcaccgacttcaccctcaaaatctcccgcgtcgaatccgacgacgtcggcacctactactgcatgcaaggcctccactccccctggaccttcggccaaggcaccaaagtcgaaatcaaa

SEQ ID NO: 54745 - RNA, 420 nt, synthetic construct
  misc_feature 1..420: note = derived and/or modified sequence opt11 from anti-HIV_PGT145_HeavyChain
  source 1..420: mol_type = other RNA
caagtgcaattggtccagagcggggccgaggtcaagaaaccgggctcgagcgtgaaagtgagctgtaaagcgagcgggaactcgttctcgaaccatgacgtgcactgggtcaggcaagcgaccgggcaagggctcgagtggatgggctggatgtcgcacgagggcgataaaacgggcttggcccagaaatttcaagggcgagtgaccataaccagggactcgggcgcgagcacggtctatatggagctcaggggcttgacagcggacgacaccgcgatctattactgtctcacaggatcgaaacatcgcttgcgcgattactttctctataacgagtacgggcccaattacgaggaatggggcgattacttggccacgctcgatgtctggggccatggaacggccgtgaccgtgagctcg

SEQ ID NO: 54746 - RNA, 657 nt, synthetic construct
  misc_feature 1..657: note = derived and/or modified sequence opt11 from anti-HIV_PGT151_LightChain
  source 1..657: mol_type = other RNA
gacatcgtcatgacccaaacacccctctccctctccgtcacccccggccaaccagcctccatctcatgcaaatcctcagaatcactccgccaatcaaacggcaaaacctccctctactggtaccgccaaaaacccggccaaagcccccaactcctagtcttcgaagtctccaaccgcttctccggcgtctccgaccgcttcgtaggctccggctccggcaccgacttcaccctccgcatatcccgagtcgaagccgaagacgtcggcttctactactgcatgcaatccaaagacttccccctaaccttcggcggcggaaccaaagtcgacctcaaacgcaccgtcgccgccccctccgtcttcatcttcccaccctccgacgaacaactcaaatccggaaccgcctccgtcgtatgcctcctcaacaacttctacccccgcgaagccaaagtccaatggaaagtcgacaacgccctccaatcaggcaactcccaagaatccgtcactgaacaagactccaaagactccacctactccctgtcctccaccctcacactcagcaaagcagactacgaaaaacacaaagtctacgcctgcgaagtaacccaccaaggcctctcttcccccgtcaccaaatccttcaaccgcggcgaatgc

SEQ ID NO: 54747 - RNA, 720 nt, synthetic construct
  misc_feature 1..720: note = derived and/or modified sequence opt11 from anti-HIV_PGT151_HeavyChain
  source 1..720: mol_type = other RNA
agagttcaactcgtcgaatccggcggcggcgtagtacaacccggaaaatcagtccgactctcctgcgtcgtctccgacttccccttctccaaataccccatgtactgggtccgacaagcccccggcaaaggcctcgaatgggtcgccgccatctccggagacgcctggcacgtagtatactccaactccgtccaaggccgcttcctcgtctcacgcgacaacgtcaaaaacaccctctacctagaaatgaactccctcaaaatcgaagacactgccgtctaccgatgcgcccgcatgttccaggaatccggccctccccgcctcgatagatggtcaggccgtaactactactactactccggcatggacgtctggggccaaggcaccaccgtcaccgtctcctctgcctccaccaaaggcccctccgtctttcccctcgccccctccagcaaatccacatccggcggcaccgcagccctcggctgcctcgtcaaagactacttccccgaacccgtaacagtctcctggaactccggagccctaacctccggcgtccacacatttcccgccgtcctccaatcctccggcctctactcactctcctcagtcgtcacagtcccctcctcctccctcggcacacaaacatacatctgcaacgtcaaccacaaaccctccaacaccaaagtagacaaacgagtagaaccaaaatcctgcgacaaa

SEQ ID NO: 54748 - RNA, 657 nt, synthetic construct
  misc_feature 1..657: note = derived and/or modified sequence opt11 from anti-HIV_PGT152_LightChain
  source 1..657: mol_type = other RNA
gacatcgtcatgacccaaacaccactctccctctccgtcgaccccggccaacccgcctccatctcatgcaaatcctcccaatcactcagacaatccaacggcaaaacctccctctactggtaccaacaaaaacccggccaatcaccacaactactcatcttcgaagtctccaaccgcttctccggagtctccgaccgcttcgtcggctcaggctccggcaccgacttcaccctacgcatatcccgcgtcgaggccgaagacgtcggcttctactactgcatgcaatcaaaagacttccccctcaccttcggcggcggaaccaaagtcgacctcaaacgcacagtcgcagccccctccgtattcatcttcccaccctccgacgaacaactaaaatccggcaccgcctcagtcgtatgcctcctcaacaacttctacccccgcgaagccaaagtccaatggaaagtagacaacgccctccaatccggcaactcccaagagtccgtcaccgaacaagactcaaaagactccacctacagcctctcctccaccctaaccctctccaaggccgactacgaaaaacacaaagtatacgcctgcgaggtcacccaccaaggcctctcctcccccgtcaccaaatccttcaaccgaggcgaatgc

SEQ ID NO: 54749 - RNA, 720 nt, synthetic construct
  misc_feature 1..720: note = derived and/or modified sequence opt11 from anti-HIV_PGT152_HeavyChain
  source 1..720: mol_type = other RNA
cgcgtccaactcgtcgaatccggcggcggagtcgtccaacccggcaaatccgtacgactctcgtgcgtcgtctcagacttccccttctccaaataccccatgtactgggtccgccaagccccaggcaaaggcctagaatgggtagccgccatctccgccgacgcctggcacgtcgtctactcaggctccgtccaaggacgattcctcgtctcccgcgacaactccaaaaacatcctatacctcgaaatgaacaccctaaaaatagaagacaccgcagtctaccgctgcgcacgaatgttccaagaatccggacccccacgcttcgactcctggtccggccgcaactactactactactccggcatggacgtctggggccagggcaccaccgtcaccgtatcctcagcctctacaaaaggcccctccgtcttccccctcgcaccctcctcaaaatcaacctccggcggcaccgccgccctaggctgcctagtaaaagactacttcccagaacccgtcaccgtctcctggaactccggcgccctcacctccggcgtccacacattccccgccgtcctccaatcatccggcctctactccctctcctcagtcgtcaccgtcccctcctcctccctcggcacccaaacctacatctgcaacgtaaaccacaaaccctctaacaccaaagtcgacaaacgagtcgaacccaaatcctgcgacaaa

SEQ ID NO: 54750 - RNA, 309 nt, synthetic construct
  misc_feature 1..309: note = derived and/or modified sequence opt11 from anti-HIV_VRC-CH30_LightChain
  source 1..309: mol_type = other RNA
gacatccaaatgacccaatccccctcctccctctccgcctccctcggcgaccgcgtcaccatcacctgccaagcctcccgcggcatcggcaaagacctcaactggtaccaacaaaaacccggcaaagcacccaaactcctcgtctccgacgcctccatcctcgaaggcggcgtcccctcccgcttctccggctccggcttccaccaaaacttctccctcaccatctcctccctccaacccgaagacgtcgccacctacttctgccaacaatacgaaaccttcggccaaggcaccaaagtcgacatcaaa

SEQ ID NO: 54751 - RNA, 393 nt, synthetic construct
  misc_feature 1..393: note = derived and/or modified sequence opt11 from anti-HIV_VRC-CH30_HeavyChain
  source 1..393: mol_type = other RNA
caagtccaactcgtccaatccggcgccgccgtccgcaaacccggcgcctccgtcaccgtctcctgcaaattcgccgaagacgacgactactccccccactgggtcaaccccgcccccgaacactacatccacttcctccgccaagcccccggccaacaactcgaatggctcgcctggatgaaccccaccaacggcgccgtcaactacgcctggcaactccacggccgcctcaccgccacccgcgacggctccatgaccaccgccttcctcgaagtccgctccctccgctccgacgacaccgccgtctactactgcgcccgcgcccaaaaacgcggacgctccgaatgggcctacgcccactggggccaaggcacccccgtcgccgtatcctcc

SEQ ID NO: 54752 - RNA, 309 nt, synthetic construct
  misc_feature 1..309: note = derived and/or modified sequence opt11 from anti-HIV_VRC-CH31_LightChain
  source 1..309: mol_type = other RNA
gacatccaaatgacccaatccccctcctccctctccgcctccctcggcgaccgcgtcaccatcacctgccaagcctcccgcggcatcggcaaagacctcaactggtaccaacaaaaagccggcaaagcccccaaactcctcgtctccgacgcctccaccctcgaaggcggcgtcccctcccgcttctccggctccggcttccaccaaaacttctccctcaccatctcctccctccaagccgaagacgtcgccacctacttctgccaacaatacgaaaccttcggccaaggcaccaaagtcgacatcaaa

SEQ ID NO: 54753 - RNA, 393 nt, synthetic construct
  misc_feature 1..393: note = derived and/or modified sequence opt11 from anti-HIV_VRC-CH31_HeavyChain
  source 1..393: mol_type = other RNA
caagtccaactcgtccaatccggcgccgccgtccgcaaacccggcgcctccgtcaccgtctcctgcaaattcgccgaagacgacgactactccccctactgggtcaaccccgcccccgaacacttcatccacttcctccgccaagcccccggccaacaactcgaatggctagcctggatgaaccccaccaacggcgccgtcaactacgcctggtacctcaacggccgcgtcaccgccacccgcgaccgctccatgaccaccgccttcctcgaagtcaaatccctccgctccgacgacaccgccgtctactactgcgcccgcgcacaaaaacgcggccgctccgaatgggcctacgcccactggggccaaggcacccccgtcgtcgtctcctcc

SEQ ID NO: 54754 - RNA, 309 nt, synthetic construct
  misc_feature 1..309: note = derived and/or modified sequence opt11 from anti-HIV_VRC-CH32_LightChain
  source 1..309: mol_type = other RNA
gacatccaaatgacccaatccccctcctccctctccgcctccctcggcgaccgcgtcaccataacctgccaagcctcccgcggcatcggcaaagacctcaactggtaccaacaaaaacccggccgcgcccccaaactcctcgtctccgacgcctccatcctcgaaggcggcgtccccacccgcttctccggctccggcttccaccaaaacttctccctcaccatctcctccctccaagccgaagacgtcgccacctacttctgccaacaatacgaaaccttcggccaaggcaccaaagtcgacatcaaa

SEQ ID NO: 54755 - RNA, 393 nt, synthetic construct
  misc_feature 1..393: note = derived and/or modified sequence opt11 from anti-HIV_VRC-CH32_HeavyChain
  source 1..393: mol_type = other RNA
caagtccaactcgtccaatccggcgccgccgtccgcaaacccggcgcctccgtcaccgtctcctgcaaattcgccgaagacgacgacttctcaccccactgggtcaaccccgcccccgaacactacatccacttcctccgccaagcccccggccaacaactcgaatggctcgcctggatgaaacccacaaacggcgccgtcaactacgcctggcaactccaaggccgcgtcaccgtcacccgcgaccgctcccaaaccaccgccttcctcgaagtcaaaaacctccgctccgacgacaccgccgtctactactgcgcccgcgcccaaaaacgcggccgctccgaatgggcctacgcccactggggccaaggcacccccgtcgtcatctccgcc

SEQ ID NO: 54756 - RNA, 309 nt, synthetic construct
  misc_feature 1..309: note = derived and/or modified sequence opt11 from anti-HIV_VRC-CH33_LightChain
  source 1..309: mol_type = other RNA
gacatccaaatgacccaatccccctcctccctctccgcctccctcggcgaccgcgtcaccatcacctgccaagcctcccgcggcatcggcaaagacctcaactggtaccaacaaaaacgcggccgcgccccccgcctcctcgtctccgacgcctccgtcctcgaaggcggcgtcccctcccgattctccggctccggcttccaccaaaacttctcactcaccatctccaccctccaacccgaagacgtcgccacctacttctgccaacaatacgaaaccttcggccaaggcaccaaagtcgacatcaaa

SEQ ID NO: 54757 - RNA, 393 nt, synthetic construct
  misc_feature 1..393: note = derived and/or modified sequence opt11 from anti-HIV_VRC-CH33_HeavyChain
  source 1..393: mol_type = other RNA
caagtccaactcgtccaatccggcgccgccgtccgcaaacccggcgcctccatctccgtctcctgcaaattcgccgacgccgacgactactccccccactggatgaaccccgcccccgaacactacatccacttcctccgccaagcccccggccaacaactcgaatggctcgcctggatgaaccccaccaacggcgccgtcaactacgcctggtacctcaacggccgcgtcaccgccacccgcgaccgctccatgaccaccgccttcctcgaagtccgctccctccgctccgacgacaccgccgtctactactgcgcccgcgcccaaaaacgcgcccgctccgaatgggcctacgcccactggggccaaggcacccccgtcgtcgtctcctcc

SEQ ID NO: 54758 - RNA, 309 nt, synthetic construct
  misc_feature 1..309: note = derived and/or modified sequence opt11 from anti-HIV_VRC-CH34_LightChain
  source 1..309: mol_type = other RNA
gacatccaaatgacccaatccccctcctccctctccgcctccctcggcgaccgcgtcaccatcacctgccaagcctcccgcggcatcggcaaagacctcaactggtaccaacaaaaagccggcaaagcccccaaactcctcgtctccgacgcctccatcctcgaaggcggcgtcccctcccgcttctccggctcaggcttccaccaaaacttctccctcaccatctcctccctccaacccgaagacgtcgccacctacttctgccaacaatacgaaaccttcggccaaggcaccaaagtcgacatcaaa

SEQ ID NO: 54759 - RNA, 393 nt, synthetic construct
  misc_feature 1..393: note = derived and/or modified sequence opt11 from anti-HIV_VRC-CH34_HeavyChain
  source 1..393: mol_type = other RNA
caagtccaactcgtccaatccggcgccgccgtccgcaaacccggcgcctccgtcacagtctcctgcaaattcgccgaagacgacgactggtcaccccactgggtcaaccccgcccccgaacactacatccacttcctccgacaagcccccggccaacaactagaatggctcgcctggatgaacccaaccaacggcgccgtcaactacgcctggcaactcaacggccgcctcaccgccacccgcgacacctccatgaccaccgccttcctcgaagtcaaatccctccgctcagacgacaccgccgtctactactgcgcccgagcccaaaaacgcggccgctccgaatgggcctacgcccactggggacaaggcacccccgtcgtcgtctcctcc

SEQ ID NO: 54760 - RNA, 306 nt, synthetic construct
  misc_feature 1..306: note = derived and/or modified sequence opt11 from anti-HIV_VRC-PG04_LightChain
  source 1..306: mol_type = other RNA
gaaatcgtcctcacccaatcccccggcaccctctccctctcccccggcgaaaccgcctccctctcctgcaccgccgcctcctacggccacatgacctggtaccaaaaaaaacccggccaaccccccaaactactcatcttcgccacctccaaacgcgcctccggcatccccgaccgcttctccggctcccaattcggcaaacaatacaccctcaccatcacccgcatggaacccgaagacttcgcccgctactactgccaacaactcgaattcttcggccaaggcacccgcctcgaaatccgccgc

SEQ ID NO: 54761 - RNA, 375 nt, synthetic construct
  misc_feature 1..375: note = derived and/or modified sequence opt11 from anti-HIV_VRC-PG04_HeavyChain
  source 1..375: mol_type = other RNA
caggtccagctcgtgcaatcgggctcgggagtgaaaaagcccggggcctcggtcagggtatcgtgctggacctcggaagatatctttgaaaggacagagctcatacactgggtcaggcaagcgcccgggcaagggctagagtggataggctgggtcaagaccgtgaccggggccgtgaactttggctcgcccgatttcaggcaaagggtatcgctcacgcgcgatcgcgatctctttaccgcgcacatggacatacgcgggctcacgcaaggggacacggccacgtacttttgcgcgcgccagaaattttacacgggagggcaagggtggtatttcgatctctggggcaggggcacgctcatagtagtgagctcg

SEQ ID NO: 54762 - RNA, 303 nt, synthetic construct
  misc_feature 1..303: note = derived and/or modified sequence opt11 from anti-HIV_VRC-PG04b_LightChain
  source 1..303: mol_type = other RNA
gaaatcgtcctcacccaatcccccggcaccctctccctctcccccggcgaaaccgcctccctctcctgcaccgccgcctcctacggccacatgacctggtaccaaaaaaaacccggccaaccccccaaactcctcatcttcgccacctccaaacgcgcctccggcatccccgaccgcttctccggctcccaattcggcaaacaatacaccctcaccatcacccgcatggaacccgaagacttcgccggctactactgccaacaagtcgaattcttcggccaaggcacccgcctcgaaatccga

SEQ ID NO: 54763 - RNA, 375 nt, synthetic construct
  misc_feature 1..375: note = derived and/or modified sequence opt11 from anti-HIV_VRC-PG04b_HeavyChain
  source 1..375: mol_type = other RNA
caggtacagctcgtgcaatcgggctcgggcgtgaaaaagcccggggcctcggtcagggtctcgtgctggacctcggaagatatctttgaaaggacagagctaatacactgggtcaggcaagcgccagggcaagggctcgagtggataggctgggtcaagaccgtgacaggggccgtgaactttggctcgcccaatttcaggcacagggtctcgctcacgcgcgatcgcgatctctttaccgcgcacatggacataagagggctcacgcaaggggacacggcaacgtacttttgcgcacgacagaaatttgaaaggggcgggcaagggtggtatttcgatctctggggcaggggaacgctaatagtcgtgagctcg

SEQ ID NO: 54764 - RNA, 612 nt, synthetic construct
  misc_feature 1..612: note = derived and/or modified sequence opt11 from anti-HIV_VRC-PG20_LightChain
  source 1..612: mol_type = other RNA
caatccgccctcacccaacccccatccgtctccggctcccccggccaatccatcaccctctcctgcaccggcgcctccacatccgtcgcctggtaccaacaatacgccgacaaagccccccgcctcatcgtcttcgacggcaacaaacgcccctcagacatctcctcccgcttctccggctcccaatccggcggcacagcatcacttaccatctcaggcctccaatccgaagacgaagcctactaccactgcaacgcattcgaattcttcggcggcggaaccaaactcaccgtactctcccaacccaaagccgccccatccgtcacactcttccccccctcatccgaagaactccaagccaacaaagccaccctagtatgcctcatctccgacttctacccaggcgccgtcacagtcgcctggaaagccgactcatcccccgtaaaagccggcgtcgaaaccaccaccccctccaaacaatccaacaacaaatacgccgcatcctcctacctatctctcacccccgaacaatggaaatcccataaatcctactcctgccaagtcacccacgaaggctccaccgtcgaaaaaaccgtcgccccaaccgaatgc

SEQ ID NO: 54765 - RNA, 681 nt, synthetic construct
  misc_feature 1..681: note = derived and/or modified sequence opt11 from anti-HIV_VRC-PG20_HeavyChain
  source 1..681: mol_type = other RNA
gaagtccacctcatgcaatccggaaccgaaatgaaaaagcccggcgcctccgtccgcgtcacatgccaaacctccggatacaccttctcagactacttcatccactggctccgacaagtccccggccgcggcttcgaatggatgggctggatgaacccccaatggggccaagtcaactacgcccgcaccttccaaggccgcgtaaccatgacccgcgacgtctaccgcgaagtcgcctacctcgacctacgatcactaaccttcgccgacaccgccgtctacttctgcgcccgccgcatgcgctcccaagaccgcgaatgggacttccaacactggggccaaggcacccgcatcatcgtctcctccgcctccaccaaaggaccctcagtctttcccctcgcaccatcatcaaaaagcaccagcggcggcaccgccgccctcggctgcctcgtcaaagactacttccccgaacccgtcaccgtctcctggaactccggcgccctcacctctggcgtacacaccttccccgccgtcctccaaagctccggcctctactccctctcctccgtagtcacagtcccttcctcctccctaggcacccaaacatacatctgcaacgtcaaccacaaaccctccaacacaaaagtcgacaaaaaagtagaacccaaatcctgcgacaaa

SEQ ID NO: 54766 - RNA, 1059 nt, synthetic construct
  misc_feature 1..1059: note = derived and/or modified sequence opt11 from anti-HIV_VRC-PG20_G-Chain
  source 1..1059: mol_type = other RNA
gtctggaaagacgccgacaccacactcttctgcgcaagcgacgccaaagcccacgaaaccgaagtccacaacgtatgggccacccacgcctgcgtacccaccgacccgaacccccaagaaatccacctagaaaacgtcaccgaaaacttcaacatgtggaaaaacaacatggtggaacaaatgcaagaagacgtcatatctctctgggaccagagcctccaaccctgcgtaaaactcaccggaggctcagtcatcaaacaagcctgcccaaaaatcagcttcgaccccatccccatccactactgcacaccagcaggttacgttatactaaaatgcaacgacaaaaacttcaacggaacaggaccctgcaagaacgtctcctccgtccaatgcacacacggaataaaacccgtcgtatccacccaactcctcctaaacggctcccttgccgaggaagaaatcatcatccgcagcgaaaacctaaccaacaacgccaaaaccatcatagtccacctcaacaaatccgtcgaaatcaactgcacacgaccatccaacggcggctccggctccggcggcgacatccgaaaagcctactgcgagatcaacggcacaaaatggaacaaagtactcaaacaagtaaccgaaaaacttaaagaacacttcaacaacaaaacaatcatcttccaaccaccctccggtggcgatctagaaatcacaatgcaccactttaactgccgcggagagttcttctactgcaacaccacccaactattcaacaacacatgcatcggcaacgaaaccatgaaaggctgcaacggcacaataaccctcccctgcaaaatcaaacaaatcatcaacatgtggcaaggcaccggacaagccatgtacgcacctcccatcgacggaaaaatcaactgcgtctcaaacatcaccggcatcctcctaacccgagacggcggcgccaacaacacctcaaacgaaaccttccgccccggcggcggcaacatcaaagacaactggcgctccgaactctacaaatacaaagtcgtacaaatagaa

SEQ ID NO: 54767 - RNA, 312 nt, synthetic construct
  misc_feature 1..312: note = derived and/or modified sequence opt11 from anti-HIV_VRC02_LightChain
  source 1..312: mol_type = other RNA
gaaatcgtcctcacccaatcccccggcaccctctccctctcccccggcgaaaccgccatcatctcctgccgcacctctcaatacggctccctcgcctggtaccaacaacgccccggccaagccccccgcctcgtcatctactccggctccacccgcgccgccggcatccccgaccgattctccggctcccgctggggccccgactacaacctcaccatccgcaacctcgaatccggcgacttcggcctctactactgccaacaatacgaattcttcggccaaggcaccaaagtccaagtcgacatcaaacgc

SEQ ID NO: 54768 - RNA, 363 nt, synthetic construct
  misc_feature 1..363: note = derived and/or modified sequence opt11 from anti-HIV_VRC02_HeavyChain
  source 1..363: mol_type = other RNA
caggtccagctcgtgcaatcgggcgggcaaatgaaaaagcccggggaatcgatgaggatctcgtgccaggcctcgggctatgaatttatcgattgcacgctcaattgggtgcgcttggccccgggcaggcgcccggaatggatggggtggttgaaaccgcgcgggggcgcggtcaattacgcgcgcccgctccagggcagggtcacgatgacgcgcgatgtctatagcgataccgcgttcttggaattgcgctcgctcacggccgatgacacggccgtgtactattgcacgcgcgggaaaaattgcgattacaattgggatttcgagcactggggcaggggcacgcccgtgaccgtgagctcg

SEQ ID NO: 54769 - RNA, 309 nt, synthetic construct
  misc_feature 1..309: note = derived and/or modified sequence opt11 from anti-HIV_VRC03_LightChain
  source 1..309: mol_type = other RNA
gaaatcgtcctcacccaatcccccggcatcctctccctctcccccggcgaaaccgccaccctcttctgcaaagcctcccaaggcggcaacgccatgacctggtaccaaaaacgccgcggccaagtcccccgcctcctcatctacgacacctcccgccgcgcctccggcgtccccgaccgcttcgtcggctccggctccggcaccgacttcttcctcaccatcaacaaactcgaccgcgaagacttcgccgtctactactgccaacaattcgaattcttcggcctcggctccgaactcgaagtccaccgc

SEQ ID NO: 54770 - RNA, 390 nt, synthetic construct
  misc_feature 1..390: note = derived and/or modified sequence opt11 from anti-HIV_VRC03_HeavyChain
  source 1..390: mol_type = other RNA
caagtgcaattggtccagagcggggccgtgatcaagaccccgggctcgagcgtgaaaataagctgtcgcgcgagcgggtacaatttcagggactatagcatacactgggtcaggctcatacccgataaagggttcgagtggataggctggatcaagcccttgtggggcgccgtgagctatgccaggcaactgcaagggcgagtgagcatgaccaggcaattgagccaggacccggacgatcccgattggggcgtcgcgtacatggaatttagcgggctcacgcccgcggacacggccgagtacttctgcgtacgcagagggtcgtgcgattactgtggggatttcccgtggcagtactggggccagggcacggtcgtggtcgtgagctcg

SEQ ID NO: 54771 - RNA, 630 nt, synthetic construct
  misc_feature 1..630: note = derived and/or modified sequence opt11 from anti-HIV_VRC23_LightChain
  source 1..630: mol_type = other RNA
gaaatcgtaatgacccaatcccccgtcaccgtcagcgtatcccgcggaggaaccgccaccctctcctgccgcgcaagccaaggcgtcggctccgacgtcgcctggtaccaacacaaacccggacaaacaccccgcctcctcatctacggcgcctccacccgcgcctccggcgtccccgaacgattctccggctccggcttccacgtcgacttcacactatcaatctccggcctccaacccgaagacgtcgccatatactactgccaacaatacgaaaccttcggccaaggaaccaaggtcgaaataaaacgcaccgtcgccgcccccagcgtcttcatcttcccaccctccgacgaacaactcaaatccggcacagcctcagtcgtctgcctcctcaacaacttctacccccgcgaggccaaagtccaatggaaagtcgacaacgcactccaaagcggcaactcccaagaatccgtcaccgaacaagacagcaaagactcaacctacagcctaagctctaccctaaccctatccaaagccgactacgaaaaacacaaagtatacgcctgcgaagtcacccaccaaggcctatcctcccccgtcaccaaatccttcaaccgcggcgaatgc

SEQ ID NO: 54772 - RNA, 672 nt, synthetic construct
  misc_feature 1..672: note = derived and/or modified sequence opt11 from anti-HIV_VRC23_HeavyChain
  source 1..672: mol_type = other RNA
gaagtacaattcgtacaatccggcgccgaagtcaaaaaacccggagcatccgtcagagtctcctgcgaagcctcaggctactcattcacagactacgtcctacaatggatccgccaagcccccggccaacgccccgaatggatgggctggatcaaacccgaacgcggcgccgtctcctacgccccccaattccaaggacgactcaccctcacccgagacctatacaccgaaaccgcctacatgcacttcaaaaacctccgctcagacgacaccgccatctactactgcgcacgcggcgtccgacgcgacgcatcctggtggctccagttctggggccaaggcacactcgtcaccgtctcctccgcctcaaccaaaggcccctccgtcttccccctcgccccctcctccaaaagcacatccggaggcaccgccgccctcggctgcctcgtcaaagactacttccccgaaccagtcaccgtctcctggaactccggcgcccttacctccggcgtacacacattccccgccgtactccaatcctccggcctctactccctctcatccgtcgtcacagtcccatcctcctccctcggcacccaaacctacatctgcaacgtcaaccacaaaccctccaacaccaaagtcgacaaaaaagtcgaaccaaaatcatgc

SEQ ID NO: 54773 - RNA, 1077 nt, synthetic construct
  misc_feature 1..1077: note = derived and/or modified sequence opt11 from anti-HIV_VRC23_G-Chain
  source 1..1077: mol_type = other RNA
gtctggcgcgacgcagacaccacactcttctgcgccagcgacgcaaaagcctacgaaacagaaaagcacaacgtctgggccacccacgcctgcgtccccacagaccccaacccccaagaaatccacctagacaacgtcaccgaaaaattcaacatgtggaaaaacaacatggtcgaacaaatgcacacagatatcatcagcctatgggaccaatcactcaaaccctgcgtcaaactcaccggaggctcagccatcacccaggcctgccccaaagtctccttcgaaccaataccaattcactactgcacacccgccggattcgccatcctcaaatgcaaagacgaaggattcaacggaaccggactctgcaaaaacgtctccaccgtccaatgcacccacggcataaaacccgtagtctcaacccagctactcctcaacggctcactcgccgaaaagaacattaccatccgctccgaaaacatcaccaacaacgccaaaataataatcgtacaactcgtccaacccgtcaccatcaaatgcatccgacccaacaacggcggctcaggatcgggcggggacatacgccaagcccattgcaacgtcacacgatccagatggaacaaaaccctccaagaagtagccgaaaaactccgcacctacttcggaaacaaaacaatcatcttcgcgaacagctccggcggagaccttgaaataaccacccacagcttcaactgcggcggcgagttcttctactgcaacacatcaggcctattcaactccacatggtacgtcaactccacatggaacgacaccgactccacccaagaatcaaacgacacaataacactcccctgccgaatcaaacaaatcatcaacatgtggcaacgcgccggccaagcaatgtacgccccacccatccccggcgtcatcaaatgcgaatccaacatcactggcctcctcctcacccgcgacggcggaaaagacaacaacgtaaacgaaaccttccgacccggcggcggcgacatgcgcgacaactggcgctcagaactctacaaatacaaagtcgtcgaaatcgaa

SEQ ID NO: 54774 - RNA, 648 nt, synthetic construct
  misc_feature 1..648: note = derived and/or modified sequence opt11 from anti-HIV_5CCK_LightChain
  source 1..648: mol_type = other RNA
caatccgccctcacccaacccgcctccgtatccgcctcacccggccaatccatcacaatctcctgctccggcacccgctccgacgtaggcggctacgacttcgtctcctggtaccaacaacaccccggcaaagtccccaaacttatcatatacgaagttaccaaacgcccctccggaatcccccaacgcttctccggctccaaatcaggcaacaccgcctcccttaccatctccggactacaagccgacgacgaagccgactactactgctgctcctacgccaactacgacaaactaatcctcggcggcggcacaaaactcaccgtcctcggccaaccaaaagccaaccccaccgtcaccctcttcccaccctcctccgaagaactacaagccaacaaagccaccctcgtctgcctaatctccgacttctaccccggcgcagtcaccgtcgcctggaaagccgacggctcccccgtcaaagccggcgtcgaaacaaccaaaccatccaaacaatccaacaacaaatacgccgcctcctcttacctctcgctcacacccgaacaatggaaatcccaccgatcctactcctgccaagtcacccacgaaggctcaaccgtcgaaaaaaccgtcgcccccaccgaatgctcc

SEQ ID NO: 54775 - RNA, 696 nt, synthetic construct
  misc_feature 1..696: note = derived and/or modified sequence opt11 from anti-HIV_5CCK_HeavyChain
  source 1..696: mol_type = other RNA
caagtgcaactggtacagagcggggccgaaatgaaggacccgggcgcgagcgtaaaagtgagctgccgcgcgagcggctacaagttcacggactactacatgcactgggtcagacaagcgcccggacaagggctcgagtgggtaggatgggtcaacaccaatggagggttcacaaaatacggcgcgaaattccaagggcgcgtgaccgtgaccagggacacgagtacgaacacggtcttcctcgagctatcacgcctgaccttcggcgataccgcgatgtacttctgcgcacggcccatgcgcccggtctcgcacgggatcgactactcgggcttgttcgtattccagttctggggcagaggaacgatggtgaccgtaagctcggcctcgaccaagggcccgagcgtattcccgctcgcgccctcgagcaagagcacgagcggaggcaccgccgcgctcggatgcctggtcaaggactatttcccggaaccggtcacggtctcgtggaacagcggagccctaacatcaggcgtacacacgttcccggccgtgctacagagctcgggactgtactcactctcgagcgtagtcacggtcccgagctcgagcctaggcacgcaaacgtacatatgcaacgtcaaccacaagccctcgaacacaaaagtggacaagaaagtggaaccgaaatcatgcgac

SEQ ID NO: 54776 - RNA, 648 nt, synthetic construct
  misc_feature 1..648: note = derived and/or modified sequence opt11 from anti-HIV_5AWN_LightChain
  source 1..648: mol_type = other RNA
caatccgtactcacccaacccgcctctgtctccgcctcccccggccaatcaatcaccgtctcctgcaccggctcccgaaacgacgtcggcggctacgacttcgtctcatggtaccaacgccaccctggcggcgtccccaaactcatcatctatgaaatctccaaacgaccctcaggcatcccccaacgcttctcaggctcccgctcaggcaacaccgcctcactcaccatcagcggcctccaagacgacgacgaagccgactactactgctgctcctacgcatcctacgaccgcctcatcttcggcggaggcacacgagtctccgtcctccgccaacccaaagccgccccctcagtcaccctattcccaccctcctccgaagaactgcaagcaaacaaagccacactcgtctgcctcatctccgacttctacccaggcgccgtcaccgtcgcctggaaagccgacggctcccccgtcaaagccggagtcgaaaccaccaaaccctccaaacaatccaacaacaaatacgccgcctcatcctacctctccctcactcccgaacaatggaaatcccaccgctcctactcttgccaagtcacccacgaaggctccaccgtcgaaaaaaccgtcgcccccaccgaatgctcc

SEQ ID NO: 54777 - RNA, 696 nt, synthetic construct
  misc_feature 1..696: note = derived and/or modified sequence opt11 from anti-HIV_5AWN_HeavyChain
  source 1..696: mol_type = other RNA
caagtccaactaatgcaatccggcgcccaactccgcgaccccggcgactccctcaaaatctcctgcaaagcatccggctacaacttcatcgactaccacatccactgggtccgcctcgcccccggccgtggcctagaatggatgggctggatcgaccccgtcggcggcatcaccaaatacgccggccaattccaaggccgactatccctaacccgcgacacctccaccaacaccctcttccttgaactctcccgcctaaccgccggcgacaccgccgtctacttctgcgcccgctccatgcgccccgtcgaccacggcatcgactactccggcctattcgtattccacttctggggccgcggctcagacgtcctcgtctcctccgcctctaccaaaggcccctccgtcttccccctcgccccctcctcaaaatccacctccggcggcaccgccgccctaggctgcctagtcaaagactacttcccagaacccgtcaccgtctcctggaactcaggcgccctcacctccggcgtccacacattcccagccgtcctccaatcctccggcctctactccctctcctccgtcgtcaccgtcccctcctcctccctaggcacccaaacctacatctgcaacgtcaaccacaaaccctcgaacacaaaagtcgacaagaaagtcgaacccaaatcctgcgat

SEQ ID NO: 54778 - RNA, 645 nt, synthetic construct
  misc_feature 1..645: note = derived and/or modified sequence opt11 from anti-HIV_3QEG_LightChain
  source 1..645: mol_type = other RNA
gaaatcgtaatgatgcaatcacccggcaccctatccctctcccccggcgaacgcgccacactctcatgccgcgcatcccaatccgtctccagctcctacctcgcctggtaccaacaaaaacccggccaagcaccacgcctcctcatctacggcgcctcctcccgcgccaccggcatccccgaccgcttctcaggatcaggctccggcacagacttcaccctcaccatatctcgcctcgaacccgaagacttcgccgtatactactgccaacaatacggctcctcccccgaaacattcggacaaggcaccaaagtcgaaatcaaacgcaccgtcgcagccccctccgtcttcatcttcccaccctccgacgaacaactcaaatccggcaccgcctccgtagtctgcctactcaacaacttctacccacgcgaagcaaaagtccaatggaaagtcgacaacgcactccaatccggcaactcccaagaatctgtcaccgaacaagactccaaagactcaacatactccctctcctccaccctcaccctatccaaagctgactacgaaaaacacaaagtctacgcctgcgaagtcacccaccaaggcctatcttcccccgtcaccaaatccttcaaccgcggcgaatgc

SEQ ID NO: 54779 - RNA, 717 nt, synthetic construct
  misc_feature 1..717: note = derived and/or modified sequence opt11 from anti-HIV_3QEG_HeavyChain
  source 1..717: mol_type = other RNA
caagtccaacttgtccaatccggcgccgaagtcaaaaaacccggctcatccgtcaaagtctcatgccgagcctcccgcggcaccttctcctcctacggcatcacctgggtccgccaagcacccggccaaggcctagaatggatgggcggcatcatcccaatcttcgacgtcaccaactacgcacaaaacttccaaggccgagtagcaatcaccaccgacgccgaaatgtccaccgcctacatggaactccgctccctcaaatccgaagactcagccgtctactactgcgcctccgactcccgagacttctcctactacgaacccggcacctcctactcccactactacaacatcatggacgtctggggacaaggcaccaccgtcactgtctcctccgcctccacaaaaggaccatccgtcttccccctcgccccctcctcaaaatccacctccggcggaaccgcagcactcggctgcctagtaaaagactacttccccgaacccgtaaccgtctcatggaactccggcgccctaacctcaggcgtacacaccttccccgccgtcctccaatcctccggcctctactccctctcttcagtcgtcaccgtcccctcctcctccctcggcacccaaacctacatctgcaacgtcaaccacaaaccctccaacaccaaagtcgacaaacgagtcgaaccaaaatcctgcgacaaaacccac

SEQ ID NO: 54780 - RNA, 690 nt, synthetic construct
  misc_feature 1..690: note = derived and/or modified sequence opt11 from anti-HIV_1N0X_K-Chain
  source 1..690: mol_type = other RNA
caagtccaactagtccaatccggcgccgaagtcaaaaaacccggcgcctccgtcaaagtctcctgccaagcctccggataccgcttctccaacttcgtcatccactgggtccgccaagcccccggccaacgattcgaatggatgggctggatcaacccctacaacggcaacaaagaattctccgccaaattccaagaccgtgtaacattcaccgccgacacctccgccaacaccgcctacatggaactccgatccctccgctccgccgacaccgccgtctactactgcgcccgcgtcggcccctactcctgggacgactccccccaagacaactactacatggacgtctggggcaaaggaaccaccgtaatcgtctcctccgcctccaccaaaggtccttccgtattccccctcgccccctcctccaaatcaacctccggcggcaccgccgccctcggatgcctcgtcaaagattacttccccgaacccgtcaccgtctcctggaactccggcgccctaacctccggcgtccacaccttccccgccgtcctccaatcctccggcctctactccctctcctccgtcgtcaccgtcccctcctcatccctcggcacacaaacatacatctgcaacgtcaaccacaaaccctccaacaccaaagtagacaaaaaagtcgaacccaaatcctgc

SEQ ID NO: 54781 - RNA, 645 nt, synthetic construct
  misc_feature 1..645: note = derived and/or modified sequence opt11 from anti-HIV_1N0X_M-Chain
  source 1..645: mol_type = other RNA
gaaatcgtcctcacccaatcccccggcaccctatcactctcacccggagaacgcgccaccttctcctgccgctcatcccactccatccgatcccgccgcgtagcatggtaccaacacaaacccggccaagcaccccgcctcgtaatccacggcgtatccaaccgcgcctccggcatctcagacagattctccggctcgggctcaggcaccgacttcaccctaaccatcacccgcgtcgaacccgaagacttcgccctctactactgccaagtctacggcgcatcctcctacaccttcggccaaggcaccaaactcgaacgaaaacgaaccgtcgcagcccccagcgtcttcatcttcccaccctccgacgaacaactcaaatccggcaccgcctcagtcgtctgcctcctcaacaacttctacccccgcgaagccaaagtacaatggaaagtcgacaacgccctccaatccggcaactcccaagaatccgtcaccgaacaagattccaaagactccacctactccctatcctccaccctaaccctctccaaagccgactacgaaaaacacaaagtctacgcctgcgaagtcacccaccaaggcctgcgatcacccgtaaccaaatccttcaaccgcggcgaatgc

SEQ ID NO: 54782 - RNA, 654 nt, synthetic construct
  misc_feature 1..654: note = derived and/or modified sequence opt11 from anti-HIV_3QEH_HeavyChain
  source 1..654: mol_type = other RNA
gacatcgtcatgacacaatcccccctctccctacccgtcacccccggcgaagccgcctccatctcctgccgctcctcccaatccctactccacaccaacggcttccaatacctcgactggtacctccaaaaacccggccaatcccctcaactcctcatctacctcggctccaacagggccacaggagtcccccaccgcttctcaggctccggctccggcaccgaattcaccctcaaaatctcccgcgtcgaagccgaagacgtcggcgtctactactgcatgcaagccaaagaatcccccacattcggacaaggcaccaaagtcgaaataaaacgcaccgtcgccgccccctccgtcttcatcttccccccctccgacgaacaactcaaatccggcaccgcctccgtcgtctgcctcctcaacaacttctacccccgcgaagccaaagtccaatggaaagtcgacaacgcactccaatctggcaactcccaagaatccgtcaccgaacaagactccaaagactccacctactccctctcctccaccctaaccctctccaaagccgactacgaaaaacacaaagtctacgcctgcgaagtcacccaccaaggcctcagctcccccgtcaccaaatccttcaaccgcggagaatgc

SEQ ID NO: 54783 - RNA, 696 nt, synthetic construct
  misc_feature 1..696: note = derived and/or modified sequence opt11 from anti-HIV_3QEH_G-Chain
  source 1..696: mol_type = other RNA
caagtccaactcgtccaatccggagccgaagtccgcaaacccggcgcctccgtcacagtctcatgcaaaacctcaggctacaccttcgtcaacttctacatcgtctgggtccgccaagcaccaggccaaggcctcgaatggatgggcgtaatcaaccccttccgcggcgacacctacttcgcccaaaaattcaaaggccgcgtcacactcacacgcgacacctccacctctaccgtcttcatggaactctcctccctacgctccgacgacaccgccatctactactgcgcacgcgacctcgaaatgcgcgacggcaacaaccacggatcacacctcgaattttggggccaaggcaccctcgtcaccgtctcctccgcctccaccaaaggcccatcagttttccccctagccccctcctccaaatccacatccggcggcaccgccgccctcggatgcctagtcaaagactacttccccgaacccgtcaccgtctcatggaactccggcgccctaacttccggcgtacacacattccccgccgtcctccaatcctcaggactctattcactctcatccgtcgtcaccgtcccctcctcctccctcggcacccaaacatacatctgcaacgtaaaccacaaaccctccaacacaaaagtcgacaaacgcgtcgaaccaaaatcctgcgataaaacacac

SEQ ID NO: 54784 - RNA, 678 nt, synthetic construct
  misc_feature 1..678: note = derived and/or modified sequence opt11 from anti-HIV_2B1H_HeavyChain
  source 1..678: mol_type = other RNA
gaaatccaactcgaacaatccggcgccgaagtcaaaaaatcaggagaatccctcaaaatctcctgccaaacctcaggatactccttctctgactactggataggctgggtacgccaaatgcccggcaaaggcctcgaatggatgggcatattctaccccggcgactccgactcacgctactccccctccttcgaaggccaagtcaccatgtccgccgaccgatccaccaacaccgcccacctccaatggtcctccctcaaaccctccgacaccgccctctactactgcgcccgcctaggcggcgactacgaagactcaggcgcagacgccttcgacttctggggccaaggcacactcgtcaccgtctcatccgcctccacaaaaggcccctccgtcttccctctcgcaccctcatcaaaatccacctccggcggcaccgccgccctcggctgcctcgtcaaagactacttccccgaacccgtaaccgtatcatggaactccggcgccctaacctccggcgtccacaccttcccagccgtcctccaatcctccggcctatactcactctcctccgtagtcaccgtcccatcatcctctctcggaacacaaacctacatctgcaacgtcaaccacaaaccctcaaataccaaagtcgacaaaaaagtcgaacccaaatca

SEQ ID NO: 54785 - RNA, 645 nt, synthetic construct
  misc_feature 1..645: note = derived and/or modified sequence opt11 from anti-HIV_2B1H_LightChain
  source 1..645: mol_type = other RNA
caatccgtcctcacccaaccaccatcagcctccggcacccccggccaacgcatctccatctcctgctcaggaacctcctccaacgtcgaaaacaactacgtctactggtaccaacacctacccggcaccgcccccaaactcctcatctaccgaaacgaccaccgctcatccggcatcccagaccgcttctccgcctccaaatccggcacctccgcctccctagccatctcaggcctccgcccagaagacgaaggcgactactactgcgccgcctgggacgactcccgcggcggcccagactgggtattcggcggcggaaccaaactcaccgtcctcgcacaacccaaagcagccccctccgtaaccctcttccccccctcctccgaagaactacaagccaacaaagccaccctcgtctgcctaatctccgacttctaccccggcgccgtcaccgtcgcctggaaagccgactcctcccccgtcaaagccggcgtcgaaaccacaaccccctccaaacaatccaacaacaaatacgccgccagctcctacctctccctaacccccgaacaatggaaatcccacaaatcatactcctgccaagtaacccacgaaggctcaaccgtcgaaaaaacagtcgcccccaca

SEQ ID NO: 54786 - RNA, 648 nt, synthetic construct
  misc_feature 1..648: note = derived and/or modified sequence opt11 from anti-HIV_3TNM_B-Chain
  source 1..648: mol_type = other RNA
caatccgtcctaacccaacccccctccgcctcaggctcccctggccaatccgtaaccatctcctgcaccggcacctcctccgacgtcggcggctacaactacgtctcctggtaccaacaccacccaggcaaagcccccaaactcatcatctccgaagtcaacaaccgccccagcggagtccccgaccgcttctcaggctcaaaatccggcaacacagcctccctcaccgtctccggcctccaagccgaagacgaagcagaatactactgctcctcctacaccgacatccacaacttcgtcttcggaggcggcaccaaactcacagtcctcggccaacccaaagcagccccctccgtcaccctattccccccctcatcagaagaactccaagcaaacaaagcaacactcgtctgcctcatctccgacttctaccccggcgccgtcacagtcgcctggaaagccgactcctcccccgtcaaagccggcgtcgaaaccaccactccctccaaacaatccaacaacaaatacgccgcctcatcctacctctccctcacccccgaacaatggaaatcccaccgctcctactcctgccaagtcacacacgaaggctccaccgtcgaaaaaaccgtcgcccccaccgaatgctcc

SEQ ID NO: 54787 - RNA, 693 nt, synthetic construct
  misc_feature 1..693: note = derived and/or modified sequence opt11 from anti-HIV_3TNM_A-Chain
  source 1..693: mol_type = other RNA
caagtccaactccaagaatcaggccccggcctcgtcaaaccctcacaaaccctctccctctcctgcaccgtctccggcggctcctcttcctccggcgcacactactggtcctggatacgccaataccccggcaaaggactcgaatggatcggctacatccactactccggaaacacctactacaacccctccctcaaatcccgcatcaccatatcccaacacacctcagaaaaccaattctccctcaaactcaactccgtcaccgtcgccgacaccgccgtctactactgcgcccgcggcacacgactacgcaccctccgaaacgcattcgacatctggggccaaggcaccatggtaaccgtctcctccgcctccaccaaaggcccctccgtcttcccactcgccccctcctcaaaatcaacctccggcggcacagccgccctcggatgcctagtcaaagactacttccccgaacccgtcaccgtctcctggaacagcggcgccctcacctcaggcgtacacaccttccccgccgtcctccaatcctccggcctctactctctctcctcagtagtcaccgtcccctcctcctcactcggaacccaaacctacatctgcaacgtcaaccacaaaccctccaacaccaaagtagacaaacgcgtcgaaccaaaatcatgcgacaaaacacacacc

SEQ ID NO: 54788 - RNA, 690 nt, synthetic construct
  misc_feature 1..690: note = derived and/or modified sequence opt11 from anti-HIV_3UJJ_HeavyChain
  source 1..690: mol_type = other RNA
gaagtccaactagtccaatccggcgccgaagtcaaaaaacccggcgaatcactcaaaatctcatgcaaagcctcaggctactccttctcatcttactggatcgcctgggtccgccaaatgcccggcaaaggcctcgaatggatgggattcatctaccccgccgactctgacacccgctactcccccagcttccaaggccaaggaaccatctccgccgacaaatccatctccaccgcctacctccaatggtcctccctaaaagcctccgacaccgccatgtactactgcgccatcctaggcttctggggagccaaccgcggcggcggcggcatggacgtctggggccaaggaaccaccgtcatcgtatcatccgcctccaccaaaggcccctcagtcttcccactcgccccctcctcaaaatccacctccggcggcacagccgccctaggctgcctcgtcaaagactacttccccgaacccgtcacagtctcctggaattccggcgcccttacatccggagtacacaccttccccgccgtactacaatcctccggcctatactccctctcttccgtcgtcaccgtcccctcctcctccctcggcacccaaacctacatctgcaacgtcaaccataaaccctcaaacaccaaagtcgacaaaaaagtcgaaccaaaatcctgcgacaaaaca

SEQ ID NO: 54789 - RNA, 639 nt, synthetic construct
  misc_feature 1..639: note = derived and/or modified sequence opt11 from anti-HIV_3UJJ_LightChain
  source 1..639: mol_type = other RNA
tcctacgaactcacccaacccccctccgtctcagtcagccccggccaaaccgcccgcatcacttgctccggcgacgccctccccgaaaaatacgcatactggtaccaacaaaaatccggccaagcccccgtcctaatcatctacgaagactccaaacgcccctccggaatccccgaacgcttctccggatcccgctcaggcaccatggccaccctcaccatctctggcgcccaagtcgacgacgaagccgactactactgctactccacaaactccggcggcaccttcttcgtcttcggcaccggcaccaaagtcacagtactcggccaacccaaagccaaccccaccgtcacactcttccccccctcctcagaagaactccaagccaacaaagccaccctcgtctgccttatctcagacttctaccccggcgccgtcactgtcgcctggaaagccgactcctcaccagtcaaagccggagtcgaaaccaccaccccatccaaacaatccaacaacaaatacgccgcctcctcctacctatccctcaccccagaacaatggaaatcccaccgctcatactcctgccaagtcacccacgaaggctccaccgtcgaaaaaacagtagcccccaccgaatgc

SEQ ID NO: 54790 - RNA, 669 nt, synthetic construct
  misc_feature 1..669: note = derived and/or modified sequence opt11 from anti-HIV_3UJI_HeavyChain
  source 1..669: mol_type = other RNA
caagtccaactagtccaatccgccgcggaagtcaaaaaacccggcgaagccctcaaaatatcctgcaaaggctccggctactccttctccaactactggatcgcctgggtccgccaaatgcccggcaaaggcctagaatggatgggcatcgtctaccccgacgactccgactcctcctacaactcctccttccaaggccaaatcaccttctcagccgacaaatccatctccacagcctacctccactggacctcactccaagcctccgacaccgccatgtactactgcgcccgcctaggattcgaaggcgactactccggctccttcttcgactactggggccaaggcaccctcctaatcgtatcctcagcctccaccaaaggcccctccgtattcccactagccccctcctccaaatccacctccggcggcaccgcagccctcggctgcctcgtcaaagactacttccccgaacccgtcaccgtctcctggaactccggcgccctcacctccggcgtccacacattccccgccgtcctccaaagctccggcctatactccctctcctccgtcgtcaccgtcccctcctcctccctcggcacacaaacctacatctgcaacgtcaaccacaaaccctccaacaccaaagtcgataaaaaagtagaaccc

SEQ ID NO: 54791 - RNA, 627 nt, synthetic construct
  misc_feature 1..627: note = derived and/or modified sequence opt11 from anti-HIV_3UJI_LightChain
  source 1..627: mol_type = other RNA
tcttacgaactcacccaacccccctccgtctccgtctcccccggccaaaccgcctcaatcacctgctccggagacatcctcggagacaaatacgtctcctggtaccaacaaaaatccggacaatcccccctcctcgtcatctacgaagacaccaaacgcccctccggcatccccgaccgcttctccggctccaaatccggcaacaccgcaaccctcaccatctccggaacccaagccatggacgaagccgactactactgccaagcctgggactccaccctaggcgtcgtcttcggcggcggcacaaaagtaaccgtcctcggacaacccaaagccgccccctccgtcaccctcttccccccctcctccgaagaactccaagccaataaagccaccctcgtctgcctcatctccgacttctaccccggagccgtcacagtcgcctggaaagccgactcctccccagtcaaagccggcgtagaaaccaccaccccctcaaaacaatccaacaacaaatacgccgcctcctcctacctttccctcacacccgaacaatggaaatcccacaaatcatactcatgccaagtaacccacgaaggctccaccgtcgaaaagacagtcgccccc

SEQ ID NO: 54792 - RNA, 666 nt, synthetic construct
  misc_feature 1..666: note = derived and/or modified sequence opt11 from anti-HIV_2QSC_HeavyChain
  source 1..666: mol_type = other RNA
caagttcaacttgtccagtccggcggcggcctcgtccaaccaggcggctctctccgcctctcatgcgccgcattcggcttcaacttctcctcttacgtcatgcactgggtccgccaagcccccggccaaggcctcgaatacctctccgccatctcctccgacggagaaactacataccacgccaactcagtcaaaggccgcttcacctcctcccgcgacaactccaaaaacaccctcttcctacaaatgggatcactccgaaccgaagacgtcgccgtctactactgcgcacgagaccgctactacgaaacctccggctccaacgccttcgacgtatggggccaaggcaccatggtagtcgtatcatccgcctctaccaaaggaccctccgtcttccccctagccccctgctcccgatcaacctccgaatccaccgccgcactaggctgcctagtcaaagactacttccccgaacccgtcaccgtctcatggaactcaggcgcccttacctccggcgtccacacattccccgccgtcctccaatcctccggcctctactccctctcctccgtcgtcaccgtcccctcctcaaacttcggcacccaaacctacacatgcaacgtcgaccacaaaccctccaacaccaaagtcgacaaaaccgtcgaa

SEQ ID NO: 54793 - RNA, 645 nt, synthetic construct
  misc_feature 1..645: note = derived and/or modified sequence opt11 from anti-HIV_2QSC_LightChain
  source 1..645: mol_type = other RNA
aactccgtcctcacccaatccccttcctccctctccgcctccgtcggcgaccgcgtaacaatcacatgccaagccagccaagacatctccaactaccttaactggtaccaacacaaacccggcaaagcccccaaactcctcatctacaccgcctccaacctcgaaaccggcgtcccctcccgcttctccggcggaggctccggcacccacttctcctttaccatcacctccctccaacccgaagacgccgccacctacttctgccaacaatacgacaacctcggcgacctctccttcggcggaggcaccaaagtcgaaatcaaacgcacagtagccgccccctcagttttcatcttcccaccctccgacgaacaactcaaatccggcaccgcctccgtcgtctgcctactcaacaacttctacccccgagaagccaaagtccaatggaaagtcgacaacgccctccaatccggcaactcccaagaatccgtcaccgaacaagactccaaagactccacctactcactctcctccaccctcaccctctccaaagccgactacgaaaagcacaaagtctacgcctgcgaagtcacccaccaaggcctctcctcccccgtcaccaaatccttcaaccgcggcgaatgc

SEQ ID NO: 54794 - RNA, 690 nt, synthetic construct
  misc_feature 1..690: note = derived and/or modified sequence opt11 from anti-HIV_3MLZ_HeavyChain
  source 1..690: mol_type = other RNA
caagtccaactccaagaatccggcccaggcctcgtcaaaccctcagaaaccctctcactcacctgcacagtctccggcggctccatctccggattccactggtcatggatccgtcaaccccccggaaaaggcctagaatacattggctacatctactactccggctccacctcatacaacccctccctcaaatcccgagtctccatgtccgtcgacacctcccgcaaccaattctccctcgaactatcctcagtaaccgccgccgacaccgcagtctactactgcgcccgcgacttcggcgaataccactacgacggccgcggcttccaatgcgaaggcttcgacctctggggccaaggaaccctcgtcacagtctcttccgcctcaaccaaaggcccctccgtcttccccctcgccccctcatccaaatccacctcaggcggcaccgcagcactcggctgcctcgtcaaagactacttccccgaacccgtcaccgtctcctggaactccggagccctcacctccggcgtacacaccttccccgccgtactccaatcatcaggcctctactccctatcatccgtcgtcaccgtcccatcctcatcactaggcacccaaacctacatctgcaacgtcaaccacaaaccctccaacaccaaagtcgacaaaaaagtcgaacccaaatcctgc

SEQ ID NO: 54795 - RNA, 642 nt, synthetic construct
  misc_feature 1..642: note = derived and/or modified sequence opt11 from anti-HIV_3MLZ_LightChain
  source 1..642: mol_type = other RNA
caatccgtcctcacacaacccccctcagtctccgccgcccccggccaaaaagtcaccatctcctgctccggctcctcctccaacatcggcaacaacatggtctcctggtaccaacaacaccccggcaccgcacccaaactcctcatctacgaaaactccaaacgcccctccggcatccccgaccgcttctcaggctcacgatccggaacctccgcaaccctcggcatcatcggcctccaaaccggcgacgaagcagaatactactgcgccacctgggacgggtccctacgcaccgtcttcggcggcggcaccaaactcaccgtcctctcccaacccaaagccgccccctccgtcacactcttccccccctcctccgaagaactccaggccaacaaagccaccctcgtctgcctcatctccgacttctaccccggcgccgtcaccgtagcctggaaagccgactcctcacccgtccgcgccggcgtcgaaaccaccaccccctccaaacaatccaacaacaaatacgccgcctcatcctacctctccctcacccccgaacaatggaaatcccaccgctcatactcttgccaagtcacccacgaaggctccaccgtcgaaaaaaccgtagcccccaccgaatgc

SEQ ID NO: 54796 - RNA, 684 nt, synthetic construct
  misc_feature 1..684: note = derived and/or modified sequence opt11 from anti-HIV_3MLX_I-Chain
  source 1..684: mol_type = other RNA
caagtccaactccaagaatcaggccccggcctagtcaaaccctccgaaaccctctccctcacctgcaccgtctccggcggatccatctccggcttccactggtcctggatccgccaaccccccggcaaaggcctcgaatacatcggatacatatactactccggctccacctcctacaacccctccctcaaatcccgcgtctccatgtcagtcgacacctctcgcaaccaattctccctcgaactatcctcagtcaccgccgcagacaccgccgtctactactgcgcccgagacttcggcgaataccactacgacggacgcggcttccaatgcgagggcttcgacctctggggccaaggcaccctagtaaccgtctcctccgcctccaccaaaggcccctccgtattccccctcgccccctcatccaaatccacatccggcggcaccgccgccctaggctgcctcgtcaaagactacttccccgaacccgtcaccgtctcctggaactccggcgccctcacctccggcgtccataccttccccgccgtccttcaatcctcaggcctctactcactctcatccgtcgttaccgtcccctcatcctcccttggcacccaaacctacatctgcaacgtcaaccacaaaccctccaacacaaaagtagacaaaaaagtcgaacccaaa

SEQ ID NO: 54797 - RNA, 633 nt, synthetic construct
  misc_feature 1..633: note = derived and/or modified sequence opt11 from anti-HIV_3MLX_M-Chain
  source 1..633: mol_type = other RNA
tccgtcctcacccaacccccctccgtctcagccgccccaggccaaaaagtaaccatatcctgctccggctcctcctccaacatcggcaacaacatggtctcctggtaccaacaacaccccggcaccgcccccaaactacttatctacgaaaacagcaaacgcccctccggcatccccgaccgcttctccggctcacgctccggcacatccgccaccctcggcatcatcggcctccaaaccggagacgaagccgaatactactgcgcaacctgggacggctccctccgcaccgtcttcggcggcggcaccaaattaaccgtcctctcccaacccaaagcagcccccagcgtcaccctattccccccctcctccgaagaacttcaagccaacaaagccaccctcgtctgcctcatctcagacttctaccccggcgccgtcaccgtcgcctggaaagccgactcctcccccgtccgcgccggcgtcgaaactaccaccccctccaaacaatccaacaacaaatacgccgcctcctcttacctctccctcacccccgaacaatggaaatcccaccgctcctactcttgccaagtcacccacgaaggctccaccgtcgaaaaaacagtcgcccccacc

SEQ ID NO: 54798 - RNA, 684 nt, synthetic construct
  misc_feature 1..684: note = derived and/or modified sequence opt11 from anti-HIV_3MLW_I-Chain
  source 1..684: mol_type = other RNA
caagtccaactagtccaatccggcgccgaagtcaaaaaagccggcgaatccctagaaatctcatgcaaaggctctggctacaccttcaccgaccactggatagcctgggtccgccaagtccccggaaaaggcctcgaatggatgggcatgatctacccaggcgactccgacacccgctactccccctccctccaaggccgcgtaaccatgtccgccgacaaaaccctctcaaccgcatacctccaatggtcccgcctcgaagcctctgacaccgccatgtactactgcgcccgactccactactccgaccgatccggctcctacttcaacgacgtcttccacatgtggggccaaggcaccaccgtcaccgtatcatccgcctccaccaaaggcccatccgtattccccctcgccccctcctccaaatcaacctccggcggcaccgccgccctcggctgcctcgtcaaagactacttccccgaacccgtcacagtctcctggaactccggcgccctcacctcaggcgtccacacattccccgccgtcctccaatcctccggcctctactcactctcctccgtagtaaccgtcccctcctcctcactaggaacccaaacatacatctgcaacgtcaaccacaaaccctccaacacaaaagtagacaaaaaagtcgaaccaaaatcc

SEQ ID NO: 54799 - RNA, 645 nt, synthetic construct
  misc_feature 1..645: note = derived and/or modified sequence opt11 from anti-HIV_3MLW_M-Chain
  source 1..645: mol_type = other RNA
caatccgtcctcacccaacccccctccgcctccggaacccccggccaacgcgtcaccatctcctgctccggcaactcctcaaacatcgaaaacaactacgtctactggtaccaacaactcccaggctccacacccaaactcctcatcttccgcgacgaccaacgcccatccggcgtccccgaccgattctccggctccaaatcaggcacctcagcctccctcgcaatctcaggcctacgatccgaagacgaagccgactactactgcgcctcctgggacgactccagaggcggccccgactacgtattcggcaccggcaccaaagtcaccgtcctcggccaacccaaagccaaccccaccgtcaccctattccccccatcctccgaagaacttcaagccaacaaagccaccctcgtctgcctaatctcagacttctaccccggagccgtcaccgtcgcttggaaagccgacggatcccccgtcaaagccggcgtcgaaaccaccaaaccctccaaacaatcaaacaacaaatacgccgcctcctcctacctctcccttacacccgaacaatggaaatcccaccgctcctactcctgccaagtcacccacgaaggctccactgtagaaaaaaccgtcgcccccacc

SEQ ID NO: 54800 - RNA, 678 nt, synthetic construct
  misc_feature 1..678: note = derived and/or modified sequence opt11 from anti-HIV_3MLV_N-Chain
  source 1..678: mol_type = other RNA
gaagtccaactcgtcgaatcaggcggagaagtcaaacaacccggccaatccctcaaaatctcctgcaaatcatcaggttacaacttcctcgactcctggatcggctgggtccgccaaatacccggcaaaggcctagaatggatcggcatcatctaccccgacgactccgacgcccactactccccctccttcgaaggacaagtcaccatgtccgtcgacaaatccatctccaccgcctacctccaatggaccactctacaagcctccgacaccggcaaatacttctgcacacgcctctacctcttcgaaggcgcccaatcctcaaacgccttcgacctctggggccaaggcaccatgatactcgtctcctccggcaccaccaaaggcccatccgtcttccccctagcccccagctccaaatcaacctccggcggcacagccgccctcggctgcctagtcaaagactacttccccgaacccgtcaccgtctcctggaactccggcgcactcaccagcggagtccacaccttccccgccgtcctccaatcctccggcctctactccctatcctcagtcgtcaccgtcccctcatcctccctcggcacccaaacctacatctgcaacgtcaaccacaaaccctccaacaccaaagtcgacaaaaaagtcgaacccaaatca

SEQ ID NO: 54801 - RNA, 657 nt, synthetic construct
  misc_feature 1..657: note = derived and/or modified sequence opt11 from anti-HIV_3MLV_M-Chain
  source 1..657: mol_type = other RNA
tcctacctcctaacccaacccccctcagtctccgtatcccccggccaaaccgcctccatctcctgctcaggcgacaaactcgacgacaaatacgtctcctggtactaccaacgccccggccaatcacccgtcctcctcatgtaccaagacttcaaacgaccctccggaatccccgaacgcctctccggctcaaaatccggcaaaaccgccaccctcaccatctccggcacacaatccctcgacgaaggcgactactactgccaagcctgggacgcatccaccggcgtctccggcggcggcacaaaactcaccgtcctcttcggcgaaggcacccgcctcaccgtactcgcccaacccaaagccgccccctccgtcaccctcttccccccctcctccgaagaactccaagctaacaaagccaccctcgtctgcctcatctccgacttctaccccggcgcagtcaccgtcgcctggaaagctgactcctcccccgtaaaagccggcgtcgaaaccaccaccccatccaaacaatccaacaacaaatacgccgcctcctcctacctctccctcacccccgaacaatggaaatcccacaaatcctactcatgccaagtcacccacgaaggctccaccgtagaaaaaaccgtcgcccccacc

SEQ ID NO: 54802 - RNA, 654 nt, synthetic construct
  misc_feature 1..654: note = derived and/or modified sequence opt11 from anti-HIV_3MLU_LightChain
  source 1..654: mol_type = other RNA
tacctactcacccaacccccatcagtctccgtctcccccggccaaacagcctcaatctcctgctccggcgacaaactcgacgacaaatacgtctcctggtactaccagcgccccggccaatccccagtcctcctcatgtaccaagacttcaaacgcccctccggcatccccgaacgcctctcaggctcaaaatccggaaaaaccgccaccctcaccatctccggaacacaatccctagacgaaggcgactactactgccaagcctgggacgcctccacaggcgtctccggcggcggcaccaaactcaccgtactcttcggcgaaggcacccgcctcaccgtcctagcccaacccaaagccgccccatccgtcaccctcttccccccctcctccgaagaactccaagccaacaaagccaccctcgtctgccttatctccgacttctaccccggcgccgtcacagtcgcctggaaagccgactcctcccccgttaaagccggcgtcgaaaccaccaccccatccaaacaatccaacaacaaatacgccgcctcctcctacctctccctcactcccgaacaatggaaatcccacaaatcatactcctgccaagtcacccacgaaggctccaccgtcgaaaaaaccgtcgcacccacc

SEQ ID NO: 54803 - RNA, 657 nt, synthetic construct
  misc_feature 1..657: note = derived and/or modified sequence opt11 from anti-HIV_3MLT_G-Chain
  source 1..657: mol_type = other RNA
tcctacgaccttacccaaccaccctccgtctccgtctccccaggccaaacagcctccatctcctgctccggcgacaaactcgacgacaaatacgtctcctggtactatcaacgcccaggccaatcacccgtcctcctcatgtaccaagacttcaaacgcccctccggcatccccgaacgcctctccggctccaaatcaggcaaaaccgccaccctcaccatctccggaacccaatccctcgacgaaggcgactactactgccaagcctgggacgcctccaccggcgtctccggcggcggcaccaaactcaccgtactcttcggagacggcacccgactcaccgtcctcggacaacccaaagccgccccctccgttaccctattcccaccctcatccgaagaactacaagctaacaaagccaccctagtctgcctaatctcagacttctaccccggcgccgtcaccgtcgcctggaaagcagactcctcccccgtcaaagccggcgtcgaaaccacaacaccctcaaaacaatcaaacaacaaatacgccgcctcctcctacctctccctaacacccgaacaatggaaatcccacaaatcctactcatgccaagtcacccacgaaggctcaactgtcgaaaaaaccgtcgcccccacc

SEQ ID NO: 54804 - RNA, 666 nt, synthetic construct
  misc_feature 1..666: note = derived and/or modified sequence opt11 from anti-HIV_3GO1_HeavyChain
  source 1..666: mol_type = other RNA
gaagtccaactacaagaatccggccccggcctcgtcaaaccctcagaaacactctccctcacatgcaccgtctccggcggcccaatcaacaacgcctactggacctggatccgccaaccacccggcaaaggactcgaatacctcggctacgtttaccacaccggcgtcaccaactacaacccctccctcaaatcccgactcaccatcaccatcgatacctcacgaaaacaactctcactctccctcaaattcgtcaccgcagccgactccgccgtctactactgcgcccgcgaatgggccgaagacggagacttcggcaacgccttccacgtatggggccaaggaacaatggtcgccgtatcctccgcctcaaccaaaggcccctccgtcttccccctagccccctccagcaaatcaacctccggcggaaccgccgccctcggctgcctagtaaaagactacttccccgaacccgtcaccgtctcctggaactccggcgccctaacctccggcgtccacacattccccgccgtcctccaatcctccggcctctactcactctcctccgtcgtcaccgtcccctcctcatccctcggcacccaaacctacatctgcaacgtcaaccacaaaccctccaacaccaaagtcgacaaacgcgtcgaaccc

SEQ ID NO: 54805 - RNA, 627 nt, synthetic construct
  misc_feature 1..627: note = derived and/or modified sequence opt11 from anti-HIV_3GO1_LightChain
  source 1..627: mol_type = other RNA
tcttacgtactcacccaaccaccctccgtctcagtctcccccggtcaaaccgcccgcatcacctgctccgcagaagccctctccaaccaatacgcatactggtaccgccaacgccccggccaagcccccctcctaatcatctacaaagacaccaaacgcccctccggcatccccgaacgcttctccggatccacctccggcaccaccgtcactctcaccatctccggcgtccaagccgaagacgaagccgactactactgccaatccgccgactcctccggcgactacgtcttcggcggcggcaccaaagtaaccgtcctcggccaacccaaagccaaccccaccgtcaccctcttccccccctcatccgaagaactccaagccaacaaagccaccctcgtctgcctcatctccgacttttaccccggcgcagtcacagtcgcctggaaagccgacggctcccccgtcaaagccggcgtcgaaaccaccaaaccctcaaaacaatccaacaacaaatacgccgcctcctcctacctctccctcacccccgaacaatggaaatcccaccgctcatactcctgtcaagtcacccacgaaggctcaaccgtagaaaaaaccgtcgccccc

SEQ ID NO: 54806 - RNA, 690 nt, synthetic construct
  misc_feature 1..690: note = derived and/or modified sequence opt11 from anti-HIV_4XCY_J-Chain
  source 1..690: mol_type = other RNA
caagtccaactcgtacaatccggcgccgaagtcaaacgccccggctcctccgtcaccgtctcctgcaaagcctccggcggctccttctcaacttacgccctctcctgggtacgccaagcccccggccgcggcctagaatggatgggtggcgtcatcccccttctcacaatcaccaactacgccccccgcttccaaggccgcatcacaataaccgccgaccgctcaacctccaccgcttacctcgaactcaactccctacgcccagaagacaccgccgtctactactgcgcccgcgaaggcaccaccggctggggctggctcggcaaacccatcggcgccttcgcccattggggccaaggaaccctcgttaccgtctcctcagcctccaccaaaggcccatccgtcttccccctcgccccctcatccaaatccacatcaggcggcaccgccgcactcggctgcctcgtcaaagactacttccccgaacccgtcaccgtctcctggaactccggcgccctcacctcaggagtccacaccttccccgccgtcctccaatcctcaggcctctactcactctcctccgtagtcaccgtaccctcttcctcactcggcacccaaacctacatctgcaacgtcaaccacaaaccctccaacaccaaagtcgacaaaaaagtcgaacccaaatcctgc

SEQ ID NO: 54807 - RNA, 645 nt, synthetic construct
  misc_feature 1..645: note = derived and/or modified sequence opt11 from anti-HIV_4XCY_K-Chain
  source 1..645: mol_type = other RNA
gaaatcgtcctcacccaatcccccggcacccaatccctctcacccggcgaacgagccaccctatcatgccgcgcatcccaatccgtaggcaacaacaaactagcatggtaccaacaacgacccggccaagccccacgactcctcatctacggcgcctcctcccgcccatcaggcgtcgccgaccgattctccggctccggctcaggcaccgacttcaccctaaccatctcgcgactcgaacccgaagacttcgccgtctactactgccaacaatacggccaatcactatccaccttcggccaaggcaccaaagtcgaagtaaaacgcaccgtcgccgccccaagcgtcttcatcttcccaccctcagacgaacaactaaaatccggcacagcctccgtcgtctgcctcctaaacaacttctacccccgcgaagccaaagtccaatggaaagtcgacaacgccctccaatccggcaactcccaagaatccgtcaccgaacaagactcaaaagactccacctactccctctcatccaccctcaccctctccaaagccgactacgaaaaacacaaagtctacgcatgcgaagtaacccaccaaggcctcagctccccagtcaccaaatccttcaaccgcggcgaatgc

SEQ ID NO: 54808 - RNA, 630 nt, synthetic construct
  misc_feature 1..630: note = derived and/or modified sequence opt11 from anti-HIV_4YBL_C-Chain
  source 1..630: mol_type = other RNA
gtcctcacccaacccccctccgcctccggctcccccggccaatcagtcaccatctcctgcaccggcacctcctccgacgtcggcggctacaactacgtctcctggtaccaacaccaccccggcaaagcccccaaactcatcatctccgaagtaaacaaccgcccctccggcgtcccagaccgcttctcaggctccaaatccggcaacaccgcctccctcacagtatccggcctccaagccgaagacgaagccgaatactactgctcctcctacaccgacatccacaacttcgtcttcggcggcggcaccaaactaaccgtcctaggccaacccaaagccgcaccctccgtcaccctcttccccccctcctccgaagaactccaagccaacaaagccaccctcgtctgcctcatctctgacttctacccaggagccgtcaccgtcgcatggaaagccgactcatcacccgtcaaagccggcgtagaaaccaccaccccctcaaaacaatccaacaacaaatacgccgcctcctcctacctttccctaactcccgaacaatggaaatcccaccgctcatactcctgccaagtcacccacgaaggctctaccgtagaaaaaaccgtcgcaccc

SEQ ID NO: 54809 - RNA, 672 nt, synthetic construct
  misc_feature 1..672: note = derived and/or modified sequence opt11 from anti-HIV_4YBL_B-Chain
  source 1..672: mol_type = other RNA
caagtccaactccaagaatccggcccaggcctcgtcaaaccatcccaaactctctccctctcttgcacagtctccggtggctcatcctcctcaggcgcccactactggtcctggatccgacaataccccggcaaaggcctcgaatggatcggatacatccactactcaggcaacacctactacaacccatccctcaaatcccgcatcacaatctcacaacacacatccgaaaaccaattctccctcaaactcaactccgtcaccgtcgccgacaccgccgtatactactgcgcccgaggaacccgcctacgcaccctccgcaacgccttcgacatatggggccaaggcaccatggtcaccgtctcctccgcctctaccaaaggcccctccgtcttcccactcgccccctcctccaaatccacctccggcggcaccgccgccctcggctgcctcgtcaaagactacttcccagaacccgtcaccgtttcctggaactccggcgccctcacctccggcgtccacaccttccccgccgtcctccaatcatccggcctctactccctatcgtcagtcgtcaccgtcccatcctcctcactcggcacccaaacctacatctgcaacgtcaaccataaaccctccaacaccaaagtagacaaacgcgtcgaacccaaa

SEQ ID NO: 54810 - RNA, 630 nt, synthetic construct
  misc_feature 1..630: note = derived and/or modified sequence opt11 from anti-HIV_4R4N_X-Chain
  source 1..630: mol_type = other RNA
gacatccaaatgacacaatccccctccttcgtctccgcctccgtcggcgaccgcgtcaccatcacctgccgcgcctcccaaggcatctcctcctacctcgcctggtaccaacaaaaacccggcaaagcccccaaactagtcatctacgccgcctccaccctccaatcaggagtaccctcccgcttctccggctccggctcaggcaccgaattcaccctcaccatctcctccctccaacccgaagacttcgcaacctactactgccaacacctcatcggcctacgctccttcggccaaggcaccaaactcgaaatcaaacgcaccgtcgccgccccctccgtattcatcttcccaccctccgacgaacaacttaaatcaggcaccgcctcagtagtctgcctcctcaacaacttctacccccgcgaagccaaagtccaatggaaagtcgacaacgccctccaatcaggcaactcccaagaatccgtcaccgaacaagactctaaagactccacctactccctctcctccaccctcaccctatccaaagccgactacgaaaaacacaaagtctacgcctgcgaagtcacccaccaaggcctctcctcacccgtcaccaaatccttcaaccgc

SEQ ID NO: 54811 - RNA, 660 nt, synthetic construct
  misc_feature 1..660: note = derived and/or modified sequence opt11 from anti-HIV_4R4B_F-Chain
  source 1..660: mol_type = other RNA
caagtccaactacaacaatggggcgccggcctcctcaaaccctctgaaaccctatcactaacctgcggcgtctacggcgaatccctctctggtcactactggtcatgggtccgacaaccacccggcaaacgcctagaatggatcggcgaaataaaacacaacggctcccccaactaccacccctccctcaaatcccgcgtcaccatctcactcgacatgtccaaaaaccaattctccctcaacctcacatccgtcaccgccgccgacaccgccgtctacttctgcgcccgccgatccaactggccctacctccccttcgacccctggggccaaggcaccctcgtcaccgtctcctcagcctccaccaaaggcccatcagtcttccccctcgcaccttcctccaaatctacctccggcggcacagccgccctcggctgcctcgtcaaagactacttccccgaaccagtcaccgtctcctggaactccggcgccctcacctccggcgtccacacattccccgccgtactccaatcctccggcctctactccctctcctccgtcgtcaccgtcccctcctcctccctcggcacccaaacctacatctgcaacgtcaaccacaaaccttccaacaccaaagtagacaaaaaagtcgaacccaaa

SEQ ID NO: 54812 - RNA, 750 nt, synthetic construct
  misc_feature 1..750: note = derived and/or modified sequence opt11 from anti-HIV_3JUY_D-Chain
  source 1..750: mol_type = other RNA
caagtgcaactggtacagagcggggcagaggtaaagaaaccgggagcgagcgtgaaagtaagctgccaagcgagcggatacaggttcagccacttcacggtacactgggtaaggcaagcaccagggcagaggttcgagtggatgggatggataaacccgtacaacgggaacaaggagtttagcgcgaagttccaggacagagtgacattcacagcggacacgagcgcgaacacggcatacatggagctaagaagcctgaggagcgcagacacggcggtatactactgcgcaagggtaggagaatggggatgggacgacagcccgtacgacaactactacatggacgtgtgggggaaagggacaacggtaatagtaagcagcggaggagggggaagtgggggaggagggagcggaggaggagggagcgagatagtgttgacccaggcaccggggacgctaagcctaagccccggggaaagggcgacgttcagctgccgaagcagccacagcataaggagcaggagagtggcatggtaccagcacaagccagggcaagcgccaaggctagtaatacacggggtgagcaacagagcaagcgggatatcagacagattcagcgggagcgggagcgggacggacttcacactgacgatcacaagagtagaaccggaggacttcgcactgtactactgccaggtatacggagcaagcagctacacgttcgggcaagggacaaagctggaaagaaag

SEQ ID NO: 54813 - RNA, 369 nt, synthetic construct
  misc_feature 1..369: note = derived and/or modified sequence opt11 from anti-HIV_4KG5_HeavyChain
  source 1..369: mol_type = other RNA
caactcgtccaatccggccccgaagccaaacgccccggctcctccgtcaaagtctcctgcaaagcctcccgcgacaccttcaacaactacgtactcaactgggtccgacaagcccccggccaaggcctcgaatggatgggcggcatcggccccatcatcgaaaccgccgactacgccgaaaaattccgcggccgcctctccatcaccgccgacgaatccaccacaaccgcctacatggaactctcctccctcacctccgacgacaccgccgtctactactgcgcccgctccccctactcctccctcaccgacacctactactactacatggacctctggggcaaaggcaccaccgtcaccgtctcctca

SEQ ID NO: 54814 - RNA, 336 nt, synthetic construct
  misc_feature 1..336: note = derived and/or modified sequence opt11 from anti-HIV_4KG5_LightChain
  source 1..336: mol_type = other RNA
ctcacccaatcccccgactccctcgccgtctccctcggcgaacgcgccaccatcaactgcaaatcctcccaatccatactcgactcctccaacaaccgcaactacctcacctggtaccaacaaaaacccggccaaccccccaaactcctcatctactgggcctccacccgcgaatccggcgtccccgaccgcttctccggctccggctcctccaccgacttcaccctcaccatctcctccctccaagccgaagacgtcgccgtctactactgccaacaatacttctccacccccggcatcaccttcggccaaggcacccgcctcgaaatcaaacgc

SEQ ID NO: 54815 - RNA, 309 nt, synthetic construct
  misc_feature 1..309: note = derived and/or modified sequence opt11 from anti-HIV-1_LightChain
  source 1..309: mol_type = other RNA
gaaatcgtcctcacccaatcccccgccacactctccctctcccccggcgaacgcgccaccctctcctgccgcgcctcccaatccgtctacaccaaactcgcctggtaccaacaaaaacccggccaacccccccgcctcctcatctacgacgcctccaaccgcgccgccggcatccccgcccgcttctccggctccggctccggcaccgaattcaccctcaccatcaaacgcatggaacgcgaagacttcgccgtctactactgccaaatcctcgaattcttcggccaaggcaccaccatcgacatgaac

SEQ ID NO: 54816 - RNA, 312 nt, synthetic construct
  misc_feature 1..312: note = derived and/or modified sequence opt11 from anti-HIV-1_LightChain
  source 1..312: mol_type = other RNA
gacatccaaatgacccaatccccctcatccgtctccgcctccgtcggcgaccgcgtcaccatcacctgccgcgcctcccaaggcatcctctcatcccaactcgcctggcaccaacaacgccgcggccaacccccccgcctactcatctacggcggctccaaccgcgcccccggcatccccgaacgcttcaccggctctggctccggcaccgacttcgtcctcaccatcaaacgcctccaacgcgacgacttcgccgtctactactgccaaatcctcgaattcttcggccgcggcacccgcgtcgaaatgaac

SEQ ID NO: 54817 - RNA, 312 nt, synthetic construct
  misc_feature 1..312: note = derived and/or modified sequence opt11 from anti-HIV-1_LightChain
  source 1..312: mol_type = other RNA
ggcctcctcctcacccaatcccccggccccgtctccttcttccccggcgaacgcgccaccgtctcctgccgcgcctcacactccgtcaactccgccgccatcaactggtaccaacaaaaacgcggccaacccccccgcctaatcatcgtcgacggctccacccgagccaccgccgtccccgaacgcttctccgccaccggctccggcaccgaattcaccctcgtcatctcccgcctcgaacccgaagacttcgccgtctacttctgccaacacctccaattcttcggcctcggcaccaaagtcgacatcaaa

SEQ ID NO: 54818 - RNA, 312 nt, synthetic construct
  misc_feature 1..312: note = derived and/or modified sequence opt11 from anti-HIV-1_LightChain
  source 1..312: mol_type = other RNA
gccttcgtcatgacccaatcccccggcaccctcgccctctcccccggcgaacgcgccaccctctcctgccgcacctcccaagaaatcctctccaaccaactcgcctggcaccaacaacgccgcggccaacccccccgcctcctcatctacggcggctccaaccgcgcccccggcatccccgaacgcttcaccggctccggctccggcaccgacttcgtcctcaccatcaaccgcctcgaacgcgacgacttcgccgtctactactgccaaatcctcgaattcttcggccgaggcacccgcgtcgaaatgaac

SEQ ID NO: 54819 - RNA, 312 nt, synthetic construct
  misc_feature 1..312: note = derived and/or modified sequence opt11 from anti-HIV-1_LightChain
  source 1..312: mol_type = other RNA
ggcatcgtcctcacccaatcccccgacaccctctccctctcccccggcgaccgcgccaccctctcctgcaaaacatcccaatccatcgcctccgaacacctcgcctggtaccaacaacgccccggccaacccccccgcctcctcatcttcggcgcctccaaccgcgcctccggcatccccacccgcttctccggctccggctccggcgccgacttcaccctctccatcacccgcctcgaacccgaagacttcgccgtctactactgccaattctccgaattcttcggccgcggcgcccgagtcgaagtcaaa

SEQ ID NO: 54820 - RNA, 312 nt, synthetic construct
  misc_feature 1..312: note = derived and/or modified sequence opt11 from anti-HIV-1_LightChain
  source 1..312: mol_type = other RNA
caattcgtaatgacacaatcacccgcaaccctgagctcgagcccaggcggaaccgcaaccctaagctgccgcacaagccacagcatactcaacagccaactcgcatggcaccaacaacgcagaggccaacccctacgcctactcatatacggagcctcaaacagagccccaggcatacccgaacgcttcagcgcaagcgggagcggaaccgaattcgtactcacaatcaaacgcatggaaagagaagacttcgcagtctactactgccaaatactcgaattcttcggccaaggcacaaccatagacatgaac

SEQ ID NO: 54821 - RNA, 354 nt, synthetic construct
  misc_feature 1..354: note = derived and/or modified sequence opt11 from anti-HIV-1_HeavyChain
  source 1..354: mol_type = other RNA
cgcgtgcacttggtccagagcgggacccaggtcaagaaaccgggcgcgagcgtgaaagtgagctgtgaaacgagcgggttcaagttcttggactcgctcatacactgggtcagacaagcgcccgggcaagggctctattggatgggctggatcaagccctatcgcgggagcgtgaactatgacgggtactttcgcgggcgcgtgagcatgaccagggacatatacacggacacggcctatctcgagctctcgggcttgcgctcggacgataccgcgatctattactgtgcctttggcgcgggcgatggctgggacttggtctggggccagggcacgctcgtgatcgtgagctcg

SEQ ID NO: 54822 - RNA, 354 nt, synthetic construct
  misc_feature 1..354: note = derived and/or modified sequence opt11 from anti-HIV-1_HeavyChain
  source 1..354: mol_type = other RNA
cgagtgcacttggtccagagcgggacccaggtcaagaaaccgggcgcgagcgtgaaagtgagctgtgaaacgagcgggttcaagttcttggactcgctaatacactgggtcaggcaagcgcccgggcaagggctctattggatgggctggatcaagccctttcgcgggagcgtgaactatgacgggtactttcgcgggcgcgtgagcatgaccagggacatatacacggacacggcctatatggagctctcgggcttgcgctcggacgataccgcgatctattactgtgcctttggcgcgggcgatggctgggacttggtctggggccagggcacgctcgtgatcgtgagctcg

SEQ ID NO: 54823 - RNA, 354 nt, synthetic construct
  misc_feature 1..354: note = derived and/or modified sequence opt11 from anti-HIV-1_HeavyChain
  source 1..354: mol_type = other RNA
caagtgcacttggtccagagcgggacccaggtcaagaaaccgggcgcgagcgtgcgcgtgagctgtgaaacgagcgggttcaagttcttggactcgatcatacactggttcaggcaagcgcccggggaagggctcttttggatgggctggatcaagccctataccgggagcgtgaactatgtcaggcgctatcaagggcgcgtgagcatgaccagggacgtgtactcggacacggcctatatggatctctcgggcttgaactcggacgataccgcggtctatttctgtacctatggcgcgggcgatggctggaacttggtctggggccagggcacgctagtgatcgtgagcgcg

SEQ ID NO: 54824 - RNA, 363 nt, synthetic construct
  misc_feature 1..363: note = derived and/or modified sequence opt11 from anti-HIV-1_HeavyChain
  source 1..363: mol_type = other RNA
caggtcaggctcgtgcaatcgggcaatcaagtgcgcaagcccggggcctcggtcaggatctcgtgcgaggcctcgggctataaatttatcgatcactttatccattgggtgcgccaggtcccgggccatggcttggaatggctcgggtggataaacccgcgcgggggcggggtcaattactcgcgcgggttccagggcaagctctcgatgacgatgacgcgcgataactttgaagagaccgcgtacttggacttgagcaggctcaatcccggggacacggccgtgtactattgcgcgcgcgggttcgcgggctatgaatggagctttctctggggccagggcacgctcgtgatcgtgagctcg

SEQ ID NO: 54825 - RNA, 357 nt, synthetic construct
  misc_feature 1..357: note = derived and/or modified sequence opt11 from anti-HIV-1_HeavyChain
  source 1..357: mol_type = other RNA
caggtctcgctcgtgcaatcgggcaatcaattgaaaaagcccggggcctcggtcagaatctcgtgcgagacctcgggctataactttctcaatcactttatccattgggtgcgccaggtcccgggccatggattggaatggctcgggtggataaacccgcgcgggggcggggtcaattactcgcgcaatttccagggcaaggtctcgctcacgcgcaatatcgatatggagaccgtgtacttggacgtgcgcgggctcacgcccggggacacggccgtgtactattgcgcgcgcgggttcgggggctcggactggaactttgtctggggccagggcacgcgcataaccgtgagcgcg

SEQ ID NO: 54826 - RNA, 357 nt, synthetic construct
  misc_feature 1..357: note = derived and/or modified sequence opt11 from anti-HIV-1_HeavyChain
  source 1..357: mol_type = other RNA
aggataaatttgcatcagagtgggagtcaggtgaagaggagtggggcgagtgtgaggataagttgtgagacgagtgggtttaagtttatggatagtcatttgcattgggtgaggcaggtggcggggcaggggtttgagtggatggggtggatatttacgagtggggggggggtgaattatgcgaggcagtttcaggggaggttgacgttgacgagggatgtgtttacggatacggtgtttatggatttgagtggggtgaatgtgggggatacgggagtgtattattgtgtgaaggggacgggggggaatgagtgggggtttagttgggggcaggggacggtggtggtggtgagtccg

SEQ ID NO: 54827 - RNA, 357 nt, synthetic construct
  misc_feature 1..357: note = derived and/or modified sequence opt11 from anti-HIV-1_HeavyChain
  source 1..357: mol_type = other RNA
aggataaatttggatcagagtgggagtcaggtgaagaagagtggggcgagtgtgaggataagttgtgagacgagtgggtttaagtttatggatagtcatttgcattgggtgaggcaggtggcggggcaaccgtttgagtggatggggtggatatttacgagcggggggggggtgaattatgcgaggcagtttcaggggaggttgacgttgacgagggatgtgtttagtgagacggtgtttatggatttgagtgggttgaatgcgggggatacgggggtgtatttttgtgtgaaggggacgggggggaatgagtgggggtttgtgtgggggcaggggacggtggtggtggtgagtccg

SEQ ID NO: 54828 - RNA, 357 nt, synthetic construct
  misc_feature 1..357: note = derived and/or modified sequence opt11 from anti-HIV-1_HeavyChain
  source 1..357: mol_type = other RNA
aggatcgagctccatcaatcgggctcgcaagtgaaaaagagcggggcctcggtcaggatctcgtgcgagacctcgggctttaaatttatggatagccatctccattgggtgcgacaggtcgcgggacagcgctttgaatggatggggtggatattcacgagcgggggaggggtcaattacgcgcgccagttccagggcaggctcaggctcacgcgagatgtctttagcgagagcgtgttcatggacttgagcgggctcaatagcggggacacgggcgtgtactattgcgtgaaagggaccgggggcaatgaatggggctttgtctggggccagggctcgctcgtggtcgtgagcccg

SEQ ID NO: 54829 - RNA, 372 nt, synthetic construct
  misc_feature 1..372: note = derived and/or modified sequence opt11 from anti-HIV-1_HeavyChain
  source 1..372: mol_type = other RNA
caagccctagtccaaagcggaagccaaatgaaaaaaccaggcgacagcgtacgcctaagctgccaaacaagcgacagcgcaatcacaaaatacttcatacactggatcagacaagcacccggaaaaggactcgaatggatagcctggatctcaccctacggcggacgcgtaaactacggctggcaagtacgcgaccgcgcaaccctaaccagaaacatacacatggaaacagtctacatggacctcagaggcctacgcccagacgacaccgcaacctactactgcgccatgcgcgactactgccgcgacgacaactgcaaccgctgggacctaggccactggggacaaggaagcctgatcgtagtctcagcc

SEQ ID NO: 54830 - RNA, 357 nt, synthetic construct
  misc_feature 1..357: note = derived and/or modified sequence opt11 from anti-HIV-1_HeavyChain
  source 1..357: mol_type = other RNA
caagtgaccctagtccagagcgggaaccagctcaagcgcccgggcgcgagcgtgcgcataagctgcgaaacgagcggatacaacttcatggaccacttcatacactgggtcaggcaagtgcccggacacgggcccgagtggctaggctgggtcaaccccaggggcgggggcgtgaactacagcaggaaattccaaggacgcttcagcatgaccagagacgtgtacatggaaacggcctacctcgacgtcacgggcttgagcccggccgacaccgcggtctactactgcgccaggggcttcggcggaagcgactggtcgttcctgtggggacaagggaccctaatcatagtctcaagc

SEQ ID NO: 54831 - RNA, 324 nt, synthetic construct
  misc_feature 1..324: note = derived and/or modified sequence opt11 from anti-HIV-1_LightChain
  source 1..324: mol_type = other RNA
gaaatcgtcctcacccaatcccccggcaccctctccctctccgccggcgaacgcgcctccctctcctgccgcgcctcccaaaccctcaactccaacttcttcgcctggtaccaccaaaaacccggccaagcaccccgcctcctcatctacggcgcctccaaccgcgccaccggcatccccgaccgcttctccggctccggctccggctccgacttcaccctcaccatctcccgcctcgaacccgaagacttcggcaaatactactgcgaacaatacgacgtctcaccccgcaccttcggacaaggcaccaaagtcgaaatcaaa

SEQ ID NO: 54832 - RNA, 324 nt, synthetic construct
  misc_feature 1..324: note = derived and/or modified sequence opt11 from anti-HIV-1_LightChain
  source 1..324: mol_type = other RNA
gaagtcgtcctcacccaatcccccggaaccctctccctctcccccggcgaacgcgccaccctctcctgccgcgcctcccaatccatcaactccaacttcttcgcctggtaccaccaaaaacccggccaagccccccgcctcctcatctacggcgcctcctcccgcgccaccggcatccccgaccgcatctccggaaccggctccggcgccgacttcaccctcaccatcaccggcctcgaacccgaagacttcggcctctactactgccaacaatacgacttctccccccgcaccttcggccaaggcacccgcgtcgaaatcaaa

SEQ ID NO: 54833 - RNA, 324 nt, synthetic construct
  misc_feature 1..324: note = derived and/or modified sequence opt11 from anti-HIV-1_LightChain
  source 1..324: mol_type = other RNA
gaagtcgtcctcacccaatcacccggcaccctctccctctcccccggcgaacgcgccaccctctcctgccgcgcctcccaaaccatcaactccaacttcttcgcctggtaccaccaaaaacccggccaagccccccgcctcctcatctacggcgcctcctcccgcgccaccggcatccccgaccgcatctccggctccggctccggcaccgacttcaccctcaccatcaccggcctcgaacccgaagacttcggcctctactactgccaacaattcgacttctccccccgaaccttcggccaaggcacccgcgtcgaaatcaaa

SEQ ID NO: 54834 - RNA, 324 nt, synthetic construct
  misc_feature 1..324: note = derived and/or modified sequence opt11 from anti-HIV-1_LightChain
  source 1..324: mol_type = other RNA
gaaatcgtcctcacccaatcccccggcaccctatccctcgcccccggcgaacgagccaccctctcctgccgcgcctcccaatccatctccaccacctacctcgcctggtaccaacaaaaacccggccaagccccccgcctactcatctacgaaacctcctcccgcgcctccgacatccccgaccgcttctccggctccggctccggcaccgacttcaccctcaccatctcccgcctcgaacccgaagacttcgccgtctactactgccaccaatacgaccgctccccccgcaccttcggccaaggcaccaaagtcgaaatcaaa

SEQ ID NO: 54835 - RNA, 336 nt, synthetic construct
  misc_feature 1..336: note = derived and/or modified sequence opt11 from anti-HIV-1_LightChain
  source 1..336: mol_type = other RNA
gacatcgtaatgacacaatcacccgcaagcctgagcgtaaccccgggcgagaccgcaagcataagctgcaaatgcagcagaagcctacgcgaagaagtaggctacaactacctcgactggtacctccagcgcccaggcaaaagcccacaactactcatatacgtaggctcattcagggccccaggcgtaagcgaacgcttccgcggaagcggagaacacaaagacttcacactaaaaatcgcacgcgtagaaccgggcgacgccggaatctactactgcatgcagggcatagacacgcccaggaccttcggccaaggcacaaccctggaaataaac

SEQ ID NO: 54836 - RNA, 321 nt, synthetic construct
  misc_feature 1..321: note = derived and/or modified sequence opt11 from anti-HIV-1_LightChain
  source 1..321: mol_type = other RNA
gacatccaaatgacccaatccccctcctccctctccgcctccgtcggcgaccgcgtcaccatcacctgccgcgcctcccaagccttccgcaacgacctcggctggtaccaacacaaacccggcaaagcccccgaacgactcatctacgccacctccaccctcgaatccggcgtcccctcccgcttctccggctccggctccggcaccaacttcaccctcaccatctcctccctccaagccgaagacttcgccacctactactgcctccaatacaacaccttcccccgcaccttcggccaaggcaccaaagtcgaaatcaaa

SEQ ID NO: 54837 - RNA, 333 nt, synthetic construct
  misc_feature 1..333: note = derived and/or modified sequence opt11 from anti-HIV-1_LightChain
  source 1..333: mol_type = other RNA
aacttcatgctaacccaaccccactccgtctccgaatcccccggcaaaaccgtcaccatatcctgcgcccgcacccgcggcggcatcgactccgcctacgtccactggtaccaacaacgccccggctccgtccccaccaccgtcatcttcgaagacaaccgccgcccccccggcgtccccgaccgcttctccggctccatcgacacctcctccaacaccgcctccctcaccatctccggcctaaaaaccgaagacgaagccgactactactgccaatcctacgacgacacctacttctgggtcttcggcggcggcaccaaactcaccgtcctc

SEQ ID NO: 54838 - RNA, 333 nt, synthetic construct
  misc_feature 1..333: note = derived and/or modified sequence opt11 from anti-HIV-1_LightChain
  source 1..333: mol_type = other RNA
aacttcatgctcacccaaccccactccgtctccgaatcccccggcaaaaccgtcaccatctcctgcgcccgcaccagaggcaccatcgactcagcctacgtccactggtaccaacaacgccccggcgccgtccccaccaccgtcatcttcgaagacgaccgccgcccctccggcgtccccgaccgattctccggctccatcgactcctcctccaactccgcctccctcaccatctccggcctcaaaaccgaagacgaagccgactactactgccaatcctacgactccaactactactgggtcttcggcggcggcaccaaactcaccgtcctc

SEQ ID NO: 54839 - RNA, 396 nt, synthetic construct
  misc_feature 1..396: note = derived and/or modified sequence opt11 from anti-HIV-1_HeavyChain
  source 1..396: mol_type = other RNA
caagtccaactccaacaatccggccccgccctcgtcaaaccctccgaaaccctctccctcacctgctccgtctcctccggccgagtctcctcctactactggtcctggatccgccaatcccccggcaaaggcctcgaatggatcggctacatccactacgaccccgacaccaacaccaactaccgcacccactaccacccctccctccgcggccgcgtcgtcatctccgtcgactcctccaaatcccaagtctccctcaaagtccgctccgtcaccgccgccgactccgccctctactactgcgcccgccaccgctacgacccctggtccaaaggctacgacatccgctcccccttcgacttctggggccaaggcaccctcgtcaccgtctcctcc

SEQ ID NO: 54840 - RNA, 396 nt, synthetic construct
  misc_feature 1..396: note = derived and/or modified sequence opt11 from anti-HIV-1_HeavyChain
  source 1..396: mol_type = other RNA
caagtccacctccaacaatccggccccggcctcgtcaaaccctccgaaaccctctccctaacctgcacagtctccggcggccgcgtctcctcctactactggtcctggatccgccaatcccccggcaaaggcctcgaatggatcggctacatccactacgaccccgacacctcaaccaactaccgcacccactaccacccctccctccgcggccgcgtcgtcatctcagtcgacacctccaaaaaccaagtctccctcaccgtccgctccgtcaccgccgccgactccgccctctactactgcgcccgccaccgctacgacgtctggtccaacggctacgacatccgctccccctacgacttctggggccgaggcaccctcgtcaccgtctcctcc

SEQ ID NO: 54841 - RNA, 396 nt, synthetic construct
  misc_feature 1..396: note = derived and/or modified sequence opt11 from anti-HIV-1_HeavyChain
  source 1..396: mol_type = other RNA
caagtccacctcgaacaatccggccccgccctcgtcaaaccctccgaaaccctctccctcacctgcaccgtctccggcggccgcgtctcctcctactactggtcctggatccgccaatcccccggcaaaggcctcgaatggatcggctacatccactacgaccccgacacctccaccaactaccgcacccactaccacccctccctccgcggccgcgtcgtcatctccgtcgactcctccaaaaaccaagtctccctcaaagtccgctccgtcaccgccgccgactccgccctctactactgcgcccgccaccgctacgacgtctggtccaaaggctacgacatccgctccccattcgacttctggggccgcggcaccctcgtcaccgtctcctcc

SEQ ID NO: 54842 - RNA, 390 nt, synthetic construct
  misc_feature 1..390: note = derived and/or modified sequence opt11 from anti-HIV-1_HeavyChain
  source 1..390: mol_type = other RNA
caagtcgtcttccaaaaacccggccccggcgtcgtcaaaccctccgaaaccctctccctcacctgcaccgtctccggcggccgagtccgctcctactactggtcctggatccgactcccccccggccaaggcctcgaatggatcggctacatccactacgacgaaaccacagaatacaaacgctcctacaacccctccctcaaatcccgcatcaccatctccatggacacctccaaaaaccaagtatccctcaaactctcctccgtcaccgccgccgacgccgccgtctactactgcgcccgccaccgctacgaccgctggtcagactcctacgacatccgctcccccttcgacatctggggccaaggaaccgtagtcaccgtctccgcc

SEQ ID NO: 54843 - RNA, 396 nt, synthetic construct
  misc_feature 1..396: note = derived and/or modified sequence opt11 from anti-HIV-1_HeavyChain
  source 1..396: mol_type = other RNA
caagtccaactccaacaatggggcgccggactcctcaaaccctccgaaaccctctccctaacctgcgccatctacggctcctcattctccggccactactggatgtggatccgccaatcccccgccaaaaccctcgaatggatcgccgaaatcaaccacaccggcggcacccgctacaacccctccctcgcctcccgagtacgcgtcttctcagacacatccaaaaaccaattctccctcaacatgacctccctcaccgccgccgacaccggcatctactactgcgtccgcggccacctctcccgcgaccgcctcggccaatacgccttctggtccggcgccctcatcgactacctcgacccctggggccaaggcaccctcgtcacagtctcctcc

SEQ ID NO: 54844 - RNA, 387 nt, synthetic construct
  misc_feature 1..387: note = derived and/or modified sequence opt11 from anti-HIV-1_HeavyChain
  source 1..387: mol_type = other RNA
caagtccaactccaccaatggggcgccggcctcctcaaaccctccgaaaccctctccctaacctgcgccgtctacggctccttcaccggcttccaatggacctgggtccgccaaacccccggcaaaggcctcgaatggatcggcgaaatcaaccactccggcctcctcgtcaccggaaaaaccgactacaacccatccctcgaatcccgcgtcaccatctccgtcgacacctccaaaaaccaattctccctcaaactcacctccgtcaccgccgcagacaccggagtctactactgcgcccgcgccggcggcatgtccgactgggcctacccctactactacggcatggacgtctggggccaaggcaccatggtcaccgtctcctcc

SEQ ID NO: 54845 - RNA, 357 nt, synthetic construct
  misc_feature 1..357: note = derived and/or modified sequence opt11 from anti-HIV-1_HeavyChain
  source 1..357: mol_type = other RNA
caggtccagctcgtggaatcgggcgggggcgtggtccagcccgggcgctcgctcacgctctcgtgcgcgacctcgggctttgactttagctcgtacgggttccattgggtgcgccaggccccgggcaagggcctgcaatgggtctcgatcataagccatgacgggagcatcaaaaattacggggactcgatgaagggcagattctcggtctcgcgcgataacgcgaaagatatattgtacttgcaaatgaactcgctcaggcccgatgacacggccttgtaccattgcgtgcgcggggacggggaaaatggcgggaccgattactggggcctgggaacgctcgtgaccgtgagcgcg

SEQ ID NO: 54846 - RNA, 357 nt, synthetic construct
  misc_feature 1..357: note = derived and/or modified sequence opt11 from anti-HIV-1_HeavyChain
  source 1..357: mol_type = other RNA
caagtggacttggtcgagagcgggggcggggtcgtgcaaccgggcaagagcttgaaattgagctgtaccgcgagcgggttcacgttcacgagctatggcatgcactgggtcaggcaaatacccgggaaagggctcgagtgggtggccataatctcgcacgatggcacgatcaagaactatggcgatagcgtgaaagggcgctttaccataagcagggacaatgccatgaacatactctatctacagatgaataacctgcgcggggacgataccgcgctctattactgtgtcaggggcgatggcgagaacgggggcacggactattgggggcaagggaccgtggtcacggtctcgagc

SEQ ID NO: 54847 - RNA, 369 nt, synthetic construct
  misc_feature 1..369: note = derived and/or modified sequence opt11 from anti-HIV_V3_HeavyChain
  source 1..369: mol_type = other RNA
gaagtccaactcgtccaatccggcgccgaagtcaaaaaacccggcgaatccctcaaaatctcctgccaaggcttcggctacaccttctccacctactggatcggctgggtccgccaaatgcccggcaaaggcctcgaatggctcggcatcatctaccccgaagactcagaaaccatctactcaccctccttccaaggccaagccaccatctccgccgacaaatccctctcaaccgcctacctccaatggtccggcctccgcgcctccgactccgccatctactactgcgcccgcctcggctactgcggctccacctcctgctccttcttcgacttctggggccgcggcaccctagtcaccgtctcatcc

SEQ ID NO: 54848 - RNA, 369 nt, synthetic construct
  misc_feature 1..369: note = derived and/or modified sequence opt11 from anti-HIV_V3_HeavyChain
  source 1..369: mol_type = other RNA
gaggtccagctcgtgcaatcgggcgcggaagtgaccaagcccggggaatcgctcaagatctcgtgcaagggctcgggctatagctttagcacgcactggatcgcgtgggtgcgccagatgccgggcaggggcttggaatggatggggttcatatacccggacgatagcgataccaggtactcgccctcgctccagggccatgtcataatctcggccgataaatcgctctcgaccgcgtacttgcaatggagctcactcaaggcctcggacacggccatgtactattgcgcgcgcttgggcggggacgagtaccagagctcgggcgggatggatgtctggggccagggcacgaccgtgatcgtgagctcg

SEQ ID NO: 54849 - RNA, 393 nt, synthetic construct
  misc_feature 1..393: note = derived and/or modified sequence opt11 from anti-HIV_V3_HeavyChain
  source 1..393: mol_type = other RNA
gaagtccaactcgtccaatccggcgccgaagtcaaaaaacccggcgccaccgtcaaaatctcctgcaaagtctccggctacaccctcaccgactactacatccactgggtccaacaagccccaggccgcggcctcgaatggctcggcctcgtcgaccccgaaaacggcgaaaccctctacgccgaaaaattccaaggccgcgtcacactcaccgccgacacctccaccgacaccgcctacatggaactcaaatccctccgatacgaagacaccgccgtctactactgcgccaccgaaggccccccctcctactacgactccggcacctacgccaaatccctccccgcctccttcgcatgctggggccaaggcaccctcgtcaccgtctcatcc

SEQ ID NO: 54850 - RNA, 369 nt, synthetic construct
  misc_feature 1..369: note = derived and/or modified sequence opt11 from anti-HIV_V3_HeavyChain
  source 1..369: mol_type = other RNA
caagtccaactccaagaatccggccccggcctcgtcaaaccctccgaaaccctctccctcacctgcaccgtctccggcggctccatcaacaactactactggtcctggatccgccaaccccccggcaaaggcctcgaatacatcggctacatcttctactccggctccaccaactacaacccctccctaaaatcccgcgtcaccttctccgtcgacacctccaaaaaccaattctccctcaaactcacctccgtcaccgccaccgacaccgccgtctactactgcgcccgcggccccctcctctacttcggcgcaccccgcacccacttcgactactggggccaaggcgccctcgtcaccgtctcctcc

SEQ ID NO: 54851 - RNA, 372 nt, synthetic construct
  misc_feature 1..372: note = derived and/or modified sequence opt11 from anti-HIV_V3_HeavyChain
  source 1..372: mol_type = other RNA
gaggtccagctcgtgcaatcgggcgcggaagtgaaaaagcccggggaatcgctaaagatctcgtgcaagggctcgggctatagctttagctcgcactggatcgggtgggtgcgccagctcccgggcaagggcttggaatggatggggatcatatacccggacgatagcgataccaagtacaatccctcgttccagggccaggtcacgatctcggccgatcgctcgatctcgaccgcgtacttgcaatggagctcgctcaaggcctcggacacggccatgtactattgcgcgcgcgtgggctatgactcgtacgggtactcgggctcgaactttgacgagtgggggcaagggaccttggtcacggtctcgagc

SEQ ID NO: 54852 - RNA, 357 nt, synthetic construct
  misc_feature 1..357: note = derived and/or modified sequence opt11 from anti-HIV_V3_HeavyChain
  source 1..357: mol_type = other RNA
gaggtccagctcgtgcaatcgggcgcggaagtgaaaaagcccggggaatcgctcaagatctcgtgcaagggctcgggctataactttaactcggactggatcgggtgggtgcgccagatgccgggcaagggcttggaatgggtcgggatgatatacccggacgatttcgaggtcaggcactcgccaccgttccagggcagggtcacgatgtcggtcgataaatcgatctcgaccgcgtacttgcaatggagctcgctaaagagctcggacacgggcatgtacttttgcgcgcgcttggacgggaacgcggccgcgttcgattactggggccagggcacgcaagtgaccgtgagctcg

SEQ ID NO: 54853 - RNA, 360 nt, synthetic construct
  misc_feature 1..360: note = derived and/or modified sequence opt11 from anti-HIV_V3_HeavyChain
  source 1..360: mol_type = other RNA
gacgtgcaattggtccagagcggggcagaggtcaagaaagcgggcgagagcttgaaaataagctgtcgcccgagcgggtacaatttcgcggactattggataggctgggtcaggcaaatgcccgggaaagggctcgagtggatgggcataatctttcccgatgactcggacacgcgctatggcccgagctttgaagggcaagtgaccataagcgcggacaagagcataaacacggcctatctccagtggaatagcttgaaagcgagcgataccgcgatgtatttctgtgccaggcacgggggctcgggcgcggccccgggagattactggggccagggcacgctcgtgaccgtgagctcg

SEQ ID NO: 54854 - RNA, 363 nt, synthetic construct
  misc_feature 1..363: note = derived and/or modified sequence opt11 from anti-HIV_V3_HeavyChain
  source 1..363: mol_type = other RNA
gaggtccagctcgtgcaatcgggcgcggaagtgaaaaagcccggggccacagtcaagatatcgtgcaaggtctcgggctatacctttaccgattactttatgcattgggtgcaagaggccccgggcaagggcttggcctggatggggctagtggacccggaaaatggcgataccgtgtacgcggaaaagctccagggcagggtcacgatgtcggccgatacctcgcgagataccgcgtacatggaattgacctcgctcaggagcgaggacacggccgtgtactattgcgcgatcgggaaatcggtcgcgggcacgagcgcgtacgatatctggggccagggcacgatggtgaccgtgagctcg

SEQ ID NO: 54855 - RNA, 369 nt, synthetic construct
  misc_feature 1..369: note = derived and/or modified sequence opt11 from anti-HIV_V3_HeavyChain
  source 1..369: mol_type = other RNA
caggtgcagttggtgcagagtggggcggaggtgaggaagccgggggcgagtgtgaaggtgagttgtaaggcgagtggggatacgtttaataatcatgatataaattgggtgaggcaggcgccggggcaggggccggagtgggtggggtggatgaatccgaagagtgggaatgcggggtatgcgcagaagtttcaggggagggtgacgatgacgagggatacgagtataagtacggcgtatatggagttgaggagtttgacgagtgaggatacgggggtgtactattgtgcgaggttgacggtggattgtgatgatggggggtgttatggggattattgggggcaggggacgttggtgacggtgagtagt

SEQ ID NO: 54856 - RNA, 354 nt, synthetic construct
  misc_feature 1..354: note = derived and/or modified sequence opt11 from anti-HIV_V3_HeavyChain
  source 1..354: mol_type = other RNA
gaagtgtacttgcaacagagcggggccgagctcaaggaaccgggcgcgaacgtgaaaataagctgtaaagcgttcgggttcatattcacggactatttcatacactggctcaggcaagcgcccgggaaagggccccagtgggtgggcgtggtcgatcccgaggacgggagcacgacctatgccgaggcctttcaagggcgcgtgagcataaccgcggacaggagcacggacacggcctatatggatctcgcaggcttgacctcggacgataccgcggtctattactgtgccctgatgtggaacgagagcgggcccgataactggggccagggcacgctcgtgatcgtgagctcg

SEQ ID NO: 54857 - RNA, 393 nt, synthetic construct
  misc_feature 1..393: note = derived and/or modified sequence opt11 from anti-HIV_V3_HeavyChain
  source 1..393: mol_type = other RNA
gaagtgcaagtggtcgagttcgggggcgaggtaaagaaaccgggcgcgagcgtgaaagtgagctgtgaagcgagcgggtacacgttcgcgaaatttgccatacactgggtcagacaagcgcccaggcaagggctcgagtggatgggctggatcaatggagatgacgggaaaacggaatatagccagaaatttcaagatcgcgtgaccatgaccagggacacgagcgcgagcacggtctatatggagctctcgagcttgcgatcggaagataccgcgctctattactgtgccagggccatgtacccagacacggtaacgggcaatgacaatcccgcgccaccgccctttgaaggggactattgggggcaagggaccttggtcacggtctcgagc

SEQ ID NO: 54858 - RNA, 393 nt, synthetic construct
  misc_feature 1..393: note = derived and/or modified sequence opt11 from anti-HIV_V3_HeavyChain
  source 1..393: mol_type = other RNA
gaagtgcaattggtcgagagcggaggcgggctagtgaaaccgggcgggagcttgcgcttgacctgtgtcgcgagcgggttcacgttctcggacgtgtggttgaactgggttaggcaagcgcccgggaaagggctagagtgggtgggcagaatcaagagcaggacagatggcgggaccacggactatgccgcgagcgtgaaagggcgatttaccataagcagggacgatagcaagaacacgctctatctccagatgaatagcttgaaaacggaagataccgcggtctatagctgtaccacggacgggttcataatgatacgcggggtatcggaagattactattactattacatggacgtgtgggggaaagggaccacggtcacggtctcgagc

SEQ ID NO: 54859 - RNA, 387 nt, synthetic construct
  misc_feature 1..387: note = derived and/or modified sequence opt11 from anti-HIV_CD4bs_HeavyChain
  source 1..387: mol_type = other RNA
gaggaacagctcgtggaatcaggcgggggcctggtcaagcccgggggctcgcaaaggctctcgtgcgcggcatcggaatttacctttagcagatacacgatgaattgggtgcgccaggccccgggcaagggcttggaatgggtctcgagcataagcgggaacgataacaatatctattacgcggactcggtcaagggcaggttcacgatctcgcgcgataacgcgcgaaatagcttgtacttgcaaataaactcgctcagagtcgaggacacggccgtgtactattgcgcgcgcgggcccctggactcgtacgatttctggagcgggagcaggcactattacgggctcgatgtctggggacagggcacgaccgtgaccgtgagctca

SEQ ID NO: 54860 - RNA, 372 nt, synthetic construct
  misc_feature 1..372: note = derived and/or modified sequence opt11 from anti-HIV_CD4bs_HeavyChain
  source 1..372: mol_type = other RNA
caagtccaactcgtccaatcaggctccgaactcaaaaaacccggcgcctccgtcaaagtctcctgcaaagcctccggctacaccttcacctcccacatcatcaactgggtccgccaagcccccggccaaggactcgaatggatgggctggatcaacaccaacaccggcaaccccacctacgcccaaggcttcaccggccgcttcgtcttctccctcgacacctccgtatccatggcctacctccaaatctcatccctcaaagccgaagacaccggcgtctactactgcgcccgcggcttccgccaatggctcgtcgcccgcatcacctacttcgactactggggccaaggcaccctcgtcaccgtctcctcc

SEQ ID NO: 54861 - RNA, 369 nt, synthetic construct
  misc_feature 1..369: note = derived and/or modified sequence opt11 from anti-HIV_CD4bs_HeavyChain
  source 1..369: mol_type = other RNA
gagctaagactccaggcctcgggcccgggcttggtcaagccctcggaaacgctctcgctcgtgtgctcggtctcgggcgtgagcataagcgatagctattggaattggatacgccagcccgcgggcaagggcttggaatggatcgggcgcgtgtacacgcgcgggacccatacctataacccgagcttaggcgggcgcgcgaccgtgagcggggacacgaacaagaacgaggtctcgctcaagctcatgagcgtgaccgcggccgataccgcggtctattactgtgccagggccttgagcggggactggaccaggcgctatttctatatggatgtctggggcaggggaacgcccgtgaccgtgagctcg

SEQ ID NO: 54862 - RNA, 381 nt, synthetic construct
  misc_feature 1..381: note = derived and/or modified sequence opt11 from anti-HIV_CD4bs_HeavyChain
  source 1..381: mol_type = other RNA
caactccaactccaagaatcaggcccccgactcgtcaaaccctccgaaaccctctcactcacctgcacagtctccggcggctccatcagctccggcgactactactggacctggatccgccaaccccccggcgaaggcctagaatacatcggatacatctactccggcggctccaccgactacaacccatccctaaaatcacgcgcctccatctcccaagacacctccaccaacgaattctcactcaaactcacatcagtcaccgccgccgacaccgccgtctacttctgcgcccgcgaccgacgcgtcctcctctggttcggcgaaccccgccgcggcctcgacttctggggccccggcacactcgtcaccgtatcctca

SEQ ID NO: 54863 - RNA, 396 nt, synthetic construct
  misc_feature 1..396: note = derived and/or modified sequence opt11 from anti-HIV_CD4bs_HeavyChain
  source 1..396: mol_type = other RNA
gaagtgcaattggtcgagagcgggggcgggctcgtgaaaccgggcgggagcttgcgattgagctgtgccgcgagcgggttcacgttctcgagcgcgtggatgagctgggtcaggcaagcgcccgggaaagggctcgagtgggtgggcaggatcaagagcaagagcgatggcgagaccacggactatgccgcgcccgtgaaagggcgcttcaccataagcagggacaatctagagagcacgctctatctccagctcaatagcttgaaaacggaagataccgcagtctattactgtgccacggccacgccctcgtactatgacataatgacgggcaattacaagtactattactatatggatgtctggggcaagggcacgaccgtgaccgtgagctcg

SEQ ID NO: 54864 - RNA, 363 nt, synthetic construct
  misc_feature 1..363: note = derived and/or modified sequence opt11 from anti-HIV_CD4bs_HeavyChain
  source 1..363: mol_type = other RNA
caagtccaactcgtcgaatccggcggcggcctcgtcaaacccggcggctccctccgcctctcctgcgccgcctccggcttcatcttccgcgaccactacatgacctggatccgccaagcccccggcaaaggcctcgaatgggtctcctacatctcctcctcctccaacaacatccaatacgccgactccgtcaaaggccgcttcaccgtctcccgcgacaacgccaaaaactccctctacctccaaatgaactccctacgcgccgacgacaccgccgtctactactgcgcccgctccggccccttctacaactacggcccacccaacaactggggccaaggcaccctcgtcaccgtctcatcc

SEQ ID NO: 54865 - RNA, 378 nt, synthetic construct
  misc_feature 1..378: note = derived and/or modified sequence opt11 from anti-HIV_CD4bs_HeavyChain
  source 1..378: mol_type = other RNA
caagtgcaattggtcgagagcgggggcggggtcgtgcaaccgggcgggagcttgaccttgagctgtaccgcgagcgggttcccgttcaatagctatgccatgcactgggtcaggcaagcgcccgggaaagggctcgagtgggtgagcatgacctcgcacgatggcgggaacaaggactttgtcgacagcgtgaaagggcgctttaccataagcagggacaatagcaggaacacgctctttctccagatgaatagcttgagccaggacgataccggggtctattactgtgtcaggggcaagctcgaggactataacttttgggggcactatcgcgatttcgatagctggggccagggcacgctcgtgaccgtgagcgcg

SEQ ID NO: 54866 - RNA, 405 nt, synthetic construct
  misc_feature 1..405: note = derived and/or modified sequence opt11 from anti-HIV_CD4bs_HeavyChain
  source 1..405: mol_type = other RNA
gaaccgcacgtggtcgagagcgggggcgggatggcgaaaccgggcgggagcttgcgcttgagctgtgccgggagcgggttcacgttcacgaacgcgtggatgaactgggtcagacaagcgcccgggaaagggctcgagtgggtgggcttgatcaagagcaagagcgatggagggaccacggactatgccgcggacgtggaagggcgctttacaataagcagggacgatctcgagagcacgatgtttctcgagatgcatagcttgcaaatagaagataccgcggtctatttctgtaccacgcaatatccaaggtactatgacttgatgacgggcaattacaagcgcaggtactttagctcgggcatggacgtgtgggggcaagggaccgcggtcacggtctcgagc

SEQ ID NO: 54867 - RNA, 384 nt, synthetic construct
  misc_feature 1..384: note = derived and/or modified sequence opt11 from anti-HIV_CD4bs_HeavyChain
  source 1..384: mol_type = other RNA
caagtccaactccaagaatccggccccggcctcgtcaaaccatcccaaaccctctccctcacctgcaccgtctccggcgactccgtctcctccggcaactactactggtcctggatccgacaacccgccggcaaacccctcgaatggatcggccacatctccaccggcggcggcaccaaaaacaacccctccctccaatcccgcgtcaccatctccctcgactcctccaaaaaccaagtctccctatccctctcctccgtcaccgccgccgacaccgccgtctacacctgcgcccgcggccccccccgctccctctggttcggcgaccccacctactcctacatggacgtctggggcaaaggcaccaccgtcaccgtctcctcc

SEQ ID NO: 54868 - RNA, 372 nt, synthetic construct
  misc_feature 1..372: note = derived and/or modified sequence opt11 from anti-HIV_CD4bs_HeavyChain
  source 1..372: mol_type = other RNA
caagtgcaattggtccagagcggggccgaggtcaagaaaccgggctcgagcgtgaaagtgagctgtaaagcgagcgggggcacgttcaatagccatgcctttacctgggtcagacaagcgcccgggcaagggctagagtggatgggcgggatcatacccacgctcgggctcgcgaacgatgcccagaaatttcaaggacgctttaccataaccgcggacgagagcacgaccacggtctatatggagctctcgagcttgcgctcggaagataccgcggtctattactgtgccaggcgcccgtactatgaccaggtatcgggcgtgggcgcgttcgatatctggggccagggcacgcgcgtgaccgtgagctcg

SEQ ID NO: 54869 - RNA, 390 nt, synthetic construct
  misc_feature 1..390: note = derived and/or modified sequence opt11 from anti-HIV_V2_HeavyChain
  source 1..390: mol_type = other RNA
caagtgcaattggtccagagcggggccgaggtcaagaaaccgggctcgagcgtgaaagtgagctgtgaagcgagcggggtcacgagctcgagctataccataagctgggtcaggctagcgcccgggcaagggctcgagtggatgggcaggatcacgcccatattcgatatcacgaactatgcccagaaatttcaagggcgcgtgaccttgaccgcggacaagagcacgggcacgacctatatggagctatcgagcttgcgctcggacgataccgcggtctattactgtgccagggacaagagcgatgtcgtggtcgtgacctcgatcaggccagcgtactattacgggatggatgtctggggccagggcacgaccgtgaccgtgagctcg

SEQ ID NO: 54870 - RNA, 366 nt, synthetic construct
  misc_feature 1..366: note = derived and/or modified sequence opt11 from anti-HIV_V2_HeavyChain
  source 1..366: mol_type = other RNA
caagtgcaactggtccagagcggggccgaggtcaagaaaccgggctcgagcgtgaaagtgagctgtaaagcgagcgggggcacgttcaggagctatgccataagctgggtcagacaagcgcccgggcaagggctcgagtggatgggcgggatcatacccatattcgggaccgcggactatgcccagaaatttcaagggaaagtgaccataaccgcggacgagagcacgagcacggcctatatggagctctcgagcctgacctcggaagataccgcgatgtattactgtgccaggagcagagaccatttctttgacacgcgagtgttccagggctggggccagggcacgctcgtgaccgtgagctcg

SEQ ID NO: 54871 - RNA, 363 nt, synthetic construct
  misc_feature 1..363: note = derived and/or modified sequence opt11 from anti-HIV_V2_HeavyChain
  source 1..363: mol_type = other RNA
caggtccagctcgtgcaatcgggcgcggaagtgaaaaagcccgggagctcggtcaaggtctcgtgcaaggcctcgggcgggaactttaacacgtacacgatctcgtgggtgcgccaggccccgggccagggcttggaatggatgggacgcataatcccgatctttggcatagtcaatcccgcgcaaaagttcccgggcagggtcacgatcaatgtcgataaatcgaccaataccgcgtacatggaattgagctcgctcaggagcgaggacacggccgtgtactattgcgcgacctcgggcgtgggcttgcactttggctatttcgattactggggccagggcacgcaagtgaccgtgagctcg

SEQ ID NO: 54872 - RNA, 378 nt, synthetic construct
  misc_feature 1..378: note = derived and/or modified sequence opt11 from anti-HIV_V2_HeavyChain
  source 1..378: mol_type = other RNA
caagtccaactccaacaatggggccccggcctcctcaaaccctccgaaaccctctccctaacctgcgccgtctacggcggctccttcggccgctactactggtcctggatccgccaatcctccggcgaaggcctcgaatggctcggccaaatcgaccacaccggctccaccacctacaacccctccctcaaaggccgcgtcaccatctccatcgactcatccaccaaccaattctccctcaaagtcacctccgtcatcgccgccgacaccgccgtctactactgcgcccgcgccccctccggctaccccggcgtatccctctaccaatactacggcctcgacgtctggggccaaggcaccaccgtcaccgtctccccc

SEQ ID NO: 54873 - RNA, 366 nt, synthetic construct
  misc_feature 1..366: note = derived and/or modified sequence opt11 from anti-HIV_V2_HeavyChain
  source 1..366: mol_type = other RNA
caagtgcaattggtccagagcggggccgaggtcaagaaaccgggctcgagcgtgaaagtgagctgtaaagcgagcgggggcacgttctcgaactatgccataagctgggtcaggcaagcgcccgggcaagggctcgagtggatgggcgggatcatacccatattcgggaccacggactatgcccagaaatttcaagggcgcgtgaccataaccgcggacgcgagcacgagcacggcctatatggagctatcgagcttgcgctcggacgataccgcggtctattactgtgccaggagcaggggccattactttgacacgcgcgtgttcgagggctggggccagggcacgctcgtgaccgtgagctcg

SEQ ID NO: 54874 - RNA, 372 nt, synthetic construct
  misc_feature 1..372: note = derived and/or modified sequence opt11 from anti-HIV_V2_HeavyChain
  source 1..372: mol_type = other RNA
caagtccacctcgtccaatccggcaccgaagtcaaaaaacccggcgcctccgtcaccgtctcctgcaaagcctccggctactccttcaccggctactacctccactgggtccgccaagcccccggccaaggcctcgaatggatgggctggatcaaccccaactccggcggcacctactacgcccaaaacttccaagcccgcgtcaccatgacccgcgacacctccatctccaccgtctacatggacctctcccgcctccgctccgacgacaccgcagtctactactgcgtccgccgcgccgtcctcaccgccctcccaccccgctactacttcgacttctggggccaaggcaccctcgtcaccgtctcctca

SEQ ID NO: 54875 - RNA, 318 nt, synthetic construct
  misc_feature 1..318: note = derived and/or modified sequence opt11 from anti-HIV_V3_LightChain
  source 1..318: mol_type = other RNA
tccctcgaactcacccaacccccctccgtctccgtctccccaggccaaaccgtctccatcacctgctccggcaacctcctcggcgacaaagacgcctcctggtaccaactcaaacccggccaatcacccatcctcgtcatctacctagacaccgaacgcccctccggcatccccgaacgcttctccggctccaaatccggcaacaccgccaccctcaccatctccggcacccaagccatggacgaagccgaatacttctgccaagcctgggacaccaccaccgtcctcttcggcggcggcacccgcctcaccgtcctc

SEQ ID NO: 54876 - RNA, 324 nt, synthetic construct
  misc_feature 1..324: note = derived and/or modified sequence opt11 from anti-HIV_V3_LightChain
  source 1..324: mol_type = other RNA
agcgatgaattgacccagcccccgagcgtgagcgtgagcccgggccagaccgcgcgcataacctgtagcggggacgcgctcccggaaaagtacgcgtactggtaccagcaaaagagcgggcaagcgcccgtgctcgtgatcgatgaagataacaagcgcccgttcgggaccccggaaaggttctcgggctcgcgctcaggcacgatggcgaccttgaccataaccggggcccagatggaggacgaggccgattactattgctcaagcacggactcgcgcgggacctattgggtgttcgggggcgggaccaagctcacggtctta

SEQ ID NO: 54877 - RNA, 336 nt, synthetic construct
  misc_feature 1..336: note = derived and/or modified sequence opt11 from anti-HIV_V3_LightChain
  source 1..336: mol_type = other RNA
caatccgtcctcacccaacccccctcagtctccgccgcccccggccaaaaagtcaccatctcctgctccgccggcaactccaaaatcggcgacaactacatctcctggtaccaacacgtccccggcgccgcccccaaactcctcatctacgaaaacgacaaacgcccctccggcatccccgaccgcttctccggctccaaatccggcacctccgcctccctcggcatcaccggcctccaaaccggcgacgaagccgactactactgcgccgcctgggacaactccctctcctccgccctctacgtcttcggcaccggcaccaaagtcaccgtcctc

SEQ ID NO: 54878 - RNA, 339 nt, synthetic construct
  misc_feature 1..339: note = derived and/or modified sequence opt11 from anti-HIV_V3_LightChain
  source 1..339: mol_type = other RNA
gacatcgtcatgacccaatcccccgactccctcgccgtctccctcggcgaacgcgccaccatcaactgcaaatcctcccaaaacgtcttctactcctccaacaaccgcaactacctagcctggtaccaacaacgccccggccaaccccccaaactcctcttctactgggcctccacccgcgaatccggcgtccccgaccgcttctccggctccggctccggcaccgacttcaccctcaccatctcctccctccaaaccgaagacgtcgccatctactactgccaacaatactacaacaccccccccaccttcggccccggcaccaaagtcgaaatcaaa

SEQ ID NO: 54879 - RNA, 318 nt, synthetic construct
  misc_feature 1..318: note = derived and/or modified sequence opt11 from anti-HIV_V3_LightChain
  source 1..318: mol_type = other RNA
tcctacgaactcacccaacccccctccgtctccgtctcccccggccaaaccgccaccatcacctgctccggcgacctcctcggcgacaaatacgcctcctggtaccgccaaaaacccggccaatcccccgtcctcgtcatctacgaagacaccaaacgcccctccggcctacccgaacgcttctccggctccaactccggcaacaccgccaccctcaccatctccgaaacccaagccatggacgaagccgactactactgccaagcctgggacacccgcaccgtcgtcttcggcggcggcaccaaactcaccgtcctc

SEQ ID NO: 54880 - RNA, 327 nt, synthetic construct
  misc_feature 1..327: note = derived and/or modified sequence opt11 from anti-HIV_V3_LightChain
  source 1..327: mol_type = other RNA
caatcagtcctgacccaacccccaagcgtaagcgcagccccaggccaaaaagtaaccataagctgcagcggacgctcaagcgacatcgaaaacaaattcgtaagctggtaccaacaactacccggaaccgcacccaaactcctaatctacgaagacaacaaacgcccaagcggaatccccgacagattctcaggctcaaaatcaggcacaagcgcaaccctaggcataaccggactccaaaccggagacgaagccgactactactgcggaacctgggacaacaacctacgcgcaggcttcggcggaggcacacacctaaccgtactc

SEQ ID NO: 54881 - RNA, 324 nt, synthetic construct
  misc_feature 1..324: note = derived and/or modified sequence opt11 from anti-HIV_V3_LightChain
  source 1..324: mol_type = other RNA
agctacgaactaacccaacccccctccgtctccgtcagccccggccaaaccgcccgcatcacctgcagcggcgacgccctccccaacaaatacgcattctggtaccaacaaaaaagcggccaagcccccgtcctcgtcatcttcgacgacaacagacgccccgccggcatccccgaaagattctccggctcacgctccggcaccctcgccaccctaaccatctccggcgcccaagtcgaagacgaagccgactactactgctacagcaccgacaacgacggcaaatacttcgtcttcggctccggcaccatggtcacagtccta

SEQ ID NO: 54882 - RNA, 318 nt, synthetic construct
  misc_feature 1..318: note = derived and/or modified sequence opt11 from anti-HIV_V3_LightChain
  source 1..318: mol_type = other RNA
tcctacgaactcacccaacccccctccgtctccgtctcccccggccaaaccgcctccatcacctgctccggccacaaactcggcgacaaatacgcctcatggtaccaacacaaacccggccaatcccccgtcctcgtcatctacgaagacacccaacgcccctccggaatccccgaacgcatctccggctccaaatccggcaacacagccaccctcaccatctccggcacccaagccatggacgaagccgactactactgccaagcctgggactcccgcgccgccgtcttcggcggcggcacccgcctcaccgtcctc

SEQ ID NO: 54883 - RNA, 327 nt, synthetic construct
  misc_feature 1..327: note = derived and/or modified sequence opt11 from anti-HIV_V3_LightChain
  source 1..327: mol_type = other RNA
caatccgccctcacccaacccgcctccgtctccggctcccccggccaatccatcaccatctcctgcaccggcatctcctccgacatcggcaccgacaactacgtctcctggtaccaacaacaccccggcaaagcccccaaactcatcatctacgaagtctccaaccgcccctccggcatctcccaccgcttctccggctccaaatccggcaacaccgcctccctcatcatctccggcctccaagtcgaagacgaagcccactactactgcaactcctaccgctccgacaccctcgtcttcggcggcggcaccaaagtcaccgtcctc

SEQ ID NO: 54884 - RNA, 333 nt, synthetic construct
  misc_feature 1..333: note = derived and/or modified sequence opt11 from anti-HIV_V3_LightChain
  source 1..333: mol_type = other RNA
caatccgtcctcacccaacccccctccgcctccggcacccccggccaacgcgtcaccatctcctgctccggctcctcctccaacatcggctccaacaccgtcaactggtaccaacacctccccggcaccgcccccaaactcctcatctactccaacgaccaacgcccctccggcgtccccgaccgcttctccggctcctcctccggcacctccgcctccctcgccatctccggcctccaatccgaagacgaagccgactactactgcgccgcctgggacgactccctcaacggccccttcgtcttcggcaccggcaccaaagtcaccgtcctc

SEQ ID NO: 54885 - RNA, 318 nt, synthetic construct
  misc_feature 1..318: note = derived and/or modified sequence opt11 from anti-HIV_V3_LightChain
  source 1..318: mol_type = other RNA
gacatccaaatgacacaatccccctcctccctctccgcctccgtcggcgaccgcatcaccatcacctgccgcacctcccaatccatcgacaaccacctcaactggtaccaacacaaacccggcaaagcccccaaactcctcatctccgccgcctcccgcctccaatccggcgtcccctcccgattcaccggctccggctccggcaccgaattcaccctcaccatctcctccctccaacccgaagacttcgccgtctactactgccaacaatcatacatcaccatcaccttcggccccggcaccaaagtcgacatcaaa

SEQ ID NO: 54886 - RNA, 321 nt, synthetic construct
  misc_feature 1..321: note = derived and/or modified sequence opt11 from anti-HIV_V3_LightChain
  source 1..321: mol_type = other RNA
gaaatcgtcatgacccaatcccccgccaccctctccgtctcccccggcgaaggcgtcaccctctcctgccgagcctcccaatccgtctcctcaaacatcctctggtaccaacaacgccccggccaagccccccgcctcctcctctacggcgcctccacccgcgccaccggcatccccgcccgattctccggctccggctccggcaccgaattcaccctcaccatcaactccatgcaatccgaagacttcgccatctactactgccaacaataccacgactggctatggaccctaggccaaggcacccaagtcgaaatcaaa

SEQ ID NO: 54887 - RNA, 327 nt, synthetic construct
  misc_feature 1..327: note = derived and/or modified sequence opt11 from anti-HIV_V3_LightChain
  source 1..327: mol_type = other RNA
tcctacgaactcacccaacccccctccgtctccgtctcccccggccaaaccgcctccatcacctgctccggcgacaaaatgggcgaacgctacacctcctggtaccaacaaaaacccggccaatcccccgtcctcgtcatgtccgaaaacatcaaacgccccgccggcatccccgaacgcttctccggctcctcctccggcaacaccgccatcctcaccatctccggcacccaagccgtcgacgaagccgactactactgccaagtctgggacaccaccaccacctcctacgtcatcttcggcggcggcaccaaactcaccgtcctc

SEQ ID NO: 54888 - RNA, 321 nt, synthetic construct
  misc_feature 1..321: note = derived and/or modified sequence opt11 from anti-HIV_V3_LightChain
  source 1..321: mol_type = other RNA
gacatccaaatgacccaatccccctcctccctctccgcctccgtcggcgaccgcgtcaccatcacctgccaagcctcccaagacatcggcaactacctcaactggtaccaccaaaaacccggcaaagcccccaaactcctcatctacgacgcctccaacgtcgaaaccggcgtcgcctcccgcttctccggctccggctccggcaccgacttcaccctcaccatctcctccctccaacccgaagacatcggcacctacttctgccaacaatacgaatccctcccctgggccttcggcggcggcaccaaagtcgaaatccgc

SEQ ID NO: 54889 - RNA, 333 nt, synthetic construct
  misc_feature 1..333: note = derived and/or modified sequence opt11 from anti-HIV_V3_LightChain
  source 1..333: mol_type = other RNA
aacttcaaactcacccaaccccactccgtctccgaatcccccggcaaaaccgtcaccatctcctgcacccgcacctccggcaccatcgccaccaactacgtccaatggttccaacaacgccccggctcctcccccaccaccatgatctacgaaaacgacaaacgcccctccggcgtccccgaccgcttctcaggctccatcgacacctcctccaactccgcctccctcaccatctccggcctcaaaaccgaagacgaagccgactactactgccaatcctacaactccaccgacatcgtcgtcttcggcggcggcaccaaactcaccgtcctc

SEQ ID NO: 54890 - RNA, 327 nt, synthetic construct
  misc_feature 1..327: note = derived and/or modified sequence opt11 from anti-HIV_V3_LightChain
  source 1..327: mol_type = other RNA
caatcagtcctcacccaacccccctccgtctccgccgcccccggccaaaaagtcaccatctcctgctccggctcctcctccaacatcggcaacaacatggtctcctggtaccaacaacaccccggcaccgcccccaaactcctcatctacgaaaactccaaacgcccctccggcatccccgaccgcttctccggctcccgctccggcacctccgccaccctcggcatcatcggcctccaaaccggcgacgaagccgaatactactgcgccacctgggacggctccctccgcaccgtcttcggcggcggcacaaaactcaccgtcctc

SEQ ID NO: 54891 - RNA, 324 nt, synthetic construct
  misc_feature 1..324: note = derived and/or modified sequence opt11 from anti-HIV_V3_LightChain
  source 1..324: mol_type = other RNA
agctatgaattgacccagcccccgagcgtgagcgtgagcccgggccagaccgcgcgcataacctgtagcggggacgcgctcccgaaccagtacgggtactggtaccagcaaaagcccgggcaagcgcccgtgctcgtgatctttaaagatagcgagcgcccgagcgggatcccggaaaggttctcgggctcgagctcgggcacgaccgtgaccttgaccataagcggggtccaggccgaggacgaggccgattactattgccagagcgcggactcgagcgggaactatgaagtgttcgggggcgggaccaagctcacggtcttg

SEQ ID NO: 54892 - RNA, 330 nt, synthetic construct
  misc_feature 1..330: note = derived and/or modified sequence opt11 from anti-HIV_V3_LightChain
  source 1..330: mol_type = other RNA
caatccgtcctcacccaacccccctccgtctccgaagccccccgccaacgcgtcaccatctcctgctccggctcctcctccaacatcggcaacaacgccgtcaactggtaccaacaagtccccggcaaagcccccaaactcctcatctactacgacgacctcctcccctccggcgtctccgaccgcttctccggctccaaatccggctcctccgcctccctcgccatctccggcctccaatccgaagacgaagccgactactactgcgccgcctgggacgactccctcaaagtctacgtcttcggcaccggcacctccgtcaccgtcctc

SEQ ID NO: 54893 - RNA, 333 nt, synthetic construct
  misc_feature 1..333: note = derived and/or modified sequence opt11 from anti-HIV_V3_LightChain
  source 1..333: mol_type = other RNA
gacatcgtcatgaaccaatcccccccctccctcgccgtcacccccggcgaacccgcctccatctcctgccgcgcctcccaatccctcctctactccgacggccacaactacctcgactggtacctccaaaaacccggccaagccccccaactcctcatctacctcggctccacccgcgcctccggcgtccccgaccgcttctcaggctccggctccggcaccgacttcaccctcaaaatctcccgcgtcgaagccgaagacgtcggcgtctactactgcatgcaacccctccaatcctacaccttcggccaaggcaccaaactcgaaatcaaa

SEQ ID NO: 54894 - RNA, 321 nt, synthetic construct
  misc_feature 1..321: note = derived and/or modified sequence opt11 from anti-HIV_V3_LightChain
  source 1..321: mol_type = other RNA
gcctacgaactcacccaacccccctccgtctccgtatcccccggccaaacagcccgcatcacctgctccggcgacgccctccccaaccaatacgcatactggtaccaccaacgacccggccaagcccccgtcctcgtcatccacaaagacaccgaacgcccctccggcatccccgcccgcttctccggctcctcctccggcaccaccgtaaccctcaccatctccgaagtccaagccgaagacgaaggcgactactactgccaatccgccgacacctccgcctacgtcgtcttcggcggcggcacaaaactcaccgtcctc

SEQ ID NO: 54895 - RNA, 330 nt, synthetic construct
  misc_feature 1..330: note = derived and/or modified sequence opt11 from anti-HIV_V3_LightChain
  source 1..330: mol_type = other RNA
caatccgtcctcacccaagccccctcctcctccggcacccccggccaatccgtcaccatctcctgctccggctcctcctccaacatggaaatcaactacgtctactggtaccgccaattccccggcaccgccccccaactcctcatctacaacgacaaccaacgcccctccggcgtccccgaccgcttctccgcctccaaatcaggcacctccgcctccctcgccatcggcggcctccgctccgaagacgaagccgactacttctgcgccgtctggcacggcgaccgcggcggccccgtcttcggcggcggcaccaaactaaccgtcctc

SEQ ID NO: 54896 - RNA, 327 nt, synthetic construct
  misc_feature 1..327: note = derived and/or modified sequence opt11 from anti-HIV_V3_LightChain
  source 1..327: mol_type = other RNA
tcctacgaactcaaacaaccccgctccgtctccgtctcccccggccaaaccgcccgcatcacatgctccggcgacgccatgcccaaccaatacgcatactggtaccaacaacgccccggccgcgcccccgtcctcctcatcttcaaagacaacgaacgcgcctccggcatccccgaacgcatctccggctcctcctcaggcaccaccgccaccctcaccatcaaccgcgtccaagccgaagacgaagccgactacctctgccaatccgccgactcctccggcgccttcccctgggtcttcggcggcggcaccaccctcaccgtcctc

SEQ ID NO: 54897 - RNA, 324 nt, synthetic construct
  misc_feature 1..324: note = derived and/or modified sequence opt11 from anti-HIV_V3_LightChain
  source 1..324: mol_type = other RNA
agctacgaactaacccagcccccgagcgtaagcgtaagcccgggccagaccgcacgcataacctgcagcggagacgcactcccgaaagaatacgcatactggtaccagcagaaaagcggacaagcacccgtactcgtaatctacgaagacaccagacgcccgagcggaatcccggaaaggttctcgggctcaagctcaggcacaatggcgaccctgaccgtaagcggggcccacgtcgacgacgaagccgactactactgctacagcagagacacaagcgcaaaccaatgggtattcggaggcggaaccaaactcacagtcctg

SEQ ID NO: 54898 - RNA, 318 nt, synthetic construct
  misc_feature 1..318: note = derived and/or modified sequence opt11 from anti-HIV_V3_LightChain
  source 1..318: mol_type = other RNA
gaaatcgtcctcacccaatcacccgccaccctctccctctcccccggcgaacgcgccaccctctcctgccgcgcctcccaatccatctccacctacctcggctggtaccaacaaaaacccggccaagccccccgcctcctcatctacgacgcctccaaccgcgccaccggcatccccgcccgcttctccggctccggctccggcaccgacttcaccctcaccatctcctccctcgaacccgaagacttcgccgtctactactgccaacaacgatacacctggatcaccttcggccaaggcacccgcctcgaaatcaaa

SEQ ID NO: 54899 - RNA, 327 nt, synthetic construct
  misc_feature 1..327: note = derived and/or modified sequence opt11 from anti-HIV_V3_LightChain
  source 1..327: mol_type = other RNA
tcctacgaactcacccaacccccctccgtctccgtctcccccggccaaaccgcccgcatcacctgctccggcgacgccctccccaaccaatacgtctactggtaccaacaacgacccggccaagcccccgtcgtcgtcctctacaaagacaccgaacgcccctccggcatccccgaacgcttctccggctcctcctccggcaccaccgtcaccctcaccatctccggcgtccaagccgaagacgaagccgactactactgccaatccgccgacaactccggcgcctaccccctcttcttcggcggcggcaccaaactcaccgtcctc

SEQ ID NO: 54900 - RNA, 333 nt, synthetic construct
  misc_feature 1..333: note = derived and/or modified sequence opt11 from anti-HIV_V3_LightChain
  source 1..333: mol_type = other RNA
caatccgtcctcacccaacccccctccgtctccgccgcccccggccaaaaagtcaccatctcctgctccggctcctcatccaacatcggcaacaactacgtcctctggtaccaacaattccccggcaccgcccccaaactcctcatctacggcaacaacaaacgcccctccggcatccccgaccgattctccggctccaaatccggcacctccgccaccctcggcatcaccggcctccaaaccggcgacgaagccgactacttctgcgccacctgggactccggcctctccgccgactgggtcttcggcggcggcaccaaactcaccgtcctc

SEQ ID NO: 54901 - RNA, 321 nt, synthetic construct
  misc_feature 1..321: note = derived and/or modified sequence opt11 from anti-HIV_V3_LightChain
  source 1..321: mol_type = other RNA
gacatccaaatgacccaatccccctcctccctctccgcctccgtcggcgaccgcgtcaccatcacctgccgcgcctcccaagaaatcgacaactacctcgcctggtaccaacaacgccccggcaaagcccccaaatccctcatctacgccgcctcctccctccaaggcggcgtcccccccaaattctccggctccggctccggcaccgaattcaccctcaccatctcctccctccaagccgaagacttcgccacctactactgccaacaatacaacgcctaccccctcaccttcggccaaggcacccgcctcgacatcaac

SEQ ID NO: 54902 - RNA, 324 nt, synthetic construct
  misc_feature 1..324: note = derived and/or modified sequence opt11 from anti-HIV_V3_LightChain
  source 1..324: mol_type = other RNA
tcctacgaactcacccaacccccctccctctccgtctcccccggccaaaccgcctccatcacctgctccggcgacggcctccccaaacaatacggctactggtaccaacaaaaacccggccaagcccccctcctcgtcatcctcaaagacaccgaacgcccctccggcatccccgaacgcttctccggctcctcctccggcaccaccgtcaccctcaccatctccggcgtccaagccgaagacgaagccgactactactgccaatccgtcgactccaccggctcctactacgtcttcggccccggaaccaaagtcaccgtcctc

SEQ ID NO: 54903 - RNA, 324 nt, synthetic construct
  misc_feature 1..324: note = derived and/or modified sequence opt11 from anti-HIV_V3_LightChain
  source 1..324: mol_type = other RNA
tcctacgaactcacccaacccccctccgtctccgtctccccaggccaaaccgcccgcatcacctgctccggcgacgtcctccccaaaaaatacgcctactggtaccaacaaaaatccggcctcgcccccgtcctcgtcatctacgaagacaaccgccgcccctccggcatccccgaacgcttctccggctcctcctccggcaccatggccaccctcaccatctccggcgcccaagtcgaagacgaaggcgactactactgctcctccaccgactcctccggcgaccactacgtcttcggcaccggcaccaaagtcaccgtccta

SEQ ID NO: 54904 - RNA, 321 nt, synthetic construct
  misc_feature 1..321: note = derived and/or modified sequence opt11 from anti-HIV_V3_LightChain
  source 1..321: mol_type = other RNA
gcctacgaactcacccaacccccctccgtctccgtctcacccggccaaaccgcccgcatcacctgctccgccgaagccctctccaaccaatacgcctactggtaccgccaacgccccggccaagcccccctcctcatcatctacaaagacaccaaacgcccctccggcatccccgaacgcttctccggctccacctccggcaccaccgtcaccctcaccatctccggcgtccaagccgaagacgaagccgactactactgccaatccgccgactcctccggcgactacgtcttcggcggcggcaccaaagtcaccgtcctc

SEQ ID NO: 54905 - RNA, 333 nt, synthetic construct
  misc_feature 1..333: note = derived and/or modified sequence opt11 from anti-HIV_CD4bs_LightChain
  source 1..333: mol_type = other RNA
caacccgtcctcacccaatcctcctccgcctccgcctccctcggctcctccgtcaaactcacctgcaccctcggctccggccactccggatccatcatcgcctggcaccaacaacaacccggcaaagccccccgctacctaatgaaagtccaatcatccggctcctacaacaaaggctccggcgtccccgaccgcttctccggctcctcctccggagccgaccgctacctcaccatctccaacctacaattcgaagacgaaggcgactactactgcgaaacctgggacaccaacaaatacgtcttcggcaccggcaccaaagtcaccgtcctc

SEQ ID NO: 54906 - RNA, 324 nt, synthetic construct
  misc_feature 1..324: note = derived and/or modified sequence opt11 from anti-HIV_CD4bs_LightChain
  source 1..324: mol_type = other RNA
gaactcgtcctcacccaatcccccggcaccctctccctctcccccggcgaacgcgccaccctctcctgccgcgcctcccaatccgtcgcctcctactacctcgcctggtaccaacaaaaacccggccaagccccccgcctcctcatctacggcgcctcctcccgcgccaccggcatccccgaccgcttctccggctccgtctccggcaccgacttcaccctcaccatctcccgcctcgaacccgaagacttcgccctctactactgccaacaatacggctcctcccccctctccttcggcggcggcaccaaagtcgaaatccgc

SEQ ID NO: 54907 - RNA, 333 nt, synthetic construct
  misc_feature 1..333: note = derived and/or modified sequence opt11 from anti-HIV_CD4bs_LightChain
  source 1..333: mol_type = other RNA
caatccgcactcacccaacccccctccatgtccggctcacccggccaatccatcaccatctcctgcaccggctccggctccgacgtcggctcccacaacttcgtctcctggtaccaacaacaccccgcccgcgtccccaaactcctcatctacgccgtcggcaaccgcccctccggcgtctccgaacgcttctccggctccaaatccggcaacaccgcctacctcaccatctccggcctccaagccgacgacgaagccgactactactgctcctcccacaccaccggcaccaccctcgaagtcttcggcggcggcacccgcctcaccgtcctc

SEQ ID NO: 54908 - RNA, 333 nt, synthetic construct
  misc_feature 1..333: note = derived and/or modified sequence opt11 from anti-HIV_CD4bs_LightChain
  source 1..333: mol_type = other RNA
gacatcgtcatgacccaatcccccctctccctccccgtcacccccggcgaacccgcctccatctcctgccgctcatccgaatccctcctccactccaacggcttcatctacctcgactggtacctccaaaaacccggccaatccccccaactcctcatctacctcggctccaaacgcgcctccggcgtctccgaccgcttctccggctccggctccggcaccgccttcaccctcaaaatctcccgcgtcgaagccgaagacgtcggcgtctactactgcatgcaagccctcgaatcccgcaccttcggccaaggcaccaaactcgaaatcaaa

SEQ ID NO: 54909 - RNA, 327 nt, synthetic construct
  misc_feature 1..327: note = derived and/or modified sequence opt11 from anti-HIV_CD4bs_LightChain
  source 1..327: mol_type = other RNA
gaaatcgtcctcacccaatcccccggcaccctatccctctcccccggcgaacgcgccaccctctcctgccgcgcctcccaatccgtctcctcctcctacctcgcctggtaccaacaaaaacccggccaatcaccccgcctcctcatctacggcgcctcctcccgcgccaccggcatccccgaccgcttctccggctccggctccggcaccgacttcaccctcaccatctcccgcctcgaacccgaagacttcgccgtctactactgccaacactacggctcctcctccatcttcaccttcggccccggcaccaaagtcgacatccgc

SEQ ID NO: 54910 - RNA, 330 nt, synthetic construct
  misc_feature 1..330: note = derived and/or modified sequence opt11 from anti-HIV_CD4bs_LightChain
  source 1..330: mol_type = other RNA
aacttcatgctcacccaaccccactccgtctccggctcccccggcaaaaccgtcaccatctcctgcacccgctcctccggctccatcgccggcaactacgtccaatggtaccaacaacgccccggcacctcccccaccaccgtcatctacgaaaacgaccaacgctcctccggcgtccccgaccgcttctccggctccatcgactcctcctccaactccgcctccctcaccatctccggactcaaaaccgaagacgaagccgactactactgccactcctacgacgccaccaaccaagtcttcggcggcggcaccaaactcaccgtcctc

SEQ ID NO: 54911 - RNA, 333 nt, synthetic construct
  misc_feature 1..333: note = derived and/or modified sequence opt11 from anti-HIV_CD4bs_LightChain
  source 1..333: mol_type = other RNA
gacgtcgtcgtcacccaatcccccctctccctccccgtcaccctcggccaacccgcctccatctcctgccgctcctcccaatccctcgtctactccgacggcaccacccacctcaactggtaccaccaacgccccggccaaccaccccgccgcctcatctaccgcgtctccaaccgcgactccggcgtccccgaccgcttctccggctccggctccggcaccgacttcaccctccgcatctcccgcgtcgaagccgaagacgtcggcctctactactgcatgctcgccacccaccccttcaccttcggccccggcaccaaagtcgaaatcaaa

SEQ ID NO: 54912 - RNA, 336 nt, synthetic construct
  misc_feature 1..336: note = derived and/or modified sequence opt11 from anti-HIV_CD4bs_LightChain
  source 1..336: mol_type = other RNA
cagagcgtgctcacgcaaccgccctcggtctcgggcgcgcccgggcaaacggtcacgatctcgtgcacgggctcgagctcaaacataggcccgagctatgacgtgcaatggtaccagcaatttcccgggcgcgcgcccaagctcctgatctcgggcaataacaatcgcgcgagcggggtcccggacaggttctcgggctcgaaatcgggcacgagcgcgagcttggccataaccgggctccagagcgaggacgaggccgattactattgccagacctatgactcgagcttgagcgggcacgtggtctttggcgggggcacgcgcctgaccgtgctc

SEQ ID NO: 54913 - RNA, 321 nt, synthetic construct
  misc_feature 1..321: note = derived and/or modified sequence opt11 from anti-HIV_CD4bs_LightChain
  source 1..321: mol_type = other RNA
gacatccaaatgacacaatccccctccaccctctccgcctccgtcggcgaccgcgtcaccatcacctgccgcgcctccgcctccatctacacctggctcgcctggtaccaacaacgacccggcaaagcccccgaagtcctcatctacaaagcctccaccctcaaatccggcgtcccctcccgcttctccggctccggctccggcaccgaattcaccctcaccatctcctccctccaacccggcgacttcgccacctactactgccaacaatacaccacctacccactcaccttcggcggcggcaccaccgtcgaaatcaaa

SEQ ID NO: 54914 - RNA, 330 nt, synthetic construct
  misc_feature 1..330: note = derived and/or modified sequence opt11 from anti-HIV_CD4bs_LightChain
  source 1..330: mol_type = other RNA
caatcagccctcacccaacccgcctccgtctccggctcccccggccaatccatcaccatctcctgcaccggcacctccaacgacatcggcacctacaacctcgtctcctggtaccaacaccaccccaacaaagcccccaaagtcgtcgtctacgaaaacaacaaacgcccctccggcatctccaaccgcttctccggctccaaatccggcaacaccgcctccctcaccatctccggcctccaagccgaagacgaagccgactactactgctgctcctacgccggctcctccacctgggtcttcggcggcggcaccaaactcaccgtcctc

SEQ ID NO: 54915 - RNA, 321 nt, synthetic construct
  misc_feature 1..321: note = derived and/or modified sequence opt11 from anti-HIV_V2_LightChain
  source 1..321: mol_type = other RNA
gacatccaaatgacccaatccccctccaccctctccgcctccgtcggcgaccgcgtcaccatcacctgccgcgcctcccaaaccatctcctcctggctcgcctggtaccaacaaaaatccggcaccgcccccaaactcctcatctacaaagcctcctccatcgtctccggcgtcccctcccgcttctccggctccggctccggcaccgaattcaccctcaccatcacctccctccaacccgacgacttcgccacctactactgccaacaatacaactcctcccccgaaaccttcggccaaggcaccaaagtcgaaatcaaa

SEQ ID NO: 54916 - RNA, 318 nt, synthetic construct
  misc_feature 1..318: note = derived and/or modified sequence opt11 from anti-HIV_V2_LightChain
  source 1..318: mol_type = other RNA
gaaatcgtcctcacccaatcccccggcaccctctccctctcccccggcgaacgcgccaccctatcctgccgcgcctcccaatccgtctcctcctacctcgcctggtaccaacaaaaacccggccaagcaccccgcctcctcatctacgacgcctcctcccgcgccaccggcatccccgaccgcttctccggctccggctccggcaccgacttcaccctcaccatctcccgcctcgaacccgaagacttcgccgtctactactgccaacactacgccggatcccgcaccttcggccaaggcaccaaagtcgaaatcaaa

SEQ ID NO: 54917 - RNA, 333 nt, synthetic construct
  misc_feature 1..333: note = derived and/or modified sequence opt11 from anti-HIV_V2_LightChain
  source 1..333: mol_type = other RNA
caatccgtcctcacccaacccccctccgtctccggcgcccccggccaacgcgtcaccatctcctgcaccggctcctcctccaacatcggcgcccactacgacgtccactggtaccaacaactccccggcaccgcccccaaactcctcatctacggcaactccaaccgcccctccggcgtccccgaccgcttctccggctccaaatccggcacctccgcctccctcgccatcaccggcctccaagccgaagacgaagccgactactactgccaatcctacgactcctccctctccggctacgtcttcggcaccggcaccaaagtcaccgtcctc

SEQ ID NO: 54918 - RNA, 324 nt, synthetic construct
  misc_feature 1..324: note = derived and/or modified sequence opt11 from anti-HIV_V2_LightChain
  source 1..324: mol_type = other RNA
gacaccgtcatgacccaatcccccgccaccctctccgtctcccccggcgaacgcgtcaccctctcctgccgcgcctcccaaatcatcaacaccaacctagcctggtaccaaaaacgccccggccaagccccccgcctcctcatctacgccgcctccgcccgcgccaccggcatccccgcccgcttctccggctccggctccggcaccgaattcacactcaccatctccggcctccaatccgaagactccgccgtctactactgccaacaatacaaacactggcccccctacaccttcggccgcggcaccaaactcgaaatccgc

SEQ ID NO: 54919 - RNA, 321 nt, synthetic construct
  misc_feature 1..321: note = derived and/or modified sequence opt11 from anti-HIV_V2_LightChain
  source 1..321: mol_type = other RNA
gaaatcgtcctcacccaatcccccggcaccctctccctctcccccggcgaacgcgccaccctctcctgccgcgcctcccaatccgtctcctcctcctacctcgcctggtaccaacaaaaacccggccaagccccccgcctcctaatctacggcgcctcctcccgcgccaccggcatccccgaccgcttctccggctccggctccggcaccgacttcaccctcaccatctcccgcctcgaacccgaagacttcgccgtctactactgccaacaatacggctcctcccgcaccttcggccaaggcaccaaagtcgaaatcaaa

SEQ ID NO: 54920 - RNA, 321 nt, synthetic construct
  misc_feature 1..321: note = derived and/or modified sequence opt11 from anti-HIV_V2_LightChain
  source 1..321: mol_type = other RNA
gacatccaaatgacccaatcaccctcctccctctccgcctccgtaggcgaccgcgtcaccatcacctgccgcgcctcccaatccatctccggcaacctcaactggtaccaacaaaaacccggcaaagcccccaacctcctcatctacggcgcctcctccctccaatccggcgtcccctcccgcttctccggctccggctccggcaccgacttcaccctcaccatctcctccctccaacccgaagacttcgccacctaccactgccaacaatcccactccacctcatggaccttcggccaaggcaccaaagtcgtcatcaaa

SEQ ID NO: 54921 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtatccgtcgccctcggccaaaccgtcaccatcacctgccgcggcgactccctccgcaaccactacacctcctggtaccaacaaaaaaccggccaagccccagtcctcctcatctaccccaaacacaaccgctcccccggcatctccgaccgcttctccgcctcctcctccggcaacaccgcctccctcaccatcaccggcgcccaaaccgaagacgaaggcgactactactgctcctcccgcgacaaatccggctcccgcctcgtcaccttcggcggcggcaccgaagtcaccggcctc

SEQ ID NO: 54922 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaaccactacacctcctggtaccaacaaaaaaccggccaagcccccgtcctcctcatctaccccaaacacaaccgctcccccggcatctccgaccgcttctccgcctcctcctccggcaacaccgcctccctcaccataaccggcgcccaaaccgaagacgaaggcgactactactgctcctcccgcgacaaatccggctcccgcctcgtcaccttcggcggcggcaccaaagtcaccgtcgtc

SEQ ID NO: 54923 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaactactacacctcctggtaccaacaaaaacccggccaagcccccgtcctcctcatctaccccaaacacaaccgcccccccggcatctccgaccgattctccgcctcctcctccggcaacaccgcctccctcaccatcaccggcgcccaaaccgaagacgaaggcgactactactgctcctcccgcgacaaatcaggctcccgcctcgtcaccttcggcggcggcaccaaagtcaccggcctc

SEQ ID NO: 54924 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaactactacacctcctggtaccaacaaaaacccggccaagcccccgtcctcctcatctaccccaaacacaaccgcccccccggcatctccgaccgcttctccgcctcctcctccggcaacaccgcctccctcaccatcaccggcgcccaaaccgaagacgaaggcgactactactgctcctcccgcgacaaatccggctcccgcctcgtcaccttcggccgcggcaccaaactcaccgtcgta

SEQ ID NO: 54925 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaaccactacacctcctggtaccaacaaaaaaccggccaagcccccgtcctcctcatctaccccaaacacaaccgctcccccggcatctccgaccgcttctccgcctcctcctccggcaacaccgcctcactcaccatcaccggagcccaaaccgaagacgaaggcgactactactgctcctcccgcgacaaatccggctcccgcctcgtcaccttcggcggcggcaccaaagtcaccgtcctc

SEQ ID NO: 54926 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaactactacacctcctggtaccaacaaaaaccccgccaagcccccgtcctcctcatctaccccaaacacaaccgcccccccggcatctccgaccgcttctccgcctcctcctccggcaacaccgcctccctcaccatcaccggcgcccaaaccgaagacgaaggcgactactactgctcctcccgcgacaaatccggctcccgcctcgtcaccttcggcggcggcaccaaactcaccgtcctc

SEQ ID NO: 54927 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaactactacacctcctggtaccaacaaaaacccggccaagcccccgtcctcctcatctaccccaaacacaaccgcccccccggcatctccgaccgcttctccgcctcctcctccggcaacaccgcctccctcaccatcaccggcgcccaaaccgaagacgaaggcgactactactgctcctcccgcgacaaatccggctcccgcctcgtcaccttcggcggcggcaccaaactcaccgtcctc

SEQ ID NO: 54928 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccaccgtctccgtcgccctcggccaaaccgtcaccatcacctgccgcggcgactccctccgcaaccactacacctcatggtaccaacaaaaaaccggccaagcccccatcctcctcatctaccccaaacacaaccgcccccccggcatctccgaccgcttctccgcctcatcctccggcaacaccgcctccctcaccatcaccggcgcccaaaccgaagacgaaggcgactactactgctcctcccgcgacaaatccggctcacgcctcgtcaccttcggcggcggcaccaaactcaccgtcctc

SEQ ID NO: 54929 - RNA, 327 nt, synthetic construct
  misc_feature 1..327: note = derived and/or modified sequence opt11 from anti-HIV_10E8
  source 1..327: mol_type = other RNA
tcgagcgatctcacgcaagatcccgcggtctcggtcgcgctcgggcaaacggtcaggatcacgtgccagggcgatagcttgcgcaggtactatgccgggtggtatcaacagaaaccgggccaggccccggtcttggtcgtgtacgggcgcgataacaggccctcaggcatacccgatcgctttagcgggagcacgagcgggaacacggcctcgctcacgatcgcgggcgcgcaagcggaagatgacgcggactattactgtagctcacgcgataaatcgggctcgcgcttgagcgtgttcgggggcgggaccaagctcacggtcttg

SEQ ID NO: 54930 - RNA, 327 nt, synthetic construct
  misc_feature 1..327: note = derived and/or modified sequence opt11 from anti-HIV_10E8
  source 1..327: mol_type = other RNA
gcgagcgagctcacgcaagatcccgcggtctcggtcgcgttcgagaaaacggtcacgatcacgtgccagggcgatagcttgcgctcgcactatgtctcgtggtatcaaaagcgcccgggccaggccccggtcctggtcttttacgggaaaaataacaggccctcgggcatacccgatcgctttagcgggagcacgagcgggaacacggcctcgctcacgatcgcgggcgcgcaagcggaagatgacgcggactattactgtagctcgcgcgataaatcaggctcgcgcttgagcgtgttcgggggcgggaccaagctcacggtcccg

SEQ ID NO: 54931 - RNA, 327 nt, synthetic construct
  misc_feature 1..327: note = derived and/or modified sequence opt11 from anti-HIV_10E8
  source 1..327: mol_type = other RNA
gcgagcgagctcacgcaagatcccgcggtctcggtcgcgctcaagcaaacggtcacgatcacgtgcaggggcgatagcttgcgctcgcactatgtctcgtggtatcaacagaaaccgggccaggccccggtcctggtcttttacgggaaaaataacaggccctcgggcatacccgatcgctttagcgggagctcgagcgggaacacggcctcgctcacgatcgcgggcgcgcaagcggaagatgacgcggactattactgtagctcgcgcgataaatcgggctcgcgcttgagcgtgttcgggggcgggaccaagctcacggtcttg

SEQ ID NO: 54932 - RNA, 327 nt, synthetic construct
  misc_feature 1..327: note = derived and/or modified sequence opt11 from anti-HIV_10E8
  source 1..327: mol_type = other RNA
tcgagcgagctcacgcaagatcccggggtctcggtcgcgctcaagcaaacggtcacgatcacgtgcaggggcgatagcttgcgctcgcactatgtctcgtggtatcaaaagaaaccgggccaggccccggtcctggtcttttacgggaaaaatatcgggccctcaggcatacccgatcgctttagcgggagcacgagcgggaacacggcctcgctcacgatcgcgggcgcgcaagcggaagatgacgcggactattactgtagctcgcgcgataaatcgggctcgcgcttgagcgtgttcgggggcgggaccaagctcacggtcttg

SEQ ID NO: 54933 - RNA, 327 nt, synthetic construct
  misc_feature 1..327: note = derived and/or modified sequence opt11 from anti-HIV_10E8
  source 1..327: mol_type = other RNA
gcctccgaactcacccaagaccccgccgtctccgtcgccctcaaacaaaccgtcaccatcacctgccgcggcgactccctccgctcccactacgtctcctggtaccaaaaaaaacccggccaagcccccgtcctcgtattctacggcaaaaacaaccgcccctcaggcatcccagaccgcttctccggctcctcctccggcaacaccgcctcactcaccatcgccggcgcccaagccgaagacgacgccgactactactgctcctcccgcgacaaatccggctcccgcctctccgtcttcggcggcggcaccaaactcaccgtcctc

SEQ ID NO: 54934 - RNA, 327 nt, synthetic construct
  misc_feature 1..327: note = derived and/or modified sequence opt11 from anti-HIV_10E8
  source 1..327: mol_type = other RNA
gcgagcgagctcacgcaagatcccggggtctcggtcgcgctcaagcaaacggtcacgatcacgtgcaggggcgatagcttgcgctcgcactatgtctcgtggtatcaaaagcgcccgggccaggccccggtcttggtcttttacgggaaaaataacaggccctcgggcatacccgatcgctttagcgggagcacgagcgggaacacggcctcgctcacgatcgcgggcgcgcaagcggaagatgacgcggactattactgtagctcgcgcgataaatcgggctcgcgcttgagcgtgttcgggggcgggaccaagctcacggtcttg

SEQ ID NO: 54935 - RNA, 327 nt, synthetic construct
  misc_feature 1..327: note = derived and/or modified sequence opt11 from anti-HIV_10E8
  source 1..327: mol_type = other RNA
gcgagcgagctcacgcaagatcccggggtctcggtcgcgctcgagcaaacggtcacgatcacgtgcaggggcgatagcctgcgctcgcactatgtctcgtggtatcaaaagaaaccgggccaggccccggtcttggtcttttacgggaaaaataacaggccctcgggcatacccgatcgctttagcgggagcacgagcgggaacacggcctcgctcacgatcgcgggcgcgcaagcggaagatgacgcggactattactgtagctcgcgcgataaatcgggatcgcgcttgagcgtgttcgggggcgggaccaagctcacggtcttg

SEQ ID NO: 54936 - RNA, 327 nt, synthetic construct
  misc_feature 1..327: note = derived and/or modified sequence opt11 from anti-HIV_10E8
  source 1..327: mol_type = other RNA
gcgagcgagctcacgcaagatcccggggtctcggtcgcgctcaagcaaacggtcacgatcacgtgcaggggcgatagcttgcgctcgcactatgtctcgtggtatcaaaagaaaccgggccaggccccggtcttggtcttttacgggaaaaataacaggccctcgggcatacccgatcgctttagcgggagcacgagcgggaacacggcctcgctcacgatcgcgggcgcgcaagcggaagatgacgcggactattactgtagctcgcgcgataaatcgggctcgcgcttgagcgtgttcgggggcgggaccaagctcacggtcttg

SEQ ID NO: 54937 - RNA, 327 nt, synthetic construct
  misc_feature 1..327: note = derived and/or modified sequence opt11 from anti-HIV_10E8
  source 1..327: mol_type = other RNA
tcctccgaactcacccaagaccccggcgtctccgtcgccctcaaacaaaccgtcaccatcacctgccgcggcgactccctccgctcacactacgtctcctggtaccaaaaaaaacccggccaagcccccgtcctcgtcttctacggcaaaaacaaccgcccatccggcatccccgaccgcttctccggctccacatccggcaacaccgcctccctcaccatcgccggcgcccaagccgaagacgacgccgactactactgctcctcccgcgacaaatccggctcccgcctctccgtcttcggcggcggcaccaaactaaccgtcctc

SEQ ID NO: 54938 - RNA, 327 nt, synthetic construct
  misc_feature 1..327: note = derived and/or modified sequence opt11 from anti-HIV_10E8
  source 1..327: mol_type = other RNA
tcgagcgagctcacgcaagagaccggggtctcggtcgcgctcgggcgcacggtcacgatcacgtgcagaggcgatagcttgcgctcgcactatgcctcgtggtatcaagagaaaccgggccaggccccgaaattgctcttttacgggaaaaataacaggccctcgggcatacccgatcgctttagcgggagcgcgagcgggaacagggcctcgctcacgatctcgggcgcgcaagcggaagatgacgcggaatattactgtagctcgcgcgataaatcgggctcgcgcttgagcgtgttcgggggcgggaccaagctcgcggtcttg

SEQ ID NO: 54939 - RNA, 327 nt, synthetic construct
  misc_feature 1..327: note = derived and/or modified sequence opt11 from anti-HIV_10E8
  source 1..327: mol_type = other RNA
tcctccgaactcacacaagaaaccggcgtctccgtcgccctcggccgcaccgtcaccatcacctgccgcggcgactccctccgctcccactacgcctcctggtaccaaaaaaaacccggccaagcccccaaactcctcttctacggaaaaaacaaccgcccctccggcatccccgaccgcttctccggcttcgcctccggcaacagagcctccctcaccatctccggcgcccaagccgaagacgacgccgaatactactgctcctcacgcgacaaatccggctcccgcctatccgtcttcggcggcggcaccaaactcacagtcctc

SEQ ID NO: 54940 - RNA, 327 nt, synthetic construct
  misc_feature 1..327: note = derived and/or modified sequence opt11 from anti-HIV_10E8
  source 1..327: mol_type = other RNA
tcgagcgagctcacgcaagagaccggggtctcggtcgcgctcgggcgcacggtcacgatcacgtgcaggggcgatagcctgcgatcgcactatgcctcgtggtatcaaaagaaaccgggccaggccccgaaattgctcttttacgggaaaaataacaggccctcgggcatacccgatcgctttagcgggagcgcgagcgggaacagggcctcgctcacgatctcgggcgcgcaagcggaagatgacgcggaatatatctgtagctcgcgcgataaatcgggctcgcgcctgagcgtgttcgggggcgggaccaagctcacggtcttg

SEQ ID NO: 54941 - RNA, 327 nt, synthetic construct
  misc_feature 1..327: note = derived and/or modified sequence opt11 from anti-HIV_10E8
  source 1..327: mol_type = other RNA
tcgagcgagctcacgcaagagaccggggtctcggtcgcgctcgggcgcacggtcacgatcacgtgcaggggcgatagcttgcgctcgcactatgcctcgtggtatcaaaagaaaccgggccaggccccgaaattgctcttttacgggaaaaataacaggccctcgggcatacccgatcgctttagcgggagcgcgagcgggaacagggcctcgctcacgatctcaggcgcgcaagcggaagatgacgcggaatattactgtagctcgcgcgataaatcgggctcgcgcttgagcgtgttcgggggcgggaccaagctcacggtcttg

SEQ ID NO: 54942 - RNA, 327 nt, synthetic construct
  misc_feature 1..327: note = derived and/or modified sequence opt11 from anti-HIV_10E8
  source 1..327: mol_type = other RNA
tcaagcgagctcacgcaagagaccggggtctcggtcgcgctcgggcgcacggtcacgatcacgtgcaggggcgatagcttgcgctcgcactatgcatcgtggtatcaaaagaaaccgggccaggccccgatcctgctcttttacgggaaaaataacaggccctcgggcatacacgatcgctttagcgggagcgcgagcgggaacagggcctcgctcacgatctcgggcgcgcaagcggaagatgacgcggaatattactgtagctcgcgcgataaatcgggctcgcgcttgagcgtgttcgggggcgggaccaagctcacggtcttg

SEQ ID NO: 54943 - RNA, 393 nt, synthetic construct
  misc_feature 1..393: note = derived and/or modified sequence opt11 from anti-HIV_10E8
  source 1..393: mol_type = other RNA
gaagtgcaactggtcgagagcgggggcgatctcgtgaaaccgggcgggagcttgcgcttgagctgtagcgcgagcgggttctcgttcaagaacacgtggatgacctgggtcaggcaagcgcccgggaaagggctagagtgggtgggcaggatcacgggcccgggcgagggctggacctcggactatgccgcgaccgtgcaagggcgctttacaataagcaggaacaatatgatagacatgctatatctcgagatgaatcgcttgcgcacggacgataccgggctctattactgtgtccataccgagaaatattacaatttctggggcgggtacccgcccggggaagagtactttcaacattgggggcgcgggacattggtcatagtctcgagc

SEQ ID NO: 54944 - RNA, 393 nt, synthetic construct
  misc_feature 1..393: note = derived and/or modified sequence opt11 from anti-HIV_10E8
  source 1..393: mol_type = other RNA
gagataaggttggtggagagcgggggggggctagtgaagccgggggggagcttgagattgagctgtagcgcgagcgggttcaatttcgatagcgcgtggatgacgtgggtgaggcagccgccagggaaggggctggagtgggtgggaaggataacggggccgggggaggggtggagcgtggggtatgcggagagcgtgaaagggaggtttataataagcaggataaatagcataaactttctgtatctggagatgaataacttgaggccggaggatacggggagctatttctgtgcgcatacggggaagcattacgatttctggagggggtacccgccgggggaggagtactttcaggattgggggcaggggacacaggtgatagtgtcgagc

SEQ ID NO: 54945 - RNA, 393 nt, synthetic construct
  misc_feature 1..393: note = derived and/or modified sequence opt11 from anti-HIV_10E8
  source 1..393: mol_type = other RNA
gaaatacgcttggtcgagagcgggggcgggctcgtgaaaccgggcgggagcttgcgcttgagctgtagcgcgagcgggttcaatttcgatagcgcgtggatgacctgggtcaggcaaccgcccgggaaagggctcgagtgggtgggcaggatcacgggcccgggcgagggctggagcgtggactatgccgagagcgtgaaagggcgctttatcataagcaggatcaatagcataaactttctctatctcgagatgaataacttgcgaccggaagataccgggagctatttctgtgcccataccgggaaacattacgatttctggcgcgggtacccgcccggggaagagtactttcaagattgggggcaagggacccaggtcatagtctcgagc

SEQ ID NO: 54946 - RNA, 393 nt, synthetic construct
  misc_feature 1..393: note = derived and/or modified sequence opt11 from anti-HIV_10E8
  source 1..393: mol_type = other RNA
gaggtgagattggtggagagcggggggaggctggtgaggccgggggggagcttgaggttgagctgtagcgcgagcgggttcaatttcgataacgcgtggatgacgtgggtaaggcagccgccggggaaggggctggagtgggtggggaggataacgggaccgggggaggggtggagcgtggactatgcggcgagcgtgaaggggagatttacgataagcaggatgaatagcataaactttttctatctggagatgaataacttgaagatagaggatacggggctgtatttctgtgcgaggacggggaagcattacgcgttctggggagggtacccgccgggggaggagtacttggaggattgggggcaggggacgttggtgatagtgagtagc

SEQ ID NO: 54947 - RNA, 393 nt, synthetic construct
  misc_feature 1..393: note = derived and/or modified sequence opt11 from anti-HIV_10E8
  source 1..393: mol_type = other RNA
gaggtcaggctcgtggaatcgggcgggggcctggtcaagcccgggggctcgctcaggctctcgtgctcggcctcgggctttaactttgacgatgcctggatgacgtgggtgcgccagcccccgggcaagggcctggaatgggtcgggcgcataagcgggcccggggaagggtggtcggtcgattacgcggaatcggtaaagggcaggttcacgatctcgcgcttgaactcgatcaatttcttgtacttggaaatgaacaatgtcaggaccgaggacacgggctattacttttgcgcgcgcacgggcaagcactatgacttttggtcgggctatccaccgggagaggaatatttccaggactggggccagggcacgctagtgatcgtgagctcg

SEQ ID NO: 54948 - RNA, 393 nt, synthetic construct
  misc_feature 1..393: note = derived and/or modified sequence opt11 from anti-HIV_10E8
  source 1..393: mol_type = other RNA
gaagtgcgcttggccgagagcgggggcgggctcgtgaaaccgggcgggagcttgcgcttgagctgtagcgcgagcgggttcgatttcgataacgcgtggatgacctgggtcaggcaaccgcccgggaaagggctcgagtgggtgggcaggatcacgggcccgggcgagggctggagcgtggactatgccgcgccagtggaagggcgatttaccataagcaggctcaatagcataaactttctctatctagagatgaataacttgcgcatggaagatagcgggctctatttctgtgccaggaccgggaaatattacgatttctggagcgggtacccgcccggggaagagtactttcaagattgggggcaagggaccttggtcatagtcccgagt

SEQ ID NO: 54949 - RNA, 393 nt, synthetic construct
  misc_feature 1..393: note = derived and/or modified sequence opt11 from anti-HIV_10E8
  source 1..393: mol_type = other RNA
gaagtgcgcttggtcgagagcgggggcgggctcgtgaaaccgggcgggagcttgcgcttgagctgtagcgcgagcgggttcgatttcgataacgcgtggatgacctgggtcaggcaaccgcccgggaaagggctcgagtgggtgggcaggatcacgggcccgggcgagggctggagcgtggactatgccgcgcccgtggaagggcgctttaccataagcaggctaaatagcataaactttctctatctagagatgaataacttgcgcatggaagatagcgggctctatttctgtgccaggaccgggaaatattacgatttctggagcgggtacccgcccggggaagagtactttcaagattgggggcaagggaccttggtcatagtcccgagc

SEQ ID NO: 54950 - RNA, 393 nt, synthetic construct
  misc_feature 1..393: note = derived and/or modified sequence opt11 from anti-HIV_10E8
  source 1..393: mol_type = other RNA
gaagtgcgcttggtcgagagcgggggcgggctcgtgaaaccgggcgggagcttgcgcttgagctgtagcgcgagcgggttcgatttcgataacgcgtggatgacctgggtcaggcaaccgcccgggaaagggctcgagtgggtgggcaggatcacgggcccgggcgagggctggagcgtggactatgccgcgcccgtggaagggcgctttaccataagcaggctaaatagcataaactttctctatctcgagatgaataacttgcgcatggaagatagcgggctctatttctgtgccaggaccgggaaatattacgatttctggagcgggtacccgcccggggaagagtactttcaagattgggggcaagggaccttggtcatagtctcgagc

SEQ ID NO: 54951 - RNA, 393 nt, synthetic construct
  misc_feature 1..393: note = derived and/or modified sequence opt11 from anti-HIV_10E8
  source 1..393: mol_type = other RNA
gaagtgcgattggccgagagcgggggcgggcttgtgaaaccgggcgggagcttgcgattgagctgtagcgcgagcgggttcgatttcgataacgcgtggatgacctgggtcaggcaaccgcccgggaaagggctcgagtgggtggggaggatcacgggcccgggcgagggctggagcgtggactatgccgcgcccgtggaagggcgatttacgataagcaggctaaatagcataaactttctctatctagagatgaataacttgcgcatggaagatagcgggctatatttctgtgccaggaccgggaaatattacgatttctggagcgggtacccgcccggggaagagtactttcaagattgggggcgcgggaccttggtaatagtctcgagc

SEQ ID NO: 54952 - RNA, 393 nt, synthetic construct
  misc_feature 1..393: note = derived and/or modified sequence opt11 from anti-HIV_10E8
  source 1..393: mol_type = other RNA
gaagtgcgcttggtcgagagcgggggagggctcgtgaaaccgggcgggagcttgcgcttgagctgtagcgcgagcgggttcgatttcgataacgcgtggatgacctgggtcaggcaaccgcccgggaaagggctcgagtgggtgggcaggatcacgggcccgggcgagggctggagcgtggactatgccgcgccagtggaagggcgctttaccataagcaggctcaatagcataaactttctatatctagagatgaataacttgcgcatggaagatagcgggctctatttctgtgccaggaccgggaaatattacgatttctggagcgggtacccgccaggggaagagtactttcaagattgggggcgcgggaccctggtcatagtctcgagc

SEQ ID NO: 54953 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgcagcccccggccaaaaagtcaccatctcctgctccggccgctcctccaacatcggcaacaacaacgtcttctggtaccaacaactacccggcaccgcccccaaactcctcatctacgacaacgacaaacgcccctccggcatccccgaccgcttctcaggctccaaatccggcacctccgccaccctcggcatcaccggcctccaaaccggagacgaagcagactactactgcggcacctgggactcctccctctccgccggcggcgtcttcggcaccggcaccaaagtcaccgtcctc

SEQ ID NO: 54954 - RNA, 336 nt, synthetic construct
  misc_feature 1..336: note = derived and/or modified sequence opt11 from anti-HIV-1_LightChain
  source 1..336: mol_type = other RNA
cagagcgtgctcacgcaaccggcctcggtctcgggctcgcccgggcaatcgatcacgatctcgtgcacgggcacgaaatcggacataggcgggtacaagtacgtgagctggtaccagcaacatcccgggaaagcgcccaagatcttgatctatgacgtgaacaagcgcccgagcgggatcccggacaggttctcaggctcgaaatcgggcacgagcgcgacattgggcataaccgggctccagaccggggacgaggccgattactattgcgggacctgggacaatagcttgagcacgggcggggtctttggcacgggcacgaaagtgaccgtgctc

SEQ ID NO: 54955 - RNA, 321 nt, synthetic construct
  misc_feature 1..321: note = derived and/or modified sequence opt11 from anti-HIV-1_LightChain
  source 1..321: mol_type = other RNA
caatccgtcctcacccaacccccctccgtctccgcagcccccggccaacgcgtcaccatctcctgcttcggctcccgcttctcctccgtctcctggtaccaacaactccccggcaccgcccccaaactcctcatctacgaaaacaccaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 54956 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccgcctccggcacccccggccaaaccatcaccatctcctgctccggctcctcctccaacatcggctccaacgacgtctactggtaccaacacctccccggcaccacccccaaagtcgtcatctacaaaaacaaccgccgcccctccggcatccccgaccgcttctccggctccaaatccggcacctccgccaccctcggcatcaccggcctccaaaccggcgacgaagccgactactactgcggaacctgggaccgctccctctccgccggcggcgtcttcggcaccggcaccaaagtcaccgtcctc

SEQ ID NO: 54957 - RNA, 327 nt, synthetic construct
  misc_feature 1..327: note = derived and/or modified sequence opt11 from anti-HIV-1_LightChain
  source 1..327: mol_type = other RNA
caatccgtcctcacccaacccccctccatgtccgccgcccccggccaaaaagtcaccatctcctgctccggctccacctccatcatcggcaacaactacatctcctggtaccaacaactccccggcaccgcccccaaactcctcatctacgaagacaacaaacgcccctccggcatccccgaccgcttctccggctccaaatccggcacctccgccaccctcggcatcaccggcctccaaaccggcgacgaagccgactactactgcggcacctggcactcctccctctccgcaggcggcgtcttcggcaccggcaccaaagtcacc

SEQ ID NO: 54958 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggcctcaaagtcaccatctcctgctccggcaacacctccaacgtcggcgacaacttcgtctcctggtaccgctacctccccggcaccgcccccaaactcctctcctacgaagacgacaaacgcccctccggcatccccgaccgcttctcaggctccaaatccggcacctccgccaccctcggcatcaccggcctccaaaccggcgacgaagccgactactactgcggcacctgggactcctccctctccgccggcggcgtattcggcaccggcaccaaagtcaccgtcctc

SEQ ID NO: 54959 - RNA, 333 nt, synthetic construct
  misc_feature 1..333: note = derived and/or modified sequence opt11 from anti-HIV-1_LightChain
  source 1..333: mol_type = other RNA
caatccgtcctaacccaacccccctccgcctccggcacccccggccaacgcgtcaccatctcctgctccggctcctcctccaacatcggctccaacaccgtcaactggtaccaacaattccccggcaccgcccccaaactcctcatctacgaaaacaaccgccgtccctccggcgtccccgcccgcttctccggctccaaatccggcacctccgccaccctcgccatcaccggcctccaaaccggcgacgaagccgactactactgcgccacctgggactcctccctctccgccggcggcgtcttcggcaccggcaccaaagtcaccgtcctc

SEQ ID NO: 54960 - RNA, 318 nt, synthetic construct
  misc_feature 1..318: note = derived and/or modified sequence opt11 from anti-HIV-1_LightChain
  source 1..318: mol_type = other RNA
caatccgtcctcacccaacccccctccgtctccgccgcccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctatccaccggcggcgtcttcggcaccggcacc

SEQ ID NO: 54961 - RNA, 288 nt, synthetic construct
  misc_feature 1..288: note = derived and/or modified sequence opt11 from anti-HIV-1_LightChain
  source 1..288: mol_type = other RNA
gggctctcgccctcgctctgtagcgggagctcgagcaatatcgggaacaattacgtgagctggtaccagcaattgcccgggaccgcgcccaagctcttgatctatgaaaataccaagcgcccgagcgggatcccggacaggttctcgggctcgaaatcgggcacgagcgcgaccttgggcataaccgggctccagaccggggacgagggcgattactattgcgggacctgggacaggagcttgagcgcgggcggggtctttggcacgggcacgaaagtgaccgtgctc

SEQ ID NO: 54962 - RNA, 333 nt, synthetic construct
  misc_feature 1..333: note = derived and/or modified sequence opt11 from anti-HIV-1_LightChain
  source 1..333: mol_type = other RNA
caattcgtcctcacccaaccaccctccgtctccgccgcccccggccaacgcgtcaccgtctcctgctccggcaccacctccgacatcggcgaaaactacgtctcctggtaccaaaaattctccgaagccgcccccaaactcctcctctacgacaacgacaaacgcccctccggcatccccgaccgcttctccggctccaaatccggcacctccgccaccctaggcatcaccggcctccaaaccggcgacgaagccgactactactgcggcacctgggactcctccctctccgccggcggcgtcttcggcaccggcaccaaagtcaccgtcctc

SEQ ID NO: 54963 - RNA, 327 nt, synthetic construct
  misc_feature 1..327: note = derived and/or modified sequence opt11 from anti-HIV-1_LightChain
  source 1..327: mol_type = other RNA
caatccgtcctcacccaacccccctccgtctccgccgcccccggccaaaaagtcaccatctcctgctccggcggctcctccaacatcggcaactactacgtctcctggtacctccaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcatccctctcagccggcggcgtcttcggcaccggcaccaaagtcacc

SEQ ID NO: 54964 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctcagccgcccccggccaaaaagtcaccatctcctgctccggcaacatgtccaacatcggcgacaacgccgtatcctggtaccgccaagtccccgaagcccccccacaactcctcatcttcggcaacgacaaacgcccctccggcgtcaccgaccgcttctccggctccaaatccggcacctccgccaccctcggaatcaccggcctccaaaccggcgacgaagccgactactactgcggcacctgggaccgctccctctccgccggcggcgtcttcggcaccggcaccaaagtcaccgtcctc

SEQ ID NO: 54965 - RNA, 336 nt, synthetic construct
  misc_feature 1..336: note = derived and/or modified sequence opt11 from anti-HIV-1_LightChain
  source 1..336: mol_type = other RNA
caatccgtcctcacacaacccccctcagtctccggcgcccccggccaacgcgtcaccatctcctgcaccggctcctcctccaacatcggcgccggctacgacgtccactggtacctccaactccccggcaccgccccccgcctcctcatctacgacaacgacaaacgcccctccggaatccccgaccgcttctccggctccaaatccggcacctccgccaccctcggcatcaccggcctccaaaccggcgacgaagccgactactactgcggcacctggcactcctccctctccgccggcggagtcttcggcaccggcaccaaagtcaccgtcctc

SEQ ID NO: 54966 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctccacctccaacatcggcaacaacttcgtctcctggtaccaacaactccccggcaccgcccccaaactcctcttctacgacaactacaaacgcccctccggcatccccgaccgcttctccggctcaaaatccggcacctccgccaccctcgccatcaccggcctccaaaccggcgacgaagccgactactactgcgccacctgggactcctccctctccgccggcggcgtcttcggcaccggcaccaaagtcaccgtcctc

SEQ ID NO: 54967 - RNA, 336 nt, synthetic construct
  misc_feature 1..336: note = derived and/or modified sequence opt11 from anti-HIV-1_LightChain
  source 1..336: mol_type = other RNA
cagagcgtgctcacgcaaccgccctcggtctcgggcgcgcccgggcaaagggtcacgatctcgtgcacgggcgggagctcaaacataggcgcgggctatgacgtgcactggtaccagcacttgcccgggaccgcgccccagctcttgatctatgaaaataccaagcgcccgagcgggatcccggacaggttctcgggctcgaaatcgggcacgagcgcgaccttgggcataaccgggctccagaccggggacgaggccgattactattgcgggacctgggacaggagcttgagcgcgggcggggtctttggcacgggcacgaaagtgaccgtgctc

SEQ ID NO: 54968 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccctctccgccgcccccggccaacgcgtcaccgtctcctgctccggctcctcctccaacatcggcgacaactacgtctcctggtaccaacaactccccggagccgccccccgcctcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 54969 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggccgctcctccaacatcggcaactacttcgtctcctggtaccaacaattccccggcaccgcccccaaactcctcatctacgacaacaacaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 54970 - RNA, 333 nt, synthetic construct
  misc_feature 1..333: note = derived and/or modified sequence opt11 from anti-HIV-1_LightChain
  source 1..333: mol_type = other RNA
caatcagtcctcacccaaccaccctccgcctccggcacccccggccaacgcgtcaccatctcctgctccggctcctcctccaacatcggctccaacgccgtccactggttccgccaactacccggcaccgcccccaaactcctaatctacgaaaacaacaaacgcccctccggcatccccgaccgcttctccggctccaaatccggcacctccgccaccctcggcatcaccggcctccaaaccggcgacgaagccgactactactgcgccacctgggactcctccctctccgccggcggcgtcttcggcaccggcaccaaagtcaccgtcctc

SEQ ID NO: 54971 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccgtctccgccgcctccggccaaaaagtcaccatctcctgctccggctcctcctccaacatcggcaacaactacgtctcctggtaccaccaactccccggcaccgcccccaaactcctaatctacgacaccaacaaacgcccctccggcatccccgaccgcttctccggctccacctccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 54972 - RNA, 333 nt, synthetic construct
  misc_feature 1..333: note = derived and/or modified sequence opt11 from anti-HIV-1_LightChain
  source 1..333: mol_type = other RNA
caacccgtcctcacccaacccccctccgtctccgccgcccccggccaaaccgtcaccatctcctgctccggctccttctccaacatcgaaaccaactacgtctcctggtaccaacaactccccggcaccgcccccaaactcctcatctacgacaacaacatgcgcccctccggcatccccgaccgcttctccggctccaaatccggcacctcagccaccctcggcatcaccggcctccaaaccggcgacgaagccgactactactgcggcacctgggacacatccctctccgccggcggcgtcttcggcaccggcaccaaagtcaccgtcctc

SEQ ID NO: 54973 - RNA, 336 nt, synthetic construct
  misc_feature 1..336: note = derived and/or modified sequence opt11 from anti-HIV-1_LightChain
  source 1..336: mol_type = other RNA
caacccgtcctcacccaacccccctccgtctccggcgcccccggccaacgcgtcaccatctcctgcaccggctcctcctccaacatcggcgccggctacgacgtccactggtaccaacaactccccggcaccgcccccaaactcctcatctacgaaaacaacaaacgcccctccggcatccccgaccgcttctccggctcaaaatccggcacctccgccaccctcggcatcaccggcctccaaaccggcgacgaagccgactactactgcggcacctgggacaactccctctccaccggcggagtcttcggcaccggcaccaaagtcacagtcctc

SEQ ID NO: 54974 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccctctccgccgcccccggccaacgcatcaccatctcctgctccggctcctcctccaacatcggcaacaactacgtctcctggtaccaacaattccccggcaccgcccccaaactcctcatctacgaaaacaacaaacgcccctccggcatccccgaccgcttctcagcctccaaatccggcacctccgccaccctcggcatcaccggcctccaaaccggcgacgaagccaactactactgcggcacctggcactcctccctctccgccggcggcgtcttcggcaccggcaccaaagtcaccgtcctc

SEQ ID NO: 54975 - RNA, 333 nt, synthetic construct
  misc_feature 1..333: note = derived and/or modified sequence opt11 from anti-HIV-1_LightChain
  source 1..333: mol_type = other RNA
caatcggtcttaacccagcccccgagcgtgagcgcggccccgggccagcgcgtgaccataagctgtttcgggagcaggttcaatgtcgggacctcgagcgtgagctggtaccagcaattgcccgggaccgcgcccaagctcttgatcgatgccaatggcgagcgcccgagcgggatcccggacaggttctcgggctcgaaatcgggcacgagcgcgaccttgggcataaccgggctccagaccggggacgaggccgattactattgcgggacctgggactcgagcttgagcgcgggcggggtctttggcacgggcacgaaagtgaccgtgctc

SEQ ID NO: 54976 - RNA, 333 nt, synthetic construct
  misc_feature 1..333: note = derived and/or modified sequence opt11 from anti-HIV-1_LightChain
  source 1..333: mol_type = other RNA
caatccgtcctcacacaacccccctccgtctccgccacccccggccaaaaagtcaccatctcctgctccggctcccgctccaacatcggctcccactacgtctcctggtaccaacaattccccggcaccgcccccaaactcctcatctacgacaacaacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtactc

SEQ ID NO: 54977 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgcctccggcacccccggccaacgcgtcaccatctcctgctccggctcctcctccaacatcggctcaaaccacgtctactggtaccaacaactacccggcaaaacccccaaactactaatctaccgcaacaaccaacgcccctccggcatccccgaccgcttctccggctccaaatccggcacctccgccaccctcggcatcaccggcctccaaaccggcgacgaagccgactactactgcggcacctgggactcctccctctccaccggcggcgtcttcggcaccggcaccaaagtcaccgtcctc

SEQ ID NO: 54978 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctcaggctcctccgccaacatcggcaacaactacgtctcctggtaccaacaattccccggcaccggcccccgcctcatcatctacgaatccaacaaacgcccctccggcatctccgaccgcttctccggctcccaatccgacgccgccgccaccctcgacatcaccggcctccaaaccggcgacgaagccgactactactgcggcacctgggactcctccctctcagccggcggcgtcttcggaaccggcacccgcgtcaccgtcctc

SEQ ID NO: 54979 - RNA, 336 nt, synthetic construct
  misc_feature 1..336: note = derived and/or modified sequence opt11 from anti-HIV-1_LightChain
  source 1..336: mol_type = other RNA
caatccgtcctaacccaaccaccctccgtctccggcgcccccggccaaaccgtcaccatctcctgcaccggcgacacctccaacatcggcgccgactaccgcgtccactggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtactc

SEQ ID NO: 54980 - RNA, 333 nt, synthetic construct
  misc_feature 1..333: note = derived and/or modified sequence opt11 from anti-HIV-1_LightChain
  source 1..333: mol_type = other RNA
caatccgtcctaacccaacccccctcactctccgccgcccccggccaacgcgtcaccgtctcctgctccggctcctcctccaacatcggcaacaactacgtctcctggtaccaacaactccccggcgccgcccccaaactcctcatctacaacaacaacatccgcccctccggcatccccgaacgcttctccggctccaaatccggcacctccgccaccctcggcatcaccggcctccaaaccggcgacgaaggcgactactactgcggcacctgggaccgctccctctccgccggcggcgtcttcggcaccggcaccaaagtcaccgtcctc

SEQ ID NO: 54981 - RNA, 333 nt, synthetic construct
  misc_feature 1..333: note = derived and/or modified sequence opt11 from anti-HIV-1_LightChain
  source 1..333: mol_type = other RNA
caatcggtcttgacccagcccccgagcgcgagcgggaccccgggccagcgcgtgaccataagctgtagcgggagctcgagcaatatcgggggcaattacgtgagctggtaccagcaattgcccgggaccgcgcccaagctattaatctcggaaaataacaagcgcccgagcgggatcccggacaggttctcaggctcgaaatcgggcacgagcgcgaccttgggcataaccgggctccagacaggggacgaggccgattactattgcgggacctgggactcgagcttgagcgcgggcggggtctttggcacgggcacgaaagtgaccgtgctc

SEQ ID NO: 54982 - RNA, 333 nt, synthetic construct
  misc_feature 1..333: note = derived and/or modified sequence opt11 from anti-HIV-1_LightChain
  source 1..333: mol_type = other RNA
caatccctcctcacccaacccccctccgtctccgccgcccccggccaaaaagtcaccatctcctgctccggctcctcctccaacatcggcaacaacttcgtctcctggtaccaacaactccccggcaccgcccccaaactcctcatctacgaaaacaacatgcgcccctccggcatccccgaccgcttctccggctccaaatccggcacctccgccacactcggcatcaccggcctccaaaccggcgacgaagccgactactactgcggcacctgggactcctcactctccgccggcggagtcttcggcaccggcaccaaagtcaccgtcctc

SEQ ID NO: 54983 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcatgctccggcacctcctccaacatcgccaactactacgtctcctggtaccgccaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggaggcgtcttcggcaccggcaccaaagtaaccgtcctc

SEQ ID NO: 54984 - RNA, 333 nt, synthetic construct
  misc_feature 1..333: note = derived and/or modified sequence opt11 from anti-HIV-1_LightChain
  source 1..333: mol_type = other RNA
caacccgtcctcacccaacccccctccgtctccggcgcccccggccaacgcgtcaccatctcctgctccggctcctcctccaacatcggcaacaacgacgtctcctggtaccaacaagtacccggcaccgcccccaaactcctcatctacgaaaacaacaaacgcccctccggcatccccgaccgcttctccggctccaaatccggcacctccgccaccctaggcatcaccggcctccaaaccggcgacgaagccgactactactgcggcacctgggacacctccctctccgccggcggcgtcttcggcaccggcaccaaagtcaccgtcctc

SEQ ID NO: 54985 - RNA, 333 nt, synthetic construct
  misc_feature 1..333: note = derived and/or modified sequence opt11 from anti-HIV-1_LightChain
  source 1..333: mol_type = other RNA
caactcgtcctcacccaacccccctccgtctccgccgcccccggccaacgcgtcaccatctcctgcttcggctcccgcttcaacgtcggcacctcctccgtctcctggtaccaacaactccccggcaccgcccccaaactcctcatcgacgccaacggcgaacgcccctccggcatccccgaccgcttcttcggctccgaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 54986 - RNA, 333 nt, synthetic construct
  misc_feature 1..333: note = derived and/or modified sequence opt11 from anti-HIV-1_LightChain
  source 1..333: mol_type = other RNA
tcctacgaactcacccaacccccctccgtctccgcagcccccggccaaaaagtcaccatctcctgctccggctcctcctccaacatcggcaacaactacgtctcctggtaccaacaactacccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 54987 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccgcctccggcacccccggccaacgcgtcaccatctcctgctccggctccacctccaacatcggcacctactacgtctcctggtaccaacaactccccggcaccgcccccaaactcctcatctacgaaaacaccaaacgcccctccggcatccccgaccgcttctccggctccaaatccggcacctccgccaccctcggcatcaccggcctccaaaccggcgacgaaggcgactactactgcggcacctgggaccgctccctatccgccggcggcgtcttcggcaccggcaccaaagtcaccgtcctc

SEQ ID NO: 54988 - RNA, 336 nt, synthetic construct
  misc_feature 1..336: note = derived and/or modified sequence opt11 from anti-HIV-1_LightChain
  source 1..336: mol_type = other RNA
caatccgccctcacccaacccgcctccgtctccgcctcccccggccaatccatagccatctcctgcaccggcacctcctccgacgtcggctcctacaactacgtctcctggtaccaacaactccccggcaccgcccccaaactcctcatctacgaaaacaccaaacgcccctccggcatccccgaccgcttctccggctccaaatccggcacctccgccaccctcggcatcaccggcctacaaaccggcgacgaagccgactactactgcggcacctgggacagatccctctccgccggcggcgtcttcggcaccggcaccaaagtcaccgtcctc

SEQ ID NO: 54989 - RNA, 330 nt, synthetic construct
  misc_feature 1..330: note = derived and/or modified sequence opt11 from anti-HIV-1_LightChain
  source 1..330: mol_type = other RNA
caatccgtcctcacccaacccccctccgtctccgccgcccccggccaacgcgtcaccatctcctgctccggcggctcctccaacatcggcaacaaccacgtctcctggtaccaacacctccccggccgcgccccccaactcctcatctacgacaccacccaacgcccctccggcatccccgaccgcttctccggctccaaatccggcacctccgccaccctcggcatcaccggcctccaaaccggcgacgaagccgactactactgcggcacctgggactcctccctctccaccggcggcgtcttcggcaccggcaccaaagtcaccgtc

SEQ ID NO: 54990 - RNA, 333 nt, synthetic construct
  misc_feature 1..333: note = derived and/or modified sequence opt11 from anti-HIV-1_LightChain
  source 1..333: mol_type = other RNA
caatcggtcttgacccagcccccgagcgcgagcgggaccccgggccagcgcgtgaccataagctgtagcgggagctcgagcaatatcgggagcaagtacgtgtgctggtaccagcaattgcccgggaccgcgcccaagctcttgatctatcgcaataaccagcgcccgagcgggatcccggacagattctcgggctcgaaatcgggcacgagcgcgaccttgggcataaccgggctccagaccggggacgaggccgattactattgcgggacctggcacagctcattgagcgcgggcggggtctttggcacgggcacgaaagtgaccgtgctc

SEQ ID NO: 54991 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggcgactcctccaccttcgaaaacgactacgtctgctggtaccaacaactccccggcaccgcccccaaactcctcatctacgacaacaacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 54992 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctcagccgcccccggccaaaaagtcaccatctcctgctccggctcctcctccaacatcggcaacaactacgtctcctggtaccaacaactccccggcaccgcccccaaactactcatctacggcaactcaaaccgcccctccggcgtccccgaccgcttctccggctccaaatccggcacctccgcctccctcgccatcaccggcctccaagccgaagacgaagccgactactactgcggcacctgggactcctccctctccgccggcggcgtcttcggcaccggcaccaaagtcaccgtcctc

SEQ ID NO: 54993 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaccgtcaccatctcctgctccggctcctcctccaacatcggctccaacaccgtcaactggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 54994 - RNA, 336 nt, synthetic construct
  misc_feature 1..336: note = derived and/or modified sequence opt11 from anti-HIV-1_LightChain
  source 1..336: mol_type = other RNA
caatccgtcctcacacaacccccctccgtctccggcgcccccggccaacgcgtcaccatcttctgcaccggctcctcctccaacgtcggcggcggctacgacgtccactggtaccaacaactccccggcaccgcccccaaactcctcatctacgaaaacaacaaacgcccctccggcatccccgaccgcttctccggctccaaatccggcacctccgccacactcggcatcaccggcctccaaaccggcgacgaagccgactactactgcggcacctgggactcctccctctccgccggcggcgtcttcggcaccggcaccaaagtcaccgtcctc

SEQ ID NO: 54995 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccctctcctgctccggctcctcctccaacatcggaaacaactccgtctcctggtaccaacaattccccggcaccgcccccaaactcctaatctacgactccgacaaacgcccctccggcatccccgaccgcttctccggctccaaatcaggcacctccgccaccctcggcatcaccggcctccaaaccggcgacgaaggcgactactactgcggcacctgggaccgctccctctccgccggcggcgtcttcggcaccggcaccaaagtcaccgtccta

SEQ ID NO: 54996 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgcctccggcacccccggccaaaaagtcaccatctcctgctccggctcctcatcccaaatcggctccaactccgtctactggtaccaacaactccccggcaccacccccaaactcctcatctacggcaacaaccaacgcccctccggcatccccgaccgcttctccggatccaaatccggcacctccgccaccctcggcatcaccggcctccaaaccggcgacgaagccgactactactgcggcacctgggactcatccctctccgccggcggcgtcttcggcaccggcaccaaagtcaccgtcctc

SEQ ID NO: 54997 - RNA, 336 nt, synthetic construct
  misc_feature 1..336: note = derived and/or modified sequence opt11 from anti-HIV-1_LightChain
  source 1..336: mol_type = other RNA
cagagcgcgctcacgcaaccggcctcggtctcgggctcgcccgggcaatcgatcacgatctcgtgcacgggcacgggctcggacgtaggcgggtacaatcacgtgagctggtaccagcaacatcccgggaaagcgcccaagctcttgatctatgacaataacaagcgcccgagcgggatcccggacaggttctcgggctcgaaatcaggcacgagcgcgaccttgggcataaccgggctccagaccggggacgaggccgattactattgcgggacctggcactcgagcttgagcgcgggcggggtctttggcacgggcacgaaagtgaccgtgctc

SEQ ID NO: 54998 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcacccggccaacgcgtcaccatctcctgctccggctccggctccaacatcggcgaccgcttcgtctcctggtaccaacacctccccggcaccgtccccaaactcctcatctacgacaacgaacaccgaccctccggcatccccgaccgcttctccggctcaaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 54999 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaaatcaccatctcctgctccggctcctcctccaacatcggcaaatccgtcgtctcctggtaccgccaattccccggcaccgcccccaaactcctcatctacgacacctacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 55000 - RNA, 333 nt, synthetic construct
  misc_feature 1..333: note = derived and/or modified sequence opt11 from anti-HIV-1_LightChain
  source 1..333: mol_type = other RNA
caacccgtcctcacccaacccccatccgcctccggcacccccggccaacgcgtcaccatctcatgctccggctcctcctccaacatcggcggcaacaccgtcaactggtaccaacaattccccggcgccgccccccgcctcctcatctacgaagacaacaaacgaccctccggcatccccgaccgcttctccggctccaaatcaggcacctccgccaccctcggcatcaccggcctccaaaccggcgacgaagccgactactactgcggcacctgggactcctccctctccgccggcggcgtcttcggcaccggcaccaaagtaaccgtcctc

SEQ ID NO: 55001 - RNA, 333 nt, synthetic construct
  misc_feature 1..333: note = derived and/or modified sequence opt11 from anti-HIV-1_LightChain
  source 1..333: mol_type = other RNA
aacttcatgctcacccaaccccactccgtctccgaatcccccggcaaaaccgtcaccatctcctgcacccgctcctccggctcagtcgcctccaactacgtccaatggtaccaacaactacccggcaccgcccccaaactcctcatctacgaaaacaacaaacgcccctccggcatccccgaccgcttctccggctccaaatccggcacctccgccaccctcggcatcaccggcctccaaacaggcgacgaagccgactactactgcggcacctggcactcctccctctccgccggcggagtcttcggcaccggcaccaaagtcaccgtcctc

SEQ ID NO: 55002 - RNA, 333 nt, synthetic construct
  misc_feature 1..333: note = derived and/or modified sequence opt11 from anti-HIV-1_LightChain
  source 1..333: mol_type = other RNA
caatccatgctcacacaacccccctccgtctccgcagcccccggccaacgcgtcaccgtctcctgctccggctcctcctccaacatcggctcccacttcgtctcctggtaccaacaactccccggcaccgcccccaaactcctcatctacgacaactccaaccgcccctccgccatccccgaccgcttctccggctccaaatccggcacctccgccaccctcggcatctccggcctccacaccggcgacgaagccgactactactgcgccacctgggacaactccctctccaccggcggcgtcttcggcaccggcaccaaagtcaccgtcctc

SEQ ID NO: 55003 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccatccgtctccgccgcccccggccaaaaagtcatcatctcctgctccggcggctcctccaacatcggcaacaacttcgtctcctggtaccaccaactccccggcaccgcccccaaactcctcatctacgaaaacaccaaacgcccctccaaaatccccgcccgattctccggctccaaatccggcacctccgccaccctcggcatcaccggcctccaaaccggcgacgaagccgactactactgcggcacctgggactcctccctctcagccggaggcgtcttcggcaccggcaccaaagtcaccgtcctc

SEQ ID NO: 55004 - RNA, 315 nt, synthetic construct
  misc_feature 1..315: note = derived and/or modified sequence opt11 from anti-HIV-1_LightChain
  source 1..315: mol_type = other RNA
caatccctcctcacccaacccccctccgtctccgccgcccccggccaaaaagtcaccatctcctgctccggctcctcctccaacatcggcaacaactacgtctcctggtaccaacaactccccggaaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggc

SEQ ID NO: 55005 - RNA, 336 nt, synthetic construct
  misc_feature 1..336: note = derived and/or modified sequence opt11 from anti-HIV-1_LightChain
  source 1..336: mol_type = other RNA
caatccgccctcacccaacccgcctccgtctccggctcccccggccaatccatcaccatctcctgcaccggcacctcctccgacatcggatcctactccttcgtctcctggtaccaacaacaccccggcaaagcccccaaactcatcatctacgacgtcaacaaacgcccctccggcatccccgaccgcttctccggctccaaatccggcacctccgccaccctaggcatcaccggcctccaaaccggcgacgaagccgactactactgcggcacctgggaccgctccctctccgccggcggcgtcttcggcaccggcaccaaagtcaccgtcctc

SEQ ID NO: 55006 - RNA, 336 nt, synthetic construct
  misc_feature 1..336: note = derived and/or modified sequence opt11 from anti-HIV-1_LightChain
  source 1..336: mol_type = other RNA
cagagcgtactcacgcaaccgccctcggtctcgggcgcgcccgggcaaagggtcacgatctcgtgcacgggcaatagctcgaacataggcgcgggctttgacgtgcactggtacaggcacctccccgggaccgcgcccaagctgttgatctatgaaaataccaagcgcccgagcgggatcccggacagattctcgggctcgaaatcgggcacgagcgcgaccttgggcataaccgggctccagaccggggacgaggccgattactattgcgggacctgggacaggagcttgagcgcgggcggggtctttggcacgggcacgaaagtgaccgtgctc

SEQ ID NO: 55007 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggcggctcctccaacatcggcaactactacgtctcctggtacctccaactccccggcgccgcccccaaactcctcatctacgacaccgacaaacgcccctccggcatccccgaccgcttctccggctccaaatccggcacctccgcaaccctcggcatcaccggcctccaaaccggcgacgaagccgactactactgcggcacctgggaccgctccctctccgccggcggcgtcttcggcaccggcaccaaagtcaccgtcctc

SEQ ID NO: 55008 - RNA, 333 nt, synthetic construct
  misc_feature 1..333: note = derived and/or modified sequence opt11 from anti-HIV-1_LightChain
  source 1..333: mol_type = other RNA
caatccgtcctcacccgacccccctccgtctccgccgcccccggccaaaaagtaaccatctcctgctccggccgctcctccaacatcggcaacaactacgtctcctggtaccaacaactccccggcgccgcccccaaactcctcatctacgaaaacaacaaacgcccctccggcatccccgaccgcttctcaggctcaaaatccggcacctccgccaccctcggcatcaccggcctccaaaccggcgacgaagccgactactactgcggcacctgggactcctccctctccgccggcggcgtcttcggcaccggcaccaaagtcaccgtactc

SEQ ID NO: 55009 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgcagcccccggccaaaaagtcaccatctcctgctccggcaccatctccaacatcggcgccaacctcgtctcctggtaccgccaactccccggcaccgtccccaccgtcctcatccacgaaaacaacaaacgcccctccggaatccccgaccgcttctccggctcaaaatccggcacctccgccaccctcggcatcaccggcctccaaaccggcgacgaagccgactactactgcggcacctggcactcctccctctccgccggcggcgtcttcggcaccggcaccaaagtcaccgtactc

SEQ ID NO: 55010 - RNA, 327 nt, synthetic construct
  misc_feature 1..327: note = derived and/or modified sequence opt11 from anti-HIV-1_LightChain
  source 1..327: mol_type = other RNA
caatccgtcctcacccaacccccctccgtctccgccgcccccggccaaaaagtcaccatctcctgctccggctcctcctccaacatcggcaacaacttcgtctcctggtaccaacaactccccggaaccgcccccaaactcctcatctacgaaaacaccaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcacc

SEQ ID NO: 55011 - RNA, 333 nt, synthetic construct
  misc_feature 1..333: note = derived and/or modified sequence opt11 from anti-HIV-1_LightChain
  source 1..333: mol_type = other RNA
caatccgtcctcacccaatccccctccgtatccgccgcccccggccaacgcgtcaccatctcctgctccggcggctcctccaacatcggctccaacgccgtctcctggtaccaacaactccccggcaccgcccccaaactcctcatctacggcgacaccatgcgcccatccggcatccccgaccgcttctccggctcaaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55012 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctcagccgcccccggccaacaagtcaccatctcctgctccggcaccacctccaacatcggcaccaactacgtctcctggtaccaacaaatgccccccgccgcccccaaactcctcatctacgacaacaaaaaacgcccctccgacatccccgaccgcttctccggctccaaatcaggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55013 - RNA, 333 nt, synthetic construct
  misc_feature 1..333: note = derived and/or modified sequence opt11 from anti-HIV-1_LightChain
  source 1..333: mol_type = other RNA
caatccgtcgtcacccaatccccctccgcctccggcacccccggccaacgcgtcatcatctcctgctccggctcctcctccaacatcggcaacatctacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 55014 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccatgtccgccgcccccggccaaaaagtcaccatctcctgctccggctccacctcaatcatcggcaacaactacatctcctggtaccaacaactccccggcaccgcccccaaactcctcatctacgaagacaacaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55015 - RNA, 336 nt, synthetic construct
  misc_feature 1..336: note = derived and/or modified sequence opt11 from anti-HIV-1_LightChain
  source 1..336: mol_type = other RNA
caatccgccctcacccaacccccctccgcctcaggctcccgcggccaatccgtcatcatctcctgcaccggcacctcctccgacgtcggcgtctacaacctagtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcctccctctccgcaggcggcgtcttcggcaccggcaccaaagtcaccgtcctc

SEQ ID NO: 55016 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccatgtccgccgcccccggccaatccgtctctatctcctgctccggctcctccgacaacatcgaacgcaaccaagtcatctggctccgccaagtccccggcgccgcccccaccgtcctcatcatcttcaacaaccgccgcccctccggcgtccccgaccgcttctccggctcccgctccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55017 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaccgtcaccatctcctgctccggctccttctccaacatcgaaaccaactacgtctcctggtaccaacaactccccggcaccgcccccaaactcctaatctacgaaaacaccaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55018 - RNA, 333 nt, synthetic construct
  misc_feature 1..333: note = derived and/or modified sequence opt11 from anti-HIV-1_LightChain
  source 1..333: mol_type = other RNA
caatccctcctcacccaaccaccctccgtctccgccgcccccggccaaaaagtcaccatctcctgctccggctcatcctccaacatcggctccaaatacgtctgctggtaccaacaactccccggcaccgcccccaaactcctcatctacgaaaacaccaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55019 - RNA, 336 nt, synthetic construct
  misc_feature 1..336: note = derived and/or modified sequence opt11 from anti-HIV-1_LightChain
  source 1..336: mol_type = other RNA
caatccgccctcacccaaccccgctccgtctccggctcccccggccaatccgtcaccatctcctgcaccggcaccacctccgacgtcggcggctacaactacgtctcatggtaccaacaactccccggcaccgcccccaaactactcatctacgaaaacaacaaacgcccctccggcatccccgaccgcttctccggatccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 55020 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaacgcgtcaccatctcctgcaccggcttcacctccaacatcggcctcaactacgtctcctggtaccaacaagtccccggcaccacccccaaactcgtcatcttcgaaaacgaccgccgcttcctcggcatccccgaccgcttctccggctccaaatccggcgcctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55021 - RNA, 333 nt, synthetic construct
  misc_feature 1..333: note = derived and/or modified sequence opt11 from anti-HIV-1_LightChain
  source 1..333: mol_type = other RNA
caatccgtcctcgcccaacccccctccgtctccgccgcccccggccaaaaagtcaccatctcctgctccggccgcacctccaacatcggcaacaactacgtctcctggtaccaacaactccccggcaccgcccccaaactcctcatctacgaaaacaacaaacgcccctccggcatccccgaccgcttctccggctccaaatcaggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 55022 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccacctccgtctccgccgcccccggccgctgggtcaccgtatcctgctccggcacccgctccaacatcggcgaccactccgtctcctggttccaacacctccccggcgccgcccccaaactcctcatctacgaaaacaacaaacgcccctccggcatccccgaccgcttctccggctccaaatccggcacctccgccaccctaggcatcaccggcctccaaaccggagacgaagccgactactactgcggcacctgggactcctccctctccaccggcggcgtcttcggcaccggcaccaaagtcaccgtcctc

SEQ ID NO: 55023 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctcctcctccaacatcggcgacaactacgtctcctggtaccaacaattccccggcaccgcccccaaactcctcatctccgaaaacaacaaacgcccctccggcatccccgaccgcttctccggctccaaatccggcacctccgccaccctaggcatcaccggcctccaaaccggcgacgaagccgactactactgcggcacctgggactcctccctctccgccggcggcgtcttcggcaccggcaccaaagtcaccgtcctc

SEQ ID NO: 55024 - RNA, 333 nt, synthetic construct
  misc_feature 1..333: note = derived and/or modified sequence opt11 from anti-HIV-1_LightChain
  source 1..333: mol_type = other RNA
caagccctcctaacccaacccccctccgtctccgccgcccccggccaaaaagtcaccatctcctgctccggctcctcctcaaacatcggcaacaactacgtctcctggtaccaacaactccccggcaccgcccccaaactcctcatctccgaaaacaacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 55025 - RNA, 333 nt, synthetic construct
  misc_feature 1..333: note = derived and/or modified sequence opt11 from anti-HIV-1_LightChain
  source 1..333: mol_type = other RNA
caactcgtcctcacccaacccccctccgcctccggcacccccggccaacgcgtcaccatctcctgctccggctccacctccaacatcggcacctactacgtctactggtaccaactcctccccggcaccacccccaaagtcctaatctacgccaacgaccaacgcccctccggcatccccgaccgcttctcaggctccaaatccggcacctccgccaccctcggcatcaccggcctccaaaccggcgacgaagccgactactactgcggcacctgggactcctccctctccaccggcggcgtcttcggaaccggcaccaaagtcaccgtcctc

SEQ ID NO: 55026 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggcacctcctccaacatcggcaacaacttcgtctcatggtaccaacgcctccccggcaccgcccccaaactcctcatcttcgaaaacgacaaacgcccctccggcatccccgaccgattctccggctccaaatcaggcacctccgccaccctaggcatcaccggcctccaaaccggcgacgaagccgactactactgcggcacctgggaccgctccctctccgccggcggcgtcttcggcaccggcaccaaagtcaccgtcctc

SEQ ID NO: 55027 - RNA, 333 nt, synthetic construct
  misc_feature 1..333: note = derived and/or modified sequence opt11 from anti-HIV-1_LightChain
  source 1..333: mol_type = other RNA
caatccgtcctcacccaatccccctccgtctccgccacccccggccaacgcgtcaccatctcctgctccggcaacacctccaacatcggcaaaaacttcgtctcctggtaccaacaattccccggcaccgcccccaaactcctcatctacgacaacgacaaacgcccctcaggcatccccgaccgcttctcaggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55028 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccgtctccgccgcccccggccgcgaagtcatcatctcctgctccggctcctcctccaacatcggcaacaaccacgtctcctggtaccaacaactccccggcaccgcccccaaagtcctcatctacgaatccaacaaacgccactccggcatccccgaccgcttctccggctccaaatccggcacctccgccaccctcgccatcaccggcctccaaaccggcgacgaagccgactactactgcggcgcctgggactcctccctctccgccggcggcgtcttcggcaccggcaccaaagtcaccgtcctc

SEQ ID NO: 55029 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgcctccggcacccccggccaacgcgtcaccatctcctgctccggctcctcctccaacatcggcgactccaccgtcaactggtaccaacaactacccggcaccgcccccaaactcctcatctacgaaaacaccaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55030 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccgtctccgccgcccccggccaaaaagtcaccatctcctgctccggctccacctccaacatcggcaacaactacgtctcctggtaccaacaactccccggcaccgcccccaaactcctcatctacgaaaacaaccgccaaccctccggcatccccgaccgcttctccggctccaaatccggcacctccgccaccctcggcatcaccggcctccaaaccggcgacgaaggcgactactactgcggcacctgggaccgctccctctccgccggcggcgtcttcggcaccggcaccaaagtcaccgtcctc

SEQ ID NO: 55031 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctcctcctccaacatcggctccaactacgtctcctggtaccaacaactccccggcaccgcccccaaactcctcatctacgaaaacaacaaacgcccctccggcatccccgaccgcttctccggctcaaaatccggcacctccgccaccctcggcatcaccggcctccaaaccggcgacgaagccgtctactactgcggcacctgggactcctccctcaccgccggcggcgtcttcggctccggcaccaaagtcaccgtcctc

SEQ ID NO: 55032 - RNA, 336 nt, synthetic construct
  misc_feature 1..336: note = derived and/or modified sequence opt11 from anti-HIV-1_LightChain
  source 1..336: mol_type = other RNA
caatccgtcctcacccaacccccctccgtctccggcgcccccggacaacgcgtcaccatctcctgcatcggctcctcctccaacatcggcgccgactaccgcgtccactggtaccaacaactccccggcaccgcccccaaactcctcatctacgaaaacaacaaacgcccctccggcatccccgaccgcttctcaggctccaaatccggcacctccgccaccctaggcatcaccggcctccaaaccggcgacgaagccgactactactgcggcacctgggactcctccctctccaccggcggcgtcttcggcaccggcaccaaagtcaccgtcctc

SEQ ID NO: 55033 - RNA, 336 nt, synthetic construct
  misc_feature 1..336: note = derived and/or modified sequence opt11 from anti-HIV-1_LightChain
  source 1..336: mol_type = other RNA
caatccgtcctcacccaacccccctccgtctccggcgcccccggccaacgcatcaccgtctcctgcaccggcacctcctccaacatcggcgccccctacgacgtcaactggtaccaacaactccccggcaccgcccccaaactcctcatctacgaaaacaccaaacgcccctccggcatccccgaccgcttctccggctccaaatccggcacctccgccaccctcggcatcaccggactccaaaccggcgacgaagccgactactactgcggcacctgggaccgctccctctccgccggaggcgtcttcggcaccggcaccaaagtcaccgtcctc

SEQ ID NO: 55034 - RNA, 333 nt, synthetic construct
  misc_feature 1..333: note = derived and/or modified sequence opt11 from anti-HIV-1_LightChain
  source 1..333: mol_type = other RNA
caatcagtcctgacccagcccccggccatgagcgcagccccaggccaaagcgtaaccataagctgcagcggaagcgcattcaacatcgaacgccaccaagtgacctggctcagacacctacccgggaccgcacccacaagcgtaatcataatgaacaaccaacgcccaagcggagtcccggacagattctcaggctcacgctcaggcacaagcgcaaccctgggcataaccggactccaaaccggagacgaaggcgactactactgcggaacctgggacagaagcctaagcgcaggcggagtcttcggcacaggcacaaaagtaaccgtactc

SEQ ID NO: 55035 - RNA, 333 nt, synthetic construct
  misc_feature 1..333: note = derived and/or modified sequence opt11 from anti-HIV-1_LightChain
  source 1..333: mol_type = other RNA
caatcagtcctcgcccaacccccctccgcctccggcacccccggccaacgcgtcaccatctcctgctccggctccgcctccaacatcggcttcaactccgtcacctggtaccaacaactccccggcaccgcccccaccgtcctcatctacggcaacgacctccgcccctccggcatccccgaccgcttctccggctccaaatccggcacctccgccaccctcggcatcaccggcctccaaaccggagacgaaggcgactactactgcggcacctgggaccgctccctctccgccggcggcgtcttcggcaccggcaccaaagtcaccgtcctc

SEQ ID NO: 55036 - RNA, 336 nt, synthetic construct
  misc_feature 1..336: note = derived and/or modified sequence opt11 from anti-HIV-1_LightChain
  source 1..336: mol_type = other RNA
cagagcgcgctcacgcaaccggcctcggtctcgggctcgcccggggaatcgatcacgatctcgtgcacgggcacgcgctcggacataggcaattacgcgtacgtgagctggtaccagcaattacccgggaccgcgcccaagctcttgatctcggaaaataacaagcgcccgagcgggatcccggacaggttctcaggatcgaaatcgggcacgagcgcgaccttgggcataaccgggctccagaccggggacgaggccgattactattgcgggacctgggactcgagcttgagcgcgggcggggtctttggcacgggcacgaaagtgaccgtgctc

SEQ ID NO: 55037 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccccccccggccaaaaagtcaccatctcctgctccggcaccacctccaacatcggctccaactacgtcgcctggtaccaacaactccccggcaccgcccccaaactcctcatctacgacaacgacaaacgcccctccggcatccccgaccgcttctccggctccaaatccggcacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55038 - RNA, 333 nt, synthetic construct
  misc_feature 1..333: note = derived and/or modified sequence opt11 from anti-HIV-1_LightChain
  source 1..333: mol_type = other RNA
caatccgtcctcacccaatccccctccgtctccggcacccccggccaacgcgtcaccatcttctgctccggctccgactccgacatcggcatcaactccgtctcctggtaccaacaactccccggcaccgcccccaaactcctcatctacgacaacaacaaacgcccctccggcatccccgaccgcttctcaggctccaaatccggcacctccgccaccctcggcatcaccggcctccaaaccggcgacgaagccgactactactgcggcacctgggaccgctccctctccgccggcggcgtcttcggcaccggcacaaaagtcaccgtcctc

SEQ ID NO: 55039 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggcaactcctccaacatcggcaacaactacgtctcctggtaccaacacctccccggcaccgcccccaaactcctcatctacgaaaacaccaaacgcccctccggcatccccgaccgcttctccggctccaaatccggaacctccgccaccctcggcatcaccggcctacaaaccggcgacgaagccgactactactgcggcacctgggaccgctccctctccgccggcggcgtcttcggcaccggcaccaaagtcaccgtcctc

SEQ ID NO: 55040 - RNA, 333 nt, synthetic construct
  misc_feature 1..333: note = derived and/or modified sequence opt11 from anti-HIV-1_LightChain
  source 1..333: mol_type = other RNA
caatccctcctcacccaacccccctccgtctccgccgcacccggccaaaaagtcaccatctcctgctccggcggcaactccgacatcggcaaaaacttcgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 55041 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcatcatctcctgctccggctcctcatccaacatcggcaaaaactacgtcgcctggtaccaacaactccccggcaccgcccccaaactcctcgtctacgaaaacaccaaccgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55042 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctccatgtccgacatcggcctcaaccccgtctcctggtaccgccaactccccgaagcccccccccacctcctcatcttcgacaacgacgaacgcccctccggcaccgccggccgcttctccgcctccaaatccggcacctccgccaccctcgacatcaccggcctccaaaccggcgacgaagccgactactactgcggcacctgggactcctccctctccgccggcggcgtcttcggcaccggcaccaaagtcaccgtcctc

SEQ ID NO: 55043 - RNA, 336 nt, synthetic construct
  misc_feature 1..336: note = derived and/or modified sequence opt11 from anti-HIV-1_LightChain
  source 1..336: mol_type = other RNA
cagagcgcgctcacgcaaccggcctcggtctcgggctcgcccgggcaatcgatcacgatctcgtgcacgggcacgagctcggacgtgggctcgtacaatctcgtgagctggtaccagcaatatcccgggcgagcgcccaagctcctgatctatgaaaataacaagcgcccgagcgggatcccggacaggttctcgggctcgaaatcgggcacgagcgcgaccttgggcataaccgggctccagaccggggacgaggccgattactattgcgggacctgggacaatagcctgagcacgggcggggtctttggcacgggcacgaaagtgaccgtgctc

SEQ ID NO: 55044 - RNA, 333 nt, synthetic construct
  misc_feature 1..333: note = derived and/or modified sequence opt11 from anti-HIV-1_LightChain
  source 1..333: mol_type = other RNA
caatccctcctcacccaacccccctccgtctccgcctcccccggccaaaaagtcaccatctcctgctccggaacctcctccaacatcggcaacaactacgtctcctggtaccaacaattccccggcaccgcccccaaactcctaatctacgaaaacaacaaacgctcctccggcatccccgaccgcttctccggctccaaatccgacacctccgccaccctcggcatcaccggactccaaaccggcgacgaagccgactactactgcggcacctgggaccgctccctctccgccggcggcgtcttcggcaccggcaccaaagtcaccgtcctc

SEQ ID NO: 55045 - RNA, 336 nt, synthetic construct
  misc_feature 1..336: note = derived and/or modified sequence opt11 from anti-HIV-1_LightChain
  source 1..336: mol_type = other RNA
cagagcgtgctcacgcaaccgccctcggtctcgggcgcgcccgggcaaagggtcacgatctcgtgcacgggcaggcgctcgaacataggcgcgggctatgacgtgcactggtaccagcaattgcccgggaccgcgcccaagctcttgatctatgaaaataacaagcgcccgagcgggatcccggacaggttctcgggctcgaaatcgggcacgagcgcgaccttgggcataaccgggctccagaccggggacgaggccgattactattgcgggacctgggacacgagcttgagcgcgggcggggtctttggcacgggcacgaaagtgaccgtgctc

SEQ ID NO: 55046 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaacgcgtcaccatctcctgctccggctcctcctccaacatcggcaacaacttcgtctcctggtaccaattcttccccggcaccgcccccaaactcgtcatctacgaaaacgacaaacgcccctccggcacccccgaccgcttctcaggctccaaatccggcacctccgccaccctcgccatcatcggcctccaaaccggcgacgaaggcgactactactgcggcacctgggacaactccctctccaccggcggcgtcttcggcaccggcaccaaagtcaccgtcctc

SEQ ID NO: 55047 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaacgcgtcaccatctcctgctccggcggctcctccaacatcggcaacaaccacgtctcctggtaccaacaactccccggcaccgcccccaaactcctcatctccgaaaacaacaaacgcccctccggcatccccgaccgcttctccggctcaaaatccggcacctccgccaccctcggcatcaccggcctccaaaccggcgacgaagccgactactactgcggcacctgggactcctccctatccgccggcggagtcttcggcaccggcaccaaagtcaccgtcctc

SEQ ID NO: 55048 - RNA, 333 nt, synthetic construct
  misc_feature 1..333: note = derived and/or modified sequence opt11 from anti-HIV-1_LightChain
  source 1..333: mol_type = other RNA
caatccgtcctaacccaacccccctccgtctccgccgcccccggccaaaaagtcaccatctcctgctccggctcctcctcaaacatcggccgcgacttcgtctcctggtaccaacaagtccccggcaccgcccccaaactcctcatctacgacaacgacaaacgcccctccggcatccccgaccgcttctccggctccaaatccggcacctccgccacactcggcatcaccggactccaaaccggcgacgaagccgactactactgcggcacctgggactcctccctctccgccggcggcgtcttcggcaccggcaccaaagtcaccgtcctc

SEQ ID NO: 55049 - RNA, 336 nt, synthetic construct
  misc_feature 1..336: note = derived and/or modified sequence opt11 from anti-HIV-1_LightChain
  source 1..336: mol_type = other RNA
cagaccgtggtaacgcaaccgccctcggtctcgggcgcgcccgggcaaacggccacgatctcgtgcacgggctcgagctcgaacataggcgcggactatgacgtgcactggtaccagcaactgcccgggaccgcgcccaagctcttgatctatgacaataacaagcgcccaagcgggatcccggacaggttctcgggctcgaaatcgggcacgagcgcaaccttgggcataaccgggctccagaccggggacgaggccgattactattgcgggacctgggacaggagcttgagcgcgggcggggtctttggcacgggcacgaaagtgaccgtgctc

SEQ ID NO: 55050 - RNA, 333 nt, synthetic construct
  misc_feature 1..333: note = derived and/or modified sequence opt11 from anti-HIV-1_LightChain
  source 1..333: mol_type = other RNA
aacttcatgctcacccaacccccctccgcctccggcacccccggccaacgcgtcaccatctcctgctccggctcctcctcaaacatcggctccaactacgtctactggtaccaacaactccccggcaccacccccaaactcctcatctaccgcaacaaccaacgcccctccggaatccccgaccgattctccggctccaaatccggcacctccgccaccctcggcatcaccggcctccaaaccggcgacgaagccgactactactgcggcacctgggactcctccctctccgccggcggcgtattcggcaccggcaccaaagtcaccgtcctc

SEQ ID NO: 55051 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctcctcccccaacatcggcaacaacttcctctcctggtaccaacaactccccggcaccgcccccaaactcctcatctacgaaaacaccaaacgcccctccggcatccccgaccgcttctccggctccaaatccggcacctccgccaccctcggcatcacaggcctccaaaccggcgacgaagccgactactactgcggcacctgggaccgctccctctccgccggcggcgtcttcggcaccggcaccaaagtcaccgtcctc

SEQ ID NO: 55052 - RNA, 333 nt, synthetic construct
  misc_feature 1..333: note = derived and/or modified sequence opt11 from anti-HIV-1_LightChain
  source 1..333: mol_type = other RNA
caatccgtcctcacccaatccccctccgtatccgccgcacccggccaaaaagtcaccatctcctgctccggctcctcctccgacatcggcaacaacttcgtatcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcatccctctccgccggcggcgtcttcggcaccggcaccaaagtcaccgtcctc

SEQ ID NO: 55053 - RNA, 333 nt, synthetic construct
  misc_feature 1..333: note = derived and/or modified sequence opt11 from anti-HIV-1_LightChain
  source 1..333: mol_type = other RNA
caattcttcctcacccaacccccctccctctccgccacccccggccaacgcgtctccatctcctgctccggcggcggctccaacatcgccaacaacgacgtcttctggttccaacaattccccggcgccggcccccgcctcctcatctacgacaacctcaaacgccactacggcacccccgaccgcttctccggctccaaatccggcacctccgccaccctcggcatcaccggcctccaaaccggcgacgaagccgactactactgcggcacctgggacaactccctctcaaccggcggcgtcttcggcaccggcaccaaagtcaccgtcctc

SEQ ID NO: 55054 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctccggacccaacatcggctccaactccgtctcctggtaccaacacttccccggcaccgcccccaaactcctaatctacgacaacaacaaacgcccctccggcatccccgaccgcttctccggctccaaatccggcacctccgccaccctcggcatcaccggcctccaaaccggcgacgaagccgactactactgcggaacctgggaccgctccctctccgccggcggcgtcttcggcaccggcaccaaagtcaccgtcctc

SEQ ID NO: 55055 - RNA, 333 nt, synthetic construct
  misc_feature 1..333: note = derived and/or modified sequence opt11 from anti-HIV-1_LightChain
  source 1..333: mol_type = other RNA
caatccgtcctcacacaatccccctccgcctccggcacccccggccaacgcgtcaccatctcctgctccggctcctcctccaacatcggctccaacaccgtctcctggttccaacacctacccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcctccctatccgccggcggcgtcttcggcaccggcaccaaagtcaccgtcctc

SEQ ID NO: 55056 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccggcgcccccggccaaaacgtcatcatctcctgctccggctcctcctccaacatcggcaaaaactacgtagcctggtaccaacaactccccggcaccgcccccaaaatcgtcatctacgaaaccaccaaccgcccctccggcatccccgcccgcttctccggctccaaatccggcacctccgccaccctcggcatcaccggcctccaagccggcgacgaagccgactactactgcggcacctgggactcatccctcaacgccggcggcgtcttcggcaccggcaccaaagtcaccgtcctc

SEQ ID NO: 55057 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccgtctccgccgcccccggccaaaaagtcaccatctcctgctccggctcctcctccaacatcggcaacaacttcctctcctggtaccaacacctccccggcaccgccccccgcctactcatctacgacaacgaccaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 55058 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgcctccggcacccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcacaggcctccaaaccggcgacgaagccgactactactgcggcacctgggactcctccctctccaccggcggcgtcttcggcaccggcaccaaagtcaccgtcctc

SEQ ID NO: 55059 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggcaccacctccaacatcggcaaccactacgtctcatggtaccaacaattccccggcaccgcccccaaactcatcatctacgaaaccgaccgccgcccctccggcatccccgcccgcttctccggctccaaatccggcacctccgccaccctcgccatcgccggcctccaaaccggcgacgaagccgactactactgcggcacctgggactcctccctctccaccggcggcgtcttcggcaccggcaccaaagtaaccgtactc

SEQ ID NO: 55060 - RNA, 333 nt, synthetic construct
  misc_feature 1..333: note = derived and/or modified sequence opt11 from anti-HIV-1_LightChain
  source 1..333: mol_type = other RNA
caactcgtcctcacccaacccccctccgtctccgcagcccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctcaaccggcggcgtcttcggcaccggcaccaaagtcaccgtccta

SEQ ID NO: 55061 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccatccgtctccgccgcccccggccaacgcgtcaccatctcatgctccggcggctcctccaacatcggcaacaaccacgtctcctggtaccaacacctccccggccgcgccccccaactcctcatctacgacaccacccaacgcccctcccgcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 55062 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaaatcaccatctcctgctccggctcccgctccaacatcggcaacaactacgtctcctggtaccaacaattccccggcaccgcccccaaactcctcatctacgacaacaaccaacgcccatcccgcatccccgaccgcttctccggctcaaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55063 - RNA, 321 nt, synthetic construct
  misc_feature 1..321: note = derived and/or modified sequence opt11 from anti-HIV-1_LightChain
  source 1..321: mol_type = other RNA
caatccgtcctcacccaacccccctccgtctccgccgcccccggccaacgcgtcaccatctcctgcttcggctcccgcttctcctccgtctcctggtaccaacaactccccggcaccgcccccaaactcctcatctaccccaacggcgaacgcccctccggcatccccgaccgcttcttcggctccgaatccggcacctccgccaccctcggcatcaccggcctccaaaccggcgacgaagccgactactactgcgccacctgggactcctccctctccgccggcggcgtcttcggcaccggcaccaaactcaccgtcctc

SEQ ID NO: 55064 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccctctccgccgcccccggccaaaaagtcaccatctcctgctccggctcctccctcaacatcggcaaccactacgtctcctggtaccaacaagtccccggcaccgcccccaaactcctcatctacgaagacaacaaacgcccctccggcatccccgaccgcttctccggctccaaatccggcacctccgccaccctcggaatcaccggcctccaaaccggcgacgaagccgactactactgcggcacctggcactcatccctctccgccggcggcgtcttcggcaccggcaccaaagtcaccgtactc

SEQ ID NO: 55065 - RNA, 333 nt, synthetic construct
  misc_feature 1..333: note = derived and/or modified sequence opt11 from anti-HIV-1_LightChain
  source 1..333: mol_type = other RNA
caattcgtcctcacccaacccccctccgtctccgccgcccccggccaaaaagtcaccgtctcctgctccggcaccacctccgacatcggcgaaaactacgtctcctggtaccaaaaattccccgaagccgcccccaaactcctcatctacgacaacgacaaacgcccctcaggcatccccgaccgcttctccggctccaaatccggcacctccgccaccctcggcatcaccggcctccaaaccggcgacgaagccgactactactgcggcacctgggaccgatccctctccgccggcggcgtcttcggcaccggcaccaaagtcaccgtcctc

SEQ ID NO: 55066 - RNA, 333 nt, synthetic construct
  misc_feature 1..333: note = derived and/or modified sequence opt11 from anti-HIV-1_LightChain
  source 1..333: mol_type = other RNA
ctctccgtcctcacccaacccccctccgtctccgccgcccccggccaacaagtcaccatctcctgctccggcaccacctccaacatcggcaccaactacgtctcctggtaccaacaaatgccccccaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55067 - RNA, 336 nt, synthetic construct
  misc_feature 1..336: note = derived and/or modified sequence opt11 from anti-HIV-1_LightChain
  source 1..336: mol_type = other RNA
caatcaatgctcacccaaccaccctccgtctccggcgcccccggccaacgcgtcaccatctcctgcaccggctcccgctccaacatcggcgccggctacgacgtccactggtacctccaactccccggcaccgcccccaaactactcatctacgaaaacaacaaacgcccctccggcatccccgaccgcttctccggctccaaatccggcacctccgccaccctcggcatcaccggcctccaaaccggagacgaagccgactactactgcggcacctgggacaactccctatccaccggcggcgtcttcggcaccggcaccaaagtcaccgtcctc

SEQ ID NO: 55068 - RNA, 333 nt, synthetic construct
  misc_feature 1..333: note = derived and/or modified sequence opt11 from anti-HIV-1_LightChain
  source 1..333: mol_type = other RNA
caatcagtcctcacccaaccaccctccgtctccgccacccccggccaaaaagtcaccatctcctgctccggctcccgctccaacatcggctcccactacgtctcctggtaccaacaattccccgaatccgcccccaccctcctcatctacgaaaacgtcgaacgcccctccggcatccccgaccgcttctccggctccaaatccggcacctccgccaccctcggcatcaccggcctccaaaccggcgacgaagccgactactactgcggcacctgggactcctcactctccgccggcggcgtcttcggcaccggcaccaaagtcaccgtcctc

SEQ ID NO: 55069 - RNA, 333 nt, synthetic construct
  misc_feature 1..333: note = derived and/or modified sequence opt11 from anti-HIV-1_LightChain
  source 1..333: mol_type = other RNA
caattcttcctcacccaacccccctccctctccgccacccccggccaacgcgtctccatctcctgctccggcggcggctccaacatcgccaacaacgacgtcttctggttccaacaattccccggcgccggcccccgcctcctcatctacgacaacctcaaacgccactacggcacccccgaccgcttctccggctccaaatccggcgccaccggaaccctcgaaatcaccgaagtccaaaccgccgacgaagccgactactactgcggcacctgggactcctccctctccgccggcggcgtcttcggcaccggcaccaaagtcaccgtcctc

SEQ ID NO: 55070 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctcagtctccgccgcccccggccaaaaagtcaccatctcctgctccggcggctcctccaacatcggcgacaactccgtctcctggtaccaacaactccccggcaccgcccccaaactcctcatctacgaaaacaacaaacgcccctccggcatccccgaccgattctccggctccaaatccggcacctccgccaccctcggcatcaccggcctccaaaccggcgacgaagccgactactactgcggcacctgggactcctccctctccaccggcggcgtcttcggcaccggcaccaaagtcaccgtcctc

SEQ ID NO: 55071 - RNA, 333 nt, synthetic construct
  misc_feature 1..333: note = derived and/or modified sequence opt11 from anti-HIV-1_LightChain
  source 1..333: mol_type = other RNA
caatcggtcttgacccagcccccgagcgtgagcgcggccccgggccagaccgtgaccataagctgtagcgggagcgcgagcaatatcgggcgcaatagcgtgagctggtaccagtacgtgcccggggccgcgcccaagcgcttgatctatgaaaataacaagcgcccgagcgggatcccggacaggttctcgggctcgaaatcaggcacgagcgcgaccttgggcataaccgggctccagaccggggacgaggccgattactattgcgggacctgggacacgagcttgagcgcgggcggggtatttggcacgggcacgaaagtgaccgtgctc

SEQ ID NO: 55072 - RNA, 333 nt, synthetic construct
  misc_feature 1..333: note = derived and/or modified sequence opt11 from anti-HIV-1_LightChain
  source 1..333: mol_type = other RNA
caatccgtcctcgcccaacccccctccgtctccgccgcccccggccaaaaagtcaccatctcctgctccggccgcacctccaacatcggcaactacttcgtctcctggtaccaacaattccccggcaccgccccccgcctcctcatctacgacaacgaccaacgcccctccggcatccccgaccgcttctccggctccaaatccggcacctccgccaccctcggcatcaccggcctccaaaccggcgacgaagccgactactactgcggcacctgggactcctccctctcagccggcggcgtcttcggcaccggcaccaaagtcaccgtcctc

SEQ ID NO: 55073 - RNA, 333 nt, synthetic construct
  misc_feature 1..333: note = derived and/or modified sequence opt11 from anti-HIV-1_LightChain
  source 1..333: mol_type = other RNA
caatccgccctcacccaacccgcctccgtctccgccgcccccggccaaaaagtcaccatctcctgctccggctcctcctccaacatcggcaacatctacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcacaaaagtcaccgtcctc

SEQ ID NO: 55074 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccacccccggccaacgcgtcaccgtctcctgctccggctcctcctccaacatcggcaaccactacgtatcctggtaccaacaagtccccggcaccgcccccaaactcctcatctacgacaactccaaccgaccctcaggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55075 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccctctccgccgcccccggccaacgcgtcacagtctcctgctccggctcctcctccaacatcggcgacaactacgtctcctggtaccaacaactccccggcgccgccccccgcctcctcatctacgacaactccatccgcccctccgccatccccgcccgcttctccggctccaaatccggcacctccgccaccctcgcaatcaccggcctccaaaccggcgacgaagccgactactactgcggcacctgggactcctccctctccgccggcggcgtcttcggcaccggcaccaaagtcaccgtcctc

SEQ ID NO: 55076 - RNA, 336 nt, synthetic construct
  misc_feature 1..336: note = derived and/or modified sequence opt11 from anti-HIV-1_LightChain
  source 1..336: mol_type = other RNA
caatccgccctcacccaacccgcctccgtatcaggctcccccggccaatccatcaccatctcatgcaccggcacctcctccgacgtcggcggctacgactacgtctcctggtacctccaactccccggcaccgcccccaaactcctcatctacgaaaacaacaaacgcccctccggcatccccgaccgcttctccggctccaaatccggcacctccgcaaccctcggcatcaccggcctccaaaccggcgacgaagccgactactactgcggcacctgggactcctccctctccgccggcggcgtcttcggcaccggcaccaaagtcaccgtcctc

SEQ ID NO: 55077 - RNA, 333 nt, synthetic construct
  misc_feature 1..333: note = derived and/or modified sequence opt11 from anti-HIV-1_LightChain
  source 1..333: mol_type = other RNA
caatcagtcctcacacaacccccctccgtctccgccgcccccggccaacgcgtcaccgtctcctgctccggctcctcctccaacatcggcaacaactacgtctcctggtaccaacaattccccggcaccgcccccaaactcgtcatctacgacaccgacaaacgcccctccggcatccccgaccgcttctccggctccaaatccggcacctccgccaccctcggcatcaccggcctccaaaccggcgacgaagccgactactactgcgccacctgggactcctccctatccgccggcggcgtcttcggcaccggcaccaaagtaaccgtcctc

SEQ ID NO: 55078 - RNA, 336 nt, synthetic construct
  misc_feature 1..336: note = derived and/or modified sequence opt11 from anti-HIV-1_LightChain
  source 1..336: mol_type = other RNA
cagagcgtgctcacgcaaccgccctcggtctcgggcgcgcccgggcaaagggtcacgatctcgtgcacgggcaatagctcgaacataggcgcgggctatgacgtgcactggtaccagcaattgcccgggaccgcgcccaagctcttgatctcggaaaataacaagcgcccgagcgggatcccggacaggttctcgggctcgaaatcgggcacgagcgcgaccttgggcataaccgggctccagaccggggacgaggccgattactattgcgggacctgggactcgagcttgagcgcgggcggggtctttggcacgggaacgaaagtgaccgtgctc

SEQ ID NO: 55079 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgcctccggcacccccggccaacgcgtcacaatctcctgctccggctcctcctcaaacatcggctccaactacgtcgactggtaccaacaactccccggcaccgcccccaaactcctcatctacgaaaacaacaaacgcccctccggcatccccgaccgcttctccggctccaaatccggcacctccgccaccctcggcatcaccggcctccaaacaggcgacgaagccgactactactgcggcacctggcactcctccctctccgccggcggcgtcttcggcaccggcaccaaagtcacagtcctc

SEQ ID NO: 55080 - RNA, 333 nt, synthetic construct
  misc_feature 1..333: note = derived and/or modified sequence opt11 from anti-HIV-1_LightChain
  source 1..333: mol_type = other RNA
caatcagtcctaacccaaccaccctccgtctccgccacccccggccaaaccgtcaccatctcctgctccggctcctcctcaaacatcggcaacaactacctctcctggtaccgccaactaccccgcaccgcccccaaactcctcatctacgaaaacaaccgccgcccctccggcgtccccgcccgcttctccggctccaaatccggaacctccgccaccctcgcaatcaccggcctccaaaccggcgacgaagccgactactactgcggcacctgggactcctcactatccgccggcggcgtcttcggcaccggcaccaaagtcaccgtcctc

SEQ ID NO: 55081 - RNA, 321 nt, synthetic construct
  misc_feature 1..321: note = derived and/or modified sequence opt11 from anti-HIV-1_LightChain
  source 1..321: mol_type = other RNA
caatccgtcctcacccaacccccctccgtctccgccgcccccggccaacgcgtcaccatctcctgcttcggctcccgcttctcctccgtctcctggtaccaacaactccccggcaccgcccccaaactcctcatctaccccaacggcgaacgcccctccggcatccccgaccgcttcttcggctccgaatccggcacctccgccaccctcggcatcaccgccgtccaaaccggcgacgaagccgactactactgcggcacctgggacgactccctctccaccggcggcgtcttcggcaccggcaccaaagtcaccgtcctc

SEQ ID NO: 55082 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccctctcctgctccggcacctcctccaacatcggcaacaactacgtctcctggtaccaacaagtccccggcgccgcccccaaagtcctcatctacgaaaacgacaaacgcccctccggcatccccgaccgcttctccggctccaaatccggcacctccgccaccctcggcatcaccggcctccaaaccggcgacgaagccgactactactgcggcacatgggaccgctccctctccgccggcggcgtcttcggcaccggcaccaaagtcaccgtcctc

SEQ ID NO: 55083 - RNA, 333 nt, synthetic construct
  misc_feature 1..333: note = derived and/or modified sequence opt11 from anti-HIV-1_LightChain
  source 1..333: mol_type = other RNA
caatcagtcctaacccaacccccaagcgtaagcgcagccccaggccaaaaagtaaccataagctgcagcggaagcaacagcaacatcggaaacaactacgtaagctggtaccaacaactacccggaaccgcgaccaaactcctaatctacgaaaacgacaaacgcccgagcggaatcccagacagattctcaggctcaaaatcaggcacaagcgcaaccctaggcataaccggactccaaaccggagacgaagccgactactactgcggaacctggcactcaagcctaagcgcaggcggagtcttcggcacaggcacaaaagtaaccgtactc

SEQ ID NO: 55084 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccctctccgccgcccccggccaacaagtctccatctcctgcctcggccgctcctccaacatcggcacaaactacgtctcctggtaccaacaattccccggcaccgcccccaaactcctcatctacgaaaacaaaaaacgcccctccgaaatccccgaccgcttctccggctccaaatccggcacctccgccaccctcggcatcaccggcctccaacccggcgacgaagccgactactactgcggcacctgggactcctccctctccgccggcggcgtcttcggcaccggcaccaaagtcaccgtcctc

SEQ ID NO: 55085 - RNA, 336 nt, synthetic construct
  misc_feature 1..336: note = derived and/or modified sequence opt11 from anti-HIV-1_LightChain
  source 1..336: mol_type = other RNA
caatccgccctcacccaacccccctccgcctccggctcccccggccaatccgtcaccatctcctgcaccggcacctcctccgacgtcggcgcctacaactccgtctcctggtaccaacaactccccggcaccgcccccaaactcctcatctccgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55086 - RNA, 333 nt, synthetic construct
  misc_feature 1..333: note = derived and/or modified sequence opt11 from anti-HIV-1_LightChain
  source 1..333: mol_type = other RNA
caatccgccctcacccaacccccctccgcctccggctcccccggccaatccgtcaccatctcctgctccggcggctcctcaaacatcggcaacaaccacgtctcctggtaccaacacctacccggccgcgccccccaactcctcatctacgacaccacccaacgcccctcccgcatccccgaccgcttctccggctcccgctccggcacctccgccaccctcgccatcaccggcctccaaaccggcgacgaagccgtctactactgcggcacctgggacaactccctctccaccggcggcgtcttcggcaccggcaccaaagtcaccgtcctc

SEQ ID NO: 55087 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaacgcgtcaccatctcctgctccggcggcacctccaacatcggcaacgaatacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 55088 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccgtctccgccgcccccggccaacgcgtcaccgtctcctgctccggctcctcctccaacatcggaaacaactacgtctcctggtaccaacaactccccggcgccgcccccaaactcctcatctacgacaccgacaaacgcccctccggcatccccgaccgcttctccggctccaaatccggcacctccgccaccctcggcatcaccggcctccaaaccggcgacgaagccgactactactgcggcacctgggaccgctcactctccgccggcggagtcttcggcaccggcaccaaagtcaccgtcctc

SEQ ID NO: 55089 - RNA, 333 nt, synthetic construct
  misc_feature 1..333: note = derived and/or modified sequence opt11 from anti-HIV-1_LightChain
  source 1..333: mol_type = other RNA
caatccctcctcacccaacccccctccgtctccgccgcccccggccaaaaagtcaccatctcctgctccggcggcaactccgacatcggcaaaaacttcgtctcctggtaccaacaatcccccggcgccgccccccgcctcctcatctacgaaaacgaccgccgcccctccggcatccccgaccgattctccggctccaaatccggcacctcagccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55090 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaacatctcctgctccggatcctcctccaacatcggcaaaaactacgtctcctggtaccaacaaatccccggcaccgcccccaaagtcctcatctacgaaaacaacaaacgaccctccggcatccccgaccgcttctccggctccaaatccggcacctccgccaccctcggcatcgccggactccaaaccggcgacgaagccgactactactgcgccacctgggactcctccctctccgccggcggcgtcttcggcaccggcaccaaagtcaccgtcctc

SEQ ID NO: 55091 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctcctcctccaacatcggcaaccgccacgtctcctggtaccaacaactccccggcaccgtccccaaactcctcatctacgaaaccaacaaacgcccctccggaatccccgaccgcttctcaggctccaaatccggcacctccgccaccctcggcatcaccggcctccaaaccggcgacgaagccgactactactgcggcacctgggacaactccctatccaccggcggcgtcttcggcaccggcaccaaagtcaccgtcctc

SEQ ID NO: 55092 - RNA, 336 nt, synthetic construct
  misc_feature 1..336: note = derived and/or modified sequence opt11 from anti-HIV-1_LightChain
  source 1..336: mol_type = other RNA
cagagcgtgctcacgcaaccgccctcggtctcgggagcgcccgggcaaagggtcacgatctcgtgcacgggctcgagctcgaacataggcgcgggctatgacgtgcactggtaccagcaattgcccgggaccgcgcccaagctcttgatctttggccatgacaagcgcccgagcgggatcccggacaggttctcgggctcgaaatcgggcacgagcgcgaccttgggcataaccgggctccagaccggagacgaggccgattactattgcgggacctgggactcgagcttgagcgcgggcggggtctttggcacgggcacgaaagtgaccgtgctc

SEQ ID NO: 55093 - RNA, 333 nt, synthetic construct
  misc_feature 1..333: note = derived and/or modified sequence opt11 from anti-HIV-1_LightChain
  source 1..333: mol_type = other RNA
caatccgtcctcacccaactcccctccgcctccggcctccccggccaaaccgtcaccatctcctgctccggctccacctcctccatcggctccaaccacgtctactggtaccaacaagtcgccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcgccacctgggactcctccctatccgccggcggcgtcttcggcaccggcaccaaagtcaccgtcctc

SEQ ID NO: 55094 - RNA, 333 nt, synthetic construct
  misc_feature 1..333: note = derived and/or modified sequence opt11 from anti-HIV-1_LightChain
  source 1..333: mol_type = other RNA
caatcggtcttgacccagaccccgagcgcgagcggggccccgggccagggcgtgaccataagctgtagcgggagctcgagcaatgtcgggcgcaattacgtgagctggtaccagcaattgcccgggaccgcgcccaagctcttgatctatgaaaataccaagcgcccgagcgggatcccggacaggttctcgggctcgaaatcgggcacgagcgcgacactgggcataaccgggctccagaccggggacgaggccgattactattgcgggacctgggacaggagcttgagcgcgggcggggtctttggcacgggcacgaaagtgaccgtgctc

SEQ ID NO: 55095 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctcaggctcctcctccaacatcggcaacaactacgtctcctggtaccaacaattccccggcaccgcccccaaactcctcatctccgacaacaacaaacgcccctcaggcatccccgaccgcttctccgtctccaaatccggcacctccgccaccctcggcatcaccggcctccaagccggcgacgaagccgactactactgcggcacctgggactcctccctctcagccggcggcgtcttcggcaccggcaccaaagtcaccgtcctc

SEQ ID NO: 55096 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctccgccgcccccggccaaaaagtcaccatctcctgctccggctccaactccaacatcggcaacaactacgtcacctggtaccaacaattccccggcaccgcccccaaagtcctcatctacgacaactcccgccgcccctccggcatccccgaccgcttctccggctccaaatccggcacctccgccaccctaggcatcaccggcctccaaacaggcgacgaagccgactactactgcggcacctgggactcctccctctcagccggcggcgtcttcggcaccggcaccaaagtcaccgtcctc

SEQ ID NO: 55097 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccatccgtctcaggcgcccccggccaacgcgtcaccatctcctgctcaggctcatcctccaacatcggcaacaactacgtctcctggtaccaacaactccccggcaccgcccccaaactcctcatctacgaaaacaccaaacgcccctccggcatccccgaccgcttctccggctccaaatccggcacctccgcaaccctcggcatcaccggcctccaaaccggcgacgaagccgactactactgcggcacctgggaccgctccctctccgccggcggcgtcttcggaaccggcaccaaagtcaccgtcctc

SEQ ID NO: 55098 - RNA, 333 nt, synthetic construct
  misc_feature 1..333: note = derived and/or modified sequence opt11 from anti-HIV-1_LightChain
  source 1..333: mol_type = other RNA
caatccgtcctcacccaacccccctccgtctcagccgcccccggccaaaccgtcaccatctcctgctccggctccacctccaacatcggccaaaacttcctatcctggttccaacacgtccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctggcactcatccctctccgccggcggcgtcttcggcaccggcaccaaagtcaccgtcctc

SEQ ID NO: 55099 - RNA, 333 nt, synthetic construct
  misc_feature 1..333: note = derived and/or modified sequence opt11 from anti-HIV-1_LightChain
  source 1..333: mol_type = other RNA
aacttcatgctcacccaacccccctccgcctccggcacccccggccaacgcgtcaccatatcctgctccggctcctcctccaacatcggctccaaatacgtctcctggtaccaacaacttcccggcaccgcccccaaactcctcatctacgaaaacaccaaacgcccctccggcatccccgaccgcttctccggctcaaaatccggcacctccgccaccctcggcatcaccggcctccaaaccggcgacgaagccgactactactgcggaacctgggaccgctccctctccgccggcggcgtcttcggcaccggcaccaaagtcaccgtcctc

SEQ ID NO: 55100 - RNA, 333 nt, synthetic construct
  misc_feature 1..333: note = derived and/or modified sequence opt11 from anti-HIV-1_LightChain
  source 1..333: mol_type = other RNA
caatcagtcctcacccaacccccctccgtctccgccgcccccggccaaaaagtcaccatctcctgctccggctcctcctccaacatcggcaacaactacgtctcctggtaccaactcctccccggaaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacaactccctctccaccggcggcgtcttcggcaccggcaccaaagtcaccgtcctc

SEQ ID NO: 55101 - RNA, 333 nt, synthetic construct
  misc_feature 1..333: note = derived and/or modified sequence opt11 from anti-HIV-1_LightChain
  source 1..333: mol_type = other RNA
caatccgtcctcacccaaccaccctccgtctccgccgcccccggccaaaaagtcaccatctcatgctccggctcctcctccaacatcggcaacaactacgtctcctggtaccaacaactccccggcaccgcccccaaaatcatcatctacgacaacaacaaacgcccctccggcatccccgaccgcttctccggctccaaatccggcacctccgccaccctcggcatcaccggcctccaaaccggcgacgaagccgactactactgcggcacctggcactcctccctctccgccggcggcgtcttcggcaccggcaccaaagtcaccgtcctc

SEQ ID NO: 55102 - RNA, 333 nt, synthetic construct
  misc_feature 1..333: note = derived and/or modified sequence opt11 from anti-HIV-1_LightChain
  source 1..333: mol_type = other RNA
caatccgtcctaacccaaccaccctccgcctccgccacccccggccaacgcgtcaccatctcctgctcaggctcctcctccaacatcggctccaaacacgtctactggtaccaaaaactccccggcaccgcccccaaactcctcatctacgaaaacaccaaacgcccctccggaatccccgaccgcttctccggctcaaaatccggaacctccgccaccctcggcatcaccggcctccaaaccggcgacgaagccgactactactgcggcacctgggaccgctccctctccgccggcggcgtcttcggcaccggcaccaaagtcaccgtcctc

SEQ ID NO: 55103 - RNA, 432 nt, synthetic construct
  misc_feature 1..432: note = derived and/or modified sequence opt11 from anti-HIV-1_HeavyChain
  source 1..432: mol_type = other RNA
caagcgcaattggtcgagagcgggggcggggtcgtgcaaccgggcaggagcctgcgattgagctgtgcagcgagcggattcacgttctcgagctatggcatacactgggtcaggcaagcgcccgggaaagggctagagtgggtggccgtgatgtcaagcgatggcacgtacaagtactatggcgatagcatgaaagggcgctttacaataagcagggacaatagcaagaactcgctatatctccagatgaatagcttgcgcgcggtcgataccgcggtctattactgtgccaaggacttgggcgagggagagaacgaggaatgggccacggactattacgatttctcgatcgggtacccgggccaggacccgcgaggggtagtgggcacgttcgatatctggggccagggcacgatggtgaccgtgagctcg

SEQ ID NO: 55104 - RNA, 426 nt, synthetic construct
  misc_feature 1..426: note = derived and/or modified sequence opt11 from anti-HIV-1_HeavyChain
  source 1..426: mol_type = other RNA
caagtgcaattggtcgagagcgggggcggggtcgtgcaaccgggcaggagcttgcgcttgagctgtgccgcgagcgggttcacgttctcgagctatggcatgcactgggtcaggcaagcgcccgggaaagggctcgagtgggtagccgtgatctcggacgatggctcgaacaagtactatgccgatagcgtgaaagggcgctttaccataagcagggacaatagcaagaacacgctctatctacagatgaatagcttgcgcgcggaagataccgcggtctattactgtgccaaggacttgggcgagagcgagaacgaggaatgggcctcggactattacgatttcgggagcgattacccgggacaggacccgcgcgcggtcgtgggcgcgttctggggccagggaacgatggtgaccgtgagctcg

SEQ ID NO: 55105 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaatcgggcaggagcttgcgcttgagctgtgccgcgagcgggttcacgttctcggcctatgccctgcactgggtcaggcaagcgccagggaaagggctcgagtgggtggccgtgatctcgtacgatggcagggacaaggactatgcagatagcgtgaaagggcgctttaccataagcagggacaatagcaagaacacgctatatctccagatgaatagcttgcgcgcggaagataccgcggtctattactgtgctaaggacttgggcgagagcgagaacgaggaatgggcatcggactattacgatttcgggagcgattacccgggccaggacccgcgcgcagtcgtgggcgcgttcgatatctggggccagggcacgatggtgaccgtgagctcg

SEQ ID NO: 55106 - RNA, 432 nt, synthetic construct
  misc_feature 1..432: note = derived and/or modified sequence opt11 from anti-HIV-1_HeavyChain
  source 1..432: mol_type = other RNA
caagtgcaattggtccagagcgggggcgggctcgtgcagccgggccgcagcttgagattgagctgtgtggcgagcgggttcaggttctcgttccatggaatgcactgggtcaggcaagcgcccgggaaagggctcgagtgggtggccgtggtctcggacgacggatcggaccagaaatatgtcgatagcgtgaaagggcgcttgaccataagcagagacaatagcaagaacacggtatatctacagatgaatagcttgcgcgcggaagataccgcggtatattactgtgccaaggacttgggcgagagcgagaacgaggaatgggcctcggactattacgatttcgggagtgattacccgggccaggacccgcgcgcggtcgtgggagcgttcgatatctggggccagggcacgatggtgaccgtgagctcg

SEQ ID NO: 55107 - RNA, 432 nt, synthetic construct
  misc_feature 1..432: note = derived and/or modified sequence opt11 from anti-HIV-1_HeavyChain
  source 1..432: mol_type = other RNA
gaagtgcacttggtcgagagcgggggcggggtcgtgcaaccgggcaggagcttgcgcttgagctgtgccgcgagcgggttcacgttcaatagctatgcaatgatctgggtcaggcaagcgcccgggaaagggctcgagtgggtggccgtgatctcgtacgatggcaataacaagtactatgccgatagcgtgaaaggacgatttaccataagcagggaaaatagcaagaacacgctctatctccagatgaatagcctgcgcgcggaagataccgcggtctatcactgtgccaaggacttgggcgagagcgagaacgaggaatgggcctcggactattacgatttcgggcgcgattacccgggccaggacccgcgcggggtcgtgggcacattcgatatctggggccatggcacgatggtgaccgtgagctcg

SEQ ID NO: 55108 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcgcccgggcgggagcttgcgcttgagctgtacagcgagcgggttccatttcaataaatatggaatgaactgggtcaggcaagcgcccgggaaagggctcgcgctcgtggcctttatccagagcggggcctcgtacaattactatgccgatagcgtgaaagggcgctttaccataagccgggacaatagcaagaacacgctatatctccagatgaatagcttgcgcgcggaagataccgcggtctattactgtgcaaaggacttgggcgatagcgagaacgaggaatgggcctcggactattacgatttcgggagagattacccgggccaggacccgcgcggggtcgtgggcgcgttcgatatctggggccatggcacgatggtgaccgtgagctcg

SEQ ID NO: 55109 - RNA, 432 nt, synthetic construct
  misc_feature 1..432: note = derived and/or modified sequence opt11 from anti-HIV-1_HeavyChain
  source 1..432: mol_type = other RNA
caagtgcacttggtcgagagcgggggcggggtcgtgcaaccgggcaagagcttgaccatatactgtgccgtgagcgagttcacgctctcgaactatgccatgcactgggtcaggctcacgcccgggaaagggctccagtgggtggccgtgatctcgtacgatggctcgaacaagtactatgccgatagcgtgaaagggcgctttaccataagcagggacaatagcaagaacacgctatatctccagatgaatagcttgcgcgcggaagataccgcggtctattactgtgccaaggacttgggcgagagcgagaacgaggaatgggcctcggactattacgatttcgggcgcgattacccgggccaggacccgcgcggggtcgtgggcgtgttcgatatctggggacagggcacgatggtgaccgtgagctcg

SEQ ID NO: 55110 - RNA, 432 nt, synthetic construct
  misc_feature 1..432: note = derived and/or modified sequence opt11 from anti-HIV-1_HeavyChain
  source 1..432: mol_type = other RNA
gaagtgcaactgctcgagagcgggggcggggtcgtgcaaccgggcaggagcttgagactgagctgtgccgcgagcgggttcacgttctcgacctatgccttgcactgggtcaggcaagcgcccgggaaagggctcgagtgggtggccgtgatctcgtacgatggctcgaccaagttctatgccgatagcgtgaaagggcgctttaccataagcagggacaatagcaagaacacgctctatctccagatgaatagcttgcgcgcggaagataccgcggtctattactgtgccaaggacctgggcgagagcgagaacgaggaatgggcctcggactattacgatttcgggagcgattacccgggccaggacccgcgcgcggtcgtgggcgcgttcgatatctggggacagggcacgatggtgaccgtgagctcg

SEQ ID NO: 55111 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggaggggtcgtgcaaccgggcgggagcttgcgcttgagctgtgcagcgagcgggttcacgttctcgagctatggcatgcactgggtcagacaagcgcccgggaaagggctcgagtgggtggcctttatcaggtacgatggctcgaacaagtactatgccgatagcgtgaaagggcgctttaccataagcagggaaaatagcaagaacacgctctatctccagatgaatagcttgcgcgcggaagataccgcagtctatcactgtgccaaggacttgggcgagagcgagatcgaggaatggacctcggactattacgatttcgggcgcgattacccgggccaggacccgcgcggggtctttggcacgttcgatatctggggacatggcacgatggtgaccgtgagctcg

SEQ ID NO: 55112 - RNA, 432 nt, synthetic construct
  misc_feature 1..432: note = derived and/or modified sequence opt11 from anti-HIV-1_HeavyChain
  source 1..432: mol_type = other RNA
gaagtgcaattggtcgagagcgggggcggggtcgtgaaaccgggcgggagcttgcgcttgagctgtgtcgtgagcgggttcacgttctcgaacgcgtggatgagctgggtcaggcaagcgcccgggaaaggactcgagtgggtggccgtgatctcggacgatggctcgaacaagtactatgccgatagcgtgaaagggcgctttaccataagcagggacaatagcaagaacacgctctatctccagatgaatagcttgcgcgcggaagataccgcggtctattactgtgccaaggacttgggcgagagcgagaacgaggaatgggcctcggactattacgatttcgggagcgattacccgggccaggacccgcgagcggtcgtgggcgcgttcgatatctggggccagggcacgatggtgaccgtgagctcg

SEQ ID NO: 55113 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggagggagcttgcgcttgagctgtgccgcgagcgggttcacgttctcgacctatggcatgcactgggtcaggcaagcgcccgggaaagggctagagtgggtggcatttatcaggtacgatggcaggaacaagaactatgccgatagcgtgaaagggcgctttaccataagcagggacaatagcaagaacacgctctatctccagatgaatagcttgcgcgcggaagataccgcggtctattactgtgcaaaggacttgggcgagagcgagaacgaggaatgggccacggactattacgatttctcgatcgggtacccgggccaggacccgcgcggggtcgtgggcatattcgatatctggggccagggcacgatggtgaccgtgagctcg

SEQ ID NO: 55114 - RNA, 432 nt, synthetic construct
  misc_feature 1..432: note = derived and/or modified sequence opt11 from anti-HIV-1_HeavyChain
  source 1..432: mol_type = other RNA
caagtgcacttggtagagagcgggggcggggtcgtgcaaccgggcgggagcctgcgcttgagctgtgccgcgagcgggttctcgttctcgatctatggcatgcactgggtcaggcaagcgcccgggaaagggctcgagtgggtgacctttaccaggtacgatggctcgaacaagtactataccgatagcgtgaaagggcgctttaccataagcagagacaatagcaagaacacgctctatctccagatgaatagcttgcgcacggaagataccgcggtctattactgtgccaaggacttgggcgagagcgagaacgaggaatgggcctcggactattacgatttcgggagcgattacccgggccaggacccgcgcgcggtcgtgggcgcgttcgatatctggggccagggcacgatggtgaccgtgagctca

SEQ ID NO: 55115 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcgggagcttgcgcctgagctgtgccgcgagcgggttcacgttctcgagctatggcatgcactgggtcaggcaagcgcccgggaaagggctcgagtgggtggcctttatcaggtacgatggctcgaacaagtactatgccgatcccgtgaaaggacgctttaccataagcagggacaatagcaagaacacgctatatctccagatgaatagcttgcgcgcagaagataccgcggtctattactgtgccaaggacttgggcgagagcgagaacgaggaatgggcctcggactattacgatttcgggcgcgattacccgggccaggacccgcgcggggtcgtgggcgtgttcgatatctggggccagggcacgatggtgaccgcgagctcg

SEQ ID NO: 55116 - RNA, 432 nt, synthetic construct
  misc_feature 1..432: note = derived and/or modified sequence opt11 from anti-HIV-1_HeavyChain
  source 1..432: mol_type = other RNA
gaaatgcaattggtcgagagcgggggcgggctcgtgcaaccgggcgggagcttgcgcttgagctgtgcagcgagcgggttcacgttctcgagctattggatgagctgggtcaggcaagcgcccgggaaagggctagagtgggtggccgtgatctcgtacgatggcaataacaagtactatgcagatagcgtaaaagggcgctttaccataagcagggaaaatagcaagaacacgctctatctccagatgaatagcttgcgcgcggaagataccgcggtctattactgtgccaaggacttgggcgagagcgagaacgaggaatgggcctcggactattacgatttcgggagcgattacccgggccaggacccgcgcggggtcgtgggcacgttcgatatctggggccatggcacgatggtgacagtgagctcg

SEQ ID NO: 55117 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcaggagcttgcgcttgagctgtgccgcgagcgggttcacgttctcgagctgtgccatgcactgggtcaggcaagcgcccgggaaagggctcgagtgggtggccgtgatctcgtacgatggcaataacaagcactatgccgatagcgtaaaagggcgctttaccataagcagggacaatagtaagaacacgctctatctccagatgaatagcttgcgcgcggaagatatggcggtctattactgtgccaaggacctgggcgagagcgagaacgaggaatgggcctcggactattacgatttctggcgcgattacccgggccaggacccgcgcgggtgggtgggcacgttcgatatctggggccagggcacgatggtgaccgtgagctcg

SEQ ID NO: 55118 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcaggagcttgcgattgagctgtgccgcgagcgggttcacgttctcgaactatggcatgcactgggtcaggcaagcgcccgggaaagggctcgagtgggtgaccgtgatatcgagcgatggctcgaaaaagtactatgcagatagcgtgaaagggcgctttaccataagcagggacaatagcaagaacacgctatatctccagatgaatggcttgagagcggacgataccgcggtctattactgtgccaaggacttgggcgatagcgagaacgaggaatgggcctcggactattacgatttcgggcgagattacccgggccaggacccgcgcggggtcgtaggcgcgttcgatatctggggccatggcacgatggtgaccgtgagctcg

SEQ ID NO: 55119 - RNA, 432 nt, synthetic construct
  misc_feature 1..432: note = derived and/or modified sequence opt11 from anti-HIV-1_HeavyChain
  source 1..432: mol_type = other RNA
caagtacaattggtcgagagcgggggcggggtcgtgcaaccgggcgggagcttgcgcttgagctgtgccgcgagcgggttcacgttctcgagctatggcatgcactgggtcagacaagcgcccgggaaagggctagagtgggtggcctttatcaggtacgatggctcgaacaagtactatgccgatagcgtgaaagggcgctttaccataagcagggacaatagcaagaacacgctctatctccagatgaatagcttgcgagcggtcgataccgcggtctattactgtgccaaggacttgggcgagggcgagaacgaggaatgggccacggactattacgatttctcgatcgggtacccgggccaggacccgcgcggagtcgtgggagcgttcgatatctggggccagggcacgatggtgaccgtgagctcg

SEQ ID NO: 55120 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcagatcgttgcgattgagctgtgccgcgagcgggttcacattcaggaactatggcatgcactgggtcaggcaaagccccgggaaagggctcgagtgggtggccgtgatctcgtacgatggcaagatcataaactatatcgatttcgtgaaagggcgctttaccataagcagggaaaatagcaagaacacgctctatctccagatgaatagcttgcgcgcggaagataccgcggtctattactgtgccaaggacttgggcgagagcgagaacgaggaatgggcctcggactattacgatttcgggagcgattacccgggccaggacccgcgcggggtcgtgggcacgttcgatatctggggccatggcacgatggtgaccgtgagctcg

SEQ ID NO: 55121 - RNA, 432 nt, synthetic construct
  misc_feature 1..432: note = derived and/or modified sequence opt11 from anti-HIV-1_HeavyChain
  source 1..432: mol_type = other RNA
gaagtgcaattgctcgagagcgggggcgggctagtgcaaccgggcaggagcttgcgcttgagctgtgccgcgagcgggttcacgttctcgagctatgtcatgcactgggtcaggcaagcgcccgggaaagggctcgagtgggtggccgtgatctcgtacgatggctcgaacaagcactatgccgatagcgtgaaagggcgctttaccataagcagggacaatagcaagaacacgctctatctccagatgaatagcttgcgcgcggaagataccgcggtctattacagggccaaggacttgggcgagagcgagaacgaggaatgggcctcggactattacgatttcgggcgcgattacccgggccaggacccgcgcggggtcgtgggcgtgctctatatctggggccagggcacgatggtgaccgtgagctcg

SEQ ID NO: 55122 - RNA, 432 nt, synthetic construct
  misc_feature 1..432: note = derived and/or modified sequence opt11 from anti-HIV-1_HeavyChain
  source 1..432: mol_type = other RNA
gaagtgcaattggtcgagagcgggggcgggctagtgaaaccgggcgggagcttgcgcttgagctgtgccgcgagcgggttcacgttctcgacctatagcatgcactgggtcaggcaagcgcccgggaaagggctagagtgggtggccgtgatctcgtacgatggcaataacaagtactatgccgatagcgtgaaagggcgctttaccataagcagggaaaatagcaagaacacgctctatctccagatgaatagcttgcgcgcggaagatacagcggtctatcactgtgccaaggacttgggcgagagcgagaacgaggaatgggcctcggactattacgatttcgggcgcgattacccgggccaggacccgcgcggggtcgtgggcacgttcgatatctggggccatggcacgatggtgaccgtgagctcg

SEQ ID NO: 55123 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgatagcgggggcggggtcgtgcaaccgggaaggagcttgcgcttgttctgtgccgtgagcgggttcacgttctcgacctataccatgcactgggtcaggcaagcgcccgggcgcgggctcgagtgggtggccgtgatctcgtacgatggctcgaccaagtactatgccgatagcgtgcaagggcgctttaccataagcagggacaatagcaagaacacgctctatctccagatgaatagcttgcgcgcggaagataccgcggtatattactgtgccaaggacttgggcgagagcgagaacgaggaatgggcctcggactattacgatttcgggagcgattacccgggccaggacccgcgcgcggtcgtgggcgcgttcgatatctggggccagggcacgatggtgacagtgagctcg

SEQ ID NO: 55124 - RNA, 426 nt, synthetic construct
  misc_feature 1..426: note = derived and/or modified sequence opt11 from anti-HIV-1_HeavyChain
  source 1..426: mol_type = other RNA
caagtgcaattggtcgagagcgggggcggggtcgtgcaaccgggccgcagcttgagattgagctgtgccgcgagcgggttcacattctcgagctttggcatgcactgggtcaggcaagcgcccgggaaagggctcgagtgggtggccgtgatctcgtacgatggcaataacaagtactatgccgatagcgtgaaagggagatttaccataagcagggaaaatagcaagaacacactctatctacagatgaatagcttgcgcccggaagataccgcggtctattactgtgccaaggacttgggcgagagcgagaacgaggaatgggcctcggactattacgatttcgggcgcgattacccgggacaggacccgcgcggggtcgtgggcacgttcgatatctggggccatggcacgatggtgaccgtg

SEQ ID NO: 55125 - RNA, 432 nt, synthetic construct
  misc_feature 1..432: note = derived and/or modified sequence opt11 from anti-HIV-1_HeavyChain
  source 1..432: mol_type = other RNA
caagtgcaattggtagagagcgggggcggggtcgtgcaaccgggcaggagcttgcgcttgagctgtgccgcgagcgggttcatgttctcgcgctatggcatgcactgggtcaggcaagcgcccgggaaagggctcgagtgggtggccgtgatctcgcacgatggctcgaacaagtactatgccgatagcgtgaaagggcgctttatcataagcagggacaatagcaagaacacgctctatctccagatgaatagcttgcgcgcggacgataccgcggtctattactgtgccaaggacctgggcgagagcgagaacgaggaatgggcctcggactattacgatttctggatcgggtacccgggccaggacccgcgcggggtcgtgggcgcgttcgatatctggggccagggcacgatggtgaccgtgagctcg

SEQ ID NO: 55126 - RNA, 432 nt, synthetic construct
  misc_feature 1..432: note = derived and/or modified sequence opt11 from anti-HIV-1_HeavyChain
  source 1..432: mol_type = other RNA
caagtgcaactggtcgagagcgggggcggggtcgtgcaaccgggcgggagcttgcgcttgagttgtgccgcgagcgcgttcacgttctcgagctatggcatgcactgggtcagacaagcgccagggaaagggctcgagtgggtggcctttatcaggtacgatggctcgaacaagtactatgccgatagcgtgaaagggcgctttaccataagcagggacaatagcaagaacacgctatttctccagatgaatagcttgcgcgcggaagatatggcggtctattactgtgcaaaggacttgggcgagagcgagaacgaggaatgggcctcggactattacgatttctggcgcgattacccgggccaggacccgcgcgggtgggtgggcacgttcgatatctggggccagggcacgatggtgacagtgagctcg

SEQ ID NO: 55127 - RNA, 426 nt, synthetic construct
  misc_feature 1..426: note = derived and/or modified sequence opt11 from anti-HIV-1_HeavyChain
  source 1..426: mol_type = other RNA
caagtgcaattggtcgagagcgggggcggggtcgtgcaaccgggcaggagcttgcgcttgagctgtgccgcgagcgggttcacgttctcgagctttggcatgcactgggtcaggcaagcgcccgggaaagggctcgagtgggtggccgtgatctcgtacgatggctcgaacaagtactatgtcgatagcgtaaaagggcgctttaccataagcagagacaatagcaagaacacgctctatctccagatgaatagcctgcgcgcggaagataccgcggtctatgccaaggacttgggcgagagcgagaacgaggaatgggcctcggactattacgatttcgggagcgattacccgggccaggacccgcgaggggtcgtgggcacgttcgatatctggagccagggcacgatggtgaccgtgagctcg

SEQ ID NO: 55128 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcgggagcttgcgcctgagctgtgccgcgagcgggttcacgttctcgacctatggcatgcactgggtcaggcaagcgcccgggaaagggctcgattgggtggcctttatcaggtacgatggctcgcacaagtactatgccgatagcgtgaaagggcgctttaccataagcagggaaaatagcaagaacacgctctatctccagatgaacagcctgcgcccggaagataccgcggtctattactgtgccaaggacttgggcgagagcgagaacgaggaatgggcctcggactattacgacttcgggcgcgattacccgggccaggacccgcgcggggtcgtgggcacgttcgatatctggggacatggcacgatggtgaccgtgagctcg

SEQ ID NO: 55129 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcggaggcggggtagtgcaaccgggcaggagcttgcgattgagctgtgccgcgagcgggttcacgttctcgagctacgccatgcactgggtcaggcaagcgcccgggaaagggctcgagtgggtggccgtgatctcgtacgatggctcgggagattactatgccgatagcgtgaaagggcgctttacaataagcagggacaatagcaagagcacgctctatctccagatgaatagcttgcgcccggaagataccgcggtctattactgtgccaaggacttgggcgagagcgagaacgaggaatgggcctcggactattacgatttcgggcgcgattacccgggccaggacccgcgcggggtcgtgggcacgttcgatatctggggccatggcacgatggtgaccgtgagctcg

SEQ ID NO: 55130 - RNA, 432 nt, synthetic construct
  misc_feature 1..432: note = derived and/or modified sequence opt11 from anti-HIV-1_HeavyChain
  source 1..432: mol_type = other RNA
caagtgcacttagtcgagagcgggggcggggtcgtgcaaccgggcgggagcttgcgcttgagctgtgccgcgagcgggttcacgttctcgacctatggcatgcaatgggtcaggcaagcgcccgggaaagggctcgagtgggtggcctttatcaagaacgatggcacgaacgagttctatggcgatagcgtgaaagggcgatttaccataagcagggacaatagcaagaacacggtctcgctccatatggatagcttgcgcccggaagataccgcgctctattactgtgccaaggacttgggcgagagcgagaacgaggaatgggcctcggactattacgatttcgggagcgattacccgggccaggacccgcgcgcggtcgtgggcgcgttcgatatctggggccagggcacgatggtgaccgtgagctcg

SEQ ID NO: 55131 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcgggagcttgcgattgagctgtgtagcgagcgggttcacgttctcgagttatggaatgcactgggtcaggcaagcgcccgggaaagggcttgagtgggtggcctttatcaggtacgatggcaggaacaagtactatgccgatagcgtgaaagggcgctttacaataagcagggacaagagcaagaacacgctatgtctccagatgaatagcttgcgagtggaagataccgcggtctattactgtgccaaggacttgggcgatagcgagaacgaggaatgggcatcggactattacgatttcgggcgcgattacccgggccaggacccgcgcggggtagtgggcgcgttcgatatctggggccatggcacgatggtgacagtgagctcg

SEQ ID NO: 55132 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcggaggcggggtcgtgcaaccgggcaggagcttgcgcttgagctgtgccgcgagcgggttcacgttctcaagctatggcatgcactgggtcaggcaagcgccagggaaagggctcgagtgggtggccgtgatctcgtacgatggctcgaacaagtactatcgcgatagcgtgaaagggcgctttaccataagcagagacaatagcaagaacacggtctacctccagatgaatagcctgcgcgcggaagataccgcggtctattactgtgcaaaggacctgggcgagagcgagagcgaggaatgggcctcggactattacgatttcgggcgagattacccaggccaggacccgcgcggggtcgtgggcgcgctagatatctggggccagggcataatggtgaccgtgagctcg

SEQ ID NO: 55133 - RNA, 432 nt, synthetic construct
  misc_feature 1..432: note = derived and/or modified sequence opt11 from anti-HIV-1_HeavyChain
  source 1..432: mol_type = other RNA
gaagtgcaattggtcgagagcgggggcggaatggtgcaaccgggcaggcccttgcgattgagctgtgccgcgagcgggttcatattctcgggctttggcttgcactgggtcaggcaagcgcccgggaaagggctcgagtgggtggcctcgatctcgtacgatggcgggaacaagtactatgccgatagcgtgcgcgggcgctttaccataagcagagacaatagcaagaacacgctctatctccagatgaatagcctgcgcgcggaagataccgcggtatattactgtgccaaggacttgggcgagagcgagaacgaggaatgggcctcggactattacgatttcgggagcgattacccgggccaggacccgcgcgcggtcgtgggagcgttcgatatctggggccagggaacgatggtgaccgtgagctcg

SEQ ID NO: 55134 - RNA, 432 nt, synthetic construct
  misc_feature 1..432: note = derived and/or modified sequence opt11 from anti-HIV-1_HeavyChain
  source 1..432: mol_type = other RNA
gaagtgcaattggtcgagagcgggggcggggtcgtgcgaccgggcgggagcttgcgattgagctgtgccgcgagcgggttcacgttcaatgactatggcatggcctgggtcaggcaagcgcccgggaaagggctcgagtgggtggccgatatctcgtacgatggctcgaacaagtactatgccgatagcgtgaaaggacgctttaccataagcagggacaatagcaagaacacgctctatctccagatgaatagcttgcgcgcggaagataccgcggtctattactgtgccaaggacttgggcgagagcgagaacgaggaatgggcctcggactattacgatttcgggcgcgattacccgggccaggacccgcgcggggtcgtgggcgcgttcgatatatggggacagggcacgatggtgaccgtgagctca

SEQ ID NO: 55135 - RNA, 429 nt, synthetic construct
  misc_feature 1..429: note = derived and/or modified sequence opt11 from anti-HIV-1_HeavyChain
  source 1..429: mol_type = other RNA
caagtgcaactggtcgagagcgggggcggggtcgtgcaaccgggcaggagcttgcgactgagctgtgcagcgagcgggttcacgttctcgagctatggcatgcactgggtcaggcaagcgcccgggaaagggctcgagtgggtggccgtggtctcgtacgatgaatcgaaatattacgcggactctgtcaagggcaggttcacgatctcgcgcgataactcgaaaaataccttgtacttgcaaatgaactcactcagggccgaggacatggccgtgtactattgcgcgaaagatctcggggaatcggaaaatgaagagtgggcgagcgattactatgaattttggagggactatccagggcaagatcccaggggctgggtcgggacctttgacatatgggggcaagggaccatggtcacggtctcaagc

SEQ ID NO: 55136 - RNA, 432 nt, synthetic construct
  misc_feature 1..432: note = derived and/or modified sequence opt11 from anti-HIV-1_HeavyChain
  source 1..432: mol_type = other RNA
caagtgcaactggtcgagcccgggcgcggggtcgtgcacccgggcgggagcttgcgcttgagctgtgtcacgagcgggttcacgttcgagaactttcccatgcactgggtcaggcaagcacccgggaaagggctcgagtgggtggccttgatctcgtacgatggctcggacaagtactatagcgatagcgtgaaagggcgctttaccataagcagggacaatagcaagaacacgctctatctccagatgaatagcttgcgcgcggaagataccgcggtctattactgtgccaaggacttgggcgagagcgagaacgaggaatgggcctcggactattacgatttcggaagcgattacccgggccaggacccgcgcggggtcgtgggcacgttcgatatctggggccatggcacgatggtgaccgtgagctcg

SEQ ID NO: 55137 - RNA, 432 nt, synthetic construct
  misc_feature 1..432: note = derived and/or modified sequence opt11 from anti-HIV-1_HeavyChain
  source 1..432: mol_type = other RNA
caagcgcaattggtcgagagcgggggcggggtcgtgcaaccgggcaggagcttgcgcttgagctgtgccgcgagcgggttctcgttcgcgacccatgccatgcactgggtcaggcgctcgcccgggaaagggctcgagtgggtggcaacgatctcgtacgggggcaagaacgagtactatgccgatagcgtgaaagggcgctttaccataagcagggaaaatagcaagaacacgctctatctccagatgaatagcttgcgcgcggaagatacagcggtctattactgtgccaaggacttgggcgagagcgagaacgaggaatgggcctcggactattacgatttcgggagcgattacccgggccaggacccgcgcggggtcgtgggcacgttcgatatctggggacatggcacgatggtgacagtgagctcg

SEQ ID NO: 55138 - RNA, 432 nt, synthetic construct
  misc_feature 1..432: note = derived and/or modified sequence opt11 from anti-HIV-1_HeavyChain
  source 1..432: mol_type = other RNA
gccgtgcaattggtcgagagcgggggcgggctcgtgaaaccgggcgggagcttgcgcttgagctgtgccgcgagcgggttcacgttctttaacacgtggatgagctgggtcaggcaatcgcccgggaaagggctcgagtgggtggccgatatctcgtacgatggctcgaacaagtactatgccgatagcgtgaaagggcgctttaccataagcagggacaatagcaagaacacgctctatctccagatgaatagcttgcgcgcggaagatacagcggtctattactgtgcaaaggacttgggcgagagcgagaacgaggaatgggcctcggactattacgatttcgggagagattacccgggccaggacccgcgcggggtcgtgggcgtgttcgatatctggggccagggcacgatggtgaccgtgagctcg

SEQ ID NO: 55139 - RNA, 432 nt, synthetic construct
  misc_feature 1..432: note = derived and/or modified sequence opt11 from anti-HIV-1_HeavyChain
  source 1..432: mol_type = other RNA
caagtgcaactggtcgagagcgggggcggggtcgtgcaaccgggcaggagcttgagactgagctgtgccgcgagcgggttcacattctcgagctatggcatgcactgggtcaggcaagcgcccgggaaagggctcgagtgggtggccgtgatctcgtacgatggctcgaacaagtactatgccgatagcgtgaaagggcgatttaccataagcagggacaatagcaagaacacgctctatctccagatgaatagcttgcgcgcggaagataccgcggtctattactgtgccaaggacttgggcgagagcgagaacgaggaatgggcctcggactattacgatttcgggagcgattacccgggccaggacccgcgcgcggtcgtgggcgcgttcgatatctggggccagggcacgatggtgaccgtgagctcg

SEQ ID NO: 55140 - RNA, 432 nt, synthetic construct
  misc_feature 1..432: note = derived and/or modified sequence opt11 from anti-HIV-1_HeavyChain
  source 1..432: mol_type = other RNA
caagtgcgcttggtcgagagcgggggcagggtcgtgcaaccgggcgggagcttgcgattgagctgtgtcgcgagcggattcacgttctcgagctatggcatacactgggtcaggcaagcgcccgggaaagggctcgagtgggtgacctttatctggcacgatggcagggacacgtactatgccgatgccgtgaaagggcgctttaccataagcagggacaatagcaagaacacgctatatctacagatgaatagcttgcgagcggaagatacagcggtctattactgtgccaaggacttgggcgagagcgagaacgaggaatgggccacggactattacgacttctggaccgggtacccgggccaggacccgcgcgcggtcgtgggcgcgttcgatatctggggccagggcacgatggtgaccgtgagctcg

SEQ ID NO: 55141 - RNA, 432 nt, synthetic construct
  misc_feature 1..432: note = derived and/or modified sequence opt11 from anti-HIV-1_HeavyChain
  source 1..432: mol_type = other RNA
caagtgcacttggtcgagagcgggggcggggtcgtgcaaccgggcaggagcctgcgaatatactgtgccgtgagcgagttcacgttcaggaactatgccatgcactgggtcaggctcgcgcccgggaaagggctccagtgggtggccgtgatctcgtacgatggctcgaacaagtactatggcgatagcgtgaaagggcgctttacaataagcagggacaatagcaagaacacactatatctccagatggatagcttgcgagcggaagatacagcggtctattactgtgccaaggacttgggcgagagcgagaacgaggaatgggcctcggactattacgatttcgggcgcgattacccgggccaggacccgcgcggggtcgtgggcacgttcgatatctggggccatggcacgatggtgaccgtgagctcg

SEQ ID NO: 55142 - RNA, 432 nt, synthetic construct
  misc_feature 1..432: note = derived and/or modified sequence opt11 from anti-HIV-1_HeavyChain
  source 1..432: mol_type = other RNA
gaagtgcaattggtcgagagcgggggcgggctagtgaaaccgggcgggagcttgcgcctgagctgtgcagcgagcgggttcacgttctcggacgcgtggatgagctgggtcaggcaagcgcccgggaaagggatggagtgggtggccgtgatctcgtacgatggctcgaacaagtactatgccgatagcgtgaaagggcgctttaccataagcagggacaatagcaagaacacgctatatctccagatgaatagcttgcgcgcggtcgataccgcggtctattactgtgccaaggacttgggcgagggagagaacgaggaatgggccacggactattacgatttctcgatcgggtacccgggccaggacccgcgcggggtcgtgggcgcgttcgacatctggggccagggcacgatggtgaccgtgagctca

SEQ ID NO: 55143 - RNA, 432 nt, synthetic construct
  misc_feature 1..432: note = derived and/or modified sequence opt11 from anti-HIV-1_HeavyChain
  source 1..432: mol_type = other RNA
gaagtgcaagtggtcgagagcgggggcgggctcgtgaaaccgggcgggagcttgcgcttgagctgtgaagcgagcgggttcacgttctcgaacgcgtggatgagctgggtcaggcaagcgcccgggaaagggctcgagtgggtggccgtaatctcgtacgatggcaataacaagtactatgccgatagcgtgaaagggagatttaccataagcagggaaaatagcaagaacacgctctatctccagatgaatagcctgcgcgcggaagatacagcggtatatcactgtgccaaggacttgggcgagagcgagaacgaggaatgggcctcggactattacgatttcgggcgcgattacccgggccaggacccgcgcggggtcgtgggcacgttcgatatctggggccatggcacgatggtgaccgtgagctcg

SEQ ID NO: 55144 - RNA, 432 nt, synthetic construct
  misc_feature 1..432: note = derived and/or modified sequence opt11 from anti-HIV-1_HeavyChain
  source 1..432: mol_type = other RNA
caagtgcaactggtcgagagcgggggcggggtcgtgcaaccgggcgggagcttgcgcctgagctgtgccgcgagcgggttcacgttctcgagctatggcatacactgggtcaggcaagcgcccgggaaagggctcgagtgggtggcctttatcaggagcgatgccacgaacaagtactatgccgatagcgtgaaagggcgctttaccataagcagggaaaatagcaagaacacgctatatctccagatgaatagcttgcgcgcggaagataccgcggtctattactgtgccaaggacttaggcgagagcgagaacgaggaatgggcctcggactattacgacttcgggagcgattacccgggccaggacccgcgcggggtcgtgggcacgttcgatatctggggccatggcacgatggtgaccgtgagctcg

SEQ ID NO: 55145 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtagtgcaaccgggcaggagcctgcgcttgagctgtgccgcgagcgggttcacgttctcgagctttggcatgcactgggtcaggcaagcgcccgggaaaggactcgagtgggtggccgtgatctcgtacgacggcaataacaagtactatgcagatagcgtgaaagggcgctttaccataagcagggaaaacagcaagaacacgctatacctacagatgaatagcttgcgcgcggaagataccgcggtatattactgtgccaaggacttgggcgagagcgagaacgaggaatgggcctcggactattacgatttcgggagcgattacccgggccaggacccgcgaggggtcgtgggcacgttcgatatctggggccatggcacgatggtgaccgtgagctcg

SEQ ID NO: 55146 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcaggagcttgcgcttgagctgtgccgcgagcgggttcacgttctcgaactatgccatggactgggtcaggcaagcgcccgggaaagggctcgagtgggtggccgtgatctcgtacgatggctcgaacaagtactatgccgatagcgtaaaagggcgctttaccataagcagggacaatagcaagaacacgctatatctccagatgaatagcttgcgcgcggaagataccgcggtctattactgtgccaaggacttgggcgagagtgagaacgaggaatgggccacggactattacgatttctggaccgggtacccgggccaggacccgcgcgcggtcgtgggcgcgttcgatatctggggccagggcacgatggtgaccgtgagctcg

SEQ ID NO: 55147 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtcgtgcaaccgggcaggagcttgcgcctgagctgtgccgcgagcgggttcacgttctcgagctatggcatgcactgggtcaggcaagcgcccgggaaagggctagagtgggtggccgtggtctcgtacgatgaatcgaacaagtactatgcagggagcgtaaaagggcgctttaccataagcagggacaatagcaagaacacgctctatctccagatgaatagcttgcgcacggaagatatggcggtatattactgtgccaaggacctgggcgagagcgagaacgaggaatgggcctcggactattacgatttcgggcgcgagtacccgggccaggacccgcgcgggtgggtgggcacgttcgatatctggggccagggcacgatggtaaccgtgagctcg

SEQ ID NO: 55148 - RNA, 432 nt, synthetic construct
  misc_feature 1..432: note = derived and/or modified sequence opt11 from anti-HIV-1_HeavyChain
  source 1..432: mol_type = other RNA
caagtgcaactggtcgagagcgggggaggagtcgtgcaaccgggcaggagcttgcgattgagctgtgccgcgagcgggttcacgttctcgagctatggcatgcactgggtcaggcaagcgcccgggaaaggactcgagtgggtggccgtgatctcgtacgatggctcgaacaagtactatgtcgatagcgtgaaagggcgctttaccataagcagggacaatagcaagaacacgctatatctccagatgaatagcttgcgcgcggaagataccgcggtatattactgtgccaaggacttgggcgagagcgagaacgaggaatgggccacggactattacgatttctcgatcgggtacccgggccaggacccgcgcggggtcgtgggcatattcgatatctggggccagggcacgatggtgaccgtgagctcg

SEQ ID NO: 55149 - RNA, 432 nt, synthetic construct
  misc_feature 1..432: note = derived and/or modified sequence opt11 from anti-HIV-1_HeavyChain
  source 1..432: mol_type = other RNA
caagtgcaattggtcgagagcgggggcggggtagtgcaaccgggcaggagcttgcgcttgagctgtgcagcgagcgggttcacgttctcgacctcgggcatgcactgggtcaggcaagcgcccgggaaagggatggagtgggtggccgtgatctcgtacgatggctcgaacaagtactatgccgatagcgtgaaagggcgatttaccataagcagggacaatagcaagaacacgctttatctccagatgaatagcttgcgcgcggtcgataccgcggtctattactgtgccaaggacttgggcgagggcgagaacgaggaatgggccacggactattacgatttctcgatcgggtacccgggccaggacccgcgcggggtcgtgggcgcgttcgatatctggggccagggcacgatggtgaccgtgagctcg

SEQ ID NO: 55150 - RNA, 363 nt, synthetic construct
  misc_feature 1..363: note = derived and/or modified sequence opt11 from anti-HIV_C38-VRC18.02_HeavyChain
  source 1..363: mol_type = other RNA
caggtcaggctcgtgcaatcgggcaatcaagtgcgcaagcccggggcctcggtcaggatctcgtgcgaggcctcgggctataaatttatcgatcactttatccattgggtgcgacaggtcccgggacatggcttggaatggctcgggtggataaacccgcgcgggggcggggtcaattactcgcgctcgttccagggcaagctctcgatgacgatgacgcgcgataactttgaagagaccgcgtacttggacttgagcaagctcaatcccggggacacggccgtgtacttttgcgcgcgcgggttcgcgggctatgaatggagctttatctggggccagggcacgctagtgatcgtgagctcg

SEQ ID NO: 55151 - RNA, 396 nt, synthetic construct
  misc_feature 1..396: note = derived and/or modified sequence opt11 from anti-HIV_44-VRC13.02_HeavyChain
  source 1..396: mol_type = other RNA
caagtccaactcgtccaatccggcaccgccctcaaatcccccggctcctccgccaaactctcctgcacagtcctaggcgacgaattcggcacctacttcatctcctggatccgccaagcccccggccaaggcctcgaatgggtcggcggcatcgtcccccactcccaactccaatcctccgcccaaaaattccacggccgcatcatcatctccgccggcgccggcgtaaccccccccgtcgtctccctccaactcaccaacctcaccttcgaagacaccggcacctacttctgcgcccgagaacgcggccgccaccgcgaccccaaaaccggcgacgccctccgcggccgctacttcgacttctggggccgcggcaccggcctccgcgtctcaacc

SEQ ID NO: 55152 - RNA, 321 nt, synthetic construct
  misc_feature 1..321: note = derived and/or modified sequence opt11 from anti-HIV-1_LightChain
  source 1..321: mol_type = other RNA
gatatcaagctcacgcaatcgcccgcgttcttgagcgcgagcgtgggcgagcgcgtgacctttacctgtcgcgcgagccaggacataagccatgacttggtctggttccagcaaaaggccgggcgcgcgccctcgctcttgatgttttacgggagcacgctcgagcgcggggtcccgcccaggttctcgggcaggcgctcgggcacggaatttaccgtgaccatagactcgctccagcccgaggacgtgggcacgtactattgccagcaattgagcgcgttcccgctcacgttcgggggcgggaccacggtcgatatcaag

SEQ ID NO: 55153 - RNA, 321 nt, synthetic construct
  misc_feature 1..321: note = derived and/or modified sequence opt11 from anti-HIV-1_LightChain
  source 1..321: mol_type = other RNA
gacatcaaaatgacccaatcccccgccttcctctccgcctccgtcggcgaacgcgtcaccttcacctgccgcgcctcccaagacatctcccacgacgtcgtctggttccaacaaaaatccggctccgcccccaaactcctcatgttctacggctccaccctcgaacgcggcgtccccccccgcttctccggccgccgctccggcaccgaattcaccgtcaccatcgacggcctccaacccgaagacgtcggcacctactactgccaacaactctccgccttccccctcaccttcggcggcggcaccaccgtcgacatcaaa

SEQ ID NO: 55154 - RNA, 321 nt, synthetic construct
  misc_feature 1..321: note = derived and/or modified sequence opt11 from anti-HIV-1_LightChain
  source 1..321: mol_type = other RNA
gatatcaagctcacgcaatcgcccgcgttcttgagcgcgagcgtgggcgagcgcgtgacctttacctgtcgcgcgagccaggacatacgccatgaactggtctggtaccagcaaaagcccgggcgcgggcccaagctcttgatctattacgggagcacgctcgagggcggggtcccgagcaggttctcgggcaggcgctcgggcacggaatttaccgtgaccataagctcgctccagcccgaggacgtgggcacgtactattgccagcaattgaactcgttcccgctcacgttcgggggcgggaccacggtcgatatcagg

SEQ ID NO: 55155 - RNA, 321 nt, synthetic construct
  misc_feature 1..321: note = derived and/or modified sequence opt11 from anti-HIV-1_LightChain
  source 1..321: mol_type = other RNA
gacatccaactcacccaatccccctccttcctctccgcctccgtcggcgaccgcgtctccatcacctgccgcgcctcccaaggcatcaaacacgaactcgcctggtaccaacaaaaacccggccgcgccccctccctcctcatctactacgcctccaccctcgcccgcggcgtcccctcccgcttctccgcctcctggtccggcaccctcttcaccctcaccatcaacggcctccaaccagaagacttcgccacctacttctgccaacaaatgaactccctcccactcaccttcggcggcggcaccaaaatggacgtccgc

SEQ ID NO: 55156 - RNA, 321 nt, synthetic construct
  misc_feature 1..321: note = derived and/or modified sequence opt11 from anti-HIV-1_LightChain
  source 1..321: mol_type = other RNA
gacatccaactcacccaatccccctccttcctctccgcctccgtcggcgacaaagtcaccatcacctgccgcgcctcccacggcgtccgcaacgaactcgcctggtaccaacaaaaacccggcaaagcccccaacctcctcatctactacgcctccaccctccaatccggcgtcccctcccgcttctccgccaccggctccggcacccacttcaccctcaccgtctcctccctccaacccgaagacttcgccacctacttctgccaacacatgtcctcctaccccctcaccttcggcggcggcaccaaagtcgaaatcaaa

SEQ ID NO: 55157 - RNA, 321 nt, synthetic construct
  misc_feature 1..321: note = derived and/or modified sequence opt11 from anti-HIV-1_LightChain
  source 1..321: mol_type = other RNA
gacatccaactcacccaatccccctccttcctctccgcctccgtcggcgacaaagtcaccttcacctgccgcgcctcccaaggcgtccgcaacgaactcgcctggtaccaacaaaaacccggcaaagcccccaacctcctcatctactacgcctccaccctccaatccggcgtcccctcccgcttctccgccaccggctcaggcacccacttctccctcaccgtctcctccctccaacccgaagacttcgccacctacttctgccaacacatgtcctcctaccccctcaccttcggcggcggcaccaaagtcgaaatcaaa

SEQ ID NO: 55158 - RNA, 321 nt, synthetic construct
  misc_feature 1..321: note = derived and/or modified sequence opt11 from anti-HIV-1_LightChain
  source 1..321: mol_type = other RNA
gacatccaactcacccaatccccctccttcctctccgcctccgtcggcgacaaagtcaccatcacatgccgcgcctcccaaggcgtccgcaacgaactcgcctggtaccaacaaaaacccggcaaagcccccaacctactcatctactacgcctccaccctccaatccggagtcccctcccgcttctccgccaccggctccggcacccacttcaccctcaccgtctcctccctccaacccgaagacttcgccacctacttctgccaacacatgtcctcctaccccctcaccttcggcggcggcaccaaagtcgaaatcaaa

SEQ ID NO: 55159 - RNA, 366 nt, synthetic construct
  misc_feature 1..366: note = derived and/or modified sequence opt11 from anti-HIV-1_HeavyChain
  source 1..366: mol_type = other RNA
tcccaatacctcgcccaacccggcgccgaagtcgccaaacccggcgcctccgtcaaagtctcctgcaaagtccacggcgacaacttccgcggccactacctccactgggtacgccaagcccccggccaaggcctccaatggatcggcggcatcaaccccttctccggcgaagccgcctacggaaaacgcttcgaaggccgcctccgcctcacccgcgacacctccgtcaacaccgcctacatggaactcgccaaactcacccccgacgacaccgccgtctacttctgcgcccgcgacaaaacctacaacgacgaattcaccgccatggacatctggggccacggcaccaccgtcatcgtctcctcc

SEQ ID NO: 55160 - RNA, 366 nt, synthetic construct
  misc_feature 1..366: note = derived and/or modified sequence opt11 from anti-HIV-1_HeavyChain
  source 1..366: mol_type = other RNA
agccagtacctggcccagcccggagccgaagtcgcaaaaccgtgggcaagcgtaaaagtaagctgccgcgtacacggagacaacttcagaggcttctacctgcactgggtcagacaagcgcccggacaaggactcgaatggataggcggaatcaaccccttcagcggagaagcggcctacggcagacgcttcgaaggacgcctgcgcctgaccagagacacaagcataaacacagcctacatggaagtcacaaaactgacctcggacgacaccgcggtctacttctgcgccagagacaaaacctacaacgacgaattcaccgcaatggacatctggggccagggcacaaccgtgatcgtaagctca

SEQ ID NO: 55161 - RNA, 366 nt, synthetic construct
  misc_feature 1..366: note = derived and/or modified sequence opt11 from anti-HIV-1_HeavyChain
  source 1..366: mol_type = other RNA
agccaatacctagcccaaagcggcagcgaagtcaaaaaaccaggcgccagcgtaaaagtcagctgccgcctacacggagacaaattcggagcccactacatacactgggtcagacaagcaccaggccaaggactagaatggctcggcttcttccaccccggcaccggcgacgcagtctcagcccaaaaattccaaggacgcataagcctaaccagagacacaagcataagcaccggctacctcgaagtcagacgcctaagctcagacgacaccgcagtctactactgcgccagagacaaaacctacagcgacgaagcaaccggaatggacatctggggccaaggcacaaccgtaatcgtcagctca

SEQ ID NO: 55162 - RNA, 366 nt, synthetic construct
  misc_feature 1..366: note = derived and/or modified sequence opt11 from anti-HIV-1_HeavyChain
  source 1..366: mol_type = other RNA
agcttggaattggtccagagcgggaccgaggtcaagaaaccgggcgcgagcgtgaaagtgagctgtaaattgttcggggacacgatcacgagcgggcccatacactgggtcaggcaagcgccagggcaagggctcgagtggatgggctggaccaatccccatagcggggacacggccacggccccgaaatttcaagggcgcgtgtacatgaccaatgacaagaaaataaacacggcctttctcgatgtcacgcgactggcctcggacgataccgcgatctatttctgtgccagggacatgtactatagcaatgaagcggtcgggatggatgtctggggccagggcacgaccgtgagcgtgagctcg

SEQ ID NO: 55163 - RNA, 366 nt, synthetic construct
  misc_feature 1..366: note = derived and/or modified sequence opt11 from anti-HIV-1_HeavyChain
  source 1..366: mol_type = other RNA
caagaagtcctcgtccaatccggcgccgaagtcaaaaaacccggcgcctccgtcaaagtctcctgccgcgccttcggctacaccttcaccgcccacgccctccactgggtccgccaagcccccggccaaggcctcgaatggctaggctggatcaacccccactccggcgacaccaccacctcccaaaaattccaaggccgagtctacatgacacgcgacaaatccatcaacaccgcctacctagaagtcacccgcctcacctccgacgacaccgccatcttctactgcgcccgcgacaaatactacggcgacgaagccgtcggcatggacgtctggggccaaggcacctccgtcaccgtctcctcc

SEQ ID NO: 55164 - RNA, 366 nt, synthetic construct
  misc_feature 1..366: note = derived and/or modified sequence opt11 from anti-HIV-1_HeavyChain
  source 1..366: mol_type = other RNA
caagaagtcctagtccaaagcggcgccgaagtcaaaaaaccaggcgccagcgtcaaagtcagctgccgcgccttcggctacaccttcaccggcaacgccctccactgggtccgccaagcacccggccaaggcctagaatggctaggctggatcaacccccactccggcgacaccaccaccagccaaaaattccaaggccgcgtctacatgacccgagacaaagccatcaacacagcctacctcgacgtcacacgcctaacctccgacgacaccgccatatactactgcgcccgagacaaatactacggcaacgaagcagtcggcatggacgtctggggccaaggcaccagcgtcaccgtcagctcc

SEQ ID NO: 55165 - RNA, 366 nt, synthetic construct
  misc_feature 1..366: note = derived and/or modified sequence opt11 from anti-HIV-1_HeavyChain
  source 1..366: mol_type = other RNA
caggaagtgctcgtgcaatcgggcgcggaagtgaaaaagcccggggcctcggtcaaggtctcatgcagggcctttggctatacctttaccgggaacgcgctccattgggtgcgccaggccccgggccagggcctggaatggctcgggtggataaacccgcactcgggcgataccacgacctcgcaaaagttccagggcagggtctatatgacgcgcgataaatcgatcaataccgcgttcttggacgtgaccaggctcacgagcgatgacacgggcatatactattgcgcgcgcgataaatattacgggaacgaggccgtgggcatggacgtgtgggggcaagggacctcggtcacggtctcgagc

SEQ ID NO: 55166 - RNA, 303 nt, synthetic construct
  misc_feature 1..303: note = derived and/or modified sequence opt11 from anti-HIV_45_LightChain
  source 1..303: mol_type = other RNA
tccctcacccaatcccccggcaccctctccctctcccccggcgaaaccgccatcatctcctgccgcacctcccaatacggctccctcgcctggtaccaacaacgccccggccaagccccccgcctcgtcatctactccggctccacccgcgccgccggcatccccgaccgcttctccggctcccgctggggccccgactacaacctcaccatctccaacctcgaatccggcgacttcggcgtctactactgccaacaatacgaattcttcggccaaggcaccaaagtccaagtagacatcaaa

SEQ ID NO: 55167 - RNA, 303 nt, synthetic construct
  misc_feature 1..303: note = derived and/or modified sequence opt11 from anti-HIV_45_LightChain
  source 1..303: mol_type = other RNA
gtcctcacccaatcccccggcaccctctccctctcccccggagaaaccgccaccatctcctgccgcacctcccaatacggctccctcgcctggtaccaacaacgccccggccaagccccccgcctcgtcatctactccggctccacccgcgccgccggcatccccgaccgcttctccggctcccgctccggccccgactacaccctcaccatctccaacctcgaatccggcgacttcggcgtctactactgccaacaatacgaattcttcggccaaggcaccaaagtccaacaagacaacaaa

SEQ ID NO: 55168 - RNA, 303 nt, synthetic construct
  misc_feature 1..303: note = derived and/or modified sequence opt11 from anti-HIV_45_LightChain
  source 1..303: mol_type = other RNA
gtcctcacccaatcccccggaaccctctccctctcccccggcgaaaccgccatcatctcctgccgcacctcccaatacggctccctcgcctggtaccaacaacgccccggccaagccccccgcctcgtcatctactccggctccacccgcgccgccggcatccccgaccgcttctccggctcccgctggggccccgactacaacctcaccatctccaacctcgaatccggcgacttcggcgtctactactgccaacaatacgaattcttcggccaaggcaccaaagtccaagtcgacatcaaa

SEQ ID NO: 55169 - RNA, 363 nt, synthetic construct
  misc_feature 1..363: note = derived and/or modified sequence opt11 from anti-HIV_45_HeavyChain
  source 1..363: mol_type = other RNA
caggtcaggctctcgcaatcgggcgggcaaatgaaaaagcccggggaatcgatgaggatctcgtgcagggcctcgggatatgaatttatcgattgcacgctcaattggatacgcttggccccgggcaggcgcccggaatggatggggtggttgaaaccgcgcgggggcgcggtcaattacgcgcgcgtgttccagggcagggtcacgatgacgcgcgatgtctatagcgataccgcgttcttggaattgcgctcgctcacggccgatgacacggccgtgtacttttgcacacgcgggaaaacggtcgattacaattgggatttcgagcacgtgggcccgggcacgcccgtgaccgtgagctcg

SEQ ID NO: 55170 - RNA, 363 nt, synthetic construct
  misc_feature 1..363: note = derived and/or modified sequence opt11 from anti-HIV_45_HeavyChain
  source 1..363: mol_type = other RNA
caggtcaggctctcgcaatcgggcgggcaaatgaaaaagcccggggaatcgatgaggatctcgtgccaggcctcgggctatgaatttatcgattgcacgctcaattgggtgcgcttggccccgggcaggcgcccggaatggatggggtggttgaaaccgcgcgggggcgcggtcaattacgcgcgcatattccagggcagggtcacgatgacgcgcgatgtctatagcgataccgcgttcttggaattgcgctcgctcacggccgatgacacggccgtgtacttttgcacgcgcgggaaaaattgcgattacaattgggatttcgagcacgtgggcccgggctatcccgtgaccgtgagcccg

SEQ ID NO: 55171 - RNA, 375 nt, synthetic construct
  misc_feature 1..375: note = derived and/or modified sequence opt11 from anti-HIV_45_HeavyChain
  source 1..375: mol_type = other RNA
caagtccgcctctcccaatccggcggccaaatgaaaaaacccggcgactccatgcgcatctcatgccgcgcctccggctacgaattcatcaactgccccatcaactggatccgcctcgcccccggcaaacgccccgaatggatgggctggatgaaaccccgcggcggcgccgtctcctacgcccgccaactccaaggccgcgtcaccatgacccgagacatgtactccgaaaccgccttcctcgaactccgctcactcacctccgacgacaccgccgtctacttctgcacccgcggcaaatactgcaccgcccgcgactactacaactgggacttcgaacactggggccaaggcacccccgtcaccgtctcatcc

SEQ ID NO: 55172 - RNA, 435 nt, synthetic construct
  misc_feature 1..435: note = derived and/or modified sequence opt11 from anti-HIV_cap256-206-252885_VR-Chain
  source 1..435: mol_type = other RNA
caggaacagctcgtggaatcgggcgggggcgtggtcccgcccgggagctcgctcacgctctcgtgcgtggcctcgcgctttacctttagcgcgttcgggatgcattgggtgcgccaggccccgggcaagggcttggaatgggtcgcgggcgtgagcttcgtcgggataaagaaatattacgcggactcggtcaagggcaggttcacgatctcgcgcgataactcgaaaaataccttgttcttgcaaatgaacgggctcaggggcgaggacacgggcttgtactattgcgtgaaagatatgaggtacttggaatgtgaagagtgggcgagcgattactatgactttggcaagcccaatcaaccgtgcttggacaggcgcggggtctcgggcataagcgcgttctggggccagggcacgaccgtgaccgtgagctcg

SEQ ID NO: 55173 - RNA, 438 nt, synthetic construct
  misc_feature 1..438: note = derived and/or modified sequence opt11 from anti-HIV_cap256-206-249183_VR-Chain
  source 1..438: mol_type = other RNA
caagtgctcctggtcgagagcgggggcggggtcgtggaaccgggcacgagcttgaccctgagctgtgccgcgagcaggttcacgttctcgaacttcggcatgcactgggtcaggcaaacgcccgggggcgggctcgagtgggtggcctcgatctcgaacgagggcaataaaaagtaccatgccgagagcgtgtgggggcgctttatcataagcagggacaatagcaagaacacggtctttctccatatgtcgagcttgcgcccggacgatagcgcgctctatttctgtgtcagggacaggcaagaggacgattgcgaggtctggtggtcggactatgaagcgttcgggcgagagatcccgtgcaggcaatatcgagggcaagggctagcaggcatattcgatatctggggcaggggaacgatggtgaccgtgagctcg

SEQ ID NO: 55174 - RNA, 438 nt, synthetic construct
  misc_feature 1..438: note = derived and/or modified sequence opt11 from anti-HIV_cap256-206-220956_VR-Chain
  source 1..438: mol_type = other RNA
caaatgatgttggtcgagagcgggggcgatgtcgtggaaccgggcaggagcttgacattgagctgtgcaacgagccagttcacgttctcgaactatggaatgcactgggtcaggcaagcgcccgggcgcgggctcgagtgggtggcctcgatctcgaacgagggcaataaaaagtaccatgccgagagcgtgtgggggcgcttgatcataagcagggacaatagcaagaacacgctatttctccatatgtcgagcttgcgcgcggacgatagcgcgctctatttctgtgtaagggacaggcaagaggacgagtgcgaggaatggtggtcaaactattacgcgttcgggcgcgggggcccgtgcaggaaatatcgcgggcaagggctcgcgggcatattcgatgtctggggaaggggcacgatggtgaccgtgagctcg

SEQ ID NO: 55175 - RNA, 432 nt, synthetic construct
  misc_feature 1..432: note = derived and/or modified sequence opt11 from anti-HIV_cap256-206-220629_VR-Chain
  source 1..432: mol_type = other RNA
caagagcaattggtcgagagcgggggcggggtcgtgccaccgggcaagagtttgaaattgagctgtgtcgcgagcaggttctcgttcggggcctttggcatgcactgggtcaggcaagcgcccgggaaagggctcgagtgggtggccgggatatcgttcgcgggcatcaaaaagtactatggcgatagcgtgaaagggcgcttttacataagcagagacaatagccagaacacgctctttctcgagatgaatggcttgcgaggggacgataccgcgcgatattactgtgtaaaggacttgcgcgagctcgagtgcgaggaatgggcctcggactattacgatttcgggaaaccgcaaccgtgcttggactcgcgcggggtctcgggcataagcgcgatgtggggcccgggcacgatggtgaccgtgagctcg

SEQ ID NO: 55176 - RNA, 381 nt, synthetic construct
  misc_feature 1..381: note = derived and/or modified sequence opt11 from anti-HIV_cap256-206-200599_VR-Chain
  source 1..381: mol_type = other RNA
caagagaaattggtcgagagcgggggcggggccgtgcaaccgggcgggagcttgagactgagctgtgtcgcgagcgggttcacgttcaatggctttggcatgcactgggtcaggcaagcgcccgggaaagggctcgagtgggtggccacgatctcgttctcgggcgtgtacataagcagggaaaatagcaagaacacgctctatctccagatgaatggcttgcgaggggaagataccgcgctctattactgtgccaaggacttgcgctacctcgagtgcggggaatggagcacgtactatccccagccctgtctcgataccaggggcgtgagcgggatctcgaacgtgtgggggcccgggaccagggtcacggtctcgagc

SEQ ID NO: 55177 - RNA, 432 nt, synthetic construct
  misc_feature 1..432: note = derived and/or modified sequence opt11 from anti-HIV_cap256-206-186347_VR-Chain
  source 1..432: mol_type = other RNA
caagagctcttggtcgagagcgggggcggggtcgtgcccccgggcaagagcttgaccataagctgtgtcgcgagcaggttcacgttctcggcctttggcatgcactgggtcaggcaagcgcccgggaaagggctacagtgggtggcctcgatctcgttcgcgggcacgaaaaagtactatgccgacttcgtgaaagggcgctttaccataagcagggacaatagcaagaacacgatctttctccagatgaatggcttgcgcggggaagataccgcgctctatcactgtgtcaaggacatgcgacagctagagtgcgaggaatggacctcggactattacgatttcgggcgcccgcaaccgtgcatagacaggcgcggggtctcgggcataagcgcgatgtggggcccgggcacgatggtgaccgtgagctcg

SEQ ID NO: 55178 - RNA, 438 nt, synthetic construct
  misc_feature 1..438: note = derived and/or modified sequence opt11 from anti-HIV_cap256-206-186226_VR-Chain
  source 1..438: mol_type = other RNA
caaatgctcttggtcgagagcgggggcggggtcgtggaaccgggcaggagtttgaccttgagctgtgccacgagccagttcacgttctcgaactatggcatgcactgggtcaggcaaacgcccgggacagggctcgagtgggtggcctcgatctcgaacgagggcaataaaaagtaccatggcgaggccgtgtgggggcgctttatcataagcagggacaatagcaagaaaacgctctttctccatatgtcgaacttgcgcgcggacgatagcgggctctatttctgtgtcagggacaggcaagaggacgagtgcgaggaatggtggtcggactattactcgttcgggcgcgggggcccgtgcaggaaatatcacgggcaaggactcgcgggcatattcgatatatggggcaggggcacgctcgtgaccgtgagctcg

SEQ ID NO: 55179 - RNA, 435 nt, synthetic construct
  misc_feature 1..435: note = derived and/or modified sequence opt11 from anti-HIV_cap256-206-179686_VR-Chain
  source 1..435: mol_type = other RNA
caagagcaattggtagagagcgggggcggggtcgtgcccccgtggaaaagcctgaccttgagctgtgaagcgagcagattcacgttctcggcctttggcatgcactgggtcaggcaagcgcccgggaaagggctcgagtgggtggccgggatctcgttcgcgggcataaagaagtactatgccgatagcgtgaaagggcgatttttcataagcagggacaatagcaagaacagggtcttgctcgagatgaatggcttgcgcagggaagataccgcgcgctatttctgtgtcaaggacttgcgcgagctcgagtgcgaggaatgggcctcggactattacgatttcgggaaaccgaaccagccctgtctcgatagaaggggcgtgagcgggatctcggccatgtgggggcaagggaccatggtcacggtctcgagc

SEQ ID NO: 55180 - RNA, 417 nt, synthetic construct
  misc_feature 1..417: note = derived and/or modified sequence opt11 from anti-HIV_cap256-206-173707_VR-Chain
  source 1..417: mol_type = other RNA
caagagaaattggtcgagagcgggggcggggccgtgcaaccgggcgggagcctgcgcttgagctgtgtcgcgagcgggttcacgttcaagggctttggcatgcactgggtcagacaagcgcccgggaaagggctcgagtgggtggccacgatctcgttctcgggagtgaaaaagtactatggcaatagcgcgaaagggcgctttttcataagcagggacaatctcaagaacacggtctatctagagatgaatggcttgcgcggggaagataccgcgctctattactgtgccaaggacctgcgctatctcgagtgcggggaatggagcacgtactatccccagccctgtctcgataccaggggcgtgagcgggatctcgaacgtgtgggggcccgggaccaaggtcacggtctcgagc

SEQ ID NO: 55181 - RNA, 432 nt, synthetic construct
  misc_feature 1..432: note = derived and/or modified sequence opt11 from anti-HIV_cap256-206-173339_VR-Chain
  source 1..432: mol_type = other RNA
caagagctcctggtcgagagcgggggcggggtcgtgcccccgggaaagagcttgaaattgagctgtgtcgcgagcaggttcacgttcggggcctttggcatgcactgggtcaggcaagcgcccgggaaagggctcgagtgggtggccgggatctcgttcgcgggcacgaaaaattactatgccgatagcgtgaaagggcgctttaccataagcagggacaatcccaagaacacgctatttcttcagatgaatggcctgcgcggggacgataccgggctatattactgtgtcaaggacatgcgagagctcgagtgcgagctctggacatcggactattacgatttcgggcgcccgcaaccgtgcatagaccagcgcggggtctcgggcataagcgcgatgtggggccagggcacgatggtaaccataagctcg

SEQ ID NO: 55182 - RNA, 438 nt, synthetic construct
  misc_feature 1..438: note = derived and/or modified sequence opt11 from anti-HIV_cap256-206-172689_VR-Chain
  source 1..438: mol_type = other RNA
caaatgatgttggtcgagagcgggggcggggtcgtggaaccgggcaggagcttgaccttgagctgtgccacgagccatttcacgttctcgaactatggcatgcactgggtcaggcaagcgcccgggggcaggctcgagtgggtggcctcgatctcgaacgcgggcaataaaaagtaccatggcgatagcgtgtgggggcgattgatcataagcagggacaatagcaagaacacgctctttctccatatgtcgagcttgcgcgtggacgatagcgcgctctatttctgtgtcagggacaggcaagaggacgagtgcgaggaatggtggtcggactattacgcgttcgggcgagggggaccgtgcaggaaatatcgagggcaagggctcgcgggaatattcgatatctggggcaggggcacgatggtgaccgtgagctcg

SEQ ID NO: 55183 - RNA, 432 nt, synthetic construct
  misc_feature 1..432: note = derived and/or modified sequence opt11 from anti-HIV_cap256-206-162744_VR-Chain
  source 1..432: mol_type = other RNA
caagagaaattggtcgagagcgggggcggggtcgtgccaccgggcaagagcttgcgcttgagctgtgtcgcgagcgggttcacgttctcagcctttggcatgcactgggtcaggcaagcgccagggaaagggctcgagtgggtggccgggatatcgttcgcgggcatcaaaaattactatgccgatagcgtgaaagggcgctttaccataagcagggacaatagcaagaacagcctcttcctccagatgaatggcttgcgcggggacgataccgcgcgctattactgtgtcaaggacatgcgcgagctcgagtgcgaggaatggacatcggactattacgacttcgggaaaccgcaaccgtgcatagacaggcgcggggtctcgggcatatcggcgatgtggggccagggaacgatggtgaccataagctca

SEQ ID NO: 55184 - RNA, 438 nt, synthetic construct
  misc_feature 1..438: note = derived and/or modified sequence opt11 from anti-HIV_cap256-206-146057_VR-Chain
  source 1..438: mol_type = other RNA
caaatgcaattggtcgagagcgggggcggggtcgtgcaaccgggcacgagcttgaccttgagctgtgtcgcgagccagttcacgttctcgaactatggaatgcactggatcaggcaagcgcccgggcaagggctcgagtgggtggcctcgatctcgaacgatggcgggaaaaggtaccatggcgatgccgtgtgggcgcgctttatcataagcagggacaatagcaagaacacggtctttctacagatgacgagcttgcgcgcggaagataccgcgcgctatttctgtgtcagggacaggcaagaggacgagtgcttggaatggtggtcggactattacaatttcgggcgccagctcccgtgcgcgaaatttcgcgggctcgggctcgcgggcgtgttcgatatctggggccatggcacgatggtgaccgtgagctcg

SEQ ID NO: 55185 - RNA, 435 nt, synthetic construct
  misc_feature 1..435: note = derived and/or modified sequence opt11 from anti-HIV_cap256-206-139519_VR-Chain
  source 1..435: mol_type = other RNA
caagagcaattggtcgagagcgggggcggggtcgtgcccccgggcacgagcttgcgcctgagctgtgtcgcgagcaggttctcgttcgggagctttggaatgcactgggtcaggcaagcgcccgggaaagggctcgagtgggtggccgggatctcgttcgtgggcatcaaaaagtactatggcgatagcgtgaaagggcgctttttcataagcagggacaatagcaagaacacgctctttctcgagatgaatggcctgcgcggggaagataccgcgcgctattactgtgtcaaggacatgcgcgagctcgagtgcgaggaatgggcctcggactattacgatttcgggaaaccgaaccagccctgtctcgatagaaggggcgtgagcgggatatcggccatgtgggggcccgggaccatgctcacggtctcgagc

SEQ ID NO: 55186 - RNA, 432 nt, synthetic construct
  misc_feature 1..432: note = derived and/or modified sequence opt11 from anti-HIV_cap256-206-136316_VR-Chain
  source 1..432: mol_type = other RNA
caagagcaactggtcgagagcgggggcggggtcgtgcccccgggcaagagcttgaccttgagctgtgtagcgagcgggttcacgttctcggcctttggcatgcactgggtcaggcaagcgcccgggaaagggctcgagtgggtggccgggatatcgttcgtgggcatcaaaaagtactatggcgatagcgtgaaagggcgctttaccataagcagggacaatagcaagaacacgctctttctccagatgaatggcttgcgcggggacgataccgcgctctatcactgtgtcaaggacatgcgccagctcgagtgcgaggaatggacctcggactattacgatttcgggaaaccgcaaccgtgcatagacccgcgcggggtctcgggcataagcgcgatgtggggacagggcacgatggtgaccgtgagctcg

SEQ ID NO: 55187 - RNA, 438 nt, synthetic construct
  misc_feature 1..438: note = derived and/or modified sequence opt11 from anti-HIV_cap256-206-116098_VR-Chain
  source 1..438: mol_type = other RNA
caaatgatgttggtcgagagcgggggcggggtcgtggaaccgggcaggagcttgaccttgagctgtgccgcgagccagttcacgttctcgaactatggcatgcactgggtcaggcaagcgcccggacgcgagctcgagtgggtggcctcgatctcgaacgcgggcaataaaaagtaccatggcgaggccgtgtgggggcgcttgatcataagcagggacaatagcaagaacacgctttttctccatatgtcaaacttgcgcccggacgacagcgcgctatatttctgtgtcagggacaggcaagaggacgagtgcgaggaatggtggtcggactattacgcgttcgggcgcgggggcccgtgcaggaaatatcacgggcaagggctcgcgggcatattcgatatctggggcaggggcacgatggtgaccgtgagctcg

SEQ ID NO: 55188 - RNA, 432 nt, synthetic construct
  misc_feature 1..432: note = derived and/or modified sequence opt11 from anti-HIV_cap256-206-115862_VR-Chain
  source 1..432: mol_type = other RNA
caagagcaattggtcgagagcgggggcggggtcgtgccaccgggcaagagcctgcgcttgagctgtgtcgggagcaggttcacgttctcggcctttggcatgcactgggtcaggcaagcgccagggaaagggctcgagtgggtggcctcgatctcgttcgcgggcacgaaaaagtactatgtcgatagcgtgaaagggcgctttttcataagcagggacaatagtaagaacacggtctttctcgagatgaatggcttgcgcggggaagacaccgggctctattactgtgtcaaggacatgagagagctcgagtgcgaggaatgggcctcggactattacgatttcgggaaaccgcaaccgtgcttggacaggcgcggggtctcgggcataagcgcgatgtggggacagggcacgctcgtgatcataagctcg

SEQ ID NO: 55189 - RNA, 435 nt, synthetic construct
  misc_feature 1..435: note = derived and/or modified sequence opt11 from anti-HIV_cap256-206-107018_VR-Chain
  source 1..435: mol_type = other RNA
caagagcaattggtcgagagcgggggcggggtagtgcccccgggcaagagcttgaccttgagctgtgtcgcgagcaggttctcgttctcggcctttggcatgcactgggtcaggcaagcgcccgggaaagggctagagtgggtggcatcgatctcattcgtgggcatcaaaaagtactatggcgatagcgtgaaagggcgatttttcataagcagggacaatagcaagaacacggtctttctcgagatgaatggcttgcgcggggaagataccgggctctattactgtgtaaaggacatgcgcgagctcgagtgcgaggaatgggcatcggactattacgatttcgggaaaccgaaccagccctgtctcgatcgcaggggcgtgagcgggatatcggccatgtgggggcaagggaccttggtcatagtctcgagc

SEQ ID NO: 55190 - RNA, 438 nt, synthetic construct
  misc_feature 1..438: note = derived and/or modified sequence opt11 from anti-HIV_cap256-206-098644_VR-Chain
  source 1..438: mol_type = other RNA
caaatgctattggtcgagagcgggggcggggtcgtggaaccgggcaggagcctgaccttgagctgtgccgcgagccagttcacgttctcgaactatggcatgcactgggtcaggcaagcgcccgggggcgggctcgagtgggtggcatcgatctcgaacgagggcaataaaaggtaccatggagagagcgtgtgggggcgctttgtcataagcagggacaacagtaagaacacgctatttctccatatgtcgaccttgcgcccggacgatagcgcgctatatttctgtgtcagggacaggcaagaggacgagtgcgaggaatggtggtcggactattacgcgttcgggcgagggggaccgtgcaggaaatatcacgggcaagggctagcgggcatattcgatgtctggggcaggggcacgatggtgaccgggctcttt

SEQ ID NO: 55191 - RNA, 417 nt, synthetic construct
  misc_feature 1..417: note = derived and/or modified sequence opt11 from anti-HIV_cap256-206-098135_VR-Chain
  source 1..417: mol_type = other RNA
caagagaaattggtcgagagcgggggcggggccgtgcaaccgggcgggagcttgagattgagctgtgtcgcgagcgggttcacgttctcgggctttggcatgcactgggtcaggcaagcgcccgggaaagggctagagtgggtggccacgatctcgttctcgggcatgaaaaagtactatggcacgagcgcgaaagggcgatttagcatatacagggacaatagcaagaacacgctctatctccagatggatggcttgagagagaaagataccgcgctctattactgtgccaaggacctgcgctatctcgagtgcggggaatggagcacgtactatccccagccctgtctcgatcgcaggggcgtgagcgggatctcgaacgtgtgggggcccgggaccatggtcacggtatcgagc

SEQ ID NO: 55192 - RNA, 435 nt, synthetic construct
  misc_feature 1..435: note = derived and/or modified sequence opt11 from anti-HIV_cap256-206-096276_VR-Chain
  source 1..435: mol_type = other RNA
caggagcagctggtggagagcgggggaggggtggtgccgccggggagtagcttgaggttgagctgcgtggcgagcaggttcacgttcagcgcgtttgggatgcactgggtgaggcaggcgccggggaaagggctggagtgggtggcggggataagtttcgtggggataaagaagtactatgcggatagcgtgaaagggaggtttacgataagcagggacaatagcaagaacacgctgtttctgcagatgaatgggttgaggggggaggatacggggctgtattactgcgtgaaggacatgagagagctggagtgcgaggaatggaggagtgactattacgatttcgggaagccgaaccagccgtatctggataggaggggggtgagcgggataagtgcattttgggggcaggggacgatggtgacggtgagtagc

SEQ ID NO: 55193 - RNA, 438 nt, synthetic construct
  misc_feature 1..438: note = derived and/or modified sequence opt11 from anti-HIV_cap256-206-092794_VR-Chain
  source 1..438: mol_type = other RNA
caaatgatgttggtcgagagcgggggcggggtcgtggaaccgggcaggagcttgacactgagctgtgcaacgagtcagttcacattctcgaactatggcatgcactgggtcaggcaagcgcccgggcgcgggctcgagtgggtggcctcgatctcgaacgagggcaataaaaggtaccatggcgagagcgtgtgggggcgctttatcataagcagggacaatagcaagaacacgctctttctccatatgtcgaccttgcgcgcggacgatagcgcgctctatttctgtgtcagggacaggcaagaggacgagtgcgaggaatggtggtcggactattacgcgttcgggcgcgggggaccgtgcaggaaatatcacgggcaagggctcgcgggcatattcgatatcgtgggcaggggcacgctcgtgaccgtgagctcg

SEQ ID NO: 55194 - RNA, 432 nt, synthetic construct
  misc_feature 1..432: note = derived and/or modified sequence opt11 from anti-HIV_cap256-206-086817_VR-Chain
  source 1..432: mol_type = other RNA
caggagcagttggtggagagcggggggggggtggtgccgccggggaagagcttgaggttgagttgtgcggcgagtgggtttagttttggggcgtttgggatgcattgggtgaggcaggcgccggggaaggggctggagtgggtggcggggataagttttgtggggataaagtattattatgcggatagtgtgaaggggaggtttacgataagtagggacaatagtaagaatacggtgtttctacagatgaatgggttgagaggggatgatacggggaggtattattgtgtgaaggatatgagggagttggagtgtgaggagtggacgagcgattattatgattttgggaagccgcagccgtgtatagataggaggggggtgagtgggataagtgcgatgtgggggcaggggacgatggtgacgataagtagt

SEQ ID NO: 55195 - RNA, 432 nt, synthetic construct
  misc_feature 1..432: note = derived and/or modified sequence opt11 from anti-HIV_cap256-206-086446_VR-Chain
  source 1..432: mol_type = other RNA
caagagcaattggtagagagcgggggcggggtcgtgcccccgggaaagagcttgcgcttgagctgtgtcgcgagcagattcacgttctcggcctttggcatgcactgggtcaggcaagcgcccgggaaagggctcgagtgggtggccgggatatcgttcgtgggcatcaaaaagtactatagcgatgcagtgaaagggcgcttttacataagcagggacaatagcaagaacacgctctttctagagatgaatggcttgcgcggggacgataccgcgcgctattactgtgtcaaggacttgcgcgagctcgagtgcgaggaatgggcctcggactattacgatttcgggaaaccgcaaccgtgcttggactcgcgcggggtctcgggcataagcgcgatgtggggccagggcacgatggtgaccgtgagctcg

SEQ ID NO: 55196 - RNA, 432 nt, synthetic construct
  misc_feature 1..432: note = derived and/or modified sequence opt11 from anti-HIV_cap256-206-086180_VR-Chain
  source 1..432: mol_type = other RNA
caagagcaattggaagagagcgggggcggggtcgtgcccccgggcaagagcttgcgcttgagctgtgtcgcgagcaggttcacgttctcggcatttggcatgcactgggtcagacaagcgcccgggaaagggctcgagtgggtggccgggatatcgttcgtgggcatcaaaaagtactatgccgacagcgtgaaagggcgctttaccataagcagggacaatagcaagaacacgctctttctccagatgaatggcttgcgcggggacgataccgggctctatttctgtgtcaaggacatgcgcgagctagagtgcgagcaatggacctcggactattacgacttcgggaaaccgcaaccgtgcatagacccgcgaggggtctcgggcataagcgcgatgtggggccagggaacgatggtgaccgtaagctcg

SEQ ID NO: 55197 - RNA, 435 nt, synthetic construct
  misc_feature 1..435: note = derived and/or modified sequence opt11 from anti-HIV_cap256-206-083708_VR-Chain
  source 1..435: mol_type = other RNA
caagagcaattggtagagagcgggggcggagtcatacccccgggccagagcctgcgattgagctgtgtcgcgagcaggttcacgttctcggcctttggcatgcactgggtaaggcaagcgcccgggaaagggctcgagtgggtgagctcggtctcgttcgcgggcatcaaaaagtactatgccgatagcgtgaaagggcgctttttcataagcagggacaatagcaagaacacggtctttctcgagatgaatggcctgcgcggggaagataccgggctctattactgtgtcaaggacatgcgagagctcgagtgcgaggaatgggcctcggactattacgatttcgggaaaccggaccagccctgtctcgatcgcaggggcgtgagcgggatatcggccatgtgggggcaagggaccttggtcatagtctcgagc

SEQ ID NO: 55198 - RNA, 432 nt, synthetic construct
  misc_feature 1..432: note = derived and/or modified sequence opt11 from anti-HIV_cap256-206-079556_VR-Chain
  source 1..432: mol_type = other RNA
caagagcaattggtcgagagcgggggcggggtcgtgcccccgggcaagagcttgcgcttgagctgtgtcgcgagcgggttcacgttctcgggctttggaatgcactgggtaaggcaagcgcccgggaaagggctcgagtgggtggccgggatctcgttcgtgggcataaaatattactatgccgatagcgtgaaagggcgctttagcataagcagagacaatagcaagaacacgctctttctccagatgaatggcttgcgcggggacgataccgcgctatattactgtgtcaaggacatgcgcgagctcgagtgcgaggaatggacctcggactattacgatttcgggaaaccgcaaccgtgcatagacaggcgcggggtctcgggcataagcgcaatgtggggccagggaacgatggtgaccgtaagctcg

SEQ ID NO: 55199 - RNA, 438 nt, synthetic construct
  misc_feature 1..438: note = derived and/or modified sequence opt11 from anti-HIV_cap256-206-078657_VR-Chain
  source 1..438: mol_type = other RNA
caaatgctcttggtcgagagcgggggcggggtcgtggaaccgggcaggagcttgaccttgagctgtgccacgagtcagttcacgttctcgaactatggcatgcactgggtcaggcaagcgcccgggcgcgggctcgagtgggtggcctcgatctcgaacgagggctcgaaaaagtaccatggagagcccgtgtgggggcgctttatcataagcagggacaatagcaagaaaacgctctttctccatatgtcgaacttgcgcgtggacgatagcgcgctctatttctgtgtcagggacaggcaagaggacgagtgcgaggaatggtggtcggactattacgcgttcgggcgcgggggcccgtgcaggaaatatcacgggcaagggctcgcgggcatattcgatatctggggcaggggcacgatggtgaccgtgagctcg

SEQ ID NO: 55200 - RNA, 438 nt, synthetic construct
  misc_feature 1..438: note = derived and/or modified sequence opt11 from anti-HIV_cap256-206-075802_VR-Chain
  source 1..438: mol_type = other RNA
caaatgctcttggtagagagcgggggcgatgtcgtggaaccgggcaagagcttgaccttgagctgtgccacgagcaggttcacgttctcgaactatggcatgcactgggtaagacaagcgcccgggggcgggctcgagtgggtggcctcgatctcgaacgagggcaataaaaagtaccatggcgagagcgtatgggggcgatttatcataagcagggacaatagcaagaacacgctctttctccatatgtcggccttgcgcacggacgatagcgcgctctatttctgtgtcagagacaggcaagaggacgagtgcgaggaatggtggtcggactattacgcgttcgggcgcgggggcccgtgcaggaaatatcacgggcaagggctcgcgggcatattcgatatctggggcaggggcacgatggtgaccgtgagctcg

SEQ ID NO: 55201 - RNA, 438 nt, synthetic construct
  misc_feature 1..438: note = derived and/or modified sequence opt11 from anti-HIV_cap256-206-069097_VR-Chain
  source 1..438: mol_type = other RNA
caaatgctcttggtcgagagcgggggcggggtcgtggaaccgggcaggagcttgaccttgagctgtgccacgagcaggttcacgttctcgaactatggcatgcactgggtaaggcaagcgcccgggcgcgagctagagtgggtggcatcgatctcgaacgagggcaataaaaagtaccatgccgagagcgtgtgggggcgctttatcataagcagggacaatagcaagaacacgctctttctccatatgtcgaacgtgcgcggggacgatagcgcgctctatttctgtgtcagggacaggcaagaggacgagtgcgaggaatggtggtcggactattacgcgttcgggcgcgggggcccgtgcaggaaatatcacgggcaagggctcgcgggcatattcgatgtctggggcaggggcacggtcgtgaccgtgagctcg

SEQ ID NO: 55202 - RNA, 438 nt, synthetic construct
  misc_feature 1..438: note = derived and/or modified sequence opt11 from anti-HIV_cap256-206-067758_VR-Chain
  source 1..438: mol_type = other RNA
caaatgctcttggtcgagagcgggggcggggtcgtggaaccgggcaggagcttgaccttgagctgtgccgcgagccagttcacgttctcgcactatggcatgcactgggtcaggcaagcgcccgggcgcgggctcgagtgggtggcctcgatctcaaacgagggcaataaaaggtaccatggcgagagcgtgtgggggcgctttatcataagcagggacaatagcaagaacacgctctttctccatatgtcggcattgcgcacggacgatagcgcgctctatttctgtgtcagggacaggcaagaggacgagtgcgaggaatggtggtcggactattacgcgttcgggcgcgggggcccgtgcaggaaatggcacgggcaagggctcgcgggcatattcgatatctggggcaggggcacggtcgtgaccgtgagctcg

SEQ ID NO: 55203 - RNA, 417 nt, synthetic construct
  misc_feature 1..417: note = derived and/or modified sequence opt11 from anti-HIV_cap256-206-057019_VR-Chain
  source 1..417: mol_type = other RNA
caagagaaattggtcgagagcgggggcggggccgtgcaaccgggcgggagcttgcgcttgagctgtgtcgcgagcgggttctcgttctcgggctatggcatgcactgggtcaggcaagcgcccgggaaagggctagagtggctggccacgatctcgttctcgggcgtgaaaaagtactatggcacgagcgcgaaagggcgcttttacatatacagggacaataccaagaacacgatgtatctcgagatgaatggcttgcgcggggaagataccgcgctatattactgtgcaaaggacttgcgctatctcgagtgcggggaatggagcacgtactatccccagccctgtctcgataccaggggcgtgagcggaatctcgaacgtgtgggggcccgggaccatggtcacggtctcgagc

SEQ ID NO: 55204 - RNA, 438 nt, synthetic construct
  misc_feature 1..438: note = derived and/or modified sequence opt11 from anti-HIV_cap256-206-055385_VR-Chain
  source 1..438: mol_type = other RNA
caaatgatgttggtagagagcgggggcggggtcgtggaaccgggcaggagcttgacattgagctgtgccgcgagcaagttcacgttctcgaactatggcatgcactgggtcaggcaagcgcccgggcgcgggctagagtgggtggcatcgatctcgaacgagggcaataaaaagtaccatggcgagcccgtgtgggggcgcttgatcataagcagggacaatagcaagaacacgctctttctccatatgtcggacttgcgcgcggacgatagcgcgctctatttctgtgtcagggacaggcaagaggacgagtgcgaggaatggtggtcgaactattacgcgttcgggcgcgggggcccgtgcagaaaatggcgagggcaagggctcgcgggcatattcgatgtatggggcaggggcacgatggtgaccgtgagctcg

SEQ ID NO: 55205 - RNA, 435 nt, synthetic construct
  misc_feature 1..435: note = derived and/or modified sequence opt11 from anti-HIV_cap256-206-053187_VR-Chain
  source 1..435: mol_type = other RNA
caagagcaactggtagagagcgggggcggggtcgtgcccccgggatcgagcctgcgattgagctgtgtcgcgagcaggttcacgttctcggcctttggcatgcactgggtaaggcaagcgcccgggaaagggctcgagtgggtggcagggatatcgttcgtgggaataaaatattactatgcagatagcgtgaaagggcgatttaccataagcagggacaatagcaagaacacgctctttctccagatgaatggcctgagaggggaagataccggactatattactgtgtaaaggacatgcgcgagctagagtgcgaggaatgggcatcggactattacgatttcgggaaaccgaaccagccatgtctcgatcgcaggggagtgagcgggatatcggcattttgggggcaagggaccatggtcacggtatcgagc

SEQ ID NO: 55206 - RNA, 438 nt, synthetic construct
  misc_feature 1..438: note = derived and/or modified sequence opt11 from anti-HIV_cap256-206-053139_VR-Chain
  source 1..438: mol_type = other RNA
caaatgctcttggtcgagagcgggggcgatgtcgtggaaccgggcaggagcttgaccttgagctgtgccacgagccagttcacgttctcgaactatggcatgcactgggtcaggcaagcgcccgggcgagggctcgagtgggtggcctcgatctcgaacgagggctcgaaaaagtaccatggcgagagcgtgtgggggcgctttatcataagcagggacaatagcaagaacacgctatttctccatatgacgaccctgcgaccggacgatagcgcgctctatttctgtgtcagggacaggcaagaggacgagtgcgaggaatggtggtcggactattacgcgttcgggcgcgggggcccgtgcaggaaatatcacgggcaagggctagcgggcatattcgatatatggggcagaggcacgatggtgaccgtgagctcg

SEQ ID NO: 55207 - RNA, 432 nt, synthetic construct
  misc_feature 1..432: note = derived and/or modified sequence opt11 from anti-HIV_cap256-206-050350_VR-Chain
  source 1..432: mol_type = other RNA
caagagcaattggtcgagagcgggggcggggtcgtgcccccgggcaagagcctgaaattgagctgtgtcgcgagcaggttctcgttcggggcctttggcatgcactgggtaaggcaagcgcccgggaaagggctagagtgggtggccgggatatcgttcgtgggcatcaaaaagtactatgccgatagcgtgaaagggcgcttttacataagcagggacaatagcaagaacacggtctttctcgagatgaatgccttgcgcggggaagataccgcgctctatcactgtgtcaaggacatgcgcgagctcgagtgcgaggaatgggcctcggactattacgatttcgggaaaccgcaaccgtgcttggacaggcgcggggtctcgggcataagcgcgatgtggggcccgggaacgatggtgatagtgagctcg

SEQ ID NO: 55208 - RNA, 432 nt, synthetic construct
  misc_feature 1..432: note = derived and/or modified sequence opt11 from anti-HIV_cap256-206-046207_VR-Chain
  source 1..432: mol_type = other RNA
caagagcaattggtcgagagcggaggcggggtagtgcccccgggaacgagcttgcgcttgagctgtgtcgcgagcaggttcacgttctcggcctttggcatgcactgggtcaggcaagcgcccgggaaaggactcgagtgggtggccgggatatcattcgcgggcatcaaaaagtactatgccgatagcgtgaaagggcgctttaccataagcagggacaatagcaagaactcgctatttctcgagatgaatggcctgcgaggggacgataccgcgctctattactgtgtcaaggacttgcgctatctcgagtgcgagctctggacctcggactattacgatttcgggcgaccgcaaccgtgcatagactcgcgcggggtctcgggaataagcgcgatgtggggcccgggcacgatggtgaccgtgagcgcg

SEQ ID NO: 55209 - RNA, 417 nt, synthetic construct
  misc_feature 1..417: note = derived and/or modified sequence opt11 from anti-HIV_cap256-206-043389_VR-Chain
  source 1..417: mol_type = other RNA
caagaaaaactagtcgaatccggcggcggcgccgtccaacccggcggcagcctccgcctatcctgcgtcgccagcggcttcaccttctccggcttcggcatgcactggttccgacaagcccccggcaaaggcctcgaatgggtcgccacaatctcattctccggcatcaaaaaatactacaacaccagcgccaaaggccgcttcttcatcagccgcgacaacaccaaagacacactctacctccaaatggacggcctccaagaaaaagacaccgccctctacctctgcgccaaagacctccgctacctcgaatgcggctactggtccacctactacccccaaccctgcctcgacacccgcggcgtctccggaatctcaaacgtctggggccccggcaccatggtcaccgtctcatcc

SEQ ID NO: 55210 - RNA, 432 nt, synthetic construct
  misc_feature 1..432: note = derived and/or modified sequence opt11 from anti-HIV_cap256-206-042555_VR-Chain
  source 1..432: mol_type = other RNA
caagagcaattggtcgagagcgggggcggggtcgtgcccccgggcaagagcttgcgcttgagctgtgtcgtgagcgggttcacgttctcggcctttggcatgcactgggtcaggcaagcgcccgggaaagggctcgagtgggtggccgggatctcgttcgcgggcacgaaatcgtactatgccgagagcgtgaaagggcgatttaccataagcagggacaatagcaagaactcgctctttctccagatgaatggcttgcgcggggacgataccgcactctattactgtgtcaaggacatgcgcgagctcgagtgcgagctctggacctcggactattacgatttcgggcgcccgcaaccgtgcatagacaggcgcggagtctcgggcataagcgcgatgtggggccagggcacgatggtgaccataagctcg

SEQ ID NO: 55211 - RNA, 432 nt, synthetic construct
  misc_feature 1..432: note = derived and/or modified sequence opt11 from anti-HIV_cap256-206-029720_VR-Chain
  source 1..432: mol_type = other RNA
caagagaaattggtcgagagcgggggcggggtcgtgcaaccgggcaggagcttgaccttgagctgtgtcgcgagccatttcacattctcgggcgtgggcatgcactgggtcagacaagcgcccgggaaagggctcgagtgggtggccgggatatcgttcgcgggcacgcgcaagtactatgccgatagcgtgaaagggcgctttaccataagcagggacaatagcaagaacacggtctatctccagatgaatggcttgcgcggggaagataccgcgctctatcactgtgccaaggacttgcgcgagctcgagtgcgagctctggacctcggactattacgacttcgggcgcccgcaaccgtgcatagacaggcgcggggtctcgggcatatgcgatatgtggggccagggcacgatggtgatagtgagctcg

SEQ ID NO: 55212 - RNA, 432 nt, synthetic construct
  misc_feature 1..432: note = derived and/or modified sequence opt11 from anti-HIV_cap256-206-028848_VR-Chain
  source 1..432: mol_type = other RNA
caagagcaattggtcgagagcgggggcggggtcgtgccaccgggcaagagcttgcgcctgagctgtgtcgcgagcgggttcacgttctcgggctttggcatgcactgggtcaggcaagcgcccgggaaagggctccagtgggtggccgggatctcgttcgcgggcacgaaatattactatgaagatagcgtgaaagggcgctttaccataagcagggacaatagcaagaacacggtctttctccagatgaatggattgcgaggggacgatacagcgctatattactgtgtcaaggacatgcgagagctcgagtgcgaggaatggacctcggactattacgatttcgggaaaccgcaaccgtgcatagacaggcgcggggtctcgggcataagcgcgatgtggggccagggcacgatggtgaccataagctcg

SEQ ID NO: 55213 - RNA, 432 nt, synthetic construct
  misc_feature 1..432: note = derived and/or modified sequence opt11 from anti-HIV_cap256-206-027652_VR-Chain
  source 1..432: mol_type = other RNA
caagagcaattggtagtgagcgggggagatgtcgtgcccccgggcaagagcttgcgcttgagctgtgtcgcgagcgggttcacattctcggcctttggcatgcactgggtcaggcaagcgcccgggaaagggctcgagtgggtggcctcgatctcgttcgcgggcacgaaatattactatgccgatagcgtgaaagggcgctttgccataagcagagacaatagcaagaacacgctctttctccagatgaatggcttgcgcagggaagatacagggctctattactgtgtcaaggacatgcgccagctcgagtgcgaggaatggacctcggactattacgatttcgggcgcccgcaaccgtgcatagacaggcgcggggtctcgggcataagcgcaatgtggggccagggcacgatggtgaccataagctcg

SEQ ID NO: 55214 - RNA, 417 nt, synthetic construct
  misc_feature 1..417: note = derived and/or modified sequence opt11 from anti-HIV_cap256-206-024075_VR-Chain
  source 1..417: mol_type = other RNA
caagagaaattggtcgagagcgggggcggggccgtgcaaccgggcgggagcttgcgcttgagctgtgtcgcgagcgggttcacgttctcgggctttggcatgcactgggtcaggcaagcgcccgggaaagggctagagtggttggccacgatctcgttctcgggcgtgaaaaagtactatggcacgagcgcgaaagggcgcttttacataagcagagacaataccaagaacacggtctatctccagatggatggcttgcgcggggacgataccgcgatctattactgtgccaaggacttgcgctttctcgagtgcgggctctggagcacgtactatccccagccatgtctcgataccaggggcgtgagcgggatctcgaacgtgtgggggcccgggaccatggtcacggtctcgagc

SEQ ID NO: 55215 - RNA, 417 nt, synthetic construct
  misc_feature 1..417: note = derived and/or modified sequence opt11 from anti-HIV_cap256-206-008748_VR-Chain
  source 1..417: mol_type = other RNA
caagagaaattggtcgagagcgggggcggggccgtgcaaccgggcgggagcttgcgcttgagctgtgtcgcgagtgggttcacgttcaatggctttggcatgcactgggtcaggcaagcgcccgggaaagggctcgagtgggtggccacgatctcgttctcgggagtgaaaaagtactatggcacgagcgcgaaagggcgctttttcataagcagggaaaatagcaagaacacgctatatctacagatgaatggcttgcgaggggaagatacagcgctctattactgtgccaaggacttgcgctatctcgagtgcggggaatggagcacgtactatccccagccctgtctagataccaggggcgtgagcgggatctcgaacgtgtgggggcccgggaccagggtcacggtctcgagc

SEQ ID NO: 55216 - RNA, 432 nt, synthetic construct
  misc_feature 1..432: note = derived and/or modified sequence opt11 from anti-HIV_cap256-206-008530_VR-Chain
  source 1..432: mol_type = other RNA
caagagcaattggtcgagagcgggggcggggtcgtgcccccgggcaagagcttgcgcttgagctgtgtcgcgagcgggttctcgttcggggcctttggcatgcactgggtcaggcaagcgcccgggaaagggctcgagtgggtggccgggatctcgttcgtgggcataaaatattactatgccgatagcgtgaaagggcgctttaccataagcagggacaatagcaagaaaacgctctttctccagatgaatggcttgcgcggggacgataccgcgctatattactgtgtcaaggacatgcgcgagctcgagtgcgaggaatggacctcggactattacgatttcgggaaaccgcaaccgtgcatagacaggcgcggggtctcgggcataagcgcgttctggggccagggcacgatggtgaccataagctcg

SEQ ID NO: 55217 - RNA, 432 nt, synthetic construct
  misc_feature 1..432: note = derived and/or modified sequence opt11 from anti-HIV_cap256-176-723043_VR-Chain
  source 1..432: mol_type = other RNA
caagagcaattggtcgagagcgggggcggggtcgtgccaccgggcaagagcttgcgattgagctgtgtcgcgagcgggttcacgttctcagcctttggcatgcactgggtcaggcaagcgcccgggaaagggctcgagtgggtggccggggtctcgttcgcgggcataaaatattactatgccgatagcgtgaaagggcgctttaccataagcagagacaatagcaagaacacgctctttctacagatgaatggcttgcgcggggacgataccgcgctctattactgtgtcaaggacttgcgcgagctagagtgcgaggaatggacctcggactattacgatttcgggcgcccgcaaccgtgcatagacccgcgcggggtctcgggcataagcgcgatgtggggccagggcacggtcgtgaccataagctcg

SEQ ID NO: 55218 - RNA, 432 nt, synthetic construct
  misc_feature 1..432: note = derived and/or modified sequence opt11 from anti-HIV_cap256-176-600049_VR-Chain
  source 1..432: mol_type = other RNA
gaagtgcaattggtccagagcgggggcggggtcgtgcaaccgggcaggagcttgcgcttgagctgtgccgcgccatatttcgagttcgggcgctacggctttcactgggtcaggcaagcgcccgggaaagggctagagtgggtggcctcgatctcgttcgcgggcaggggctattaccatagcccgagcgtgtgggggcgatttaccataagcagggacaatagcaagaacacgctctatctccagatgaatagcttgcgcatagaagataccgcgctctatttctgtgccagggacttgcgcgagagcgagtgcgaggaatgggaatcggactattacgatttcgggaaaaagggcccgtgcgtgaaaccgcgcggggtcgcgggcgggctcgacctctggggccagggcacgatggtgatcgtgagctcg

SEQ ID NO: 55219 - RNA, 432 nt, synthetic construct
  misc_feature 1..432: note = derived and/or modified sequence opt11 from anti-HIV_cap256-176-531926_VR-Chain
  source 1..432: mol_type = other RNA
caagtgcaactggtcgagagcgggggcggggtcgtgcccccgggcaagagcttgaccttgagctgtgtcgcgagcaggttcacgttctcggcctttggcatgcactgggtcaggcaagcgcccgggaaagggctagagtgggtggccgggatctcgttcgtgggcatacgcaagtactatgccgatagcgtgaaagggcgctttagcataagcagggacaatagcaagaacacggtctttctcgagatgaatggattgcgaggggaagataccgggctctattactgtgtcaaggacatgcgcgagctcgagtgcgaggaatgggcctcggactattacgatttcgggaaaccgcaaccgtgcttggacaggcgcggggtctcgggcataagcgcgatgtggggccagggcacgctcgtgatcataagctca

SEQ ID NO: 55220 - RNA, 432 nt, synthetic construct
  misc_feature 1..432: note = derived and/or modified sequence opt11 from anti-HIV_cap256-176-504134_VR-Chain
  source 1..432: mol_type = other RNA
gaagtgcaactggtcgagagcgggggcggggtcgtgcccccgggaaagagcctgcgcttgagctgtgtcacgagcagactcgcgttcggggcctttggcatgcactgggtcaggcaagcgccagggaaagggctcgagtgggtggcatcgatatcgttcgcgggcatcaaaaagtactatgccgacagcgtgaaagggcgctttaccataagcagggacaatagcaaggacacggtctttctcgagatgaatggcttgcgcggggacgataccgggctctattactgtgtcaaggacatgcgctatctcgagtgcgaggaatgggcctcggactattacgatttcgggcgcccgcaaccgtgcttggacccgcgcggggtctcgggcataagcgcgatgtggggacagggcacgctcgtgataataagctcg

SEQ ID NO: 55221 - RNA, 432 nt, synthetic construct
  misc_feature 1..432: note = derived and/or modified sequence opt11 from anti-HIV_cap256-119-186229_VR-Chain
  source 1..432: mol_type = other RNA
caaatgcaattggtcgagagcgggggcggggtcgtgcaaccgggcgggagcttgcgattgctctgtagcgcaagcgggttcacgttctcgacctatggcatgcactgggtcaggcaagcgcccgggaaagggctcgagtgggtggcctcgatctcgtacgatggctcggacaagtaccatgcagggctcgtgtgggggcgctttatcataagcagggacaatagcaagaacacgctctatctccagatgaatagcttgcgcgcggaagataccgcgctctattactgtgtcagggacgagcgcgagagcgagtgcgagctctgggaatcggactactacaatttcgggaaaaagctaccgtgcgtgaaaccgcgcggggtagcgggcacgctcgatatctggggccagggcacgaccgtgatcgtgagctcg

SEQ ID NO: 55222 - RNA, 432 nt, synthetic construct
  misc_feature 1..432: note = derived and/or modified sequence opt11 from anti-HIV_cap256-119-183891_VR-Chain
  source 1..432: mol_type = other RNA
caagtgcaactggtcgagagcgggggcggggtcgtgcaaccgggagggagcttgcgcttgagctgtgccgcaagcgggttcacgttctcgagctatggcatgcactgggtcaggcaagcgcccgggaaagggctcgagtgggtggcctttaccaggtacgatggctcggacaagtactatctagatagcgtgaaagggcgctttaccataagcagagacaatagcaagtacacgctctttctccagatggtgagcttgcgcacggaagataccgcgctctatttctgtgccagggacttgcgcgagagcgagtgcgaggaatgggaatcgtactattacgatttcgggaaaaagggcccgtgcgtgaaaccgcgcggggtcgtgggcgtgctcgatatctggggccagggcacgctcgtgaccgtgagctcg

SEQ ID NO: 55223 - RNA, 435 nt, synthetic construct
  misc_feature 1..435: note = derived and/or modified sequence opt11 from anti-HIV_cap256-119-183631_VR-Chain
  source 1..435: mol_type = other RNA
caagtccaactcgtccaaagcggcggcggagtcgtacaacccggccgcagcctgcgcctcagctgcgccgcaagcaaattcacattctccacctacaccctccactgggtcagacaagcccccggaaaaggactcgaatgggtcgccgtaatctcacacgacggcggcaaccgattctacgccgacagcgtcaaaggccgcttcacaatcagccgcgacaactccaaaaacaacctcttcctccaaatgaactccctccgcgtagaagacaccgcactctactactgcgccagagacctccgagaaatggaatgcgaagaatggaccctctacaactactacgacttcggctcacgcggcccctgcgtcgacccccgaggcgtcgtcggcagcttcgacgtctggggccaaggcaccatggtcacagtctcatcc

SEQ ID NO: 55224 - RNA, 432 nt, synthetic construct
  misc_feature 1..432: note = derived and/or modified sequence opt11 from anti-HIV_cap256-119-182676_VR-Chain
  source 1..432: mol_type = other RNA
caagtgcaattggtcgagagcgggggcggggtcgtgcaaccgggcaagagcttgcgcttgagctgtgtcgtgagcgggttcacgttctcgaactatcccatgcactgggtcaggcaagcgcccgggaaagggctcgagtgggtggcctcgatatcgttcgcgggcatcaaaaagtactatggcgatagcgtgaaagggcgctttaccataagcagggacaatagcaagaacacgctctatctacagatggatggcttgcgcggggaagataccgcactctattactgtgccaaggacttgcgagagctcgagtgcgaggaatgggcctcggactattacgatttcgggcgcccgcaaccgtgcttggacccgcgcggggtctcgggcataagcaatgtctggggccagggcacgatggtgaccgtgagctcg

SEQ ID NO: 55225 - RNA, 432 nt, synthetic construct
  misc_feature 1..432: note = derived and/or modified sequence opt11 from anti-HIV_cap256-119-180772_VR-Chain
  source 1..432: mol_type = other RNA
caagtgcaattggtcgagagcgggggcggggtcgtgcaaccgggcaggagcttgcgcttgagctgtgccgcgagcgagttcacgttctcgaactatgccatgcactgggtcaggcaagcgcccgggaaagggctagagtgggtggcctcgatctcgttcgatggcagggacaagtaccatagctcgctagtgtgggggcgcttgaccataagcagggacaatagcaagagcacgctctttctccagatgaatagcttgcgcccggaagataccgcgctatattactgtgccagggacgtgcgagagagcgagtgcgaggaatggcaatcagactattacgcgttctatcgcaagctcccgtgcgtgaaaccgcgaggggtcgcgggaacgctcgatatctggggccagggcacgatggtgaccgtgagctcg

SEQ ID NO: 55226 - RNA, 435 nt, synthetic construct
  misc_feature 1..435: note = derived and/or modified sequence opt11 from anti-HIV_cap256-119-180508_VR-Chain
  source 1..435: mol_type = other RNA
caagtgcacttggtcgagagcgggggcggggtcgtgcaaccgggaaggagcttgcgattgagctgtgccgcgagccatttctcgctctcgagctatggcatgcactgggtcaggcaaacgcccgggaaagggctcgagtgggtggccgggatctcgttcgcgggcgtgaaaacatactatggcacgagcgtgaaagggcgctttaccataagcagggacaatagcaagaacaatctatatctccagatgaatagcttgcgcccagaagataccgcgctctattactgtgccagggacttgcgcgagatggagtgcgaggaatggaaactgtacaattactatgactttcgcacgcgaggaccctgtgtcgatcccagaggagtggtcgggagctttgacgtgtgggggcaagggaccgtggtcacggtctcgagc

SEQ ID NO: 55227 - RNA, 432 nt, synthetic construct
  misc_feature 1..432: note = derived and/or modified sequence opt11 from anti-HIV_cap256-119-180260_VR-Chain
  source 1..432: mol_type = other RNA
gaagtgcaattggtcgagagcgggggcggggtcgtgcgaccgggcgggagcttgcgcttgagctgtgccgcgagccagttcacattctcgaactttggcatgcactgggtcaggcaagcgcccgggaaagggctcgagtgggtggcctcgatctcgttcgtgggaataaaaacgcactatgccaatagcgtgcgcgggcgctttaccataagcagggaccagagcaagaacacgctctatctccagatgaatagcgtgcgcgtggaagataccgggcgctattactgtgccagggacatgcgcgagtacgagtgcgagctctgggcctcggactattacgatttcgggaaaccgcaaccgtgcgaggacccgcgcggggtcgtgggcacgttcgatatgtggggcttgggcacgctcgtgaccgtgagctcg

SEQ ID NO: 55228 - RNA, 432 nt, synthetic construct
  misc_feature 1..432: note = derived and/or modified sequence opt11 from anti-HIV_cap256-119-180173_VR-Chain
  source 1..432: mol_type = other RNA
gaagtgcaattggtcgagagcgggggcgggctcgtgcaaccgggcgggagcctgcgcttgagctgtgccgcgagcgggttcacggtatcgagcaattacatgagctgggtcaggcaagcgcccgggaaagggctcgagtgggtggcctcgatctcgttcgcgggcacgaaaaagcactatggcaatagcgtgaaagggcgctttaccataagcagggacaatagcaagaacacgctctatctccagatgaatagcttgcgcggggaagataccgcgctatattactgtgccaaggacttgcgcgagtacgagtgcgaggaatggacctcggactattacgatttcgggcgcccgcaaccgtgcatagactcgcgcggggtcgtgggcatactcgatatctggagccagggcacgatggtgaccgtgagctcg

SEQ ID NO: 55229 - RNA, 432 nt, synthetic construct
  misc_feature 1..432: note = derived and/or modified sequence opt11 from anti-HIV_cap256-119-179839_VR-Chain
  source 1..432: mol_type = other RNA
caagtgcaattggtcgagagcgggggcggggtcgtgcaaccgggcaggagtttgcgcttgagctgtgccgcgagcgggttctcgttcgggacctcggacgtgcactgggtcaggcaagcgcccggggaagggctcgagtgggtggccttgatctcgttcgatggcaggcaaaaggacttggccgatagcgtgcgcgggcgctttaccataagtagggactcgagcaagaacacgctctatctcgagatgaatagcttgcgcccggaagatacagcgctatattactgtgccaaggacatgcgagggtacgagtgcgaggaatggacctcggactattacgatttcgggcgcccgcaaccgtgcatagactcgcgcggggtcgtgggcacgttcgatgtctggggccagggcacgatggtgaccgtgagctcg

SEQ ID NO: 55230 - RNA, 423 nt, synthetic construct
  misc_feature 1..423: note = derived and/or modified sequence opt11 from anti-HIV_cap256-119-179262_VR-Chain
  source 1..423: mol_type = other RNA
caggtacagctcgtggaatcgggcgggcgcgtggtccagagcgggggctcgctcaggctctcgtgcggggcctcgggctttagctttaccacgagtgcgatgcattgggtgcgccaggccccgggcaagggcttggaatgggtcgcgatcaatggcgcgaacaagcactatgccgagagcgtgaaagggcgctttaccataagcagggacaatagcaagaacacgctctttctcgagatgaatagcttgcgcccggacgataccgcgctctatttctgtgtcaaggaccagcgcgaggacgagtgcgaggaatggtggtcggactattacgatttcgggcgcgagcaaccgtgcttggacccgcgcggggtcgtgggcatattcgatctctggggccagggcacgatggtgaccgtaagctcg

SEQ ID NO: 55231 - RNA, 432 nt, synthetic construct
  misc_feature 1..432: note = derived and/or modified sequence opt11 from anti-HIV_cap256-119-178995_VR-Chain
  source 1..432: mol_type = other RNA
caagtgcaattggtcgagagcgggggcggggtcgtgcaaccgggcaagagcttgcgcttgagctgtgccgcgagcgggttcacgctcacgcgctttgccatgcactgggtcaggcaagcgcccgggaaagggctcgagtgggtggcagtgatctggtacgatggctcgaacaagtactatgccgatagcgtgaaagggcgctttaccgtgagcagagacaatagcaagaacacgctctatctccagatgaatagcctgcgcacggaagataccgcgctctattactgtgtcagggacaggcgcgagagcgagtgcgagctatgggaatcagactattacaatttcgggcgcaggctaccgtgcgtgaaaccgcgcggggtcgcaggcatactcgatatctggggccagggcacgaccgtgaccgtgagcccg

SEQ ID NO: 55232 - RNA, 432 nt, synthetic construct
  misc_feature 1..432: note = derived and/or modified sequence opt11 from anti-HIV_cap256-119-178455_VR-Chain
  source 1..432: mol_type = other RNA
gaagtgcaattggtagagagcgggggcgggctcgtgcaaccgggcgggagcttgcgcttgagctgtgtcgtgagcgggttcacgttctcaaacttttggatgagctgggtcaggcaagcgcccgggaaagggctcgagtgggtggcctcgatctcatacgatggcagggacaagtaccacagctcgctcgtgtgggggcgattgaccataagcagggacaatagcaagagcacgctatttctccagatgaatagcctgcgcgcggaagataccgcgctctattactgtgccagggacttgcgcgagagcgagtgcgaggaatggcaatcggactattacgcgttctataaaaagctcccgtgcgtgaaaccgcgcggggtcgcgggcacgctcgatatctggggccagggcacgatggtgaccgtgagctcg

SEQ ID NO: 55233 - RNA, 438 nt, synthetic construct
  misc_feature 1..438: note = derived and/or modified sequence opt11 from anti-HIV_cap256-119-177993_VR-Chain
  source 1..438: mol_type = other RNA
caagtgcacctggtcgagagcgggggcggggtcgtgcaaccgggcaagagcttgcgaatatactgcgccgtgagcgagttcacgttctcgaactatgccatgcactgggtaaggctcgcgcccgggcgcgggctccagtggttggccgtgatctcgtacgatggctcgaaaaagtactatgccgatagcctggaagggcgctttaccataagcaaggacaatagcaagaacacactctttctccagatgaatagcctgcgcgtggaagataccgcgctctatttctgtgtcaaggaccagcgcgaggacgagtgcgaggaatggtggtcggactattacgatttcggggaaagggcaccgctcccgaaagtgcccgggcccgggcccgggtggaatctcgatatgtggggccatggcacgatggtgaccgtgagctcg

SEQ ID NO: 55234 - RNA, 438 nt, synthetic construct
  misc_feature 1..438: note = derived and/or modified sequence opt11 from anti-HIV_cap256-119-177727_VR-Chain
  source 1..438: mol_type = other RNA
caagtgcaattggtcgagagcgggggcggggtcgtgcaaccgggcaggagcttgcgcttgagctgtgccgcgagcgggttcacgctctcgcgctatgacatgcactgggtcaggcaagcgcccgggaaaggactcgagtgggtggcctcgatctcgaaagacggcacgaaaaagtaccatggcgatagcgtgtgggggcgctttatcataagcagggacaatagcaagaacacgctctttctccagatgtcgagcttgcgcgcggaagataccgcgctatatttctgtgtcagggaccagcgagaggccgagtgcgaggaatggtggtcggactattacgatttcgggcgcgagctcccgtgcaggaaatttcgcgggctcgggctcgcgggcatattcgatatctggggccatggcacgatggtgaccgtgagctcg

SEQ ID NO: 55235 - RNA, 432 nt, synthetic construct
  misc_feature 1..432: note = derived and/or modified sequence opt11 from anti-HIV_cap256-119-176746_VR-Chain
  source 1..432: mol_type = other RNA
gaagtgcaattggtcgagagcgggggcgggctcgtgcaaccgggcgggagcttgcgcttgagctgtgccgcgagcgatttcacattcgatgactatgccatgcactgggtcaggcaagcgcccgggaaagggctagagtgggtgggcggaatctcgtacgatggctcggacaagtaccataccaatagcgtgtgggggcgctttatcgtgagcagggacaatagcaagaacacgctctatctccagatgaatagcctgcgcccggaagataccgcgctctattactgtgtcagggacaggcgcgagagcgagtgcgaggaaaggtggtcggactattacgatttcgggaaacagctcccgtgcgtgaaaccgcgcggggtcgcgggcatattcgatatctggggacagggcacgatggtgaccgtgagctcg

SEQ ID NO: 55236 - RNA, 432 nt, synthetic construct
  misc_feature 1..432: note = derived and/or modified sequence opt11 from anti-HIV_cap256-119-176241_VR-Chain
  source 1..432: mol_type = other RNA
caagtgcaattggtcgagagcgggggcggggtcgtgcaaccgggcaggagcttgcgcttaagctgtgccgcgagcgggttcacgttctcgaactatgccatgcactgggtcaggcaagcgcccgggaaagggctcgagtgggtggccgtgatctcgtacgatggatcgaacaagtactatgccgatagcgtgaaagggcgctttaccataagcagggacaatagcaagaacacgctctatctccagatggatggcttgcgcggggaagataccgcgctctattactgtgccaaggacctgcgcgagctcgagtgcgaggaatgggcatcggactattacgatttcgggcgcccgcaaccgtgcttggacccgcgcggggtctcgggcataagcaatgtctggggccagggcacgatggtgaccgtgagctcg

SEQ ID NO: 55237 - RNA, 432 nt, synthetic construct
  misc_feature 1..432: note = derived and/or modified sequence opt11 from anti-HIV_cap256-119-175215_VR-Chain
  source 1..432: mol_type = other RNA
caagtgcaattggtcgagagcgggggcggggtcgtgcaaccgggccgcagcttgagactgagctgtgcagtgagccagttcacgttcgggcgctatggcatgtactgggtcaggcaagcgcccgggaaagggctagagtgggtggccgggatctcgtacgatggctcggacaagtaccataccaatagcgtgtgggggcgctttatcgtgagcagggacaatagcaagaacatgctatatctccagatgaataacttgcgcccggaagataccgcgctctattactgtgtcagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctca

SEQ ID NO: 55238 - RNA, 432 nt, synthetic construct
  misc_feature 1..432: note = derived and/or modified sequence opt11 from anti-HIV_cap256-119-173928_VR-Chain
  source 1..432: mol_type = other RNA
ggagtggaattgctagagagcgggggcgggctcgtggaaccgggcgggagcctgcgattgagctgtgtcgggagccagttctcattcgatagatatggcatgcactgggtcagacaagcgcccgggaaagggctcgagtgggtggccgcggtctcgttcgatggcacggacaagtaccatgccgatgacgtgtgggggcgctttaccataagcagggacaatagcaagaacacgctctatctccagatgaatagcttacgcgcggaagataccgcgctctattactgtgccaaggacttgcgcgaggacgagtgcgaggaatggtggtcggactattacgatctcgggaaacagctcccgtgcaggaaatcgcgcggggtcgcgggcgtgctcgataaatggggcctgggcacgatggtgaccgtgagctcg

SEQ ID NO: 55239 - RNA, 432 nt, synthetic construct
  misc_feature 1..432: note = derived and/or modified sequence opt11 from anti-HIV_cap256-119-173495_VR-Chain
  source 1..432: mol_type = other RNA
caagtgcaattggtcgagagcgggggcggggtcgtgcaaccgggcaagagcttgcgcttgagctgtgccgcgagcaggttcacgttcaatcgctatggcatgcactgggtcaggcaagcgcccgggaaagggctcgagtgggtggccgcgatctcgttcgatggcacggacaagtaccatagcgatgacgtgtgggggcgctttacaataagcagggacaatagcaagaacacgctctatctccagatgaatagcttgcgcgcggaagataccgcggtctattactgtgccaaggacttgcgagaggacgagtgcgaggaaaggtggtcggactattacgatttcgggaaacagctcccgtgcaggaaatcgcgcggagtcgcgggcatattcgataactggggccagggcacgatggtgaccgtaagctcg

SEQ ID NO: 55240 - RNA, 432 nt, synthetic construct
  misc_feature 1..432: note = derived and/or modified sequence opt11 from anti-HIV_cap256-119-172882_VR-Chain
  source 1..432: mol_type = other RNA
caagtgcaattggtcgagagcgggggcggggtcgtgcaaccgggcaggagcttgaccttgagctgtgaagtgagcgggttcacgttcaagacctatggcatgcactgggtcaggcaagcgcccgggaaagggctcgagtgggtggcctcaatctcgtacgatggctcggacaagtaccatgccgatcgcgtgtgggggcgctttaccataagcagggacaatagcaagaacacgctctatctccagatgaatagcctgcgcgcggaagataccgcgctctattactgtgtcagggacgcgcgagagagcgagtgcgagctctgggaatcagactattacaatttcgggcgaaagctcccgtgcgtgaaaccgcgaggggtagcgggcacgctcgatatctggggccagggcacgatggtgaccgtgagctcg

SEQ ID NO: 55241 - RNA, 432 nt, synthetic construct
  misc_feature 1..432: note = derived and/or modified sequence opt11 from anti-HIV_cap256-119-172429_VR-Chain
  source 1..432: mol_type = other RNA
gaagtgcaattggtcgagaccgggggcgggctcatacaaccgggcgggagcttgcgcttgagctgtgtcgcgagccagttcacgttctcgggatgtggcctgcactgggtaaggcaagcgcccgggaaagggctcgagtgggtggcctcgatctcgttcgcgggcacgaaaaagcactatggcaatagcgtgaaagggcgctttacaataagcagggacaatagcaagaacacgctctacctcgagatgaataccttgcgcgcggaagataccgcgctctattactgtgccaaggacttgcgcgagtacgagtgcgaggaatggacctcggactattacgatttcgggcgcccgcaaccgtgcatagactcgcgcggggtcgtgggcatactcgatatctggggccagggcacgatggtgagcgtaagctcg

SEQ ID NO: 55242 - RNA, 432 nt, synthetic construct
  misc_feature 1..432: note = derived and/or modified sequence opt11 from anti-HIV_cap256-119-172223_VR-Chain
  source 1..432: mol_type = other RNA
caagtgcaattggtcgagagcgggggaggggtcgtgcaaccgggcaggagcttgcgcttgagctgtgccgcgagcgggttcacgttctcgagctatgccatgcactgggtcaggcaagcgcccgggaaagggctcgagtgggtggccgtgatctcgtacgatggcagggacttttaccatgccaggagcgtgtgggggcgctttaccataagcagggacaatagcaagaacacgctccatctacagatgaatagcttgcgcccggaagataccgcgctctatttctgtgccagggacttgcgagagagcgagtgcgaggaatgggaatcgtactattacgatttcgggaaaaaggacccatgcgtgaaaccgcgcggggtcgtgggcgtgctagatatctggggacagggcaccctagtgacagtgagctcg

SEQ ID NO: 55243 - RNA, 432 nt, synthetic construct
  misc_feature 1..432: note = derived and/or modified sequence opt11 from anti-HIV_cap256-119-171838_VR-Chain
  source 1..432: mol_type = other RNA
caagtgcaattgggcgagagcgggggaggggtcgtgcaaccgggcaggagcttgcgattgagctgtgccgcgagcgggttcacgttctcgacctttgcaatgcactgggtcaggcaagcgccagggaaagggctcgagtgggtggccgtgatctcgtacgatggctcgaacaagtactatgccgatagcgtaaaagggcgctttgccataagcagggacaatgccaagaacttgctacatctccagatgaatagcttgcgcccggaagataccgcgctctattactgtgccaaggacttgcaagaggacgagtgcgaggaatggtggtcggactattacgatttcgggaaacagctcccgtgcaggaaatcgcgcggggtcgcgggcatattcgatgactggggccagggcacgatggtgaccgtgagctcg

SEQ ID NO: 55244 - RNA, 432 nt, synthetic construct
  misc_feature 1..432: note = derived and/or modified sequence opt11 from anti-HIV_cap256-119-171587_VR-Chain
  source 1..432: mol_type = other RNA
gaagtgcaattggtcgagagcgggggcgggctcgtgcaaccgggcgggagcttgcgcttgagctgtgccgcaagcgggttcacgttctcggactattacatgagctggatcaggcaagcgcccgggaaagggctcgagtgggtggcctcgatctcgttcgcgggcacgaaacagcactatggcaatagcgtgaaagggcgctttaccataagcagggacaatagcaagaacacggtctatctccagatgaatagcctgcgcttggaagataccgcgctctattactgtgccaaggacttgcgagagtacgagtgcgaggaatggacatcggactattacgatttcgggcgcccgcaaccgtgcatagactcgcgcggggtcgtgggcatactagacatctggggccagggcacgatggtgaccgtgagctcg

SEQ ID NO: 55245 - RNA, 432 nt, synthetic construct
  misc_feature 1..432: note = derived and/or modified sequence opt11 from anti-HIV_cap256-119-169596_VR-Chain
  source 1..432: mol_type = other RNA
ctcgtgcaattggtcgagagcgggggcggggtcgtgcaaccgggcaggagcctgcgcttgagctgtaccgcgagcgggttcacgttctcgagctttgccatgcacagggtcaggcaaacgcccgggaaagggctcgagtgggtggcctcgatctcgtacgatggctcggacaagtaccatgcagatcgcgtgtgggggcgctttaccataagcagggacaatagcaagaacacactctatctccagatgaatagcttgcgcgcggaagatacagcgctctattactgtgtcagggacgcgcgcgagagcgagtgcgagctctgggaatcggactattacaatttcgggcgcaagctcccgtgcgtgaaaccgcgcggggtcgcgggcacgctcgatatctggggccagggcacgatggtgaccgtgagctca

SEQ ID NO: 55246 - RNA, 432 nt, synthetic construct
  misc_feature 1..432: note = derived and/or modified sequence opt11 from anti-HIV_cap256-119-169523_VR-Chain
  source 1..432: mol_type = other RNA
caagtgcaattggtcgagagcgggggcggggtcgtgcaaccgggcgagagcttgcgcttgagctgtgccgcgagcgggttctcgttcgggacctcggacgtgcactgggtcaggcaagcgcccggggaagggctcgagtgggtggcctcgatatcgttcgcgggcatcaaaaagtactatggtgatagcgtgaaagggcgatttaccataagcagggacaatagcaagaacacgctatatctccagatggatggcttgcgcggggaagataccgcgctatattactgtgccaaggacttgcgagagctcgagtgcgaggaatgggcctcggactattacgatttcgggcgcccgcaaccgtgcttggacccgcgcggggtctcgggcataagcaatgtctggggccagggcacgatggtgaccgtgagctcg

SEQ ID NO: 55247 - RNA, 432 nt, synthetic construct
  misc_feature 1..432: note = derived and/or modified sequence opt11 from anti-HIV_cap256-119-169462_VR-Chain
  source 1..432: mol_type = other RNA
gaagtgcaattggtcgagagcgggggcgggctcgtacaaccgggcgggagcttacgcttgagctgtgccgcgagcgggttcacgttcacgacctatagcctgcactgggtcaggcaatcgcccgggaaagggctcgagtgggtggccgcgatctcgttcgcgggcacgaaagagaactatgccaatagcgtgcgcgggcgctttaccataagcagggacaatagcaagaacacgctatatctacagatgaatagcttgcgcgcggaagataccgcgctctattactgtaccaaggacatgcgcgagtacgagtgcgaggaatggacatcggactattacgatttcgggcgcccgcaaccgtgcatagactcgcgcggggtcgtgggcacgttcgatgtctggggccagggcacgatggtgaccgtgagctcg

SEQ ID NO: 55248 - RNA, 432 nt, synthetic construct
  misc_feature 1..432: note = derived and/or modified sequence opt11 from anti-HIV_cap256-119-169092_VR-Chain
  source 1..432: mol_type = other RNA
gaagtgcaattggtcgagagcgggggcgggctcgtgcaaccgggagggagcttgcgcttgagctgtgtaataagcgggttcacgttctcgagctatgaaatgaactgggtaaggcaagcgcccgggaaagggctcgagtgggtggccgggatctcgtacgatggcagggacaagtaccatgcccatttcgtgtgggggcgcataaccataagcagggacaatagcaagaacacgctctatctacagatgaatagcttgcgcgcggaagataccgcgctctatcactgtgtcagggacttgcgcgagagcgagtgcgagctctgggaatcggactattacgatttcgggaaaaagctcccatgcgtgaaaccgcgcggggtcgcgggaatattcgatctctggggccagggcacgatggtgaccgtgagctcg

SEQ ID NO: 55249 - RNA, 432 nt, synthetic construct
  misc_feature 1..432: note = derived and/or modified sequence opt11 from anti-HIV_cap256-119-168680_VR-Chain
  source 1..432: mol_type = other RNA
caagtgcaattggtagagagcgggggcggggtcgtacaaccgggcaggagcttgcgcgtgagctgtgccgcgagccatttcacgttctcgcgctatggcatgcactgggtcaggcaagcgcccgggaaagggctcgagtgggtagcctcgatatcatacgatggcagggacttttaccatgccaggagcgtatgggggcgctttgccataagcagggacaatagcaagaacacgctacatctccagatgaatagcttgcgcacggaagataccgcgctctatcactgtgtcagggacttgcgcgagagcgagtgcgagctctgggaatcggactattacgatttcgggaaaaagctcccgtgcgtgaaaccgcgaggggtcgcgggcacgttcgatctatggggccagggaacgatggtgacagtgagctcg

SEQ ID NO: 55250 - RNA, 438 nt, synthetic construct
  misc_feature 1..438: note = derived and/or modified sequence opt11 from anti-HIV_cap256-119-166385_VR-Chain
  source 1..438: mol_type = other RNA
caagtgcaattggtcgagagcgggggcggggtcgtgcacccgggcaggagcttgcgcctgagctgtgccgcgagcgggttctcgttcgggaactttggcatgcactgggtcaggcaagcgcccgggaaagggctcgagtgggtggcctcgatctcgaacgatggcacgaaaaagtaccatgccgagagcgtgtgggatcgctttagcataagcaaggacaatagcaagaacacgctctttctacagatgaatagcttgcgagtggaagataccgcgctctatttctgtgtcaaggaccagcgagaggacgagtgcgaggaatggtggtcggactattacgatttcgggcgcgagctcccgtgcaggaaatcgcgagggctcgggctcgcgggcatattcgatatgtggggccatggcacgatggtgaccgtgagctca

SEQ ID NO: 55251 - RNA, 432 nt, synthetic construct
  misc_feature 1..432: note = derived and/or modified sequence opt11 from anti-HIV_cap256-119-165943_VR-Chain
  source 1..432: mol_type = other RNA
gaagtgcaattggtcgagagcgggggcgggctcgtgcaaccgggcaggagcttgcgcttgagctgtgccgtgagcgggttcacggtctcgagcaattacatgagctgggtcaggcaagcgcccgggaaagggctcgagtgggtggcctcgatatcgttcgcgggcatcaaaaagtactatggcgatagcgtgaaagggcgctttaccataagcagggacaatagcaagaacacgctatatctccagatggatggcctgcgcggggaagatacagcgctctattactgtgccaaggacttgcgcgagctcgagtgcgaggaatgggcctcggactattacgatttcgggcgcccgcaaccgtgcttggacccgcgcggggtctcgggcataagcaatgtctggggccagggcacgatggtgaccgtgagctcg

SEQ ID NO: 55252 - RNA, 432 nt, synthetic construct
  misc_feature 1..432: note = derived and/or modified sequence opt11 from anti-HIV_cap256-119-165738_VR-Chain
  source 1..432: mol_type = other RNA
gaagtgcaattggtcgagagcgggggcgggctagtgcaaccgggcaggagcttgcgcttgagttgtgccgcgagcgggttcacgttcgatgactatgccatgaactgggtcaggcaagcgcccgggaaagggctcgagtgggtggccacgatctcgttcgatggaacggacaagtaccatgccgatgacgtgtgggggcgctttaccataagcagggacaatagcaagaaaacgctctatctccagatgaatagcttgcgcgcggaagataccgcgctctattactgtgccaaggacttgcgcgaggacgagtgcgaggaatggtggtcggactattacgatctcgggaaacagctcccgtgcaggaaatcgcgaggggtcgcgggcgtgctagataaatggggcttgggcacgatggtgaccgtgagctca

SEQ ID NO: 55253 - RNA, 432 nt, synthetic construct
  misc_feature 1..432: note = derived and/or modified sequence opt11 from anti-HIV_cap256-119-164913_VR-Chain
  source 1..432: mol_type = other RNA
caagatcacttggtcgagagcgggggcgggggcgtgcaaccgggcaagagcctgcgactgagctgtgccgcgagcgggttcacgttctcggcccatgccatgcactgggtcaggcaagcgcccgggaaagggcccgagtgggtggccgtgatctcgcacgatggcgggcaacagttctatcgcgagagcgtgaaagggcgctttaccataagcagggacaatagcaagaacacgctctatctccagatggatggcttgcgcggggaagataccgcgctctattactgtgccaaggacttgcgagagctcgagtgcgaggaatgggcctcggactattacgatttcgggcgcccgcaaccgtgcttggacccgcgaggagtatcgggcataagcaatgtctggggccagggcacgatggtgaccgtgagctcg

SEQ ID NO: 55254 - RNA, 432 nt, synthetic construct
  misc_feature 1..432: note = derived and/or modified sequence opt11 from anti-HIV_cap256-119-164167_VR-Chain
  source 1..432: mol_type = other RNA
gaagtgcgcttggtcgagagcgggggcgggctcatacaaccgggcgggagcttgagattgagctgtgccgcgagcgggctcacggtctcgagcaatcacatgagctgggtcaggcaagcgccagggaaagggctcgagtgggtggcctcgatctcgtacgatggcagggacttttaccatgccaggagcgtgtgggggcgctttaccataagcagggacaatagcaagaacacgctccatctccagatgaatagcttgagaccggaagataccgcgctctatttctgtgcaagggacctgcgcgagagcgagtgcgaggaatgggaatcgtactattacgatttcgggaaaaagggcccgtgcgtgaaaccgcgaggggtcgtgggcgtgctcgatatctggggccagggcacgctcgtgaccgtgagctcg

SEQ ID NO: 55255 - RNA, 432 nt, synthetic construct
  misc_feature 1..432: note = derived and/or modified sequence opt11 from anti-HIV_cap256-119-163558_VR-Chain
  source 1..432: mol_type = other RNA
caaatgcaattggtcgagagcgggggcggggtcgtgcaaccgggcaggagcttgaccttgagctgtgccgcgagccagttcaatttcgcgaactatggcatgcactgggtcaggcaagcgcccgggaaaggactcgagtgggtggcctcgatctcgtacgatggctcggacaagtaccatgccgatcgcgtgtgggggcgctttaccataagcagagacaatagcaagaacacgctctatctccagatgaatagcttgcgcgcggaagataccgcgctctattactgtgtcagggacgcgcgcgagagcgagtgcgagctctgggaatcggactattacaatttcgggcgcaagctcccgtgcgtgaaaccgcgaggagtcgcgggcacgctcgatatctggggccagggcacgatggtgaccgtgagctcg

SEQ ID NO: 55256 - RNA, 432 nt, synthetic construct
  misc_feature 1..432: note = derived and/or modified sequence opt11 from anti-HIV_cap256-119-162043_VR-Chain
  source 1..432: mol_type = other RNA
caagtgcaattggtcgagagcgggggcggggtcgtgcaaccgggcaggagcttgcgcgtgagctgtgccgcgagccatttcacgttctcgcgctatggcatgcactgggtaaggcaagcgcccgggaaagggctcgagtgggtgaccgggatctcgttcgcggccacgaaaacgtactatggcgatagcgtgcgcgggcgctttaccgtgagcagggacataagcaagaacacgctctatctccagatgaatagtttgcgcccggaagataccgcgatgtattactgtgccagggaccagcgctattacgagtgcgaggaatgggcctcggactattacgatttcgggcgcgagcaaccgtgccaggacccgcgcggggtcgtgggcatactcgatctctggggccagggcacgatggtgaccgtgagctcg

SEQ ID NO: 55257 - RNA, 432 nt, synthetic construct
  misc_feature 1..432: note = derived and/or modified sequence opt11 from anti-HIV_cap256-119-161718_VR-Chain
  source 1..432: mol_type = other RNA
caagtgcaactggtcgagagcgggggaggggtcgtgcaaccgggcaagagcttgcgcttgagctgtgccgcgagccatttctcgttcaatcgctatggcatgcactgggtcaggcaagcgcccgggaaagggctcgagtgggtggccgcgatctcgtacgatggcacggacaagtaccatgccgatcaagtgtgggggcgctttaccataagcagggacaatagcaagaacacgctctatctccagatgaatagcttgcgcccggaagataccgcgctctattactgtgccaaggacttgcgcgaggacgagtgcgaggaatggtggtcggactattacgatctagggaaacagctcccgtgcaggaaatcgcgcggggtcgcgggcatattcgataaatggggccagggaacgatggtgaccgtgagctcg

SEQ ID NO: 55258 - RNA, 432 nt, synthetic construct
  misc_feature 1..432: note = derived and/or modified sequence opt11 from anti-HIV_cap256-119-161675_VR-Chain
  source 1..432: mol_type = other RNA
caagtgcaattggtcgagagcgggggcggggtcgtgcaaccgggcaggagcttgcgattgagctgtaccgcgagcgggttcacgttctcgatctatagcatgaactgggtcaggcaagcgcccggaaaagggctcgattgggtggccgggatctcgttcgcggcaacgaaaacgtactatggagggagcgtgaaagggcgctttaccgtgagcagggacataagcaagaacacgctctatctccagatgaatagcttgagaccggaagataccgcgatgtattactgtgccagggaccagcgctattacgagtgcgaggaatgggcatcggactattacgatttcgggcgcgagcaaccgtgccaggacccgcgcggggtcgtgggcgtgttcgatatgtggggccagggcacgatggtgaccgtgagctcg

SEQ ID NO: 55259 - RNA, 432 nt, synthetic construct
  misc_feature 1..432: note = derived and/or modified sequence opt11 from anti-HIV_cap256-119-161053_VR-Chain
  source 1..432: mol_type = other RNA
caagtgcacttggtcgagagcgggggcggggtcgtgcaaccgggcacgagcctgcgattgagctgtgtcgcgagcgggttcacgttctcgaactttgccatgcactgggtcaggcaagcgcccgggaaagggctcgagtgggcggccataatctcgaccaggggcaataacaggaactatgccgatagcgtgcgcgggcgctttaccgtgagcagggacataagcaagaacacgctctatctccagatgaatagcttgcgaccagaagataccgcgatgtattactgtgccagggaccaacgctattacgagtgcgaggaatgggcctcggactattacgatttcgggcgagagcaaccgtgccaggacccgcgcggggtcgtgggcatactcgatctctggggccagggcacgatggtgaccgtgagctcg

SEQ ID NO: 55260 - RNA, 432 nt, synthetic construct
  misc_feature 1..432: note = derived and/or modified sequence opt11 from anti-HIV_cap256-119-159499_VR-Chain
  source 1..432: mol_type = other RNA
caagtgcaattggtcgagagcgggggcggggtcgtgcaaccgggcaggagcttgcgattgagctgtgccgcgagcgggttcgcgttctcgcactatggcatattctgggtcaggcaagcgcccgggaaagggctcgagtgggtggcctcgatctcgttcgatggcagggactattaccatagcccacacgtgtgggggcgcttgaccataagcagagacaatagcaagaacacgctctatctccagatgaatagtttgcgagcggaagataccgcgctctattactgtgccagggacttgcgcgagagcgagcgagaggaatgggaatcggactattacgatttcgggaaaaagggcccgtgcgtgaaaccgcgcggggtcgcgggctcgctagatatgtggggccagggaacgatggtgatcgtgagctca

SEQ ID NO: 55261 - RNA, 432 nt, synthetic construct
  misc_feature 1..432: note = derived and/or modified sequence opt11 from anti-HIV_cap256-119-159114_VR-Chain
  source 1..432: mol_type = other RNA
gaagtgcaattggtcgagagcgggggcgggctcgtgcaaccgggcgggagcttgcgcttggcctgtgcagcgagcgggctaacgttcaggaaacatggcatgcactgggtcaggcaagcgcccgggaaagggctcgagtgggtgagctatatctcgagcgatggcgtgaacaattacctgatcgatagcgtgcgagggcgatttacagtgagcagggacaatagcaagaacacgctctatctccagatggatggcttgcgcggggaagataccgcgctctattactgtgcaaaggacttgcgcgagctagagtgcgaggaatgggcctcggactattacgatttcgggcgcccgcaaccgtgcttggacccgcgcggggtctcgggcataagcaatgtctggggccagggcacgatggtgaccgtgagctcg

SEQ ID NO: 55262 - RNA, 432 nt, synthetic construct
  misc_feature 1..432: note = derived and/or modified sequence opt11 from anti-HIV_cap256-119-156751_VR-Chain
  source 1..432: mol_type = other RNA
gaagtgcaattgctcgagagcgggggcgggctcgtgcaaccgggcgggagcttgagattgagctgtgcagcgagcgggttcgcgttctcgagctatggcatgcactgggtcaggcaagcgcccgggaaagggctcgagtgggtggcctcgatctcgtacgatggcagggacttttaccatgccaggagcgtgtgggggcgctttaccataagcagggacaatagcaagaacacgctccatctccagatgaatagcctgcgcccggaagataccgcgctctatttctgtgccagggacttgcgagagagcgagtgcgaggaatgggaatcgtactattacgatttcgggaaaaagggcccgtgcgtgaaaccgcgcggggtcgtgggcgtgctcgatatctggggccagggcacgctcgtgaccgtgagctcg

SEQ ID NO: 55263 - RNA, 432 nt, synthetic construct
  misc_feature 1..432: note = derived and/or modified sequence opt11 from anti-HIV_cap256-119-155656_VR-Chain
  source 1..432: mol_type = other RNA
gaagtgcaattggtcgagagcgggggagggctcgtgcaaccgggcgggagcttgcgcttgagctgtgccgcgagcgggatcacgttctcgagctatggcatgcactgggtcaggcaagcgcccgggaaagggctagagtgggtggcatttatcaggtacgatggctcgagcaagtactatgccgatagcgtgaaagggcgctttaccataagcagggacaatagcaagaacacgctctatctccagatggatggattgcgcggggaagataccgcgctatattactgtgcaaaggacttgcgcgagctcgagtgcgaggaatgggcctcggactattacgatttcgggcgcccgcaaccgtgcttggacccgcgcggggtctcgggcataagcaatgtctggggccagggcacgatggtgaccgtaagctca

SEQ ID NO: 55264 - RNA, 432 nt, synthetic construct
  misc_feature 1..432: note = derived and/or modified sequence opt11 from anti-HIV_cap256-119-154420_VR-Chain
  source 1..432: mol_type = other RNA
caagtgcgcctggtcgagagcgggggcggggtcgtgcaaccgggcaggagcttgcgcataagctgtgccgcgagccagttcatgttctcgcgatatggcatgcactgggtcaggcaagcgcccgggaaagggctcgagtgggtggcctcgatctcgtacgatggcacggacaagtaccatgccgatctcgtgtgggggcgatttaccataagcagggacaatagcaagaacacgctctatctccagatgaatagcttgcgcgcggaagataccgcgctctattactgtgccagggacttgcgcgagagcgagtgcgaggaatgggaatcggactattacgatttcgggaaaaagggcccgtgcgtgaaaccgcgcggggtcgcgggctcgctcgatatgtggggccagggcacgatggtgatagtaagctca

SEQ ID NO: 55265 - RNA, 432 nt, synthetic construct
  misc_feature 1..432: note = derived and/or modified sequence opt11 from anti-HIV_cap256-119-153954_VR-Chain
  source 1..432: mol_type = other RNA
gaagtgcaagtgctcgagagcgggggcgggctcgtgcaaccgggcgggagcttgcgcttgagctgtgtcgcgagccagttcacgttctcgggctgtggcttgcactgggtcaggcaagcgcccgggaaagggctcgagtgggtggcctcgatctcgttcgcgggcacgaaaaagcactatggcaatagcgtgaaagggcgctttaccataagcagagacaatagcaagaacacggtctatctcgagatgaatagcttgcgagcggaagataccgcgctatattactgtgccaaggacctgcgcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55266 - RNA, 432 nt, synthetic construct
  misc_feature 1..432: note = derived and/or modified sequence opt11 from anti-HIV_cap256-119-153864_VR-Chain
  source 1..432: mol_type = other RNA
caagtgcacttggtcgagagcgggggcggggtagtgcaaccgggcgggagcttgcgcttgagctgtgccgcgagcgggttcacgttctcgggatgtggcttgcactgggtcaggcaagcgcccgggaaagggctcgagtgggtggcctcgatctcgttcgcgggcacgaaaaagcactatggctcgagcgtgcgcgggcgctttagcataagcagggacaatagcaagaacacgctctatctccagatgaatagcttgcgcacggaagataccgcgctctatttctgtgccaaggacttgcgcgagtacgagtgcgaggaatggacatcggactattacgatttcgggcgcccgcaaccgtgcatagactcgcgcggggtcgtgggcatactcgatatctggggccagggcacgatggtgaccgtgagctcg

SEQ ID NO: 55267 - RNA, 432 nt, synthetic construct
  misc_feature 1..432: note = derived and/or modified sequence opt11 from anti-HIV_cap256-119-153793_VR-Chain
  source 1..432: mol_type = other RNA
gaagtgcaactggtcgagagcgggggcggggtcgtgcaaccgggagggagcttgagattgagctgtgccacgagcgggttcacgttcgggacctttggcatgcactgggtcaggcaagcgcccgggaaagggctcgattgggtggcctatatcaggtacgatggcaagaccaagaactatggcgagagcgtgaaagggcgatttaccataagcagggacaatagcaagaacacgatgtcgctccagatgaatagcttgagaccggaagataccgcgctctattactgtgccaaggacttgcgcgaggacgagtgcgaggaaaggtggtcagactattacgatttcgggaaacagctaccgtgcaggaaatcgcgaggagtagcgggcgtgttcgataactggggccagggcacaatggtgaccgtgagctcg

SEQ ID NO: 55268 - RNA, 432 nt, synthetic construct
  misc_feature 1..432: note = derived and/or modified sequence opt11 from anti-HIV_cap256-119-153462_VR-Chain
  source 1..432: mol_type = other RNA
caagtgcaattggtcgagagcgggggcggggtcgtgcaaccgggcgggagcttgcgcttgagctgtgccgcgagcgggttcacgttctcgaactatggcatgcaatgggtcaggcaagcgcccgggaaagggctcgagtgggtggccgcgatatcgtacgatggaaggaacgagtactatgccgagagcgtaaaagggcgctttaccataagcagggacaatttcaagagcacgctctttctccagatgaatagcttgcgagcggaagataccgcgctctattactgtgccagggacttgcgcgagagcgagtgcgaggaatgggaatcggactattacgcgttctatcgcaagctcccgtgcgtgaaaccgcgcggggtcgcgggcacgctcgatatctggggccagggcacgatggtgacagtgagctca

SEQ ID NO: 55269 - RNA, 438 nt, synthetic construct
  misc_feature 1..438: note = derived and/or modified sequence opt11 from anti-HIV_cap256-119-153124_VR-Chain
  source 1..438: mol_type = other RNA
caagtgcaattggtcgagagcgggggcggggtagtgcaaccgggcaggagcttgaccttgagctgcatcgcgagccagttcaatttcgcgagctatggcatgcactgggtcaggcaagcgccagggaaagggctcgagtgggtggcctcgatctcgcacgatggcacgaaaaagtaccatgccgagagcgtgtgggggcgctttaccataagcaaggacaatagcaagaacacgctatttctccagatgaatagcttgcgagtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgaccgtgagctcg

SEQ ID NO: 55270 - RNA, 438 nt, synthetic construct
  misc_feature 1..438: note = derived and/or modified sequence opt11 from anti-HIV_cap256-119-153025_VR-Chain
  source 1..438: mol_type = other RNA
caaatgcaattggtcgagagcgggggcggggtcgtgcaaccgggcaagagcttgaccttgagctgtgccgcgagccagttcacgttctcaaactatggcatgcactgggtcaggcaagcgcccgggaaagggctcgagtgggtggcctcgatctcgaacgatggcaataaaaagtaccatggcgatagcgtgtgggggcgcttgaccataagcagggacaatagcaagaacacgctctttctccagatgaatagcttgcgcccggaagataccgcgctctatttctgtgtcaaggaccagcgcgaggacgagtgcgaggaatggtggtcggactattacgatttcgggcgcgagctaccgtgcaggaaatttcgcgggctagggctcgcgggcatattcgatatctggggccatggcacgatggtgaccgtgagctcg

SEQ ID NO: 55271 - RNA, 432 nt, synthetic construct
  misc_feature 1..432: note = derived and/or modified sequence opt11 from anti-HIV_cap256-119-152713_VR-Chain
  source 1..432: mol_type = other RNA
gaagtgcaattggtcgagagcgggggcgggctcgtgcgcccgggcgggagcttgcgcttgagctgtgcaacgagcgggttcacgttctcgagccattggatgagctgggtcaggcaagcgcccgggaaagggctagagtgggtggccgggatctcgttcgcgggcacgaaaacgtactatggcgatagcgtgaaagggcgatttaccgtgagcacagacataagcaagaacacgctctatctccaggtcaatagcttgcgcccagaagatacagcgatgtattactgtgccagagaccagcgctattacgagtgcgaggaatgggcctcggactattacgatttcgggaaagagcaaccgtgcttggacccgcgcggggtcgtgggcatattcgatatctggggccagggcacgatggtgaccgtgagctcg

SEQ ID NO: 55272 - RNA, 438 nt, synthetic construct
  misc_feature 1..438: note = derived and/or modified sequence opt11 from anti-HIV_cap256-119-151794_VR-Chain
  source 1..438: mol_type = other RNA
cacgtgcaattggtagagagcgggggcggggtcgtgcaaccgggcacgagcttgcgcttgagctgtgtcgcgagcgagttctcgttcaagaactatggcatgcactgggtcaggcaagcgcccgggaaagggctcgagtgggtggcctcgatctcaaacgatggcacgaaaaagtaccatgccgagagcgtgtgggatcgctttagcataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctcccgtgcaggaaatcgcgagggctcgggctcgcgggcatattcgatatgtggggccatggcacgatggtgaccgtgagctcg

SEQ ID NO: 55273 - RNA, 438 nt, synthetic construct
  misc_feature 1..438: note = derived and/or modified sequence opt11 from anti-HIV_cap256-119-150980_VR-Chain
  source 1..438: mol_type = other RNA
caagtgcaattggtcgagagcgggggcggggtcgtgcaaccgggcaagagcctgcgcttgagctgtgccgcgagcgggttcatactctcgaactatgccatgcactgggtcaggcaagcgcccgggaaagggctagagtgggtggcctcgatctcgaacgatggctcgaaaaagtaccatggcgatagcgtgtgggcgcgctttatcataagcagggacaatagcaagaacacgctctttctccagatgagctcattgcgcgcggaagataccgcgctctatttctgtgtcagggaccatcgcgaggacgagtgcgaggaatggtggtcggactattacgatttcgggcgcgagctcccgtgcaggaaatttcgagggctcgggctcgcgggcatattcgatatctggggccatggcacgatggtgaccgtgagctcg

SEQ ID NO: 55274 - RNA, 432 nt, synthetic construct
  misc_feature 1..432: note = derived and/or modified sequence opt11 from anti-HIV_cap256-119-148895_VR-Chain
  source 1..432: mol_type = other RNA
caagtgcaattggtcgagagcgggggcggggtcgtgcaaccgggcaggagcttgcgcttgagctgtgccgcgagcgggttcacgttcaggagctatggcatgcactgggtcaggcaagcgcccgggaaagggctcgagtgggtggcagtgatctcgagcgatggcgatatcgagtactatacccagagcgtgaaaggacgatttaccataagcagggacaatagcaagaacacgctctatctccagatgaatgccttgcgcccggaagataccgcgatgtattactgtgcaagggaccagcgctattacgagtgcgaggaatgggcctcggactattacgatttcgggcgcgagcaaccgtgccaggacccgcgcggggtcgtgggcgtgttcgatatgtggggccagggcacgatggtgaccgtgagctcg

SEQ ID NO: 55275 - RNA, 438 nt, synthetic construct
  misc_feature 1..438: note = derived and/or modified sequence opt11 from anti-HIV_cap256-119-148848_VR-Chain
  source 1..438: mol_type = other RNA
caaatgcaattggtcgagagcgggggcggggtcgtgcaaccgggcaggagcttgaccttgagctgtgccgcgagccagttctcgttcacgagctatggcatgcactgggtcaggcaagcgcccgggaaagggctcgagtgggtggcctcgatctcgaacgatggcacgaaaaagtaccatggcgagagcgtgtgggatcgctttagcataagcagggacaatagcaagaacacgctctttctccagatgaatagcttgcgcgtggaagataccgcgctttatttctgtgtcaaggaccagcgcgaggacgagtgcgaggaatggtggtcggactattacgatttcgggaaagagctcccgtgcaggaaatggaaaacgcgcggggtcgcgggcatactcgataactggggccagggcacgatgttgaccgtgagctcg

SEQ ID NO: 55276 - RNA, 432 nt, synthetic construct
  misc_feature 1..432: note = derived and/or modified sequence opt11 from anti-HIV_cap256-119-148743_VR-Chain
  source 1..432: mol_type = other RNA
caagtgcaattggtcgagagcgggggcggggtcgtgcaaccgggcaggagcttgaccctgagctgtgccgcgagccagttcaatttcgcgaactatggcatgcactgggtcaggcaagcgcccgggaaagggctcgagtgggtggcctcgatctcgaacgacggcacgaaaaagtaccatgccgagagcgtgtgggatcgctttagcataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggaaaaagctcccgtgcaggaaatcgcgcggactcgcgggcatattccatgtctggggccatggcacgatggtgaccgtgagctcg

SEQ ID NO: 55277 - RNA, 432 nt, synthetic construct
  misc_feature 1..432: note = derived and/or modified sequence opt11 from anti-HIV_cap256-119-148595_VR-Chain
  source 1..432: mol_type = other RNA
gaagtgcaattggtcgagagcgggggcgggctagtgcaaccgggcgggagcttgcgattgagctgtgccgcgagcaggttcacgttcgataactatggcatgcactgggtcaggcaagcgcccgggaaagggctcgagtgggtggccttgctcaattacgatggctcgaaaaagtactatgtcgatagcgtgaaagggcgatttatcatattcagggacaatagcaagaacacgctctttctccagatgaatagcctgcgcccggaagataccgcgctctatttctgtgtcaaggaccagcgcgaggacgcgtgcgaggaatggtggtcggactattacgatttcgggaaaaagctcccgtgcaggaaatcgcgcgggctcgcgggcatattccatgtctggggccatggcacgatggtgaccgtgagctcg

SEQ ID NO: 55278 - RNA, 432 nt, synthetic construct
  misc_feature 1..432: note = derived and/or modified sequence opt11 from anti-HIV_cap256-119-148490_VR-Chain
  source 1..432: mol_type = other RNA
caagtgcaattagtagagagcgggggcggggtcgtgcaaccgggcaggagcttgcgcttgagctgtgtcgcgagcgggttcacgttctcggactatgccatgcactgggtaagacaagcgcccgggaaagggctcgagtgggtggccacgatctcgttcgatggcgcggacaagtaccatgccgatgacgtgtgggggcgctttaccataagcagggacaatagcaagaacacgctctatctccagatgaatagcttgcgcccggaagatacagcgctctattactgtgccaaggacttgcgcgaggacgagtgcgaggaaaggtggtcggactattacgatttcgggaaacagctcccgtgcaggaaatcacgaggggtcgcgggagtgttcgataactggggccagggcacgatggtgaccgtgagctcg

SEQ ID NO: 55279 - RNA, 438 nt, synthetic construct
  misc_feature 1..438: note = derived and/or modified sequence opt11 from anti-HIV_cap256-119-148470_VR-Chain
  source 1..438: mol_type = other RNA
caagtgcaattggtcgagagcgggggcggggtcgtgcaaccgggcaggagcttgcgcttgagctgtgtcgcgagcgggttcacgttctcgagctatggcatacactgggtcaggcaagcgccagggaaagggctcgagtgggtggccgtgatctcggacgatggctcgaaaaagtaccatgaagagagcgtgtgggggcgctttaccataagcaaggacaatagcaagaacacgctctttctacagatgaatagtttgcgcatagaagataccgcgctatatttctgtgtcaaggaccagcgcgaggacgagtgcgaggaatggtggtcggactattacgatttcgggcgagagctcccgtgcaggaaatcacgcgggctcgggctcgcgggcatattcgatatgtggggccatggcacgatggtgaccgtgagctcg

SEQ ID NO: 55280 - RNA, 432 nt, synthetic construct
  misc_feature 1..432: note = derived and/or modified sequence opt11 from anti-HIV_cap256-119-148107_VR-Chain
  source 1..432: mol_type = other RNA
gaagtgcaactggtcgagagcgggggcgggctcgtgcaaccgggagggagcttgcgcttgagctgtgccgcgagcgggttcacggtctcgagcaattacatgacctgggtcaggcaagcgcccaggaaagggctcgagtgggtgggctcgatctcgtacgatggctcggacaagtaccataccaatagcttgtgggggcgctttatcgtgagcagggacaatagcaagaacacgctatatctccagatgaataacttgcgcccggaagataccgcgctatattactgtgtcagggacaggcgagagagcgagtgcgaggaaaggtggtcggactattacgatttcgggaaacagctcccgtgcgtgaaaccgcgcggggtcgcgggcatattcgatatctggggccagggcacgatggtgacagtgagctcg

SEQ ID NO: 55281 - RNA, 432 nt, synthetic construct
  misc_feature 1..432: note = derived and/or modified sequence opt11 from anti-HIV_cap256-119-147933_VR-Chain
  source 1..432: mol_type = other RNA
gaattgcaattggtggagagcgggggagggctggtgcaaccgggatggagcttgaggttgagctgtgaggcgagcgggttcccgttctcggcattttggatgacatgggtaaggcaggcgccagggaaagggctggggtgggtggcatttataaggtacgatgggagtaacaagtactatgcagatagcgtgaaagggaggtttacaataagcagggacaatagcatgacgacgctatatctacagatgaatagcttgagggcggaagatgcagcggtatattactgtgcaaaggacttgagggaggacgagtgcgaggaatggtggtcggactattacgatttcgggaaaaggctgccgtgcaggaaatcgagaggggtggcgggagtgttcgataaatgggggcagggaacgatggtgacagtgagctcg

SEQ ID NO: 55282 - RNA, 432 nt, synthetic construct
  misc_feature 1..432: note = derived and/or modified sequence opt11 from anti-HIV_cap256-119-147434_VR-Chain
  source 1..432: mol_type = other RNA
caagtgcaattggtcgagagcgggggcggggtcgtgcaagcgggcaggagcttgcgcttgagctgtgccgcgagccagttcacgttcgggcgctatggcatgcactgggtcaggcaagcgcccgggaaagggctcgagtgggtgggctcaatctcgtacgatggctcggacaagtaccataccaatagcgtgtgggggcgctttatcgtgagcagggacaatagcaagaacacgctctatctccagatgaatagcttgcgcccggaagataccgcgatgtattactgtgccagggaccagcgctattacgagtgcgaggaatgggcctcggactattacgatttcggacgcgagcaaccgtgccaggacccgcgcggggtcgtgggcgtgttcgatatgtggggccagggcacaatggtgacagtgagctcg

SEQ ID NO: 55283 - RNA, 435 nt, synthetic construct
  misc_feature 1..435: note = derived and/or modified sequence opt11 from anti-HIV_cap256-119-146106_VR-Chain
  source 1..435: mol_type = other RNA
caagtgcagctagtcgagagcgggggcggggtcgtgcaaccgggcaggagcttgcgcctgagctgtgccgcgagcgggttcacgttctcaagctcaggcatgcactgggtcaggcaagcgcccgggaaagggctacaatgggtagccgtgatctcgtacgacggcgggaacaagtactatgccgacagcgtgaaagggcgctttaccataagcagggacaatagcaagaacaacctctatctccagatgaatagcctgcgcccggaagataccgcactctattactgcgccagggacttgagagagatggagtgcgaggaatggaaattatacaactactatgacttccgcacgcgcgggccctgtgtcgatcccaggggcgtggtcgggagctttgacgtgtgggggcaaggaaccgtggtcacggtatcgagc

SEQ ID NO: 55284 - RNA, 438 nt, synthetic construct
  misc_feature 1..438: note = derived and/or modified sequence opt11 from anti-HIV_cap256-119-145604_VR-Chain
  source 1..438: mol_type = other RNA
gacgtgcaactggcagagagcgggggagggctcgtgcaaccgggcgggagcttgcgcttgagctgtgtcgcgagcgggttcacgttctcgagcttcgaaatgcactgggtcaggcaagcgcccgggaaagggctcgagtgggtggcctcgatctcgaacgatggcacgaaaaggtaccatgccgagagcgtgtgggatcgctttagcattagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctaccgtgcaggaaatcgcgcgggctcgggctagcgggcatattcgatatgtggggccatggcacgatggtgaccgtgagctcg

SEQ ID NO: 55285 - RNA, 438 nt, synthetic construct
  misc_feature 1..438: note = derived and/or modified sequence opt11 from anti-HIV_cap256-119-143998_VR-Chain
  source 1..438: mol_type = other RNA
caagtgcaattagtcgagagcgggggcggggtcgtgcaaccgggcaggagcttgcgcttgagttgtgccgcgagcgggttcacgttcaggaactatggcatgcactgggtcagacaagcgcccgggaaagggctcgagtgggtggcctcgatctcgaacgatggctcgaaaaagtaccatggcgatagcgtgtgggcgcgctttatcataagcagggacaatagcaagaacacgctatttctccagatgtcgagcttgcgcgcggaagataccgcgctctatttctgtgtcaaggaccagcgagaggacgagtgcgaggaatggtggtcggactattacgatttcgggcgcgagctcccgtgcaggaaatcgcgagggctcgggctcgcgggcatattcgatatgtggggccatggaacgatggtgaccgtgagctcg

SEQ ID NO: 55286 - RNA, 438 nt, synthetic construct
  misc_feature 1..438: note = derived and/or modified sequence opt11 from anti-HIV_cap256-119-143441_VR-Chain
  source 1..438: mol_type = other RNA
gaagtgcacttggtcgagagcgggggcgggctcgcgcaaccgggcaggagcttgcgcttgagctgtgccgcgagccagttcaatttcgcgagctatggcatgcactgggtcaggcaagcgcccgggaaagggctcgagtgggtggcctcgatctcgaacgatggcacgaaaaggtaccatgccgagagcgtgtgggatcgctttagcataagcaaagacaatagcaagaacacactctttctacagatgaatagcctgcgagtggaagataccgcgctctatttctgtgtcaaggaccagcgcgaggacgagtgcgaggaatggtggtcggactattacgatttcgggcgcgagctcccgtgcaggaaatcgcgcgggctcgggctagcgggcatattcgatatgtggggccatggcacgatggtgaccgtgagctcg

SEQ ID NO: 55287 - RNA, 432 nt, synthetic construct
  misc_feature 1..432: note = derived and/or modified sequence opt11 from anti-HIV_cap256-119-141307_VR-Chain
  source 1..432: mol_type = other RNA
caagtgcacttggtcgagagcgggggcggggtcgtgcaaccgggcaggagcttgcgattgagctgtgccgcgagccagttcacgttcaatcgctatggcttgcactgggtcaggcaagcgcccgggaaagggctcgagtgggtggccgggatctcgtacgatggcagggacaagtaccatgcccatttcgtgtgggggcgctttatcataagcagggacaatagcaagaacacgctctatctccagatgaatagcttgcgcgcggaagataccgcgctctattactgtgtaagggacctgcgcgagagcgagtgcgagctctgggaatcagactattacgatttcgggaaaagactcccgtgcgtgaaaccgcgaggggtcgcgggcacgttcgatctctggggccagggcacaatggtgaccgtgagctcg

SEQ ID NO: 55288 - RNA, 432 nt, synthetic construct
  misc_feature 1..432: note = derived and/or modified sequence opt11 from anti-HIV_cap256-119-140896_VR-Chain
  source 1..432: mol_type = other RNA
gaagtgaaattggtcgagagcgggggcgggctcgtgcaaccgggcgggagcttgaaattgagctgtgccgcgagcgggttcacgttctcgtactacgccatgcactgggtcaggcaagcgcccgggaaagggctcgagtgggtggccgtgatctcgtacgatggctcggacaagtactatgccgatagcgtgaaagggcgctttaccataagcagggacaatagcaagaacacgctccatctccagatgaatagcttgcgcccggaagataccgcgctctatttctgtgccagagacttgcgcgagagcgagtgcgaggaatgggaatcgtactattacgatttcgggaaaaagggcccgtgcgtgaaaccgcgcggggtcgtgggcgtgctcgatatctggggccagggaacgctcgtgaccgtgagctcg

SEQ ID NO: 55289 - RNA, 432 nt, synthetic construct
  misc_feature 1..432: note = derived and/or modified sequence opt11 from anti-HIV_cap256-119-140090_VR-Chain
  source 1..432: mol_type = other RNA
gaagtgcaattggtcgagagcgggggcgggctcgtgcaaccgggcgggagcttgcgcttgagctgtgccgcgagcgggttcgcgttctcgagctattggatgacctgggtcaggcaagcgcccgggaaagggctagagtgggtggccgtgatctcgtacgatggctcgaacaagtactatgccgatagcgtgcgcgggcgctttaccataagcagggactcgagcaagaacacgctctatctcgagatgaatagcttgcgcccggaagataccgcgctctattactgtgccaaggacatgcgcgggtacgagtgcgaggaatggacctcggactattacgatttcgggcgaccgcaaccgtgcatagactcgcgcggggtcgtgggcacgttcgatgtctggggccagggcacgatggtgaccgtgagctcg

SEQ ID NO: 55290 - RNA, 438 nt, synthetic construct
  misc_feature 1..438: note = derived and/or modified sequence opt11 from anti-HIV_cap256-119-140037_VR-Chain
  source 1..438: mol_type = other RNA
caagtgcaattggtcgagagcgggggcgggctcgtgcaaccgggcaggagcttgcgcttgagctgtgccgcgagcgggttcacgttcgatgactatgtcatgcactgggtcaggcaagcgcccggaaaagggctcgagtgggtggcctcgatctcgaacgatggcacgaaaaagtaccatgaagagagcgtgtgggggcgatttaccataagcaaggacaatagcaagagcacgctctttctccagatgaacagcttgcgcatagaagataccgcgctctatttctgtgtcaaggaccagcgcgaggacgagtgcgaggaatggtggtcggactattacgatttcgggcgagagctcccgtgcaggaaatcgcgcgggctcgggctcgcgggcatattcgatatgtggggccatggcacgatggtgaccgtgagctcg

SEQ ID NO: 55291 - RNA, 432 nt, synthetic construct
  misc_feature 1..432: note = derived and/or modified sequence opt11 from anti-HIV_cap256-119-139135_VR-Chain
  source 1..432: mol_type = other RNA
gaagtgcaattggtcgagagcgggggcggggtcgtgcgcccgggcgggagcgtgcgcttgagctgtgtcgcgagcgggttctcgttcaggagctatggcatgcactgggtcaggcaagcgcccgggaaagggctcgagtgggtggcatcgatctcgtacgatggcagggacttttaccatgccaggagcgtgtgggggcgctttaccataagcagggacaacagcaagaacacgctccatctccagatgaatagcttgcgcccggaagataccgcgctctatttctgtgccagggacttgcgcgagagcgagtgcgaggaatgggaatcgtactattacgatttcgggaaaaagggcccgtgcgtgaaaccgcgcggggtcgtgggcgtgctcgatatctggggccagggcacgctcgtgaccgtgagctca

SEQ ID NO: 55292 - RNA, 438 nt, synthetic construct
  misc_feature 1..438: note = derived and/or modified sequence opt11 from anti-HIV_cap256-119-137881_VR-Chain
  source 1..438: mol_type = other RNA
caagtgcaattggtcgagagcgggggcgggctcgtgaaaccgggcaggagcttgaccttgagctgtgccgcgagccagttcacgttctcgaactatggaatgcactgggtcaggcaagcgcccgggaaagggctcgagtgggtggcctcgatctcgaacgatggcaataaaaagtaccatggcgatagcgtgtgggcgcgctttaccataagcagggacaatagcaagaacacgctatttctccagatgtcgagcttgcgcacggaagataccgcgctctatttctgtgtcagggacaggcgcgaggacgagtgcgaggaatggtggtcggactattacgatttcgggcgagagctcccgtgcaggaaatttcgcgggctcgggctcgcgggaatattcgatatctggggccatggcacgatggtgaccgtgagctcg

SEQ ID NO: 55293 - RNA, 432 nt, synthetic construct
  misc_feature 1..432: note = derived and/or modified sequence opt11 from anti-HIV_cap256-119-137643_VR-Chain
  source 1..432: mol_type = other RNA
gaagtgcaattggtcgagagcgggggcgatctcgtgcaaccgggcgggagcctgcgcttgagctgtgccgcgagcggattctcattctcgagctatggcatgcactgggtcaggcaagcgcccgataaagggctcgagtgggtgaccgtgatctcgtacgatggctcgaacaagcactatgccgatagcgtgaaagggcgatttaccataagcagggacaatagcaagaacacgctctatctcgagatgaacaccttgcgcgcggaagataccgcgctctattactgtgccaaggacctgcgcgagtacgagtgcgaggaatggacctcggactattacgatttcgggcgcccgcaaccgtgcatagactcgcgcggggtcgtgggcatactcgatatctggggccagggcacgatggtgagcgtgagctcg

SEQ ID NO: 55294 - RNA, 438 nt, synthetic construct
  misc_feature 1..438: note = derived and/or modified sequence opt11 from anti-HIV_cap256-119-137170_VR-Chain
  source 1..438: mol_type = other RNA
caagtgcaattggtagagagcgggggcggggtcgtgcaaccgggcaggagcttgcgcttgagctgtgccgcgagcgagttcacgttctcgcgctatagcatgcactgggtcaggcaagcgcccgggaaagggctagagtgggtggccgtgatctcgagcgatggctcgaaccagttccatgccgatagcgtgtgggggcgatttaccataagcaaggacaatagcaagaacacgctctttctccagatgaatagcttgcgcatagaagataccgcgctctatttctgtgtcaaggaccagcgcgaggacgagtgcgaggaatggtggtcggactattacgatttcgggcgcgagctcccgtgcaggaaatcgcgcgggcttgggctcgcgggcatattcgatatgtggggccatggcacgatggtgaccgtgagctcg

SEQ ID NO: 55295 - RNA, 432 nt, synthetic construct
  misc_feature 1..432: note = derived and/or modified sequence opt11 from anti-HIV_cap256-119-136616_VR-Chain
  source 1..432: mol_type = other RNA
caagtgcaattggtagagagcgggggcggggtcgtgcaaccgggcaggagtttgcgcttgagctgtgccgcgagcgggttcacgttctcgcgcaatgccataaactgggtcaggcaagcgcccgggcgagggctcgagtgggtggccgtgatctcggacgatggctcgctcaagtactatgccgatagcgtgaaaggacgctttaccataagcagggacaatagcaagaacacgctctatctccagatgaataacctgcgcccggaagatacagcgctctattactgtgtcagggacaggcgcgagagcgagtgcgaggaaaggtggtcggactattacgatttcgggaaacagctcccgtgcgtgaaaccacgcggggtcgcaggcatattcgatatctggggccagggcacgatggtgaccgtgagctcg

SEQ ID NO: 55296 - RNA, 432 nt, synthetic construct
  misc_feature 1..432: note = derived and/or modified sequence opt11 from anti-HIV_cap256-119-136206_VR-Chain
  source 1..432: mol_type = other RNA
caagtgcaattggtcgagagcgggggcggagtcgtgcaaccgggcaggagcttgcgcttgagctgtgccgcgagtcagttcacgttcgggcgctatggcatgcactgggtcaggcaagcgcccgggaaagggctcgagtgggtggccgcgatctcgttcgcgggcacgaaaaagtactatggcgatagtgcgcgcgggcgctttaccataagcagggacaatagcaagaacatgctctttctccagatgaatagcctgcgcgcggaagataccgcgctctattactgtgccagggacttgcgcgattacgagtgcgaggaatgggaagcgtactattacgatttcgggcgcgtgggcccgtgcacggacccgcgcggggtcgtgggcatactagatgtctggggccagggcacgctagtgaccgtgagctcg

SEQ ID NO: 55297 - RNA, 438 nt, synthetic construct
  misc_feature 1..438: note = derived and/or modified sequence opt11 from anti-HIV_cap256-119-135565_VR-Chain
  source 1..438: mol_type = other RNA
caagtgcacttggtcgagagcgggggcggggtcgtgcaaccgggcaagagcttgcgcttgagctgtgccgcgagccagttcacgttcgatcgatatggcatgcactgggtcaggcaagcgcccgggaaagggctcgagtgggtggcctcaatctcgaacgatggcacggacaagtaccatgcagataacgtgtgggggcgctttaccataagcagggacaatagcaagaacacgctctatctcgagatgaatagcttgcgcggagaagataccgcgctctatttctgtgtcaaggaccagcgcgaggacgagtgcgaggaatggtggtcggactattacgatttcgggcgagagctcccgtgcaggaaatcgcgcgggctcgggctcgcgggcatattcgatatgtggggccatggcacgatggtgaccgtgagctcg

SEQ ID NO: 55298 - RNA, 432 nt, synthetic construct
  misc_feature 1..432: note = derived and/or modified sequence opt11 from anti-HIV_cap256-119-135025_VR-Chain
  source 1..432: mol_type = other RNA
gaagtgcaattggtcgagagcgggggcgggctcgtgcaaccgggcgggagcctgcgattgagctgtgaagcgagcgggttcacgttcaatacctatgaaatgaactgggtcaggcaaccgcccgggcgcgggctagagtgggtggccgggatctcgttcgcggccacgaaaacgtactatggcgggagcgtgaaagggcgctttaccgtgagcagggacataagcaagaacacgctctatctccagatggatggcttgcgcggggaagacaccgcgctctattactgtgccaaggacttgcgcgagctcgagtgcgaggaatgggcctcggactattacgatttcgggcgcccgcaaccgtgcttggacccgcgcggggtctcgggaataagcaatgtctggggccagggcacgatggtgaccgtgagctcg

SEQ ID NO: 55299 - RNA, 432 nt, synthetic construct
  misc_feature 1..432: note = derived and/or modified sequence opt11 from anti-HIV_cap256-119-133983_VR-Chain
  source 1..432: mol_type = other RNA
caaatgcaattggtcgagagcgggggcggggtcgtgcaaccgggcaggagcctgaccttgagctgtgccgcgagccagttcaatttcgcgaactatggcatgcactgggtcaggcaagcgcccgggaaagggctcgagtgggtggcctcgatctcgaacgatggcacgaaaaagtaccatgaagagagcgtgtgggggcgctttaccataagcaaggacaatagcaagaacacgctctttctccagatgaatagcttgcgcccggaagataccgcgctctattactgtgccaaggacttgcgcgaggacgagtgcgaggaaaggtggtcggactattacgatttcgggaaacagctcccgtgcaggaaatcgcgcggggtcgcgggagtgttcgataactggggccagggcacgatggtgaccgtgagctcg

SEQ ID NO: 55300 - RNA, 438 nt, synthetic construct
  misc_feature 1..438: note = derived and/or modified sequence opt11 from anti-HIV_cap256-119-133917_VR-Chain
  source 1..438: mol_type = other RNA
caaatgcaactggtagagagcgggggcggggtcgtgcaaccgggcaggagcctgaccttgagctgtgccgcgagccagttcacgttctcgaactatggcatgcactgggtcaggcaagcgcccgggaaagggctcgagtgggtggcctcaatctcgaacgatggcagcaaaaagtaccatggcgattcagtgtgggcgcgctttaccataagcagggacaatagcaagaacacgctctttctccagatgtcgagcctgcgcgtggaagataccgcgctctatttctgtgtcagggaccagcgcgaggacgagtgcgaggaatggtggtcggactattacgatttcgggcgcgagctcccgtgcaggaaatttcgcgggctcgggctcgcgggcatattcgatatctggggccacggcacgatggtgaccgtgagctcg

SEQ ID NO: 55301 - RNA, 432 nt, synthetic construct
  misc_feature 1..432: note = derived and/or modified sequence opt11 from anti-HIV_cap256-119-132663_VR-Chain
  source 1..432: mol_type = other RNA
caagcgcaattggtcgagagcgggggcggggtcgtgcaaccgggcaggagcttgcgcataagctgtgccgtgagccagttcacgttctcgcgctatggcatgcactgggtcaggcaagcgcccgggaaagggctcgagtgggtggcctcgatctcgttcgatggcagggacaagtaccatagcccgctcgtgtgggggcgcctgaccataagcagggacaatagcaagaacacgctctttctcgagatgaatagcctgcgcgcggaagataccgcggtctattactgtgccagagacttgcgcgagagcgagtgcgaggaatggcaatcggactattacgcgttctataaaaagctcccgtgcgtgaaaccgcgcggggtcgcgggctcgctcgatatctggggccagggcacggtcgtgaccgtgagctcg

SEQ ID NO: 55302 - RNA, 438 nt, synthetic construct
  misc_feature 1..438: note = derived and/or modified sequence opt11 from anti-HIV_cap256-119-132113_VR-Chain
  source 1..438: mol_type = other RNA
caagtgcaattggtcgagagcgggggcgggctcgtgaaaccgggcgggagcttgcgcctgagctgtgccgcgagccagttcaatttcgcgaactatggcatgcactgggtcaggcaagcgcccgggaaagggctcgagtgggtggcctcgatctcgaacgatggcacgaaaaagtaccatgaagagagcgtgtgggggcgatttaccataagcaaggacaatagcaagagcacgctctttcttcagatgaatagcttgcgcatagaagatacagcgctctatttctgtgtcaaggaccagcgagaggacgagtgcgaggaatggtggtcggactattacgatttcgggcgcgagctcccgtgcaggaaatcgcgagggctcgggctcgcgggcatattcgatatgtggggccatggcacgatggtgaccgtgagctcg

SEQ ID NO: 55303 - RNA, 432 nt, synthetic construct
  misc_feature 1..432: note = derived and/or modified sequence opt11 from anti-HIV_cap256-119-131839_VR-Chain
  source 1..432: mol_type = other RNA
caagtgcaactggtcgagagcgggggcggggtcgtacaaccgggcaggagcctgcgcttgagctgtgccgcgagcgggttcacgttctcgagctatgccatgcactgggtcaggcaagcgcccgggaaagggctcgagtgggtggccgtgatctcgtacgatggctcgaacaagtactatgccgatagcgtgaaagggcgatttacaataagcagagacaatagcaagaacacgctctatctccagatgaatagcttgcgcgcggaagataccgcggtctattactgtgccagggaccagcgctattacgagtgcgaggaatgggcctcggactattacgatttcgggagagagcaaccgtgccaggacccgcgcggggtagtgggcgtgttcgatatgtggggccagggcacgatggtgaccgtgagctcg

SEQ ID NO: 55304 - RNA, 435 nt, synthetic construct
  misc_feature 1..435: note = derived and/or modified sequence opt11 from anti-HIV_cap256-119-130626_VR-Chain
  source 1..435: mol_type = other RNA
gaagtgcaattggtcgagagcgggggcgggctaatacacccgggcgggtgcctgcgcctgagctgtgccgtaagcgggttcacgttctcggactatcccatgcactgggtcaggcaatcgcccgggaaagggctcgagtgggtggccgtgatctcgtacgatggcataaactattactatgccgacagcgtgaaagggcgctttaccataagcagggacaatagcaagaacaatctctttctccagatgaatagcctgcgcctggaagataccgcgctctattactgtgccagggacttgcgcgagctcgattgcgaggaatggaccttatacaattactatgactttggctcacgaggaccatgcgtcgatcccaggggcgtgggcgggagctttgacgtgtgggggcaagggaccatggtcacggtctcgagc

SEQ ID NO: 55305 - RNA, 438 nt, synthetic construct
  misc_feature 1..438: note = derived and/or modified sequence opt11 from anti-HIV_cap256-119-130191_VR-Chain
  source 1..438: mol_type = other RNA
gaagtgcaactggtcgagagcgggggcgggctcatacaaccgggcaggagcttgcgcttgagctgtgccgcgagcgggttcacggtctcaagcaatttcatgacctgggtcaggcaagcacccgggaaagggctcgagtgggtggcctcgatctcgaacgatggcacgaaaaagtaccatgccgagagcgtgtgggatcgctttagcataagtaaggacaatagcaagaacacgctatttctccagatgaatagcttgcgcgtggaagataccgcgctctatttctgtgtcaaggaccagcgagaggacgagtgcgaggaatggtggtcggactattacgacttcgggcgcgagctcccgtgcaggaaatcgcgcgggctcgggctcgcgggcatattcgatatgtggggccatggcacgatggtgaccgtgagctcg

SEQ ID NO: 55306 - RNA, 438 nt, synthetic construct
  misc_feature 1..438: note = derived and/or modified sequence opt11 from anti-HIV_cap256-119-129798_VR-Chain
  source 1..438: mol_type = other RNA
caagtgcaattggtagagagcgggggcggggtcgtgcaaccgggcaagagcttgcgcctgagctgtgcagcgagcgggttcatattctcgagctatttcatgcactgggtcaggcaagcgcccgggaaagggctcgagtgggtggccgtggtcacggacgatggctcgaaaaagtactatgccgatagcgtgaaagggcgctttaccataagcagggactatagcaagaacacgctctttctccagatgaatcgattgcgcgtagaagataccgcgctctatttctgtgtcaaggaccagcgcgaggacgagtgcgaggaatggtggtcggactattacgatttcgggcgagagctcccgtgcaggaaatttcgcgggctagggctcgcgggcatattcgatatgtggggccatggcacgatggtgaccgtgagctcg

SEQ ID NO: 55307 - RNA, 432 nt, synthetic construct
  misc_feature 1..432: note = derived and/or modified sequence opt11 from anti-HIV_cap256-119-128745_VR-Chain
  source 1..432: mol_type = other RNA
caagtgcaactggtcgagagcgggggaggggtcgtgcaaccgggcaggagcctgcgcttgagctgtgccgcgagcgggttcacgttctcgaactatgccatgcactgggtcagacaagcgcccgggaaagggctcgagtgggtggcctcgatctcattcgcgggcacgaaaacgcactatggcaatagcgtaaaagggcgctttagcataagcagggacaatagcataaacacggtctatctacagatgaatagcttgcgcgcggaagataccgcgctctattactgtgccaaggacctgcgcgagtatgagtgcgaggaatggacctcagactattacgatttcgggcgcccgcaaccgtgcatagactcgcgcggggtcgtgggcatactcgacatctggagccagggcacgatggtgaccgtgagctcg

SEQ ID NO: 55308 - RNA, 438 nt, synthetic construct
  misc_feature 1..438: note = derived and/or modified sequence opt11 from anti-HIV_cap256-119-128593_VR-Chain
  source 1..438: mol_type = other RNA
caagtgcaattggtcgagagcgggggaggggtcgtgcaaccgggcaggagcctgcgattgagctgtgccgcgagcgggttcacgttctcgagctatgccatgcactgggtcaggcaagcgcccgggaaagggctcgagtgggtggcctcgatctcgtacgatggcagggacttttaccatgccaggagcgtgtgggggcgctttaccataagcagggacaatagcaagaacacgctccatctccagatgaatagcttgcgcgtggaagataccgcgctctatttctgtgtcaaggaccagcgagaggacgagtgcgaggaatggtggtcggactattacgatttcgggcgagagctcccgtgcaggaaatcgcgcgggctcgggctcgcgggcatattcgatatctggggccatggcacgatggtgaccgtgagctcg

SEQ ID NO: 55309 - RNA, 438 nt, synthetic construct
  misc_feature 1..438: note = derived and/or modified sequence opt11 from anti-HIV_cap256-119-128152_VR-Chain
  source 1..438: mol_type = other RNA
caagtgcaattggtcgagagcggaggcggggtcgtgcaaccgggcaggagcttacgcttgagctgtgccgtgagcgggttcacgttcacgagctatcccatgcactgggtcaggcaagcgcccgggaaagggctcgagtgggtggcctcggtctcgaacgatggcacgaaaaagtaccacggcgatagcgtgtgggatcgctttaccataagcagagacaatagcaagaacacgctctttctccagatgtcgagcttgcgcgcggaagataccgcggtctatttctgtgtcagggacgagcgcgaggacgagtgcgaggaatggtggtcggactattacgatttcgggcgcgagctcccgtgcaggaaatttcgcgggctcgggctcgcgggcatattcgatatctggggccatggcacgctcgtgaccgtgagctcg

SEQ ID NO: 55310 - RNA, 438 nt, synthetic construct
  misc_feature 1..438: note = derived and/or modified sequence opt11 from anti-HIV_cap256-119-127693_VR-Chain
  source 1..438: mol_type = other RNA
gaagtgcaattgctagagagcgggggcgggctagtgcaaccgggcgggagcttgcgcttgagctgtgcagcgagcgggttcacgttctcgagctatgccatggcctgggtcagacaagcgcccgggaaagggctcgagtgggtggcctcgatctcgaacgatggctcgaaaaagtaccatggcgatagcgtgtgggcgcgctttataataagcagggacaatagcaagaacacgctctttctccagatgtcgagcttgcgcgtggaagataccgcgctctatttctgtgtcagggaccatcgcgaggacgagtgcgaggaatggtggtcggactattacgatttcgggcgcgagctcccgtgcaggaaatttcgcgggctcgggctcgcgggcatattcgatatctggggccatggcacgatggtgacagtgagctcg

SEQ ID NO: 55311 - RNA, 432 nt, synthetic construct
  misc_feature 1..432: note = derived and/or modified sequence opt11 from anti-HIV_cap256-119-126684_VR-Chain
  source 1..432: mol_type = other RNA
caagtgcaattggtagagagcggaggcggggccgtgcgcccgggcaggagcttgcgcctgagctgtgccacgagcgggttcacgttctcgaactatgccatgcactgggtcaggcaagcgcccgggaaagggctcgagtgggtgaccgggatctcgttcgcgggcacgaaaacgtactatggcgatagcgtgcgcgggcgctttaccgtgagcagggacataagcaagaacacgctctttctccagatgaatagcttgcgcccggacgataccgcaatgtattactgtgccagggaccagcgctattacgagtgcgaggaatgggcatcggactattacgatttcgggcgcgagcaaccgtgcttagacccgcgcggggtcgtgggcatattcgatctctggggacagggcacgatggtgaccgtgagctca

SEQ ID NO: 55312 - RNA, 438 nt, synthetic construct
  misc_feature 1..438: note = derived and/or modified sequence opt11 from anti-HIV_cap256-119-126056_VR-Chain
  source 1..438: mol_type = other RNA
gaagtgcaattggtcgagagcggaggcgggctcgtgcaaccgggcgggagcttgcgcttgagctgtgccgatagcgggttcacgttctcgagctattggatgagctgggtcaggcaagcgcccgggaaaggactcgagtgggtggcctcgatctcgaacgatggcacgaaaaagtaccatgccgagagcgtgtgggatcgctttagcataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgaccgtgagctcg

SEQ ID NO: 55313 - RNA, 432 nt, synthetic construct
  misc_feature 1..432: note = derived and/or modified sequence opt11 from anti-HIV_cap256-119-125765_VR-Chain
  source 1..432: mol_type = other RNA
caagtgcaactggtccagagcgggggcggggtcgtgcaaccgggcaggagcctgcgcttgagctgtgccgcgagcgggttcacgttctcgagctatgtcatgcactgggtcaggcaagcgcccgggaaagggctcgagggcgtggccgtgatctcgttcgatggcaataacgagtactatgccgacagcgtgaaagggcgctttaccataagcagggacaatagcaagaacacggtctatctccagatgaatagcttgcgcgtggaagataccgcgctctactactgtgccaaggacatgcgcgagtacgagtgcgaggaatggacctcggactattacgatttcgggcgcccgcaaccgtgcatagactcgcgcggggtcgtgggcatactcgatatctggggccagggcataatggtgaccgtgagctcg

SEQ ID NO: 55314 - RNA, 438 nt, synthetic construct
  misc_feature 1..438: note = derived and/or modified sequence opt11 from anti-HIV_cap256-119-125106_VR-Chain
  source 1..438: mol_type = other RNA
caagtgcaattggtcgagagcgggggcggggtcgtgcaaccgggcaggagtttgcgcctgagctgtgccgcgagcgggttcatattcaggagctatggcatgcactgggtaaggcaagcgcccgggaaagggctcgagtgggtggcctcgatctcgaacgatggcacgaaaaggtaccatgccgagagcgtgtgggatcgctttagcataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgaccgtgagttcg

SEQ ID NO: 55315 - RNA, 435 nt, synthetic construct
  misc_feature 1..435: note = derived and/or modified sequence opt11 from anti-HIV_cap256-119-124026_VR-Chain
  source 1..435: mol_type = other RNA
caagtgcaattggtcgagagcgggggcggggtcgtgcaatcgggcaggagcttgcgcctgacctgtagcgggagcgcgttcagattctcgagctataccgtgcactgggtcaggcaagcgcccgggaaagggctagagtggttggccttgatctcgtacgatggccagaaaaagcactttgcagatagcgtgaaagggcgatttaccataagcagggacaatagcaagaacaatctatttctccagatgaatagcttgagattggaagataccgcgctctattactgtgccagggacctgcgcgagctcgattgcgaggaatggaccttgtacaattactatgactttggctcgcgcgggccctgtgtcgatcccaggggcgtgggcgggagctttgacgtgtgggggcaagggaccatggtcacggtctcgagc

SEQ ID NO: 55316 - RNA, 432 nt, synthetic construct
  misc_feature 1..432: note = derived and/or modified sequence opt11 from anti-HIV_cap256-119-121783_VR-Chain
  source 1..432: mol_type = other RNA
ctcgggcgattggtcgcgagcgggggcggggtcgtgccaccgggcgggagcttgaccttgagctgtgtcacgagccagttcacgttctcgggctgtggcttgcactgggtcaggcaagcgcccgggaaagggctcgagtgggtggcctcgatctcgttcgcgggcacgaaaaagcactatggctcgagcgtgcgcggacgctttagcataagcagggacaatagcaagaacacgctctatctccagatgaatagcttgcgcacggaagataccgcgctctatttctgtgcaaaggacttgcgcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55317 - RNA, 432 nt, synthetic construct
  misc_feature 1..432: note = derived and/or modified sequence opt11 from anti-HIV_cap256-119-121208_VR-Chain
  source 1..432: mol_type = other RNA
ctcgggcgcctggtcgcgagcgggggcggggtcgtgcccccgggcaagagcttgaccctgagctgtgtcgcgagccagttcacgttctcaggctgtggcttgcactgggtcagacaagcgcccgggaaagggctcgagtgggtggcctcgatctcattcgcgggcacgaaaaagcactatggcaatttcgtgcgcgggcgctttaccataagcagggacaatagcaagaacacgctctatctccagatgaatagcctgcgcgcggaagataccgcgctctattactgtgccaaggacctgcgcgagtacgagtgcgaggaatggacctcggactattacgatttcgggcgcccgcaaccgtgcatagactcgcgcggggtcgtgggcatactcgatatctggggccaaggcacgatggtgaccgtgagctca

SEQ ID NO: 55318 - RNA, 432 nt, synthetic construct
  misc_feature 1..432: note = derived and/or modified sequence opt11 from anti-HIV_cap256-119-120945_VR-Chain
  source 1..432: mol_type = other RNA
caagtgcaattggtcgagagcgggggcggggtcgtgcaaccgggcgggagcttgcgcttgagctgtgtcgcgagcgggttcacgttctcgaactatggcatgcactgggtcaggcaagcgcccgggaaagggctcgcgtgggtggcatttatcaggtacgacggctcgaacaagtactatgtcgatagcgtgtgggggcgatttaccataagcagggacaatagcaagaacacgctccatctccagatgaatagcttgcgcccggaagataccgcgctctatttctgtgccagggacttgcgcgagagcgagtgcgaggaatgggaatcgtactattacgatttcgggaacaagggcccgtgcgtgaaaccgcgcggggtcgtgggcgtgctcgatatctggggccagggcacgctagtgaccgtgagctcg

SEQ ID NO: 55319 - RNA, 432 nt, synthetic construct
  misc_feature 1..432: note = derived and/or modified sequence opt11 from anti-HIV_cap256-119-118229_VR-Chain
  source 1..432: mol_type = other RNA
caagtgcaagtggtcgagagcgggggcggggtcgtgcaaccgggcaggagcctgcgcttgagctgtgccgcaagcgggttcacgttctcgaactatgccatacactgggtaaggcaagcgcccgggaaagggctcgagtgggtagccttgatctcgtacgatggatataacaagtactatgcagatagcgtgcgcgggcgctttaccataagcagggacaatagcaataacacggtctatctccagatgaatagcttgaaaccagaagataccgcggtctattactgtgccagggacttgcgcgagagcgagtgcgaggaatgggaatcgtactattacgatttcgggaaaaagggcccgtgcgtgaaaccgcgcggggtcgtgggcgtgctcgatatctggggccagggaacgctcgtgaccgtgagctcg

SEQ ID NO: 55320 - RNA, 432 nt, synthetic construct
  misc_feature 1..432: note = derived and/or modified sequence opt11 from anti-HIV_cap256-119-118025_VR-Chain
  source 1..432: mol_type = other RNA
gaagtgcaattggtcgagagcgggggcggggtcgtgcaaccgggcaagagcttgcgcttgagctgtaccgcgagccagttcacgttctcgaactttggcatgcactgggtcaggcaagcgcccgggaaagggctcgagtgggtggcctcgatctcgttcgtgggcataaaaacgcactatgccaatagcgtgcgcgggcgctttaccataagcagggaccagagcaagaacacgctctatctccagatgaatagcgtgcgcatagaagataccgcgcgctatttctgtgccagggacatgcgcgagtacgagtgcgagctctgggcctcggactattacgatttcgggaaaccgcaaccgtgcgaggacccgcgcggggtcgtgggcacgttcgatatgtggggcttgggcacgctcgtgaccgtgagctcg

SEQ ID NO: 55321 - RNA, 432 nt, synthetic construct
  misc_feature 1..432: note = derived and/or modified sequence opt11 from anti-HIV_cap256-119-117418_VR-Chain
  source 1..432: mol_type = other RNA
caagtgcaattggtcgagagcgggggcggggtcgtgcaaccgggcaggagcttgcgcttgagctgtgccgcgagcgggttcaatttcaggaactatgacataaactgggtcaggcaagtgcccgggaaagggctagagtgggtggccgcgatctcgttcgatggcgcggacaagtaccatgccgataacgtgtgggggcggttgagcataagcagggacaatagcaagagcacgctctatctccagatgaatagcttgcgcccggaagatacagcggtctatttctgtgccaaggacctgcgcgaggacgagtgcgaggaaaggtggtcggactattacgatttcgggaaacagctaccgtgcaggaaatcgcgcggggtcgcgggcatattcgataactggggccagggcacgatggtgaccgtgagcgcg

SEQ ID NO: 55322 - RNA, 432 nt, synthetic construct
  misc_feature 1..432: note = derived and/or modified sequence opt11 from anti-HIV_cap256-119-117250_VR-Chain
  source 1..432: mol_type = other RNA
caagtgcgcttggtcgagagcgggggcggggtcgtgcaaccgggcgggagcttgcgcttgagctgtgccgcgagccagttcacgttctcggcatatggcatgcactgggtcaggcaagcgcccgggaaagggctcgagtgggtggcctcgatctcgttcgatggcacggacaagttccatgccgataaagtgtgggggagattggtcataagcagggacaatagcaagaacacgctctatctccagatgaatagcttgcgcccggaagataccgcggtctattactgtgccaaggacttgcgcgaggacgagtgcgaggaaaggtggtcggactattacgatttcgggaaacagctcccgtgcaggaaatcgcgcggggtcgcgggcgtgttcgataactggggccagggcacgatggtgaccgtgagctcg

SEQ ID NO: 55323 - RNA, 432 nt, synthetic construct
  misc_feature 1..432: note = derived and/or modified sequence opt11 from anti-HIV_cap256-119-117230_VR-Chain
  source 1..432: mol_type = other RNA
caagtgcaattggtcgagagcgggggcgggggcgtgcaaccgggcaggagcctgcgattgagctgtgccgcgagcgggttcacgctctcgagctatggcatgcactgggtcaggcaagcgccagggaaaggactcgagtgggtggcctcgatctcgttcgatggcagggactattaccatagcccgcacgtgtgggggcgcttgacaataagcagagacaatagcaagaacacgctctatctccagatgaatagtttgcgcgcggaagatacagcgctctattactgtgccagggacttgcgcgagagcgagtgcgaggaatgggaatcggactattacgatttcgggaaaaagggcccgtgcgtgaaaccgcgcggggtcgcgggctcgctcgatatgtggggccagggcacgatggtgatcgtgagctcg

SEQ ID NO: 55324 - RNA, 432 nt, synthetic construct
  misc_feature 1..432: note = derived and/or modified sequence opt11 from anti-HIV_cap256-119-116999_VR-Chain
  source 1..432: mol_type = other RNA
caagtgcaattggtcgagagcgggggcggggtcgtgcaaccgggcacgagcttgcgcataagctgtgccgcgagccagttcacgttctcgcgctatggcatgcactgggtcaggcaagcgcccgggaaagggctcgagtgggtggcatcgatctcgtacgatggcagggactattaccatgccgggcgcgtgtgggggcgctttaccataagcagggacaatagcaagaacacgctatatctccagatgaatagcttgcgcccggaagataccgcgctctatttctgtgtcagggactcgcgcgagagcgagtgcgaggaatgggaatcggactattacgatttcgggaaaaagctcccgtgcgtgaaaccgcgcggggtcgtgggcgtgctcgatctatggggccagggcacgctcgtgaccgtgagctcg

SEQ ID NO: 55325 - RNA, 432 nt, synthetic construct
  misc_feature 1..432: note = derived and/or modified sequence opt11 from anti-HIV_cap256-119-116558_VR-Chain
  source 1..432: mol_type = other RNA
caagtgcaattggtcgagagcgggggcggggtcgtgcaaccaggcaggagcttgcgcttgagctgtgccgcgagcgggttcacgttcaatcgctatagcttgcactgggtcaggcaagcgcccgggaaaggactcgagtgggtggcctttacctcgtacgatggctcgaacaagtactatcccgatagcgtgaaagggcgctttaccataagcagggactcgagcaagaacacgctctatctcgagatgaatagcctgcgcccggaagataccgcgctctattactgtgccaaggacatgcgagggtacgagtgcgaggaatggacctcggactattacgatttcgggcgcccgcaaccgtgcatagactcgcgcggggtcgtgggcacgttcgatgtctggggccagggcacgatggtgaccgtgagctcg

SEQ ID NO: 55326 - RNA, 432 nt, synthetic construct
  misc_feature 1..432: note = derived and/or modified sequence opt11 from anti-HIV_cap256-119-116484_VR-Chain
  source 1..432: mol_type = other RNA
gacgtgcaattgctcgagagcgggggcgatctcgtgcagccgggcgggagcttgcgcttgagctgtgccgcgagcggattcacgttcacgaaatatgaaatgacctgggtcaggcaagcgcccgggaaagggctcgagtgggtggcctcgatctcgtacgatggctcggacaagtaccatacctcgagcttgtgggggcgctttatcgtgagcagggacaatagcaagaacacgctctatctccagatgaatagcttgcgaccggaagacaccgcgctctattactgtgtcagggacaggcgcgagagcgagtgcgaggaaaggtggtcggactattacgatttcgggaaacagctaccgtgcgtgaaaccgcgcggggtcgcgggcatattcgatatctggggccagggcacgatggtgaccgtgagctcg

SEQ ID NO: 55327 - RNA, 438 nt, synthetic construct
  misc_feature 1..438: note = derived and/or modified sequence opt11 from anti-HIV_cap256-119-114844_VR-Chain
  source 1..438: mol_type = other RNA
gaagtgcaattggtcgagagcgggggcgacctcgtgcaaccgggcaggagcttgcgcttgagctgtgccgcgagcgggttcacgttctcgagctattggatgagctgggtcaggcaagcgcccgggaaagggctcgagtgggtggcctcgatctcgaacgatggcacgaaaaagtaccatgaagagagcgtgtgggggcgctttaccataagcaaggacaatagcaagagcacgctctttctccagatgaatagcttgcgcgtggaagataccgcgctatatttctgtgtcaaggaccagagagaggacgagtgcgaggaatggtggtcggactattacgatttcggacgcgagctcccgtgcaggaaatcgcgagggctcgggctagcgggcatattcgatatgtggggccatggcacgatggtgaccgtgagctcg

SEQ ID NO: 55328 - RNA, 438 nt, synthetic construct
  misc_feature 1..438: note = derived and/or modified sequence opt11 from anti-HIV_cap256-119-114141_VR-Chain
  source 1..438: mol_type = other RNA
ggcgggcgctcgggcgggggcggggtcgggaccacgccaaggcgcgggcccctgcgattgagctgtgccgcgagcgggttcacgctcgatgactatgcaatgcactgggtcaggcaagcgcccgggaaagggctcgagtgggtggcatcgatctcgaacgatggaacgaaaaagtaccatgccgagagcgtgtgggatcgctttagcataagcaaggacaatagcaagaacacgctctttctccagatgaatagcttgcgcgtggaagatacagcgctctatttctgtgtaaaggaccagagagaggacgagtgcgaggaatggtggtcggactattacgtgttctgggaaagggccccgtgcaggaccgtgcccgggcgcgggcccgggtggtatttcgatatggtgggcaggcgcacgatggtgacagtgagctcg

SEQ ID NO: 55329 - RNA, 432 nt, synthetic construct
  misc_feature 1..432: note = derived and/or modified sequence opt11 from anti-HIV_cap256-119-111917_VR-Chain
  source 1..432: mol_type = other RNA
gaagtgcacttggtcgagagcgggggcgggctcgtgcaaccgggcgggagcttgcgattgagctgtgccgcgagcgggttcacgttctcgagctatggcatgcactgggtcaggcaagcgcccgggaaagggctcgagtgggtggccacgatctcgttcgatggcgcggacaagtaccatgccgatgacgtgtgggggcgctttagcataagcagggacaatagcaagaacacgctatatctccagatgaataacttgcgcccggaagataccgcgctctattactgtgccaaggacttgcgcgaggacgagtgcgaggaaagatggtcggactattacgatttcgggaaacagctcccgtgcaggaaatcgcgaggggttgcgggcgtgttcgataactggggccagggcacgatggtgacagtgagctcg

SEQ ID NO: 55330 - RNA, 432 nt, synthetic construct
  misc_feature 1..432: note = derived and/or modified sequence opt11 from anti-HIV_cap256-119-111862_VR-Chain
  source 1..432: mol_type = other RNA
caagtgcaattggtcgagagcgggggcggggtcgtgcaaccgggcgggagcctgcgattgagctgtgccgcgagcgggttcacgtactcggactatggcatgcactgggtcaggcaagcgcccgggaaagggctcgagtgggtggcctcgatctcgttcgcgggcacgaaacagcactatggcaatagcgtgaaagggcgctttaccataagcagagacaatagcaagaacacggtctatctccagatgaatagcttgcgcgtggaagataccgcgctctattactgtgccaaggacatgcgagagtacgagtgcgaggaatggacctcggactattacgatttcgggcgcccgcaaccgtgcatagactcgcgcggggtcgtgggcatactagatatctggggccagggcataatggtgacagtgagctcg

SEQ ID NO: 55331 - RNA, 432 nt, synthetic construct
  misc_feature 1..432: note = derived and/or modified sequence opt11 from anti-HIV_cap256-119-110064_VR-Chain
  source 1..432: mol_type = other RNA
ctcgggcgcttggtcgcgagcgggggcggggtcgtgcccccgggcaggagcttgcgcttgagctgtgtcgcgagccagttcacgttctcgggctgtggcctgcactgggtcaggcaagcgcccgggaaagggctcgagtgggtggcctcgatctcgttcgcgggaacgaaacagcactatggcaatagcgtgaaagggcgctttaccataagcagggacaatagcaagaacacggtctatctccagatgaatagcttgcgagtggaagataccgcgctctattactgtgccaaggacatgcgcgagtacgagtgcgaggaatggacctcggactattacgatttcgggcgcccgcaaccgtgcatagactcgcgcggggtcgtgggcatactcgatatatggggccagggcacgatggtgaccgtgagcttt

SEQ ID NO: 55332 - RNA, 432 nt, synthetic construct
  misc_feature 1..432: note = derived and/or modified sequence opt11 from anti-HIV_cap256-119-109192_VR-Chain
  source 1..432: mol_type = other RNA
caagtgcaactggtcgagagcgggggcggggtagtgcaaccgggcaggagcttgcgcctgagctgtgccgcgagcgggttcacgttctcgaactatgccatgcactgggtcaggcaagcgcccgggaaagggctcgagtgggtggccgtgatcgcgtacgatggcgataacaagtactatgccgatagcgtgaaagggcgctttaccataagcagggacaatagcaagaacacgctctatctccagatgaatagcttgcgcgcggaagatacagcgctctattactgtgccaaggacttgcgcgaggacgagtgcgaggaatggtggtcggactattacgatctcgggaaacagctcccgtgcaggaaatcgcgcggggtcgcgggcgtgctcgataaatggggcttgggcacgatggtgaccgtgagctcg

SEQ ID NO: 55333 - RNA, 435 nt, synthetic construct
  misc_feature 1..435: note = derived and/or modified sequence opt11 from anti-HIV_cap256-119-108793_VR-Chain
  source 1..435: mol_type = other RNA
caattccaactcgtcgaatccggcggcggcgtcgtccaacccggccgctccctccgactctcctgcgccgcctccggcttcaccttctcctcctaccccatgcactgggtccgccaagcccccggcaaaggcctcgaatgggtcgcactaatctcctacgacggcaccgacaaatactacgcagactccgtcaaaggccgcttcaccatctcccgagacaactccaaaaacaccctctacctccaaatgaactccctccgcgtcgaagacaccgccgtataccactgcgccaaagacctcggcggctcaaaatccgacgaatgggccaccgactactactacgactggtccaaagcctaccccgtccacgacccccgcgccgtcgtcggcgtcttcgacatctggggccaaggcaccctcgtaaccgtatcctcc

SEQ ID NO: 55334 - RNA, 432 nt, synthetic construct
  misc_feature 1..432: note = derived and/or modified sequence opt11 from anti-HIV_cap256-119-108127_VR-Chain
  source 1..432: mol_type = other RNA
caagtgcaattggtcgagagcgggggcggggtcgtgcaaccgggcaggagcttgcgaataagctgtgccgcgagccagttcacgttcaatcgatatggcatgcactgggtcaggcaagcgcccgggaaagggctagagtgggtggcctcgatctcgtacgatggctcagacaagtaccatgccgggctcgtgtgggggcgcttcatcataagcagggacaatagcaagaacacgctctatctacagatgaatagcttgcgcgcggaagataccgcgctatattactgtgtcagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctcg

SEQ ID NO: 55335 - RNA, 438 nt, synthetic construct
  misc_feature 1..438: note = derived and/or modified sequence opt11 from anti-HIV_cap256-119-107758_VR-Chain
  source 1..438: mol_type = other RNA
gaagtgcaactggtcgagagcgggggcgggctcgtgaaaccgggcgggagcttgcgcttgagctgtgccgcgagcgggttcacgttctcgaacgcgtggatgagctgggtaaggcaagcgccagggaaagggctagagtgggtggcctcgatctcgaacgatggcacgaaaaagtaccatgaagagagcgtgtgggggcgctttaccataagcaaggacaatagcaagaacacgctctttctccagatgaatagcttgcgaatagaagataccgcgctctatttctgtgtcaaggaccagcgagaggacgagtgcgaggaatggtggtcggactattacgatttcgggcgcgagctcccgtgcaggaaatcgcgcgggctcgggctcgcgggcatattcgatatgtggggccatggcacgatggtgaccgtaagctcg

SEQ ID NO: 55336 - RNA, 432 nt, synthetic construct
  misc_feature 1..432: note = derived and/or modified sequence opt11 from anti-HIV_cap256-119-107209_VR-Chain
  source 1..432: mol_type = other RNA
gaagtgcaattggtcgagagcgggggcgggctcgtgcaaccgggcaggagcttgcgcttgagctgtaccgcgagtgggttcacgttcggggactatggcatgcactgggtcaggcaagcacccgggaaagggctcgagtgggtggccgcgatctcgttcgatggcgcggacaagtaccatgccgataacgtgtgggggcgattgagcataagcagggacaatagcaagagcacgctctatctccagatgaatagcttgcgcccggaagataccgcggtctatttctgtgccaaggacttgcgcgaggacgagtgcgaggaaaggtggtcggactattacgatttcgggaaacagctcccgtgcaggaaatcgcgcggggtcgcgggcatattcgataactggggccagggcacgatggtgacagtgagcgcg

SEQ ID NO: 55337 - RNA, 432 nt, synthetic construct
  misc_feature 1..432: note = derived and/or modified sequence opt11 from anti-HIV_cap256-119-107184_VR-Chain
  source 1..432: mol_type = other RNA
caagcgcaattggtcgagagcggaggcggggtcgtgcaaccgggcaggagcttgggcttgagctgtgcagcgagtaagttctcgctctcgagctatggcatgcactgggtcaggcaagcgcccgggcgcgggctcgagtgggtggccgggatctcgttcgcgggcacgaaaaagtactatgccgatagcgtgcgcgggcgctttagcgtgagcacggacataagcaagaacacgctctatctccagatgaatagcttgcgcccggcagataccgcgctctatttctgtgccagggacttgcgctattacgagtgcgaggaatgggcctcggactattacgatttcgggaaagagcaaccgtgcttggacccgcgcggggtcgtgggcatattcgatctatggggacagggcacgatggtgaccgtgagctcg

SEQ ID NO: 55338 - RNA, 438 nt, synthetic construct
  misc_feature 1..438: note = derived and/or modified sequence opt11 from anti-HIV_cap256-119-106827_VR-Chain
  source 1..438: mol_type = other RNA
gccgtgcaattggtcgagagcgggggcgggctcgtgcaaccgggagggagcttgcgcttgagctgtagcgtgagccagttcacgttcgggagatatggcatgtactgggtcaggcaagcgcccgggaaagggctcgagtgggtggccgtgatctcgtacgatggcgggaacaggtactatgccgatagcgtgaaaaatcgctttagcataagcagggacaatagcaagaacacgctctttctacagatgtcgagcttgcgcgcggaagataccgcgctctatttctgtgtcagagaccatcgcgaggacgagtgcgaggaatggtggtcggactattacgatttcgggcgcgagctcccgtgcaggaaatttcgcgggctcgggctcgcgggcatattcgatatctggggccatggcacgatggtgaccgtgagctcg

SEQ ID NO: 55339 - RNA, 432 nt, synthetic construct
  misc_feature 1..432: note = derived and/or modified sequence opt11 from anti-HIV_cap256-119-106511_VR-Chain
  source 1..432: mol_type = other RNA
caagtgcaactggtcgagagcgggggcggggtcgtgcaaccgggcaggagcttgcgcttgagctgtgtcgcgagccagttctcgttcgatcgatatggcatgcactgggtcaggcaagcgcccgggaaagggctcgagtgggtggcctcaatctcgttcgatggcacggacaagtaccatgccgataaagtgtgggggcgctttaccataagcagggacaatagcaagaacacgctatatctccagatgaatagcttgcgcccggaagataccgcgctctattactgtgccaaggacatgcgcgaggacgagtgcgaggcctggtggtcggactattacgatctcgggaaacagctcccgtgcagggaatcgcgcggggtcgcgggcatattcgatgaatggggccagggcacgatggtgaccgtgagctcg

SEQ ID NO: 55340 - RNA, 432 nt, synthetic construct
  misc_feature 1..432: note = derived and/or modified sequence opt11 from anti-HIV_cap256-119-106327_VR-Chain
  source 1..432: mol_type = other RNA
caagtgcaattggtcgagagcgggggcggggtcgtgcaaccgggaaggagcttgcgcctgagctgtgccgcgagcgggttcacgttctcgagctatgccatgcactgggtcaggcaagcgcccgggaaagggctagagtgggtggccgcgatctcgggcgggggcgggaacacgtacgtggccgatagcgtgaaagggagatttacaataagcagggacaatagcaagaacacggtatacctccagatgaatagcttgcgcttggaagataccgcgctctattactgtgccaaggacttgcgagagtacgagtgcgaggaatggacctcggactattacgatttcgggcgaccgcaaccgtgcatagactcgcgcggagtcgtgggcatactcgatatctggggccagggcacgatggtgaccgtgagctcg

SEQ ID NO: 55341 - RNA, 438 nt, synthetic construct
  misc_feature 1..438: note = derived and/or modified sequence opt11 from anti-HIV_cap256-119-105486_VR-Chain
  source 1..438: mol_type = other RNA
caagtgcaattggtcgagagcgggggcggggtcgtgcaaccgggcgggagcttgcgcttgagctgtgccgcgagcgggttcacggtctcgggctatggaatgcactgggtcaggcaagcgcccgcgaaagggctagactgggtggcctttatctcgcacgatggctcgaacaagtactatgccgatagcgtgcgcgggcgctttatcataagcagggacaatagcaataacacgctctatgtccagatgtcgagcttgcgcgcggaagataccgcgctctatttctgtgtcagggaccatcgcgaggacgagtgcgaggaatggtggtcggactattacgatttcgggcgcgagctcccgtgcaggaaatttcgcgggctcgggctcgcgggcatattcgatatctggggccatggcacgatggtgaccgtgagctcg

SEQ ID NO: 55342 - RNA, 432 nt, synthetic construct
  misc_feature 1..432: note = derived and/or modified sequence opt11 from anti-HIV_cap256-119-105197_VR-Chain
  source 1..432: mol_type = other RNA
caagtgcaattggtcgagagcgggggcggggtcgtgcaaccgggcaggagcttgcgcttgagctgtgccgtgagccagttcacgttcgggcgctacggcatgcactgggtcaggcaagcgcccgggaaagggctcgagtgggtgggctcgatctcgtacgatggctcggacaagtaccatacaaatagcttgtgggggcgctttatcgtgagcagggacaatagcaagaacacgctctatctccagatgaataacctgcgcccggaagataccgcgctctactactgtgtcagggacaggcgcgagagcgagtgcgaggaaaggtggtcggactattacgatttcgggaaacagctcccgtgcgtgaaaccgcgcggggtcgtgggcgtgctcgacatctggggccagggcacgctcgtaaccgtgagctcg

SEQ ID NO: 55343 - RNA, 432 nt, synthetic construct
  misc_feature 1..432: note = derived and/or modified sequence opt11 from anti-HIV_cap256-119-104946_VR-Chain
  source 1..432: mol_type = other RNA
caagagcaactggtcgagagcgggggcggggtcgtgcaaccgggcaggagcttgcgattgagctgtgtcgcgagtaggttcacgttctcggcctttggcatgcactgggtcaggcaagcgcccgggaaagggctcgagtgggtggcctcgatctcgttcgcgggcatcaaaaagtactatggcgatagcgtgaaaggacgctttaccataagcagggacaatagcaagaacacgctctatctccagatggatggcttgcgaggggaagatacagcgctctattactgtgccaaggacttgcgcgagctcgagtgcgaggaatgggcctcggactattacgatttcgggcgaccgcaaccgtgcatagactcgcgcggggtcgtgggcatactcgatatatggggccagggcataatggtgaccgtgagctcg

SEQ ID NO: 55344 - RNA, 432 nt, synthetic construct
  misc_feature 1..432: note = derived and/or modified sequence opt11 from anti-HIV_cap256-119-103667_VR-Chain
  source 1..432: mol_type = other RNA
caagtgcacttggtcgagagcgggggcggggtcgtgcaaccgggcaagagcttgcgcttgagctgtgccgcgagccagttcacgttcaatcgctttggaatgcactgggtcaggcaagcgcccgggaaaggactcgagtgggtggccgggatctcgtacgatggctcggacaagtaccatgccgataaagtgtgggggagatttaccataagcagggacaatagcaagaacacgctctatctccagatgaatagcctgcgcgcggaagataccgcgctctattactgtgccaaggacttgcgcgaggacgagtgcgaggaatgggcctcggactattacgatttcgggaaagagcaaccgtgcttggacccgcgcggggtcgtgggcatattcgatatctggggccagggcacgatggtgaccgtgagctcg

SEQ ID NO: 55345 - RNA, 438 nt, synthetic construct
  misc_feature 1..438: note = derived and/or modified sequence opt11 from anti-HIV_cap256-119-103385_VR-Chain
  source 1..438: mol_type = other RNA
gaagtgcaactggtcgagagcgggggcgggctcgtgcaaacgggcgggagcttgcgcttgagctgtgccgcgagcggattcacgttctcgcgctatgacatgaactgggtcaggcaagcgcccgggaaagggctcgagtgggtggcctcgatctcgaacgatggctcgaaaaagtaccatggcgatagcgtgtgggcgcgctttaccataagcagggacaatagcaagaacacgctctttctacagatgtcgagcttgcgcgtggaagataccgcgctctatttctgtgtcagggaccagcgagaggacgagtgcgaggaatggtggtcggactattacgatttcgggcgagagctcccgtgcaggaaatttcgcgggctcgggctcgcgggcatattcgatatctggggccatggcacgatggtgaccgtgagctcg

SEQ ID NO: 55346 - RNA, 438 nt, synthetic construct
  misc_feature 1..438: note = derived and/or modified sequence opt11 from anti-HIV_cap256-119-103267_VR-Chain
  source 1..438: mol_type = other RNA
gaagtgccctcggtcgagagcgggggcgggctcgtgcaaacgggcgggagcttgacattgagctgtgccgcgagccagttcacgttctcgaactatggcatgcactgggtcaggcaagcgcccgggaaagggctcgagtgggtggcctcgatctcgaacgatggctcgaaaaagtaccatggcgatagtgtgtgggcgcgctttatcataagcagggacaatagcaagaacacactatttctccagatgtcgagcttgcgcgcggaagataccgcgctctatttctgtgtcagggaccatcgcgaggacgagtgcgaggaatggtggtcggactattacgatttcgggcgagagctcccgtgcaggaaatttcgcgggctcgggctcgcgggcatattcgatatctggggccatggcacgatggtgaccgtgagctcg

SEQ ID NO: 55347 - RNA, 432 nt, synthetic construct
  misc_feature 1..432: note = derived and/or modified sequence opt11 from anti-HIV_cap256-119-103011_VR-Chain
  source 1..432: mol_type = other RNA
caagtgcaactggtcgagagcgggggcggggtcgtgcaaccgggcgggagcttgcgcttgagctgtgccacgagcgggttcacgttcgggacctttggcatgcactgggtcaggcaagcgcccgggaaaggactcgattgggtggccgcgatatcgttcgcgggcacgaaaaagaactatgccgatagcgtgcgagggcgctttaccataagcagggactcgagcaagaacacgctctatctccaaatgaatagcttgcgcccggaagataccgcgctctattactgtgtcaaggacatgcgcgggtacgagtgcgaggaatggacatcggactattacgatttcgggcgaccacaaccgtgcatagactcgcgcggggtcgtgggcacgttcgatgtctggggccagggcacgatggtgaccgtgagctcg

SEQ ID NO: 55348 - RNA, 438 nt, synthetic construct
  misc_feature 1..438: note = derived and/or modified sequence opt11 from anti-HIV_cap256-119-102072_VR-Chain
  source 1..438: mol_type = other RNA
gaagtgcaattggtcgagagcggaggcgggctcgtgcaaccgggcgggagcttgcgcgtgagctgtgccgtgagcgggttcacgttctcgaactatgaaatgaactgggtcaggcaagcgcccgggaaagggctcgagtgggtggcatcgatctcgaacgatggcacgaaaaagtaccatgccgagagcgtgtgggatcgctttagcataagcaaggacaatagcaagaacacgctctttctccagatgaatagcttgcgagtggaagatacagcgctctatttctgtgtcaaggaccagcgagaggacgagtgcgaggaatggtggtcggactattacgatttcgggcgcgagctcccgtgcaggaaatcgcgcgggcttgggctcgcgggcatattcgatatctggggccatggcacgatggtgaccgtgagctcg

SEQ ID NO: 55349 - RNA, 438 nt, synthetic construct
  misc_feature 1..438: note = derived and/or modified sequence opt11 from anti-HIV_cap256-119-101945_VR-Chain
  source 1..438: mol_type = other RNA
gaagtgcaattggtcgagagcgggggcgggctcgtgcaaccgggcgggagcttgcgcctgagctgcgccgcgagcgggttcacgttctcgagctatgtcatgcactgggtcaggcaagcgcccgggaaagggctcgagtgggtagcctcgatctcgaacgatggcacgaaaaagtaccatgaagagagcgtgtgggggcgctttaccataagcaaggacaatagcaagaacacgctctttctccagatgaatagcttgcgcatagaagataccgcgctctatttctgtgtcaaggaccagcgcgaggacgagtgcgaggaatggtggtcggactattacgatttcgggcgcgagctcccgtgcaggaaatcgcgagggctcgggctcgcgggcatattcgatatgtggggccatggcacgatggtgaccgtgagctcg

SEQ ID NO: 55350 - RNA, 432 nt, synthetic construct
  misc_feature 1..432: note = derived and/or modified sequence opt11 from anti-HIV_cap256-119-101319_VR-Chain
  source 1..432: mol_type = other RNA
caagtgcaactggtcgagagcgggggcggggtcgtgcaaccgggcaagagcttgcgcttgagctgtgtcgggagcgggttcacgttcgatgactatggcatgcactgggtcaggcaagcgcccgggaaagggctcgagtgggtggcctcgatctcgtacgatggaagagacttttaccatgccagaagcgtgtgggggcgctttaccataagcagggacaatagcaagaacacgctccatctccagatgaatagcctgcgcccggaagataccgcgctctatttctgtgcaagggacttgcgcgagagcgagtgcgaggaatgggaatcgtactattacgatttcgggaaaaagggcccgtgcgtgaaaccgcgcggggtcgtgggcgtgctcgatatctggggacagggcacgctcgtgaccgtgagctcg

SEQ ID NO: 55351 - RNA, 432 nt, synthetic construct
  misc_feature 1..432: note = derived and/or modified sequence opt11 from anti-HIV_cap256-119-100871_VR-Chain
  source 1..432: mol_type = other RNA
caagtgcaattggtcgagagcgggggcggggtcgtgcaaccgggcgagagcttgcgcataagctgtgccgcgagccagttcacgttctcgcgctatggcatgcactgggtcaggcaagcgcccgggaaagggctcgagtgggtggcctcgatctcgttcgatggcagagacaagtaccatagctcgctcgtgtgggggcgcttgaccataagcagggacaatagcaagagcacgctatttctccagatgaatagcttgcgcgcggaagataccgcgctctattactgtgccagggacttgcgcgagagcgagtgcgaggaatgggaatcggactattacgatttcgggaaaccgcaaccgtgcgaggacccgcgcggagtcgtgggcacgttcgatatgtggggcttgggcacgctcgtgaccgtgagctcg

SEQ ID NO: 55352 - RNA, 432 nt, synthetic construct
  misc_feature 1..432: note = derived and/or modified sequence opt11 from anti-HIV_cap256-119-100838_VR-Chain
  source 1..432: mol_type = other RNA
gaagtgcaattggtcgagagcgggggcggggtcgtgcaaccgggcgggagcttgcgcttgagctgtgccgcgagcgggttcacgttctcgagctatggcatgcactgggtcaggcaagcgcccgggaaagggctcgagtgggtggcctttatcaggtacgatggctcgaacaagtactatgccgatagcgtgaaagggcgctttaccataagcagggacaatagcaatcacacgctctatatgcagctcgatagcttgcgcgcggaagataccgcgctatattactgtgccaaggacttgcgagagtacgagtgcgaggaatggacctcggactattacgatttcgggcgcccgcaaccgtgcatagactcgcgcggggtagtgggcatactcgatatatggagccagggcacgatggtgaccgtgagctcg

SEQ ID NO: 55353 - RNA, 438 nt, synthetic construct
  misc_feature 1..438: note = derived and/or modified sequence opt11 from anti-HIV_cap256-119-100025_VR-Chain
  source 1..438: mol_type = other RNA
caagtgcaattggtcgagagcgggggcggggtcgtgcaaccgggaaggagcttgcgcttgagctgtgccgcgagcgtgttcacgttctcgtactatggcatgcactgggtcaggcaagcgccagggaaagggctcgagtgggtggcctttatatcgcacgatggctcgaacaagtactatgccgatagcgtgcgcgggcgctttatcataagcagggacaatagcaataacacgctctatgtccagatgaatagcttgcgcgcggaagataccgcgctctatttctgtgtcaaggaccagcgcgaagacgagtgcgaggaatggtggtcggactattacgatttcgggcgcgagctcccgtgcaggaaatttcgcgggctcgggctcgcgggcacgttcgatatctggggccatggcacgatgttgatcgtgagctcg

SEQ ID NO: 55354 - RNA, 432 nt, synthetic construct
  misc_feature 1..432: note = derived and/or modified sequence opt11 from anti-HIV_cap256-119-100000_VR-Chain
  source 1..432: mol_type = other RNA
caaatgcaactggtcgagagcggaggcggggtcgtgcaaccgggcaggagcctgaccttgagctgtgccgcgagccagttcacgttctcgaactatggcatgcactgggtcaggcaagcgcccgggaaagggctcgagtgggtggcctcgatctcaaacgatggcaataaaaagtaccatggcgatagcgtgtgggcgcgctttaccataagcagggacaatagcaagaacacgctctttctccagatgtcgagcctgcgcacggaagataccgcgctctatttctgtgtcagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctcg

SEQ ID NO: 55355 - RNA, 432 nt, synthetic construct
  misc_feature 1..432: note = derived and/or modified sequence opt11 from anti-HIV_cap256-119-098890_VR-Chain
  source 1..432: mol_type = other RNA
caagtgcaattggtcgagagcgggggcggggtcgtgcaaccgggcgagagcttgcgcataagctgtgtcgcgagccagttcacgttcgggcgctatggaatgcactgggtcaggcaagcgccagggaaagggctcgagtgggtggcctcaatctcgttcgatggcagggacaagtaccatagcccgctcgtgtgggggcgcttgaccataagcagggacaatagcaagaacacgctctttctccagatgaatagcctgcgcacggaagataccgcgctctattactgtgccagggacctgcgcgagagcgagtgcgaggaatgggaatcggactattacgcgttctggcgcaagctcccgtgcgtgaaaccgcgcggggtcgcgggcacgctcgatatctggggccagggcacgatggtgagcgtgagctcg

SEQ ID NO: 55356 - RNA, 435 nt, synthetic construct
  misc_feature 1..435: note = derived and/or modified sequence opt11 from anti-HIV_cap256-119-098715_VR-Chain
  source 1..435: mol_type = other RNA
caagtgcaattggtcgagagcggaggcggggtagtgcaaccgggcaggagcttgcgcttgagctgtgccgcgagcgggttctcgttcaataaccacggcatgcactgggtcaggcaagcgcccgggaaagggctcgagtgggtggcaggaatatcgttcgcgggcatcaaaaagtactatggcacgagcgtgaaagggcgctttaccataagcagggacaatagcaagaacaatctctttctccagatgaatagcctgcgcgtggaagataccgcgctctactactgtgccagggacctgcgagagatggagtgcgaggaatggaccctgtacaattactatgactttggctcgcgcgggccctgtgtagatcccagaggcgtggtagggagctttgacgtgtgggggcaagggaccatggtcacggtctcgagc

SEQ ID NO: 55357 - RNA, 438 nt, synthetic construct
  misc_feature 1..438: note = derived and/or modified sequence opt11 from anti-HIV_cap256-119-098632_VR-Chain
  source 1..438: mol_type = other RNA
caaatgcaactggtcgagagcgggggcggggtcgtgcaaccgggcagaagcctcaccttgagctgtgccgcgagccagttcaatttcgcgaactatgacatgcactgggtcaggcaagcacccgggaaagggctcgagtgggtggcatttatcaggtacgatggcaataacaagtactatgccgatagcgtgaaagggcgctttaccataagcagggacaatagcaagagcacgttgttcctccagatgaatagcttacgcatagaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggaacgatggtgaccgtgagctcg

SEQ ID NO: 55358 - RNA, 432 nt, synthetic construct
  misc_feature 1..432: note = derived and/or modified sequence opt11 from anti-HIV_cap256-119-097199_VR-Chain
  source 1..432: mol_type = other RNA
caagtgcaattggtcgagagcgggggcggggtcgtgcaaccgggcaggagtctgcgcttgagctgtgccgcgagcgggttcgcgttctcgagctatgcctttcactgggtcaggcaagcgcccgggaaagggctcgagtgggtggcctatatcccgttccatggcaatcaacagtactatggcgatagcgtgaaagggagatttaccataagcagggacaatagcagggacacgctatttctagagatgaatagcttgcgcccggaagataccgcgctctatttctgtgccagggaccagcgatattacgagtgcgaggaatgggcctcggactattacgatttcgggcgagagcaaccgtgcttggacccgcgcggggtcgtgggcatattcgatctctggggccagggcacgatggtgacagtgagctcg

SEQ ID NO: 55359 - RNA, 432 nt, synthetic construct
  misc_feature 1..432: note = derived and/or modified sequence opt11 from anti-HIV_cap256-119-096189_VR-Chain
  source 1..432: mol_type = other RNA
caagtgcaattggtcgagagcgggggcggggtcgtgcaaccgggcaggagcctgcgattgagctgtgccgcgagcgggttcaagttcgggagctttggcatgcactgggtcaggcaagcgcccgggaaagggctcgagtgggtggccgtgatctcgtacgatggctcggacaagtactatggctcgagcgtgcgcgggcgatttagcataagcagggacaatagcaagaacacgctctatctccagatgaatagcttgcgcacggaagataccgcgctctatttctgtgccaaggacctgcgcgagtacgagtgcgaggaatggacctcggactattacgatttcgggcgcccgcaaccatgcatagactcgcgcggggtcgtgggcatactcgatatctggggccagggcacgatggtgaccgtgagctcg

SEQ ID NO: 55360 - RNA, 432 nt, synthetic construct
  misc_feature 1..432: note = derived and/or modified sequence opt11 from anti-HIV_cap256-119-094581_VR-Chain
  source 1..432: mol_type = other RNA
caagtgcacttggtcgagagcgggggcggggtcgtgcaaccgggcaggagcctgcgcttgagctgtgccgcgagcgggttcaatttctcgaactatgccatacactgggtcaggcaaacgcccgggaaagggctcgagtgggtgaccttgatctcgaacgatggctcgaacaagtactatgccgatagcttgaaagggcgctttaccataagcagagacaatagcaagaacacgctctatctccagatgaatagcctgcgcgcggaagacaccgcactctattactgtgccaaggacttgcgcgaggacgagtgcgaggaatggtggtcggactattacgatttcgggaaacagctcccgtgcaggaaatcgcgcggggtagcgggcatattcgatggatggggccagggcacgatggtgaccgtgagctcg

SEQ ID NO: 55361 - RNA, 432 nt, synthetic construct
  misc_feature 1..432: note = derived and/or modified sequence opt11 from anti-HIV_cap256-119-094200_VR-Chain
  source 1..432: mol_type = other RNA
gaagtgcaattggtagagagcgggggcgggctcgtgcaaccgggcgggagcttgcgcttgagctgtgccgcgagcgggttcatattctcaagctatgccttgcactgggtcaggcaagcgcccgggaaagggctcgagtgggtggcctcgatctcgttcgcgggcacgaaaaatcactatggcaacagcgtgaaagggcgctttaccataagcagggacaatagcaagaacacggtctatctccagatgaatagcttgcgcgcggaagataccgcgctctattactgtgcaaaggacttgcgcgagtacgagtgcgaggaatggacctcggactattacgatttcgggcgcccgcaaccgtgcatagactcgcgcggggtcgtgggaatactcgatatctggagccagggcacgatggtgaccgtgagctcg

SEQ ID NO: 55362 - RNA, 432 nt, synthetic construct
  misc_feature 1..432: note = derived and/or modified sequence opt11 from anti-HIV_cap256-119-094158_VR-Chain
  source 1..432: mol_type = other RNA
caaatgcaattggtcgagagcgggggcggggtcgtgcaaccgggctcgagcctgaccttgagctgtgccgcgagccagttcacgttctcgaactatggaatgcactgggtcaggcaagcgcccgggaaagggctcgagtgggtggcctcgatctcgaacgatggcacgaaaaagtaccatggcgatagcgtgtgggatcgctttaccataagcagggacaatagcaagaacacgctctttctccagatgaatagcttgcgcgcggaagataccgcgctctatttctgtgtcaaggaccagcgcgaggacgagtgcgaggaatggtggtcggactattacgatttcgggaaacagctcccgtgcaggaaatcgcgcggggtcgcgggcatattcgatagctggggccagggcacgatggtgaccgtgagctca

SEQ ID NO: 55363 - RNA, 432 nt, synthetic construct
  misc_feature 1..432: note = derived and/or modified sequence opt11 from anti-HIV_cap256-119-092814_VR-Chain
  source 1..432: mol_type = other RNA
caagtgcaattggtcgagttcgggggcggggtcgtgcaaccgggcgggagcttgcgcttgagctgtgcagcgagcgggttctatttcacggactatggcatgcactgggtcaggcaagcgcccggggaagggctccagtgggtggcctttatctcgtacgatggcaatacaaagaccacggccgatagcgtgcgagggcgctttaccttgagcagggacaatagcaagaacacgctatatctccagatgaatagcgtgcgcgtggaagataccgcgcgctatttctgtgccagggacatgcgcgagtacgagtgcgagctctgggcctcggactattacgatttcgggaaaccgcaaccgtgcgaggacccgcgcggggtcgtgggcacgttcgatatgtggggcttgggcacgctagtgaccgtgagctcg

SEQ ID NO: 55364 - RNA, 432 nt, synthetic construct
  misc_feature 1..432: note = derived and/or modified sequence opt11 from anti-HIV_cap256-119-092808_VR-Chain
  source 1..432: mol_type = other RNA
caagtgcaattggtcgagagcgggggcggggtcgtgcaaccgggcaggagcttgcgcttgagctgtgccgcaagccagttctcgttcgggaactatggcatgcactgggtcaggcaagcgcccgggaaagggctagagtgggtggccgcgatctcgttcgcgggcacgaaaacgaactatgccgatagcgtgaaagggcgctttaccataagcagagacaatagcaagaacacggtctatctccagatgaatagcttgcgcgcggaagataccgcgctctatttctgtgccaaggacatacgcgagtacgagtgcgagtactggacctcggactattacgatttcgggcgcccgcaaccgtgcatagactcgcgcggggtcgtgggcacgttcgatgtctggggccagggcacgatggtgaccgtgagctcg

SEQ ID NO: 55365 - RNA, 432 nt, synthetic construct
  misc_feature 1..432: note = derived and/or modified sequence opt11 from anti-HIV_cap256-119-092573_VR-Chain
  source 1..432: mol_type = other RNA
caagagcaattggtcgagagcgggggcggggtcgtgcaaccgggcacgagcttgcgcttgagctgtagcgcgagcgggttcacgttctcgaactttgccatgaactgggtcaggcaagcgcccgggaaagggctcgagtgggtgagctttatctcgagcgatggcaagaacaagaactatgtcgatagcgtgaaagggcgctttacaataagcagggacaattacaagaacacgctctatctccagatgaatagcttgcgcacggaagataccgcggtctattactgtgccaaggacttgggcgggaccaaggacgatgaatgggccacggactattacgattggtcgacagcgtacccggtccaggacccgcgcgcggtcgcgggcgggttcgatctctggggcttgggcacgatggtgaccgtgagctcg

SEQ ID NO: 55366 - RNA, 432 nt, synthetic construct
  misc_feature 1..432: note = derived and/or modified sequence opt11 from anti-HIV_cap256-119-090815_VR-Chain
  source 1..432: mol_type = other RNA
caagtgcaattggtcgagagcgggggcggggtcgtggaaccgggcaggagcttgcgattgagctgtgcagcgagccagttctcgttctcgagctatggcatgcactgggtcaggcaagcgcccgggaaagggctcgagtgggtggccgcgatctcgttcgatggcgcggacaagtaccatgccgataacgtgtgggggcgcttgagcataagcagggacaatagcaagagcacgctctatctccagatgaatagcctgcgcccggaagataccgcggtctatttctgtgccaaggacttgcgcgaggacgagtgcgaggaaaggtggtcggactattacgatttcgggaaacagctcccgtgcaggaaatcgcgaggggtcgcgggcatattcgataactggggccagggcacgatggtgaccgtgagcgcg

SEQ ID NO: 55367 - RNA, 438 nt, synthetic construct
  misc_feature 1..438: note = derived and/or modified sequence opt11 from anti-HIV_cap256-119-090368_VR-Chain
  source 1..438: mol_type = other RNA
caagtgcaattggtcgagagcgggggcggggtcgtgcaaccgggcaggagcttgcgcttgagctgtgccgcgagcgggttcgcgttctcgcactatggaatattctgggtcaggcaagcgcccgggaaagggctcgagtgggtggcctcgatctcgaacgatggcacgaaaaagtaccatgccgagagcgtgtgggatcgctttagcataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgacagtgagctcg

SEQ ID NO: 55368 - RNA, 432 nt, synthetic construct
  misc_feature 1..432: note = derived and/or modified sequence opt11 from anti-HIV_cap256-119-089710_VR-Chain
  source 1..432: mol_type = other RNA
caagtgcaattggtcgagagcgggggcggggtcgtgcaaccgggcaggagcttgcgcttgagctgtaccgcgagcggattcgggttctcgaactatgccatgcactgggtcaggctcgcgcccgggaaagggctcgagtgggtggcctcaatctcgtacgatggcagggactatcaccatgccggggccgtgtgggggcgctttatcataagcagggacaatagcaagaactcgctccatctccagatgaatagcttgcgcccggaagataccgcgctctatttctgtgccagggacttgcgcgagagcgagtgcgaggaatgggaatcggactactacaatttctggaaaaagctaccgtgcgtgaaaccgcgcggggtcgtgggcatactcgatatctggggccagggcacggtcgtgaccgtgagctcg

SEQ ID NO: 55369 - RNA, 432 nt, synthetic construct
  misc_feature 1..432: note = derived and/or modified sequence opt11 from anti-HIV_cap256-119-088555_VR-Chain
  source 1..432: mol_type = other RNA
caagtgcaattggtcgagagcgggggcggggtcgtgcaagcgggcaggagcttgcgcttgagctgtgccgcgagccagttcacgttctcgcgctatggcatgcactgggtcaggcaagcgcccgggaaagggctcgagtgggtggccgggatctcgtacgatggtagggacaagtaccatgcccatttcgtgtgggggcgcttcatcataagcagggacaatagcaagaacacgctctatctccagatgaatagcttgcgcgcggaagataccgcgctatattactgtgtcagggacttgcgcgagagcgagtgcgagctctgggaatcggactattacgatttcggaaaaaggctcccgtgcgtaaaaccgcgcggggtcgcgggcacgttcgatctctggggccagggcacgatggtgaccgtgagctcg

SEQ ID NO: 55370 - RNA, 432 nt, synthetic construct
  misc_feature 1..432: note = derived and/or modified sequence opt11 from anti-HIV_cap256-119-087962_VR-Chain
  source 1..432: mol_type = other RNA
gaaatgcaattggtcgagagcgggggcgggctcgtgaaaccgggcaggagcctgcgattgagctgtgccgcgagcgggttcacgttctcgagctatgccatacactgggtcaggcaagcgcccgggaaagggctcgagtgggtggccgtgatctcgtacgatggctcgaacaagtactatgccgatagcgtgaaagggcgctttaccataagcagggacaatagcaagaacacggtctatctccagatgaatagcctgcgcgtggaagataccgcgctctattactgtgccaaggacttacgagagtacgagtgcgaggaatggacctcagactattacgatttcgggaaaccgcaaccgtgcatagactcacgcggggtcgtaggcatactcgatatctggggccagggcataatggtgaccgtgagctcg

SEQ ID NO: 55371 - RNA, 432 nt, synthetic construct
  misc_feature 1..432: note = derived and/or modified sequence opt11 from anti-HIV_cap256-119-086903_VR-Chain
  source 1..432: mol_type = other RNA
caagtgcacctggtcgagagcgggggcggggtagtgcaaccgggcaagagcttacgcttgagctgtgccgcgagccagttcacgttcgatcgctatggcatgcactgggtcaggcaagcgcccgggaaagggctcgagtgggtggcctcgatctcgaacgatggcacggacaagtaccatgccgataacgtgtgggggcgctttaccataagcagggacaatagcaagaacacgctctatctcgagatgaatagcctgcgcggggaagataccgcgctctattactgtgccaaggacatgcgagaggacgagtgcgaggaatggtggtcggactattacgatttcgggcgcccgcaaccgtgcatagactcgcgcggggtcgtgggcacgttccatgtctggggccagggcacgatggtgaccgtgagctcg

SEQ ID NO: 55372 - RNA, 432 nt, synthetic construct
  misc_feature 1..432: note = derived and/or modified sequence opt11 from anti-HIV_cap256-119-086804_VR-Chain
  source 1..432: mol_type = other RNA
gaagtgcaattggtcgagagcgggggaggggtcgtgcaaccgggcaggagcttgcgcttgttctgtgccgggagcgggttcacgttctcgagctatggcttgcactgggtcaggcaagcgcccgggaaagggctcgagtgggtgagctttatctcgtacgatggctcgaccacgaaatatgccgatagcttgaaagggcgatttaccgtaagcagggacaatagcaagaacacggtctatctcgagatgaatagcttgcgcgcggaagataccgcgctctattactgtgccaaggacttgcgcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55373 - RNA, 432 nt, synthetic construct
  misc_feature 1..432: note = derived and/or modified sequence opt11 from anti-HIV_cap256-119-085910_VR-Chain
  source 1..432: mol_type = other RNA
gaagtgcaattgctcgagagcggaggcgggctcgtgcaaccgggcgggagcctgcgcttgagctgtgccgcgagcgggttcacgttctcgagctatggcatgcactgggtccggcaagcggccgggaaagggctcgagtgggtggcctcgatctcgtacgatggcagggactatcaccatgccggggccgtgtgggggcgctttatcataagcagggacaatagcaagaactcgctccatctccagatgaatagcttgcgcccggaagataccgcgctctatttctgtgccagggacttgcgcgagagcgagtgcgaggaatgggaatcggactattacaatttctggaaaaagctcccgtgcgtgaaaccgcgcggggtcgtgggcatactcgatatctggggccagggcacggtcgtgacagtgagctcg

SEQ ID NO: 55374 - RNA, 432 nt, synthetic construct
  misc_feature 1..432: note = derived and/or modified sequence opt11 from anti-HIV_cap256-119-085772_VR-Chain
  source 1..432: mol_type = other RNA
gaagtgcgcttggtcgagagcgggggcgggctaatacaaccgggcgggagcttgcgcttgagctgtgccgcgagcgggctcacggtctcgagcaatcacatgagctgggtcaggcaagcgcccgggaaagggctcgagtgggtggccgtaatctcgtacgatggctcgaacacgttctatggcgatagcgtgaaagggcgctttaccgtgagcagggacataagcaagaacacgctatatctacagatgaatagcttgcgcccggaagatacagcgatgtattactgtgccagggaccagcgctattacgagtgcgaggaatgggcctcggactattacgatttcgggcgcgagcaaccgtgccaggacccgcgaggggtcgtgggcgtgttcgatatgtggggccagggcacgatggtgaccgtgagctcg

SEQ ID NO: 55375 - RNA, 432 nt, synthetic construct
  misc_feature 1..432: note = derived and/or modified sequence opt11 from anti-HIV_cap256-119-084603_VR-Chain
  source 1..432: mol_type = other RNA
caagtgcaattggtcgagagcgggggcggggtcgtgcaatcgggcaggagcttgcgcttgagctgtgccgcgagcgggttcccgttctcggactttgccatgcactgggtcaggcaagcgcccgggaaagggctcgagtgggtggcctcgatctcgttcgtgggcataaaaacgcactatgccaatagcgtgcgcgggagatttaccataagcagggaccagagcaagaacacgctctatctccagatgaatagcgtgcgcgtggaagataccgggcgatattactgtgccagggacatgcgcgagtacgagtgcgagctctgggcctcggactattacgatttcgggaaaccgcaaccgtgcgaggacccgcgcggagtcgtgggcacgttcgatatgtggggcttgggcacgctagtgacagtgagctcg

SEQ ID NO: 55376 - RNA, 432 nt, synthetic construct
  misc_feature 1..432: note = derived and/or modified sequence opt11 from anti-HIV_cap256-119-084276_VR-Chain
  source 1..432: mol_type = other RNA
caagtgcaattggtcgagagcgggggcggggtcgtgcaaccgggcaggagcctgcgcctgagctgtgccgcgagcaggttcacgttctcgagctatgccatgcactgggtcaggcaagcgcccgggaaagggctcgagtgggtggccgtgatctggtacgatggctcgaacaagtactatgccgatagcgtgcgcgggcgatttagcgtgagcacggacataagcaagaacacgctctatctccagatgaatagcttgcgaccggccgataccgcgctctatttctgtgccagagacttgcgctattacgagtgcgaggaatgggcctcggactattacgatttcgggaaagagcaaccgtgcttggacccgcgcggggtcgtgggcatattcgatctctggggccagggcacgatggtgaccgtgagctcg

SEQ ID NO: 55377 - RNA, 432 nt, synthetic construct
  misc_feature 1..432: note = derived and/or modified sequence opt11 from anti-HIV_cap256-119-082288_VR-Chain
  source 1..432: mol_type = other RNA
caagtgtacttggtcgagagcgggggcggggtcgtgcaaccgggcaggagcttgcgcctgagctcggccgcgagccatttctcgctatcgagctatggcatgcactgggtcaggcaagcgcccgggaaagggctcgagtgggtggccgggatctcattcgcgggcacgaaaacgtactatggagatagcgtgaaagggcgctttaccgtgagcacggacataagcaagaacacgctctatctccaggtcaatagcttgcgcccggaagataccgcgatgtattactgtgccagagaccagcgctattacgagtgcgaggaatgggcctcggactattacgatttcgggaaagagcaaccgtgcttggacccgcgcggggtcgtgggcatattcgatatctggggccagggcacgatggtgaccgtgagctcg

SEQ ID NO: 55378 - RNA, 432 nt, synthetic construct
  misc_feature 1..432: note = derived and/or modified sequence opt11 from anti-HIV_cap256-119-080383_VR-Chain
  source 1..432: mol_type = other RNA
caagtgcaattggtcgagagcgggggcggggtcgtgcaaccgggcaggagcttgcgcataagctgtgccgcgagccagttcacgttctcacgatatggcatgcactgggtcaggcaagcgcccgggaaagggctcgagtgggtggcctcgatctcgtacgatggcacggacaagtaccatgccaggctcgtgtggggacgctttaccataagcagggacaatagcaagaacacgctctatctccagatgaatagcttgcgcgcggaagataccgcgctctattactgtgtcagggacgagagagagagcgagtgcgagctctgggaatcggactattacgatttcgggaaaaagctcccgtgcgtgaaaccgcgcggggtcacgggctcgctcgatatgtggggacagggcacgcaagtgaccgtgagctcg

SEQ ID NO: 55379 - RNA, 438 nt, synthetic construct
  misc_feature 1..438: note = derived and/or modified sequence opt11 from anti-HIV_cap256-119-079333_VR-Chain
  source 1..438: mol_type = other RNA
gaagtgcaattagtcgagagcgggggcaggctcgtgcaaccgggctcgcccttgcgcttgagctgtgccgcgagccagttcaatttcgcgagctatggcatgcactgggtcaggcaagcgccagggaaagggctcgagtgggtggcctcgatctcgaacgatggcacgaaaaagtaccatgccgagagtgtgtgggatcgctttagcataagcaaggacaatagcaagaacacgctctttctccagatgaatagcttgcgcgtggaagataccgcgctatatttctgtgtcaaggaccagcgcgaggacgagtgcgaggaatggtggtcagactattacgatttcgggcgcgagctcccgtgcaggaaatcgcgcgggctcgggctcgcgggcatattcgatatgtggggccatggcacgatggtgaccgtgagctcg

SEQ ID NO: 55380 - RNA, 441 nt, synthetic construct
  misc_feature 1..441: note = derived and/or modified sequence opt11 from anti-HIV_cap256-119-078618_VR-Chain
  source 1..441: mol_type = other RNA
caaatgcaattggtcgagagcgggggcggggtcgtgcaaccgggcaggagcttgaccttgagctgtgccgcgagccagttcaatttcgcgagctatggcatgcactgggtcaggcaagcgcccgggaaagggctcgagtgggtggcctcgatctcgaacgatggcacgaaaaagtaccatgcagagagcgtgtgggatcgctttagcataagcaaggacaatagcaagaacacgctctttctccagatgaatagcttgcgagtggaagataccacgctatatttctgtgtcaaggaccagcgcgaggacgagtgcgaggaatggtggtcggactattacgatttcgggcgcgagctcccgtgcaggaaatcgcgcgggctcgggctcgcgggcaatttctgtatctgtggcgcggacgggaccatggtaacggtctcgagc

SEQ ID NO: 55381 - RNA, 432 nt, synthetic construct
  misc_feature 1..432: note = derived and/or modified sequence opt11 from anti-HIV_cap256-119-077466_VR-Chain
  source 1..432: mol_type = other RNA
caagtgcaattggtcgagagcgggggcggggtcgtgcaaccgggctcgcccttgcgcataagctgtgccgtgagccagttcacgttctcgcgctatggcatgcactgggtcaggcaagcgcccgggaaagggctcgagtgggtggcctcgatctcgttcgatggcagggacaagtaccatagctcgctcgtgtgggggcgtttgaccataagcagggacaatagcaagagcacgctatttctccagatgaatagcttgcgcgcggaagataccgcgctctattactgtgcaagggacttgcgagagagcgagtgcgaggaatgggaatcggactattacgcgttctatcgcaagctcccgtgcgtgaaaccgcgcggggtcgcgggaacgctcgatatctggggccagggcacgatggtgaccgtgagctcg

SEQ ID NO: 55382 - RNA, 423 nt, synthetic construct
  misc_feature 1..423: note = derived and/or modified sequence opt11 from anti-HIV_cap256-119-076284_VR-Chain
  source 1..423: mol_type = other RNA
caggtccagctcgtggaatcgggcgggggcgtggtccagcccgggcgctcgctcaggctctcgtgcgcggcctcgaacacgtacgcaatgcattgggtgcgacaggccccgggcaagggcttggaatggatggcgctcataagctatgaagggagcgataaatattacgtggactcagtcaagggcaggttcacgatctcgcgcgataactcgaaatcgaccttgtacttgcaaatgaactcgctctcggccgaggacacggccgtgtacttttgcgcgaaagatctcgggggcaataaagatgacgagtggacgaccgattactattacgattggtcgaaagcgcgcccggtccaggacccgcgcgtggtcgcgggcacgttcgatatctggggccagggcacgatggtgaccgtgagctcg

SEQ ID NO: 55383 - RNA, 432 nt, synthetic construct
  misc_feature 1..432: note = derived and/or modified sequence opt11 from anti-HIV_cap256-119-074680_VR-Chain
  source 1..432: mol_type = other RNA
gaagtgcaattggtcgagagcgggggagggctcgtgcaaccgggcaggagcttgcgattgagctgtgccgggagcgggttcacgttcgtggactatgccatgcactgggtcaggcaagtgcccgggaaagggctcgagtgggtgggctcgatctcgtacgatggctcggacaagtaccataccaatagcgtgtgggggcgctttatcgtgagcagggacaatagcaagaacacgctatatctccagatgaatagcttgcgcccggaagataccgcgctctattactgtgtcagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctcg

SEQ ID NO: 55384 - RNA, 432 nt, synthetic construct
  misc_feature 1..432: note = derived and/or modified sequence opt11 from anti-HIV_cap256-119-074081_VR-Chain
  source 1..432: mol_type = other RNA
gaagtgcaattggtcgagagcgggggcgggctagtgcaaccgggcgggagcttgcgcttgagctgtgtcgtgagcggggtcacggtctcgagcaattacatgagctgggtcaggcaagcgcccgggaaagggctcgagtgggtggcctcgatctcgtacgatggctcggacaagtaccatgcagatcgcgtgtgggggcgctttaccataagcagggacaatagcaagaacacgctatatctccagatgaatagcttgcgcgcggaagataccgcgctatattactgtgtcagggacgcgcgcgagagcgagtgcgagctatgggaatcggactattacaatttcgggcgcaagctcccgtgcgtgaaaccgcgcggggtcgcgggcacgctcgatatctggggccagggcacgatggtgaccgtgagctcg

SEQ ID NO: 55385 - RNA, 432 nt, synthetic construct
  misc_feature 1..432: note = derived and/or modified sequence opt11 from anti-HIV_cap256-119-071704_VR-Chain
  source 1..432: mol_type = other RNA
caaatgcaattggtcgagagcgggggcggggtagtgcaaccgggcgggagcttgcgcttgagctgtgccgtgagccagttcacgttcacgagctatggcatgcactgggtcaggcaagcgcccgggaaagggctcgagtgggtggccacgatctcgagcgatggctcgaaaaagtaccatggcgatagcgtgtgggggcgcttgaccataagcagggacaatagcaagaacacgctctttctccagatgaataacttacgcgcggaagataccgcgctctatttctgtgtcaaggaccagcgcgaggacgagtgcgaggaatggtggtcggactattacgatttcgggaaaaagctcccgtgcaggaaatcgccagggctcgcgggcatattcgatgtctggggccatggcacgatggtgaccgtgagcccg

SEQ ID NO: 55386 - RNA, 432 nt, synthetic construct
  misc_feature 1..432: note = derived and/or modified sequence opt11 from anti-HIV_cap256-119-071266_VR-Chain
  source 1..432: mol_type = other RNA
caagtgcaattggtcgagagcgggggcggggtcgtgcaaccgggcgagagcttacgcttgagctgtgccgcgagcgggttcacgttctcgagctttggcatgcactgggtcaggcaagcgcccgggaaagggctcgagtgggtgggatcgatctcgtacgatggctcggacaagtaccataccaatagcgtgtgggggcgatttatcgtgagcagggacaatagcaagaacacgctatatctccagatgaatagcttgcgcccggaagataccgcgctatattactgtgtcagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctcg

SEQ ID NO: 55387 - RNA, 432 nt, synthetic construct
  misc_feature 1..432: note = derived and/or modified sequence opt11 from anti-HIV_cap256-119-069667_VR-Chain
  source 1..432: mol_type = other RNA
gaagtgcaattggtcgagagcgggggcgggctagtgcaaccgggcaggagcctgcgcttgagctgtgccgcgagcgggttctcgttcaatacctatggcatgcactgggtcaggcaagcgcccgggaaagggctcgagtgggtggcctttatcaggtacgatggctcgaacaagtactatgccgatagcgtgaaagggcgctttaccataagcagggacaatagcaagaacacgctctatctccagatggatggcctgcgcggggaagataccgcgctctattactgtgccaaggacctgcgcgagctcgagtgcgaggaatgggcctcggactattacgatttcgggcgcccgcaaccgtgcttagacccacgcggggtctcgggcataagcaatgtctggggccagggcacgatggtgacagtgagctcg

SEQ ID NO: 55388 - RNA, 432 nt, synthetic construct
  misc_feature 1..432: note = derived and/or modified sequence opt11 from anti-HIV_cap256-119-069591_VR-Chain
  source 1..432: mol_type = other RNA
caagtgcaattggtagagagcgggggcggggtcgtgcaaccgggcaggagcctgcgcttgagctgtgccgcgagcgggttcacgttctcgagctatgccatgcactgggtcaggcaagcgcccgggaaagggctagagtgggtggccgggatctcgtacgatggctcggacaagtaccatgccgataaagtgtgggggcgctttaccataagcagggacaatagcaagaacacgctctatctccagatgaatagcttgcgcgcggaagataccgcgctctattactgtgccaaggacttgcgcgaggacgagtgcgaggaatggtggtcggactattacgatttcgggaaaaggctcccgtgcaggaaatcgcgcggggtcgcgggagtgttcgataaatggggccagggcacgatggtgaccgtgagctcg

SEQ ID NO: 55389 - RNA, 432 nt, synthetic construct
  misc_feature 1..432: note = derived and/or modified sequence opt11 from anti-HIV_cap256-119-068691_VR-Chain
  source 1..432: mol_type = other RNA
caagggcacttggtcgcgagcgggggcggggtcgtgcccccgggcaggagcctgaccttgagctgtctcgcgagccagttcacgttctcgggctatggctttcactgggtcaggcaagcgcccgggaaagggctcgagtgggtggcctcgatctcgttcgcgggcacgaaaaagcactatggcaatagcgtaaaagggcgctttaccataagcagggacaatagcaagaacacactctatctcgagatgaatagcttgcgcccggaagataccgcgctctattactgtgccaaggacaggcgcgagtacgagtgcgaggaatggacctcggactattacgatttcgggcgcccgcaaccgtgcatagactcgcgcggggtcgtgggcattctcgatatctggggcaggggcacgatggtgaccgtgagctcg

SEQ ID NO: 55390 - RNA, 432 nt, synthetic construct
  misc_feature 1..432: note = derived and/or modified sequence opt11 from anti-HIV_cap256-119-068488_VR-Chain
  source 1..432: mol_type = other RNA
caaatgcaattggtcgagagcgggggcggggtcgtgcaaccgggcatgagcttgacattgagctgtgccgcgagccagttcacgttctcgaactatggcatgcactgggtcaggcaagcgccagggaaagggctcgagtgggtggcctcgatctcgaacgatggctcgaaaaagtaccatggcgatagcgtgaaagggcgctttaccataagcagggacaatagcaagaacacgctctatctccagatggatggcttgcgcggggaagataccgcgctatattactgtgccaaggacttgcgcgagctcgagtgcgaggaatgggcctcagactattacgatttcgggagaccgcaaccgtgcttggacccgcgcggggtctcgggcataagcaatgtctggggccagggcacgatggtgaccgtgagctcg

SEQ ID NO: 55391 - RNA, 432 nt, synthetic construct
  misc_feature 1..432: note = derived and/or modified sequence opt11 from anti-HIV_cap256-119-067536_VR-Chain
  source 1..432: mol_type = other RNA
caagtgcaattggtcgagagcgggggcggggtcgtgcaaccgggcaggagcttgcgcataagctgtgcctcgagccagttcacgttctcgcgctatggcatgcactgggtcaggcaagcgcccgggaaagggctcgagtgggtggcatcgatctcgtacgatggcagggactatcaccatgcaggggccgtgtgggggcgctttatcataagcagagacaatagcaagaactcgctccatctacagatgaatagcttgcgaccggaagatacagcgctctatttctgtgccagggacttgcgagagagcgagtgcgaggaatgggaatcggactattacgcgttctatcgcaagctcccgtgcgtgaaaccgcgcggggtcgcgggaacactcgatatctggggccagggcacgatggtgaccgtgagctcg

SEQ ID NO: 55392 - RNA, 432 nt, synthetic construct
  misc_feature 1..432: note = derived and/or modified sequence opt11 from anti-HIV_cap256-119-065852_VR-Chain
  source 1..432: mol_type = other RNA
caagtgcacttggtcgagagcgggggcggggccgtgccctcgggcaggagcttgcgcttgagctgtgtcgcgagcgggttcacgttcggggtctatgacatacactgggtcaggcaagcgccagggaaagggctcgagtgggtggcctcgatctcgtacgatggcagggacaagtaccatagctcgctcgtgtgggggcgcttgaccataagcagggacaatagcaagagcacgctctttctccagatgaatagcttgagagcggaagataccgcgctctattactgtgccagggacttgcgcgagagcgagtgcgaggaatggcaatcggactattacgcgttctataaaaagctcccgtgcgtgaaaccgcgcggggtcgcgggaacgctcgatatctggggacagggcacgatggtgaccgtgagctcg

SEQ ID NO: 55393 - RNA, 432 nt, synthetic construct
  misc_feature 1..432: note = derived and/or modified sequence opt11 from anti-HIV_cap256-119-065457_VR-Chain
  source 1..432: mol_type = other RNA
ctcgggcgcttggtcgcgagcgggggcggggtcgtgcccccgggcaggagcccgcgcttgagctgtgtcgcgagccagttcacgttctcgggctgtggcttgcactgggtcaggcaagcgcccgggaaagggctcgagtgggtggccgcgatctcgttcgatggcacggacaagtaccatagcgatgacgtgtgggggcgctttaccataagcagggacaatagcaagaacacgctctatctccagatgaatagcttgcgcccggaagatacagcgctctattactgtgccaaggacttgcaagaggacgagtgcgaggaatggtggtcggactattacgatttcgggaaacagctcccgtgcaggaaatcgcgcggggtcgcgggcatattcgatgactggggccagggcacgatggtgaccgtgagctcg

SEQ ID NO: 55394 - RNA, 432 nt, synthetic construct
  misc_feature 1..432: note = derived and/or modified sequence opt11 from anti-HIV_cap256-119-064501_VR-Chain
  source 1..432: mol_type = other RNA
caagtgcaattggtcgagagcgggggcggggtcgtgcaaccgggcaggagcctgcgcttgagctgtgccgcgagcgggttcacgttctcgagttatgccatgcactgggtcaggcaagcgcccgggaaagggctagagtgggtggccgggatctcgtacgatggcagggacaagtaccatgcacatagcgtgtgggggcgcttgagcataagcagggacaatagcaagaacacgctctatctccagatgaatagcttgcgcacggaagataccgcgctctatcactgtgtcagggacttgcgcgagagcgagtgcgagctctgggaatcggactattacgatttcgggaaaaagctcccgtgcgtgaaaccgcgaggggtcgcgggcacgttcgatctctggggccagggcacgatggtgaccgtgagctcg

SEQ ID NO: 55395 - RNA, 432 nt, synthetic construct
  misc_feature 1..432: note = derived and/or modified sequence opt11 from anti-HIV_cap256-119-063568_VR-Chain
  source 1..432: mol_type = other RNA
caagtgcaaccggtcgagagcgggggcggggtcgtgtggccgggcaggagcttgcgcttgagctgtaccacgagcgggttcacgttctcgaactatgccatacactgggtcaggcaagcacccgggaaagggctccagtgggtggccgtgatctcgtacgatggctcgaacaagttctatgccgatagcgtgaaagggcgctttaccataagcagggacaatagcaagaacacgctctacctccagatgaatagcttgcgaccggaagataccgcgctctattactgtgccaaggacttgcgcgaggacgagtgcgaggaaaggtggtcggactattacgatttcgggaaacagctcccgtgcaggaaatcgcgcggggtcgcgggcgtgttcgataactggggccagggcacgatggtgaccgtgagctcg

SEQ ID NO: 55396 - RNA, 435 nt, synthetic construct
  misc_feature 1..435: note = derived and/or modified sequence opt11 from anti-HIV_cap256-119-063103_VR-Chain
  source 1..435: mol_type = other RNA
caagtgcaattggtcgagagcgggggcggactcgtgcaaccgggcaagagcttacgcttgagctgtgccgcgagcgggttcacgttctcgacctatggcatgcactgggtcaggcaagcgcccgggaaagggctagagtgggtggccttgatctcgtacgatggctcgtacacgtactatgccgatagcgtgaaagggcgcttcaccataagcagggacaatagcaagagcacgctcgatctccagctcaataccctgcgcccggaagataccgcgctctattactgtgccagggacttgcgcgagatggagtgcgaggaatggaaactgtacaattactatgactttcgcacgcgcgggccctgtgtcgatcccaggggcgtggtcgggagctttgacgtgtgggggcaagggaccgtggtcacggtctcgagc

SEQ ID NO: 55397 - RNA, 432 nt, synthetic construct
  misc_feature 1..432: note = derived and/or modified sequence opt11 from anti-HIV_cap256-119-061027_VR-Chain
  source 1..432: mol_type = other RNA
caagtgcaactggtcgagagcgggggcggggtcgtgcaaccgggcaggagcttgcgcttgagctgtagcgcgagcgggttcacgctctcgagctatggcatacactgggtcagacaagcgcccgggaaagggctcgagtgggtggccgtgatgtcgaacgatggatcgaaccagttctatggcgatagcgtgaaagggcgatttaccataagcagggacataagcaagaacacgctctatctccagatgaatagcttgcgcccggaagataccgcgatgtattactgtgccagggaccagcgatattacgagtgcgaggaatgggcctcagactattacgatttcgggcgcgagcaaccgtgccaggacccgcgcggggtcgtgggcgtgttcgatatgtggggccagggcacgatggtgaccgtgagctcg

SEQ ID NO: 55398 - RNA, 432 nt, synthetic construct
  misc_feature 1..432: note = derived and/or modified sequence opt11 from anti-HIV_cap256-119-058232_VR-Chain
  source 1..432: mol_type = other RNA
caagtgcaattggtcgagagcgggggcggggtcgtgcaaccgggcaagagcttgcgcttgagctgtaaagcgagccagttcacgttcaatcgctatggcatgcactgggtcaggcaagcgcccgggaaagggctagagtgggtggccgcgatctcgttcgatggcacggacaagtaccatgccgataaagtgtgggggcgctttaccataagcagggacgatagcaagagcacgctctatctccagatgaatagcttgcgcgcggaagataccgcgctctattactgtgccaaggacttgagagaggacgagtgcgaggaatggtggtcggactattacgatttcgggaaacagctcccgtgcaggaaatcgcgcggggtcgcgggcatattcgatggatggggccagggcacgatggtgacagtgagctcg

SEQ ID NO: 55399 - RNA, 432 nt, synthetic construct
  misc_feature 1..432: note = derived and/or modified sequence opt11 from anti-HIV_cap256-119-057341_VR-Chain
  source 1..432: mol_type = other RNA
caagtgcaattggtcgagagcgggggaggggtcgtgcaaccgggcaggagcttgcgcttgagctgtgccgcgagccatttctcgctctcgagctatggcatgcactgggtcaggcaagcgcccgggaaagggctcgagtgggtggccggggaatcgttcgcggccacgaacaagtactatgccgatagcgtgaaagggcgctttatcgtgagcagggacataagcaagaacacgctctatctcgaggtcaatagcttgcgcgcggaagataccgcgctctattactgtgccagggaccagcgatattacgagtgcgaggaatgggcctcggactattacgatttcgggcgcgagcaaccgtgccaggacccgcgcggggtcgcgggcatattcgatatctggggccagggcacgatggtgaccgtgagctcg

SEQ ID NO: 55400 - RNA, 438 nt, synthetic construct
  misc_feature 1..438: note = derived and/or modified sequence opt11 from anti-HIV_cap256-119-056895_VR-Chain
  source 1..438: mol_type = other RNA
caaatgcaactggtcgagagcggaggcggggtcgtgcaaccgggcagaagcctgcgattgagctgtgccgcgagccagttcacgttcgggagctatggcatgcactgggtcaggcaaatacccgggaaagggctagagtgggtggccacgatctcgtacgatggcacgaaaaagtaccatgccgatagcgtgtgggatcgctttatcataagcagagacaatagcaagaacacgctctttctacagatgaatagcttgcgcccggaagataccgcgctctatttctgtgtcaaggaccagcgacaggacgagtgcgaggaatggtggtcggactattacgatttcgggcgcgagctcccgtgcaggaaatcgcgcgggctcgggctcgcgggcatattcgatatgtggggccatggcacgatggtgaccgtgagctcg

SEQ ID NO: 55401 - RNA, 432 nt, synthetic construct
  misc_feature 1..432: note = derived and/or modified sequence opt11 from anti-HIV_cap256-119-056402_VR-Chain
  source 1..432: mol_type = other RNA
caagtgaaattggtcgagagcgggggcggggtcgtgcaaccgggcaagagcttgcgactgagctgtaccgcgagccagttcacgttctcgaactttggcatgcactgggtcaggcaagcgcccgggaaagggctcgagtgggtggcctcgatatcgttcgtgggcatcaaaaagcactatgccaatagtgtgcgcgggcgctttaccataagcagggaccagagcaagaacacgctctatctccagatgaatagcgtgcgcgtggaagataccgcgcgctatttctgtgccagggacatgcgcgagtacgagtgcgagctctgggcctcggactattacgatttcgggaaaccgcaaccgtgcgaggacccgcgcggggtcgtgggcacgttcgatatgtggggattgggcacgctcgtgaccgtgagctcg

SEQ ID NO: 55402 - RNA, 432 nt, synthetic construct
  misc_feature 1..432: note = derived and/or modified sequence opt11 from anti-HIV_cap256-119-056034_VR-Chain
  source 1..432: mol_type = other RNA
caagtgcaactggtcgagagcgggggcggggtcgtacaaccgggaaggagcttgcgcttgagctgtgccgcgagcgggttcacgttctcgagctatgccatgcactgggtcaggcaagcgcccgggaaaggactcgagtgggtggccgcgatctcattcgcgggcacgaaaacgcactatgccgatagcgtgaaagggcgatttaccataagcagggacaatagcaagaacgcgctctatctccagatgaataacttgcgcgcggaagataccgcgctctattactgcgccaaggacttgcgcgaggacgagtgcgaggaaaggtggtcggactattacgatttcgggaaacagctcccgtgcaggaaatcgagaggagtcgcgggcgtgttcgataactggggccagggcacgatggtgaccgtgagctcg

SEQ ID NO: 55403 - RNA, 432 nt, synthetic construct
  misc_feature 1..432: note = derived and/or modified sequence opt11 from anti-HIV_cap256-119-055042_VR-Chain
  source 1..432: mol_type = other RNA
caagtgcaattggtcgagagcgggggcggggtcgcgcaaccgggaaggagcttgcgattgagctgtgccgcgagcgggttcacgttcaggagctatggcatgcactgggtcaggcaagcgcccgggaaagggctcgagtgggtggccgtgatctcgctagatggctcgaacaagtactatgccgatagcgtgaaagggcgctttagcataagcagggacaatagcaagaacacgctctatctccagatgaatagcttgcgcccggaagataccgcggtctactactgcgccaaggacttgcgcgaggacgagtgcgaggaaaggtggtcggactattacgatttcgggaaacagctcccgtgcaggaaatcacgcggggtcgcgggcgtgttcgataactggggccagggcacgatggtgaccgtgagctcg

SEQ ID NO: 55404 - RNA, 438 nt, synthetic construct
  misc_feature 1..438: note = derived and/or modified sequence opt11 from anti-HIV_cap256-119-054776_VR-Chain
  source 1..438: mol_type = other RNA
caagtgcaattgatggagagcgggggcggggtcgtgcaaccgggcaggagcttgcgattgagctgtaccgcgagcgggttcacgttctcgagctatagcatgcactgggtcaggcaagcgcccgggaaagggctcgagtgggtggccataatctcgtacgatgaatcgaacaagtactatgccgatagcgtgcaagggcgctttaccataagcagggacaatagcaagaacacgctctttctccagatgtcgagtttgcgcgcggaagataccgcgctctatttctgtgtaagggaccatcgagaggacgagtgcgaggaatggtggtcggactattacgatttcgggcgcgagctcccgtgcaggaaatttcgcgggctcgggctcgcgggcatattcgatatctggggccatggcacgatggtgaccgtgagctcg

SEQ ID NO: 55405 - RNA, 432 nt, synthetic construct
  misc_feature 1..432: note = derived and/or modified sequence opt11 from anti-HIV_cap256-119-054539_VR-Chain
  source 1..432: mol_type = other RNA
caaatgcaactggtcgagagcgggggcggggtcgtgcaaccaggcgggagcttgcgcctgagctgtgccgcgagccagttcacgttcgggagctatgccatgcactgggtcaggcaaccgcccggggaaaggcccgagtgggtggccacgatctcgttcgatggcacgaaaaagtaccatgccgatagcgtgtgggggcgctttaccataagcagggacaatagcaagaacacgctctttctccagatgaatagcttgcgcccggaagataccgcgctctatttctgtgtcaaggaccagcgcgaggacgcgtgcgaggaatggtggtcggactattacgacttcgggaaaaattgcctggccgagagcccgggcgcgtggctggaatttttctatgtctggggccatggcacgatggtgaccgtgagctcg

SEQ ID NO: 55406 - RNA, 432 nt, synthetic construct
  misc_feature 1..432: note = derived and/or modified sequence opt11 from anti-HIV_cap256-119-054112_VR-Chain
  source 1..432: mol_type = other RNA
caagtgcaattggtcgagagcgggggcggggtcgtgcaagcgggcaggagcctgcgcttgagctgtgccgcgagcgggttcacgttctcgacctatgccatgcactgggtcaggcaagcgcccgggaaagggctcgagtgggtggccgtgatctcgtacgatggctcgaacaagtactatgccgatagcgtgcgcgggcgctttaccataagcagggacaatagcaagaacacgctctatctccagatgaatagtctgcgcgcggaagataccgcactctattactgtgccaaggacatgagagagtacgagtgcgaggaatggacctcggactattacgatttcgggcgcccgcaaccgtgcatagactcgcgcggggtcgtgggcacgttccatgtctggggccagggaacgatggtgaccgtgagctcg

SEQ ID NO: 55407 - RNA, 432 nt, synthetic construct
  misc_feature 1..432: note = derived and/or modified sequence opt11 from anti-HIV_cap256-119-053339_VR-Chain
  source 1..432: mol_type = other RNA
caagtacacttggtagagagcgggggcggggtcgtgcaaccgggcaggagcttgcgcctgagctgtgccgcgagccatttctcgctctcaagctatggcatgcactgggtcaggcaagcgcccgggaaagggctcgagtgggtgaccgggatctcgttcgcgggaacgaaaacgtactatggcgatagcgtgcgcgggcgctttaccgtgagcagggacataagcaagaacacgctcttgctccagatgaatagcctgcgcccggacgataccgcgatctattactgtgcaagggaccaacgctattacgagtgcgaggaatgggcctcggactattacgatttcgggaaagagcaaccgtgcctggacccgcgcggggtcgtgggcatattcgatctctggggacagggcacgatggtgaccgtgagctcg

SEQ ID NO: 55408 - RNA, 432 nt, synthetic construct
  misc_feature 1..432: note = derived and/or modified sequence opt11 from anti-HIV_cap256-119-052404_VR-Chain
  source 1..432: mol_type = other RNA
caaatgcaattggtcgagagcgggggcggggtcgtgcaaccgggcaggagcttgaccttgagctgtatcgcgagccagttcaatttcgcgagctatggcatgcactgggtcaggcaagcgcccgggaaagggctcgagtgggtggcctcgatctcgcacgatggcacgaaaaagtaccatgccgagagcgtgtgggggcgctttaccataagcaaggacaatagcaagaacacgctatttctccagatgaatagcctgcgagtggaagataccgcgctctatttctgtgtcaaggaccagcgcgaggacgagtgcgaggaatggtggtcggactattacgatttcgggaaacagctcccgtgcaggaaatcgcgcggggtcgcgggcgtgttcgataactggggacagggcacgatggtgaccgtgagctcg

SEQ ID NO: 55409 - RNA, 432 nt, synthetic construct
  misc_feature 1..432: note = derived and/or modified sequence opt11 from anti-HIV_cap256-119-051123_VR-Chain
  source 1..432: mol_type = other RNA
caagtgcaattggtcgagagcgggggcggggtagtgcaaccgggcgggagcttgcgattgagctgtgtcgggagccagttcatactctatcgctatggcatgcactgggtcagacaagcgcccgggaaagggctcgagtgggtggccgcggtctcattcgatggaacggacaagtaccatgccgatgacgtgtgggggcgctttaccataagcagggacaatagcaagaacatactatatctccagatgaatagcttgcgcgcggaagatacagcgctctattactgtgcaaaggacttgcgcgaggacgagtgcgaggaatggtggtcggactattacgatctcgggaaacagctcccgtgcaggaagtcgcgcggggtcgcgggcgtgttcgataaatggggattgggcacgatggtgaccgtgagctcg

SEQ ID NO: 55410 - RNA, 438 nt, synthetic construct
  misc_feature 1..438: note = derived and/or modified sequence opt11 from anti-HIV_cap256-119-051077_VR-Chain
  source 1..438: mol_type = other RNA
gaagtgcaattggtcgagagcgggggcggggtcgtgcaatcgggcaggagcttgcgcttgagctgtgccgcgagccatttcacgttctcgcgatatggaatgcactgggtcaggcaagcgcccgggaaagggctcgagtgggtggcctcgatctcgtacgatggcagggacttttaccacgccaggagcgtgtgggggcgctttactataagcagggacaatagcaagaacacgctatttctccagatgaatagcttgcgcatagaagataccgcgctctatttctgtgtcaaggaccagcgagaggacgagtgcgaggaatggtggtcggactattacgatttcgggagagagctaccgtgcaggaaatcgcgcgggctagggctcgcgggcatattcgatatgtggggacatggcacgatggtgacagtgagctcg

SEQ ID NO: 55411 - RNA, 432 nt, synthetic construct
  misc_feature 1..432: note = derived and/or modified sequence opt11 from anti-HIV_cap256-119-050442_VR-Chain
  source 1..432: mol_type = other RNA
caagcgcaaatggtcgagagcgggggcggggtcgtgcaaccgggcaggagcttgcgcttgagctgtgccgcgagcgggttctcgttctcgtactttgccatgcactgggtcaggcaagcgcccgggaaagggctcgagtgggtggccgggatctcgttcgcggccacgaaaacgtactatggcgggagcgtgaaagggcgatttaccgtgagcagggacataagcaagaacacgctatatctacagatgaatagcctgcgcccggaagataccgcgatgtattactgtgccagagaccagcgctattacgagtgcgaggaatgggcctcggactattacgatttcgggcgcgagcaaccgtgccaggacccgcgcggggtcgtgggcgtgttcgatatgtggggccagggcacgatggtgaccgtaagctcg

SEQ ID NO: 55412 - RNA, 432 nt, synthetic construct
  misc_feature 1..432: note = derived and/or modified sequence opt11 from anti-HIV_cap256-119-049433_VR-Chain
  source 1..432: mol_type = other RNA
caagtgcaattggtcgagagcgggggcggggtcgtgcaaccgggcaggagcttgcgcgtgagctgtcgagcgagcgggttcgcgttctcgagctatgccatgcactgggtcaggcaagcgccagtgaaagggctcgagtgggtggccttgacctcgagcgatggcgcggacaagtaccatgccgatgacgtgtgggggcgctttaccataagcagggacaatagcaagaacacgctctatctacagatgaatagcttgcgcccggaagataccgcgctctattactgtgccaaggacttgcgcgaggacgagtgcgaggaaaggtggtcggactattacgatttcgggaaacagctcccgtgcaggaaatcgcgcggggtcgcgggcgtgttcgacaactggggccagggcacgatggtgaccgtgagctcg

SEQ ID NO: 55413 - RNA, 432 nt, synthetic construct
  misc_feature 1..432: note = derived and/or modified sequence opt11 from anti-HIV_cap256-119-047532_VR-Chain
  source 1..432: mol_type = other RNA
ctcgggcgcctggtcgcgagcgggggcggggtcgtgcccccgggcaggagcttgaccttgagctgtgtcgcaagccagttcacgttctcgggctgtggcttgcactgggtcaggcaagcgcccgggaaagggctcgagtgggtggcctcgatctcgttcgcgggcacgaaaaagcactataccaatagcgtgcgcgggcgctttaccataagcagggacaatagcaagaacacggtctatctccagatgaatagcttgcgcgcggaagataccgcgctctattactgtgccaaggacatgggcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55414 - RNA, 432 nt, synthetic construct
  misc_feature 1..432: note = derived and/or modified sequence opt11 from anti-HIV_cap256-119-047489_VR-Chain
  source 1..432: mol_type = other RNA
caagtgcacttggtcgagagcgggggcggggtcgtgcaaccgggcaagagcttgcgcttgagctgtgccgcgagccagttcacgttcaatcgctttggaatgcactgggtcaggcaagcgcccgggaaagggctcgagtgggtggccgggatctcgtacgatggctcggacaagtaccatgccgataaagtgtgggggcgctttaccataagcagggacaatagcaagaacacgctctatctccagatgaatagcttgcgcgcggaagataccgcgctctattactgtgccaaggacttgcgcgaggacgagtgcgaggaatggtggtcggactattacgatttcgggaaaaggctcccgtgcaggaaatcgcgaggggtcgcgggcgtgttcgataaatggggacagggcacgatggtgaccgtgagctcg

SEQ ID NO: 55415 - RNA, 438 nt, synthetic construct
  misc_feature 1..438: note = derived and/or modified sequence opt11 from anti-HIV_cap256-119-046020_VR-Chain
  source 1..438: mol_type = other RNA
gaagtgcaattgctccagagcgggggcgggctcgtgcaaccgggcgggagcctgcgcttgagctgtgccgcgagcgggttctcgttctcgagctatgccatgagctggatcaggcaagcgcccgggaaagggctcgagtgggtggcctcgatctcgcacgatggcacgaaaaagtaccatgccgagagcgtgtgggggcgctttaccataagcaaggacaatagcaagaacacgctctttctccagatgaatagcctgcgcgtggaagataccgcgctctatttctgtgtcaaggaccagcgcgaggacgagtgcgaggaatggtggtcggactactacgatttcgggcgagagctcccgtgcaggaaatcgcgcgggctcgggctcgcgggaatattcgatatgtggggacatggcacgatggtgaccgtgagctcg

SEQ ID NO: 55416 - RNA, 432 nt, synthetic construct
  misc_feature 1..432: note = derived and/or modified sequence opt11 from anti-HIV_cap256-119-044746_VR-Chain
  source 1..432: mol_type = other RNA
caagtgcaactggtcgagagcgggggcggggtcgtgcaaccgggcaggagcctgcgcttgagctgtgccgcgagcgggttcacgttctcgagctatgccatgcactgggtcaggcaagcgccagggaaagggctcgagtgggtggccgtgatctcatacgatggctcgaacaagtactatgccgatagcgtgaaagggcgctttaccataagcagggacaatagcaagaacacggtctatctagagatgaatagcttgcgcgcggaagataccgcgctctattactgtgccaaggacttgcgcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55417 - RNA, 432 nt, synthetic construct
  misc_feature 1..432: note = derived and/or modified sequence opt11 from anti-HIV_cap256-119-044740_VR-Chain
  source 1..432: mol_type = other RNA
caaatgcacttggtcgagagcgggggcggggtcgtgcaaccgggcatgagcttgcgcttgagctgtgccgcgagccagttcaatttcgggagctttggcatgcactgggtcaggcaagcgcccgggaaagggctcgagtgggtggccacgatctcgtacgatggcacgaaaaagtaccatagcgatagcgtgtgggggcgcttgagcataagcagggacaatagcaagaacacgctctttctccagatgaatagcttgcgcacggaagataccgcgctctatttctgtgtcagggaccagcgcgaggacgattgcgaggaatggtggtcggactattacgatttcgggaaaaagctcccgtgcaggaaatcgcgcgggctcgcgggcatattcgatatctggggccatggcacgatggtgaccgtgagctcg

SEQ ID NO: 55418 - RNA, 432 nt, synthetic construct
  misc_feature 1..432: note = derived and/or modified sequence opt11 from anti-HIV_cap256-119-043790_VR-Chain
  source 1..432: mol_type = other RNA
ctcttgcaattggtcgagagcgggggcggggtcgtgcaaccgggcaatagcttgcgcttgagctgtgccgcggccgggttcacgttctcggactatagcttgcactgggtcaggcaagcgcccgggaaagggctcgagtgggtggccatgatctcggacgatggcaatctcgatttctatgccgcgagcgtgaaaggacgctttaccataagcagagacaatagcataaacacggtctatctccagatgaatagcttgcgcgcggaagataccgcgctatattactgtgccaaggacttgcgcgagtacgagtgcgaggaatggacctcggactattacgatttcgggcgcccgcaaccgtgcatagactcgcgcggggtcgtgggcatactcgatatctggagccagggcacgatggtgaccgtgagctcg

SEQ ID NO: 55419 - RNA, 432 nt, synthetic construct
  misc_feature 1..432: note = derived and/or modified sequence opt11 from anti-HIV_cap256-119-042880_VR-Chain
  source 1..432: mol_type = other RNA
gaagtgcgcttggtcgagagcgggggcgggctcgtgcaaccgggcgggagcttacgcttgagctgtgccgcgagcgggttcacgctctcggactattacatgagctggatcaggcaagcgcccgggaaagggctcgagtgggtggccgcgatctcgttcgcgggcacgaaaaagcactatggcaatagcgtgaaagggcgctttaccataagcagggacaatagcaagaacacgctctatctcgagatgaatagcttgcgcgtggaagataccgcgctctattactgtgccaaggacctgcgcgagtacgagtgcgaggaatggacctcagactattacgatttcgggcgaccgcaaccgtgcatagactcacgcggggtcgtgggcatactagatatctggggccagggcacgatggtgaccgtgagctcg

SEQ ID NO: 55420 - RNA, 432 nt, synthetic construct
  misc_feature 1..432: note = derived and/or modified sequence opt11 from anti-HIV_cap256-119-042606_VR-Chain
  source 1..432: mol_type = other RNA
caaatgcaattggtcgagagcgggggcggggtcgtgcaaccgggcaggagcttacgattgagctgtgccgcgagccagttcacgttcgggagctatggcatgcactgggtcaggcaaatacccgggaaagggctcgagtgggtgaccgggatctcgttcgcggccacgaaaacgtactatggcgatagcgtgcgcgggcgctttaccgtgagcagggacataagcaagaacacgctctatctccagatgaatagcttgcgaccggaagataccgcgatgtactactgtgccagggaccagcgctattacgagtgcgaggaatgggcctcggactattacgatttcgggcgcgagcaaccgtgccaggacccgcgaggggtcgtgggcatactcgatctctggggccagggcacgatggtgaccgtgagctcg

SEQ ID NO: 55421 - RNA, 432 nt, synthetic construct
  misc_feature 1..432: note = derived and/or modified sequence opt11 from anti-HIV_cap256-119-042444_VR-Chain
  source 1..432: mol_type = other RNA
caagtacaattggtcgagagcgggggcgatgtcgtgcacccgggcgggagcttgcgcttgagctgtgccgcgagcgggttcacgttctcgagctatggcatacactgggtcaggcaagcgcccgggaaagggctcgagtgggtggccgcgatctcgtacgatggatcggacaagtaccataccaatagtgtgtgggggcgctttaccgtgagcagggacaatagcaagaacacggtatatctccagatgaatagcttgcgcgcggaagataccgcgctctatttctgtgtcagggacagacgcgagagcgagtgcgaactctgggaatcggactattacgatttcgggaaaaggctcccgtgcgtgaaaccgcgaggggtcgcgggcgtgttcgatatctggggacagggcacgatggtgaccgtgagctcg

SEQ ID NO: 55422 - RNA, 432 nt, synthetic construct
  misc_feature 1..432: note = derived and/or modified sequence opt11 from anti-HIV_cap256-119-040328_VR-Chain
  source 1..432: mol_type = other RNA
caagtgcaattggtcgagagcgggggcggggtcgtgcaaccgggcgggagcttgcgcttgagctgtgccgcgagcgggttcacgttctcgagctatagcatgaactgggtcaggcaagcgcccgggaaagggctcgagtgggtggcctcgatctcgttcgcgggcacgaaacagcactatggcaatagcgtgaaagggcgctttaccataagcagggacaatagcaagaacacggtctatctccagatgaatagcttacgcttggaagataccgcgctctattactgtgccaaggacttgcgagagtacgagtgcgaggaatggacatcggactattacgatttcgggcgcccgcaaccgtgcatagactcgcgaggggtcgtgggcatactcgatatctggggccagggaacgatggtgaccgtgagctcg

SEQ ID NO: 55423 - RNA, 432 nt, synthetic construct
  misc_feature 1..432: note = derived and/or modified sequence opt11 from anti-HIV_cap256-119-040164_VR-Chain
  source 1..432: mol_type = other RNA
caaatgcacttggtcgagagcgggggcggggtcgtgcaaccgggcatgagcctgcgcttgagctgtgccgcgagccagttcaatttcgggagctttggcatgcactgggtcagacaagcgcccgggaaaggactagagtgggtggccacgatctcgtacgatggcacgaaaaagtaccatagcgatagcgtgtgggggcgctttagcataagcagggacaacagcaagaacacgctctatctccagatgaatagcttacgcacggaagataccgcgctctatttctgtgccaaggacttgcgcgagtacgagtgcgaggaatggacctcggactattacgatttcgggcgcccgcaaccgtgcatagactcgcgcggggtcgtgggcatactcgatatctggggccagggcacgatggtgaccgtgagctcg

SEQ ID NO: 55424 - RNA, 432 nt, synthetic construct
  misc_feature 1..432: note = derived and/or modified sequence opt11 from anti-HIV_cap256-119-039130_VR-Chain
  source 1..432: mol_type = other RNA
gaggaacaattggtcgagagcgggggcgggctcgtgcaaccgggaaggagcttgcgattgagctgtaccgggagcgggttcaggttcggggactatgccatgaactgggtcaggcaagcgcccgggaaagggctcgagtgggtgacctttatctcgtacgatggctcgaacaagcactatgcagatagcgtgaaagggcgatttaccgtgagcagggacaatagcaagaacacgctccatctccagatgaatagcttgcgcccggaagataccgcgctctatttctgtgcaagggacttgcgcgagagcgagtgcgaggaatgggaatcgtactattacgatttcgggaaaaagggcccgtgcgtgaaaccgcgcggggtcgtaggcgtgctcgatatatggggccagggcacgctcgtgaccgtgagctcg

SEQ ID NO: 55425 - RNA, 432 nt, synthetic construct
  misc_feature 1..432: note = derived and/or modified sequence opt11 from anti-HIV_cap256-119-038138_VR-Chain
  source 1..432: mol_type = other RNA
caagtgcaattggtcgagagcgggggcggggtagtgcaaacgggcaggagcttgcgattgagctgtaccgggagccagttcacattcgggcgctatggcatgtactgggtcaggcaagcgcccgggaaagggctcgaatgggtggcctcgatctcgtacgatggcagggacttttaccatgccaggagcgtgtgggggcgctttaccataagcagggacaatagcaagaacacgctacatctccagatgaatagcttgcgcccggaagataccgcgctatatttctgtgccagggacttgcgagagagcgagtgcgaggaatgggaatcgtactattacgatttcgggaaaaagggcccgtgcgtgaaaccgcgcggggtcgtgggcgtgctcgatatctggggccagggcacgctcgtgaccgtgagttcg

SEQ ID NO: 55426 - RNA, 432 nt, synthetic construct
  misc_feature 1..432: note = derived and/or modified sequence opt11 from anti-HIV_cap256-119-037868_VR-Chain
  source 1..432: mol_type = other RNA
caagtgcaattggtcgagagcgggggcggggtcgtgcaaccgggcaggagcttgcgattgagctgtgccgcgagccagttcacgttctcgaaatatggcatgcactgggtcaggcaagcgcccgggaaagggctccagtgggtggccgggatctcatacgatggctcggacaagtaccatgcccatttcgtgtgggggcgctttagcataagcagggacaatagcaagaacgcgctctatctccagatgaatagcttgcgaacagaagataccgcgctctatttctgtgtcagggacttgcgcgagagcgagtgcgaggaatggaaatcggactattacgatttcgggcgcaagggcccgtgcttgaaaccgcgcggggtcgcgggctcgttcgatatctggggccagggcacggtcgtgaccgtgagctcg

SEQ ID NO: 55427 - RNA, 432 nt, synthetic construct
  misc_feature 1..432: note = derived and/or modified sequence opt11 from anti-HIV_cap256-119-037102_VR-Chain
  source 1..432: mol_type = other RNA
caagtgaaattggtcgagagcgggggaggggtcgtgcaaccgggcaagagcttgcgcttgagctgtaccgcgagccagttcacgttctcaaactttggcatgcactgggtaagacaagcgcccgggaaaggactcgagtgggtggcctcgatatcgttcgtgggcatcaaaaagcactatgccaatttcgtgcgcgggcgctttaccataagcagggaccagagcaagaacacgctctatctacagatgaatagcgtgcgcgtggaagataccgcgcgctattactgtgccagagacatgcgcgagtacgagtgcgagctctgggcctcggactattacgatttcgggaaaccgcaaccgtgcgaggacccgcgcggggtcgtgggcacgttcgatatgtggggcttgggcacgctagtgaccgtgagctcg

SEQ ID NO: 55428 - RNA, 438 nt, synthetic construct
  misc_feature 1..438: note = derived and/or modified sequence opt11 from anti-HIV_cap256-119-036683_VR-Chain
  source 1..438: mol_type = other RNA
ggcgtgcaattggtcgagagcgggggcgcggtcgtacgcccgggcgggagcctgaccttgagctgtgccgcgagccagttcatactctcgagctatggaatgcactgggtcaggcaagcgccagggaaagggctcgagtgggtggcctcgatctcgaacgatggcacgaaaaagtaccatgccgagagcgtgtgggatcgatttagcataagcaaggacaatagcaagaacacactctttctccagatgaatagcctgcgcgtggaagataccgcgctctatttctgtgtcaaggaccagcgcgaggacgagtgcgaggaatggtggtcggactattacgatttcgggcgcgagctcccgtgcaggaaatcgcgagggctcgggctcgcgggcatattcgatatgtggggccatggcacgatggtgaccgtgagctcg

SEQ ID NO: 55429 - RNA, 432 nt, synthetic construct
  misc_feature 1..432: note = derived and/or modified sequence opt11 from anti-HIV_cap256-119-036495_VR-Chain
  source 1..432: mol_type = other RNA
caagtgcaattggtcgagagcgggggcggggtcgtgcaaccgggcaggagcttgcgcctgagctgtgccgcgagcgggttctcgttctcgagctatggcatgcactgggtcaggcaagcgcccgggaaagggctcgagtgggtggcctcgatctcgttcgtgggcataaaaacgcactatgccaatagcgtgcgcgggcgctttaccataagcagggaccagagcaagaacacgctatatctccagatgaatagcgtgcgcatagaagataccgcgcgctatttctgtgccagggacatgcgcgagtacgagtgcgagctctgggcctcggactattacgatttcgggaaaccgcaaccgtgcgaggacccgcgcggggtcgtgggcacgttcgatatgtggggcttgggcacgctagtgaccgtgagctcg

SEQ ID NO: 55430 - RNA, 438 nt, synthetic construct
  misc_feature 1..438: note = derived and/or modified sequence opt11 from anti-HIV_cap256-119-035375_VR-Chain
  source 1..438: mol_type = other RNA
gaagtgcaattggtcgagagcgggggcgggctcgtgcaaccgggcaggagcttgcgcttgagctgtgccgcgagtgggttcacactcgaggactatggcatgcactgggtcaggcaagcgcccgggaaagggctcgagtgggtggcctcgatctcgaacgatggcacgaaaaagtaccatgccgagagcgtgtgggatcgctttagcataagcaaggacaatagcaagaacacgctctttctccagatgaatagcttgcgcgtggaagataccgcactatatttctgtgtcaaggaccagcgcgaggacgagtgcgaggaatggtggtcagactattacgatttcgggcgcgagctcccgtgcaggaaatcgcgcgggctcgggctcgcgggcatattcgatatgtggggccatggcacgatggtgaccgtgagctcg

SEQ ID NO: 55431 - RNA, 438 nt, synthetic construct
  misc_feature 1..438: note = derived and/or modified sequence opt11 from anti-HIV_cap256-119-035165_VR-Chain
  source 1..438: mol_type = other RNA
caagtgcacttggtcgagagcgggggcggggtcgggcaaccggccaggagcttgcgcttgagctgtgccgcgagcgggttcatactctcgagctatggcttgcactgggtcaggcaagcgcccgggaaagggctcgagtgggtggccttgatctcgtacgatggaaataacgagtactatgccgagagcgtgtgggggcgctttaccataagcaaggacaatagcaagaacacgctctttctccagatgaatagcttgcgcgtggaagataccgcgctctacttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgaccgtgagctcg

SEQ ID NO: 55432 - RNA, 432 nt, synthetic construct
  misc_feature 1..432: note = derived and/or modified sequence opt11 from anti-HIV_cap256-119-035109_VR-Chain
  source 1..432: mol_type = other RNA
caagtgcaattggtcgagagcgggggcggggtagtgcaaccgggcaggagcttgcgcttgagctgtgccacggccgggttcacgttctcgagctatgcaatgcactgggtaaggcaagcgcccgggaaagggctcgagtgggtggcctcgatatcgtacgatggctcggacaagtaccatgccgatctcgtgtgggggcgctttaccataagcagggacaatagcaagaacacgctctatctccagatgaatagcttgcgcgcggaagataccgcgctctattactgtgtcagggacgcgcgcgagagcgagtgcgagctctgggaatcggactattacaatttcgggcgaaagctcccgtgcgtgaaaccgcgcggggtcgcgggcacgctcgatatctggggccagggcacgatggtgaccgtgagctcg

SEQ ID NO: 55433 - RNA, 339 nt, synthetic construct
  misc_feature 1..339: note = derived and/or modified sequence opt11 from anti-HIV_cap256-119-033789_VR-Chain
  source 1..339: mol_type = other RNA
caagtctacctcgtcgaatccggcggcggagtcgtccaacccggccgctccctccgcctctcctgcgccgcctcccacttctccctctcctcctacggcatgcactgggtccgccaagcccccgacatctccaaaaacaccctctacctccaagtcaactccctccgccccgaagacacagccatgtactactgcgcccgagaccaacgctactacgaatgcgaagaatgggcctcagactactacgacttcggcaaagaacaaccctgcctcgacccccgcggcgtcgtcggcatcttcgacatctggggccaaggaaccatggtcacagtctcctcc

SEQ ID NO: 55434 - RNA, 432 nt, synthetic construct
  misc_feature 1..432: note = derived and/or modified sequence opt11 from anti-HIV_cap256-119-033641_VR-Chain
  source 1..432: mol_type = other RNA
caagtgcaattggtcgagagcgggggcggggtcgtgcaaacgggcaggagcttgcgcttgagctgtaccgggagccagttcacgttcgggcgctatggcatgtactgggtcaggcaagcgcccgggaaagggctcgagtgggtggccgcgatctcgtacgatggctcggacaagtaccataccaatagcgtgtgggggcgctttaccgtgagcagggacaatagcaagaacacggtctatctccagatgaatagcttgcgcgcggaagataccgcgctctatttctgtgtcagggacaggcgcgagagcgagtgcgagctctgggaatcggactattacgatttcgggaaaaggctcccgtgcgtgaaaccgcgcggggtcgcgggagtgttcgatatctggggccagggcacgatggtgaccgtgagctcg

SEQ ID NO: 55435 - RNA, 432 nt, synthetic construct
  misc_feature 1..432: note = derived and/or modified sequence opt11 from anti-HIV_cap256-119-032113_VR-Chain
  source 1..432: mol_type = other RNA
caggtccagctcgtggaatcgggcgggggcgtggtccagcccgggcgcccgctcaggctctcgtgcgtgggctcgggctttagctttatcacgagcgcgatgcattgggtgcgccaggccccggacaagggcttggaatgggtcgcgatcataagcgacggcgggaacaatcgccattacgcggactcggtcaagggcaggttcacgatctcgcgagataactcgaaaaataccgtgttcctggaagtgaacaatctcaggcccgaggacacggccatgtactattgcgcgcgagatcaaagatactatgaatgtgaagagtgggcaagcgattactatgactttggcagggaacagccctgtcaagatcccaggggcgtggtcggggtctttgacatgtgggggcaagggaccatggtcacggtctcgagc

SEQ ID NO: 55436 - RNA, 432 nt, synthetic construct
  misc_feature 1..432: note = derived and/or modified sequence opt11 from anti-HIV_cap256-119-031739_VR-Chain
  source 1..432: mol_type = other RNA
caagtgcaattggtcgagagcgggggcggggtcgtgcaaccgggcaggagcttgcgcataagctgtgccgcgagccagttcacgttcaatcgctatggcatgcactgggtcagacaagcgccagggaaagggctagagtgggtggcctcaatctcgtacgatggatcggacaagtaccatgccggactcgtgtgggggcgctttatcataagcagggacaatagcaagaacacgctctatctacagatgaatagcttgcgcgcggaagataccgcgctctattactgtgtcagggacgagcgcgagagcgagtgcgagctctgggaatcggactattacgatttcgggaaaaagctcccgtgcgtgaaaccgcgcggggtcgcgggcacgctcgatatctggggccagggcacgcgcgtgaccgtgagctcg

SEQ ID NO: 55437 - RNA, 432 nt, synthetic construct
  misc_feature 1..432: note = derived and/or modified sequence opt11 from anti-HIV_cap256-119-030932_VR-Chain
  source 1..432: mol_type = other RNA
gaagtgcaattgctcgagagcgggggcggagtcgtgcaaccgggcaggagcttgcgcttgagctgtgccgcgagcgggttcgcgttctcgcactacggcatattctgggtcaggcaagcgccagggaaagggctcgagtgggtgaccgtgatctcgggagatggctcgacccagtggtatgccgatagcgtgcaagggcgctttaccataagcagggactcgagcaagaacacgctatatctccagatggatggattgcgcggggaagataccgcgctctattactgtgccaaggacttgcgcgagctcgagtgcgaggaatgggcctcggactattacgatttcgggcgcccgcaaccgtgcctggacccgcgcggggtctcgggcataagcaatgtctggggccagggcacgatggtgaccgtgagctcg

SEQ ID NO: 55438 - RNA, 438 nt, synthetic construct
  misc_feature 1..438: note = derived and/or modified sequence opt11 from anti-HIV_cap256-119-030740_VR-Chain
  source 1..438: mol_type = other RNA
caagtgcaattggtcgagttcgggggcggggtcgtgcaaacgggcaggagcttgcgcttgagctgtgccgcgagcgggttcacgttctcggactatggaatgcactgggtcaggcaagcgcccgggaaagggctcgagtgggtggcctcgatctcgaacgatggctcgaaaaagtaccatggcgatagcgtgtgggcgcgctttatcataagcagggacaatagcaagaacacgctctttctccagatgtcgagcttgcgagcggaagataccgcgctctatttctgtgtcagggaccatcgcgaggacgagtgcgaggaatggtggtcggactattacgatttcgggcgcgagctaccgtgcaggaaatttcgcgggctcgggctcgcgggcatattcgatatctggggccatggcacgatggtgaccgtgagctcg

SEQ ID NO: 55439 - RNA, 438 nt, synthetic construct
  misc_feature 1..438: note = derived and/or modified sequence opt11 from anti-HIV_cap256-119-030197_VR-Chain
  source 1..438: mol_type = other RNA
caagtgcacttggtcgagagcgggggcggggtcgtgcaaccgggcaagagcttgagattgagctgtgccgcgagccagttcacgttctgccgctatggaatgcactgggtcaggcaagcgcccgggaaagggctcgagtgggtggcctcgatctcgaacgatggcacggacaagtaccatgccgataacgtgtgggggcgctttaccataagcagggacaatagcaagaacacgctctatctcgagatgaatagcttgcgcggggaagataccgcgctctattactgtgccaaggacatgcgcgaggacgagtgcgaggaatggtggtcagactattacgatttcgggaaagagctcccgtgcaggaaatggaaaacgcgcggggtcgcgggcatactcgataactggggccagggcacgatggtgaccgtgagctcg

SEQ ID NO: 55440 - RNA, 438 nt, synthetic construct
  misc_feature 1..438: note = derived and/or modified sequence opt11 from anti-HIV_cap256-119-027047_VR-Chain
  source 1..438: mol_type = other RNA
caaatgcaattggtcgagagcgggggaggggtcgtgcaaccgggcaggagcttgaccttgagctgtgccgcgagccagttcacgttcagaaactatggcatgcactgggtcaggcaagcgcccgggaaagggctcgagtgggtggcctcgatctcgaaagatggcacgaaaaagtaccatggcgatagcgtgtgggggcgctttatcataagcagggacaatagcaagaacacgctctttctccagatgtcgagcctgcgcgcggaagataccgcgctctatttctgtgtcagggaccagcgcgaggccgagtgcgaggaatggtggtcggactattacgatttcgggcgcgagctaccgtgcaggaaatttcgcgggctcgggctcgcgggcatattcgatatctggggccatggcacgatggtaaccgtgagctcg

SEQ ID NO: 55441 - RNA, 432 nt, synthetic construct
  misc_feature 1..432: note = derived and/or modified sequence opt11 from anti-HIV_cap256-119-026950_VR-Chain
  source 1..432: mol_type = other RNA
caagtgcaactggtcgagagcgggggcggggtcgtgcaaccgggcaagagcttgcgcataagctgtgccgcgagcaggttcacgttcgggcgctttggcatgcactgggtcaggcaagcgccagggaaagggctcgagtgggtggcctcgatctcgtacgatggctcggacaagtaccatgccgggctcgtgtgggggcgctttatcataagcagggacaatagcaagaacacgctatatctccagatgaatagcttgcgcgcggaagataccgcgctctattactgtgtcagggacgagcgcgagagcgagtgcgagctctgggaatcggactattacaatttcgggaaaaattacccgtgcgtgaaaccgcgcggggtcgcgggcacgctcgatatctggggccagggcacgaccgtgatcgtgagctcg

SEQ ID NO: 55442 - RNA, 438 nt, synthetic construct
  misc_feature 1..438: note = derived and/or modified sequence opt11 from anti-HIV_cap256-119-026279_VR-Chain
  source 1..438: mol_type = other RNA
caaatgcaattggtcgagagcgggggcggggtcgtgcaaccgggcacgagcctgaccttgagctgtgccgcgagccagttctcgttcacgagctatggaatgcactgggtcaggcaagcgcccgggaaagggctcgagtgggtggcctcgatctcgaacgatggcacgaaaaagtaccatgccgagagcgtgtgggggcgctttaccataagcaaggacaatagcaagaacacgctctttctccagatgaatagcttgcgcgtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggcatattcgatatctggggccatggcacggtcgtgatcgtgagctcg

SEQ ID NO: 55443 - RNA, 432 nt, synthetic construct
  misc_feature 1..432: note = derived and/or modified sequence opt11 from anti-HIV_cap256-119-025355_VR-Chain
  source 1..432: mol_type = other RNA
gaagtgcaattggtcgagagcgggggcgggctcgtgcaaccgggcaggagcttgcgcttgagctgtgcagcgagcgggttctcgttctcggactatgccatgcactgggtcaggcaagcgcccgggcaagggctcgagtgggtggcctttatctcgtacgatggcacgaaaaagtaccatagcgatagcgtgtgggggcgcttgaccataagcagggacaatagcaggaacacgctctttctccagatgaatagcctgcgcacggaagataccgcgctctatttctgtgtcagggaccagcgcgaggacgattgcgaggaatggtggtcggactattacgatttcgggaaaaagctcccgtgcaggaaatcgcgcgggctagcgggcatattcgatatctggggccatggcacgatggtgaccgtgagctcg

SEQ ID NO: 55444 - RNA, 432 nt, synthetic construct
  misc_feature 1..432: note = derived and/or modified sequence opt11 from anti-HIV_cap256-119-025301_VR-Chain
  source 1..432: mol_type = other RNA
caagtgcacttggtcgcgagcgggggcggggtcgtgccaccgggcaggagcttgcgcttgagctgtgtcgcgagccagttcacgttctcgggctttggcttgtactgggtcaggcaagcgcccgggaaagggctcgagtgggtggccgcgatctcattcgcgggcacgaaaaagcactatgccaatagcgtgaaagggcgctttaccataagcagagacaatagcaagaacacgctctatctccagatgaatagcttgcgcccggacgataccgcgctctattactgtgccaaggacttgcgcgagtacgagtgcgaggaatggacctcggactattacgacttcgggcgcccgcaaccgtgcatagactcgcgcggggtcgtgggcatactcgatatctggagccagggcacgatggtgacagtgagctcg

SEQ ID NO: 55445 - RNA, 438 nt, synthetic construct
  misc_feature 1..438: note = derived and/or modified sequence opt11 from anti-HIV_cap256-119-025010_VR-Chain
  source 1..438: mol_type = other RNA
caagtgcaattggtcgagagcgggggcggggtcgtgcaaccgggcaggagcttgcgcttgagctgtcccgcgagcgggttctcgttctcgacctatggcatgcactgggtcaggcaagcgcccgggaaagggctcgagtgggtggcctcgatctcgaacgatggcaataaaaagtaccatggcgagagcgtgtgggatcgctttaccataagcagggacaatagcaagaacacgctctttctccagatgaatcgattgcgcgtggaagataccgcgctctatttctgtgtcaaggaccagcgcgaggacgagtgcgaggaatggtggtcggactattacgatttcgggcgcgagctcccgtgcaggaaatttcgcgggctcgggctcgcgggcatattcgatgtctggggccatggcacgatggtgaccgtgagctcg

SEQ ID NO: 55446 - RNA, 432 nt, synthetic construct
  misc_feature 1..432: note = derived and/or modified sequence opt11 from anti-HIV_cap256-119-024631_VR-Chain
  source 1..432: mol_type = other RNA
caagtgcaactgatggagagcgggggcggggtcgtgcaaccgggcgggagcttgcgattgagctgtgccgcgagcgggttcacgttctcgagctatggcatgcactgggtcaggcaagcgcccgggaaagggctcgagtgggtggccgggatctcgtacgatggctcggacaagtaccatgcccatttcgtgtgggggcgatttatcataagcagggacaatagcaagaacgcgctctatctccagatgaatagcttgcgcccggaagataccgcgctctatttctgtgtcagggacttgcgcgagagcgagtgcgaggaatggcaatcgtactattacgatttcgggcgcaagggcccgtgcttgaaaccgcgcggggtcgcgggctcgttcgatatctggggccagggcacggtcgtgaccgtgagctcg

SEQ ID NO: 55447 - RNA, 432 nt, synthetic construct
  misc_feature 1..432: note = derived and/or modified sequence opt11 from anti-HIV_cap256-119-024467_VR-Chain
  source 1..432: mol_type = other RNA
gaagtgcaattggtcgagagcgggggcgggctcgtgcaaccgggcgggagcctgaacgtgagctgtgccgcgagcgggttcacattcaggacctatgccatgcactgggtcaggcaagcgcccgggaaagggctcgagtgggtggccgcgatctcgtacgatggcgataacaagtactcggccgatagcgtgaaagggcgctttaccataagcagggaccagagcaagaacacgctctatctccagatgaatagcgtgcgcgtagaagataccgcgcgctattactgtgccagggacatgcgagagtacgagtgcgagctatgggcctcggactattacgatttcgggaaaccgcaaccgtgcgaggacccgcgcggggtcgtgggcacgttcgatatgtggggcttgggcacgctagtgaccgtgagctcg

SEQ ID NO: 55448 - RNA, 432 nt, synthetic construct
  misc_feature 1..432: note = derived and/or modified sequence opt11 from anti-HIV_cap256-119-023805_VR-Chain
  source 1..432: mol_type = other RNA
caagtgcaattggtcgagagcgggggcggggtcgtgcaaccgggaaagagcttgcgcttgagctgtgccgcgagccagttcgggttcgggagctatggcatgcactgggtcaggcaagcgcccgggaaagggctcgagtgggtggccacgatctcgttcgatggcgcggacaagtaccatgccgatgacgtgtgggggcgctttagcataagcagggacaatagcaagaacacgctctatctccagatgaataacttgcgcccggaagataccgcgctatactactgtgccaaggacttgcgcgaggacgagtgcgaggaaaggtggtcggactattacgatttcgggaaacagctcccgtgcaggaaatcgcgcggggtcgcgggcgtgttcgataactggggacagggcacgatggtgaccgtgagctcg

SEQ ID NO: 55449 - RNA, 432 nt, synthetic construct
  misc_feature 1..432: note = derived and/or modified sequence opt11 from anti-HIV_cap256-119-021736_VR-Chain
  source 1..432: mol_type = other RNA
caagtgcaactggtcgagagcgggggcggggtcgtgcaaccgggcaggagcgtgcgattgagctgtgtcgcgagccagttctcgttcgatcgatatggcatgcactgggtcaggcaagcacccgggaaagggctcgagtgggtggcctcgatctcgtacgatggcacggacaagtaccatgccgataaagtgtgggggcgatttaccataagcagggacaatagcaagaaaacgctatatctccagatgaatagcctgcgcccggaagatgccgcgctctattactgtgccaaggacttgcgcgaggacgagtgcgaggaatggtggtcggactattacgatttcgggaaacagctcccgtgcaggaaatcgcgcggagtcgcgggcatattcgatagctggggccagggcacgatggtgaccgtgagctcg

SEQ ID NO: 55450 - RNA, 438 nt, synthetic construct
  misc_feature 1..438: note = derived and/or modified sequence opt11 from anti-HIV_cap256-119-021203_VR-Chain
  source 1..438: mol_type = other RNA
caaatgcaattggtcgagagcgggggcggggtcgtgcaaccgggcaggagcttgaccctgagctgtgccgcgagccagttcacgttctcgaactatggcatgcactgggtcaggcaagcgcccgggaaagggctcgagtgggtggcctcggtctcgaacgatggaacgaaaaagtaccatggcgatagcgtgtgggatcgctttaccataagcagggacaatagcaagaacacgctctttctccagatgtcgagcttgcgcgcggaagataccgcggtctatttctgtgtcagggacgagcgcgaggacgagtgcgaggaatggtggtcggactattacgatttcgggcgcgagctcccgtgcaggaaatttcgcgggctcgggctagcgggcatattcgatatctggggccatggcacactcgtgaccgtgagctcg

SEQ ID NO: 55451 - RNA, 432 nt, synthetic construct
  misc_feature 1..432: note = derived and/or modified sequence opt11 from anti-HIV_cap256-119-020569_VR-Chain
  source 1..432: mol_type = other RNA
caagtgcaattggtagagagcgggggcggggtcgtgcaaccgggcgagagcttgcgcataagctgtgccgcgagccagttcacgttctcgcgctatggaatgcactgggtcaggcaagcgcccggaaaagggctcgagtgggtggcctcgatctcgttcgatggcagggacaagtaccatagctcgctcgtgtgggggcgcctgaccataagcagggacaatagcaagagcacgctctttctccagatgaatagcttgcgaccggaagataccgcgctctattactgtgccagggacgtgcgcgagagcgagtgcgaggaatggcaatcggactattacgcgttctatcgcaagctcccgtgcgtgaaaccgcgcggggtcgcgggcacgctcgatatctggggccagggcacgatggtgaccgtgagctca

SEQ ID NO: 55452 - RNA, 432 nt, synthetic construct
  misc_feature 1..432: note = derived and/or modified sequence opt11 from anti-HIV_cap256-119-019432_VR-Chain
  source 1..432: mol_type = other RNA
caagtgcaactggtccagagcgggggcggggtcgtgcaaccgggcaggagcctgcgcataagctgtgccgcgccctatttcacgttcgggcgctacggctttcactgggtcaggcaagcgcccgggaaagggctcgagtgggtggcctcgatctcgttcgatggcagggactattaccatagcccgcacgtgtgggggcgcctgaccataagcagagacaatagcaagaacacgctctatctccagatgaatagcttgcgcgcagaagataccgcgctctattactgtgccagggacttgcgcgagagcgagtgcgaggaatgggaatcagactattacgatttcgggaaaaagggcccgtgcgtgaaaccgcgcggggtcgcgggctcgctcgatatgtggggccagggcacgatggtgaccgtaagctcg

SEQ ID NO: 55453 - RNA, 432 nt, synthetic construct
  misc_feature 1..432: note = derived and/or modified sequence opt11 from anti-HIV_cap256-119-018827_VR-Chain
  source 1..432: mol_type = other RNA
caagcgcaattggtcgagagcgggggcggggtcgtgcaaccgggcaggagcctgcgcttgagctgtgccgcgagccatttctcgttcaaccgctatggcatgcactgggtcaggcaagcgcccgggaaagggctcgagtgggtggccgggatctcgtacgatggcagggacttttaccatgccgatatcgtatgggggcgcttgaccataagcagggacaatagcaagaacacggtatatctccagatgaatagcctgcgcgcggacgataccgggctctattactgtgccagagacgtgcgagagagcgagtgcgaggaatgggaatcgtactattacgatttcgggcgcaagggcccgtgcttgaaaccgcgcggggtcgcgggcacgttcgatatgtggggccagggcacgatcgtgagcgtgagcgcg

SEQ ID NO: 55454 - RNA, 432 nt, synthetic construct
  misc_feature 1..432: note = derived and/or modified sequence opt11 from anti-HIV_cap256-119-018483_VR-Chain
  source 1..432: mol_type = other RNA
ctcgtacaactggtcgagagcgggggcggggtcgtgcaaccgggcaagagcctgcgcttgagctgtgtcgcgagccagttcacgttcaatcgctatggcatgcactgggtcaggcaagcgcccgggaaagggctcgagtgggtggccgggatctcgtacgatggcagggacaagtaccatgcccatttcgtgtgggggcgcataaccataagcagggacaatagcaagaacacgctctatctccagatgaatagcttgcgcgcggaagataccgcgctctatcactgtgtcagggacttgcgcgagagcgagtgcgagctctgggaatcggactattacgatttcgggaaaaagctcccgtgcgtgaaaccgcgcggggtcgcgggcatattcgatctctggggccagggcacgatggtgaccgtgagctcg

SEQ ID NO: 55455 - RNA, 432 nt, synthetic construct
  misc_feature 1..432: note = derived and/or modified sequence opt11 from anti-HIV_cap256-119-018118_VR-Chain
  source 1..432: mol_type = other RNA
caagtgcacttggtcgcgagcgggggcggggtcgtgccaccgggcaggagcctgaccttgagctgtgtcgcgagccagttcacgttctcaggctgtggcttgcactgggtcaggcaagcgcccgggaaagggctcgagtgggtggcctcgatctcattcgcgggcacgaaaaagcactatggcaatagcgtgaaagggcgctttaccataagcagggacaatagcaagaacacgctctatctccagatgaatagcttgcgcccggaagataccgcgctctattactgtgccaaggacttgcgcgagtacgagtgcgaggaatggacctcggactattacgatttcgggcgcgatcaaccgtgcatagactcgcgcggggtcgtgggcatactagatatctggggccagggcacgatggtgaccgtgagctca

SEQ ID NO: 55456 - RNA, 432 nt, synthetic construct
  misc_feature 1..432: note = derived and/or modified sequence opt11 from anti-HIV_cap256-119-017782_VR-Chain
  source 1..432: mol_type = other RNA
caagtgcaattggtcgagagcgggggcggggtcgtgcaaccgggcaagagcttgcgattgagctgtgccgcgagcggattcccgttctcgaactatgccatgcactgggtcaggcaaacgcccgggcgcgggctagagtgggtggccgggatctcgttcgcggccacgaaaaagtactatcgcccgagcgtgcgcgggcgatttaccgtgagcacggacataagcaagaacacgctctatctcgagatgaatagcttgcgcccggaagataccgcgctctatttctgtgccagggaccagcgctattacgagtgcgaggaatgggcctcggactattacgatttcgggcgcgagcaaccgtgcttggacccgcgcggggtcgtgggcatattcgatctctggggccagggcacgatggtgacagtgagctca

SEQ ID NO: 55457 - RNA, 432 nt, synthetic construct
  misc_feature 1..432: note = derived and/or modified sequence opt11 from anti-HIV_cap256-119-017669_VR-Chain
  source 1..432: mol_type = other RNA
caagtgcaattggtcgagagcgggggcggggtcgtgcaaccgggctcgagcttgcgcttgagctgtgccgcgagccatttcgcgttcaatcgctacggcatgcactgggtcaggcaagcgcccgggaaaggactcgagtgggtggccgggatctcgttcgatggcgcggacaagttccatgccgataaagtgtgggggcgctttaccataagcagggacaatagcaagaacacgctctcgctccagatgaatagcttacgcccggaagataccgcgctctattactgtgccaaggacttgcgagaggacgagtgcgaggaatggtggtcggactattacgatttcgggcgaaggctcccgtgcaggaaatcgcgcggggtctcgggaatattcgataactggggccagggaacgatggtgaccgtgagctcg

SEQ ID NO: 55458 - RNA, 432 nt, synthetic construct
  misc_feature 1..432: note = derived and/or modified sequence opt11 from anti-HIV_cap256-119-016976_VR-Chain
  source 1..432: mol_type = other RNA
caagtgcaattggtcgagagcgggggcggggtcgtgcaaccgggcaggagcttgcgcttgagctgtgccgcgagccagttctcgttcggggactttggcatgcactgggtcaggcaagcgcccgggaaagggctcgagtgggtggccgcgatctcgttcgcgggcacgaaaaagaactatgccgatagcgtgcgcgggcgcttcaccataagcagggactcgagtaagaacacgctatatctccagatgaatagcttgcgcccggaagataccgcgctctattactgtgtcaaggacatgcgcgggtacgagtgcgaggaatggacctcggactattacgatttcgggcgcccgcaaccgtgcatagactcgcgcggggtcgtgggcacattcgatgtctggggccagggcacgatggtgaccgtgagctcg

SEQ ID NO: 55459 - RNA, 432 nt, synthetic construct
  misc_feature 1..432: note = derived and/or modified sequence opt11 from anti-HIV_cap256-119-015432_VR-Chain
  source 1..432: mol_type = other RNA
gaagtgcaattgctcgagagcgggggcgggctcgtgcaaccgggcgggagcttgcgcttgagctgtgccgcgagcgggttcacgttctcgggctatagcttgaactgggtcaggcaagcgcccgggaaagggctcgagtgggtggcatcgatctcgtacgatggctcggacaagtaccatgccgatcgcgtgtgggggcgctttaccataagcagggacaatagcaagaacacgctctatctccagatgaatagcttgcgagcggaagataccgcgctctattactgtgtcagggacgcgcgcgagagcgagtgcgagctctgggaatcggactattacaatttcgggcgcaagctcccgtgcgtgaaaccgcgcggggtcgcgggcacgctcgatatctggggccagggcacgatggtgaccgtgagctcg

SEQ ID NO: 55460 - RNA, 432 nt, synthetic construct
  misc_feature 1..432: note = derived and/or modified sequence opt11 from anti-HIV_cap256-119-015281_VR-Chain
  source 1..432: mol_type = other RNA
ctcgggcgcttggtcgcgagcgggggcggggtcgtgcccccgggcaggagcttgcgcttgagctgtgtcgcgagccagttcacgttctcgggctgtggcctgcactgggtcaggcaagcgcccgggaaagggctcgagtgggtggcctcaatctcattcgcgggcacgaaaaagcactatggcaatagcgtgaaagggcgctttaccataagcagggacaatagcaagaacacggtctatctcgagatgaatagcttgcgcgcggaagataccgcgctctattactgtgccaaggacttgcgcgagtacgagtgcgaggaatggacctcggactattacgatttcgggcgaccgcaaccgtgcatagactcgcgcggggtcgtgggcatactagatatctggggacagggcacaatggtgaccgtgagctcg

SEQ ID NO: 55461 - RNA, 432 nt, synthetic construct
  misc_feature 1..432: note = derived and/or modified sequence opt11 from anti-HIV_cap256-119-014957_VR-Chain
  source 1..432: mol_type = other RNA
caagtgcaagtggtcgagagcgggggcggggtcgtgcaaccgggcacgagcctgcgcctgagctgtaccgtgagcgggttctcgttctcaaactatgacttgcactgggtaaggcaaacgcccgcgaaagggctcgagtgggtggccgtggtctcgtacgatggctcgcgcgagtactataccgatagcgtaaaagggcgctttatcataagcagggaccagagcaagaacacgctctatctccagatgaatagcgtgcgcttggaagataccgcgcgctattactgtgccagggacatgcgcgagtacgagtgcgagctctgggcctcggactattacgatttcgggaaaccgcaaccgtgcgaggacccgcgcggggtcgtgggcacgttcgatatgtggggcttgggcacgctcgtgaccgtgagctcg

SEQ ID NO: 55462 - RNA, 432 nt, synthetic construct
  misc_feature 1..432: note = derived and/or modified sequence opt11 from anti-HIV_cap256-119-014777_VR-Chain
  source 1..432: mol_type = other RNA
caagtgcacttagtagagagcgggggcggggtcgtgcaaccgggcaggagcttgcgcttgagctgtgcagcgagccatttctcgctctcgagctatggcatgcactgggtcaggcaagcgcccgggaaagggctcgagtgggtggccgggatctcgttcgcggccacgaaaacgtactatggcgggagcgtgaaagggcgctttaccgtaagcagggacataagcaagaacacgctatatctccagatgaatagcttgcgcccggaagataccgcgatgtattactgtgccagggaccagcgctattacgagtgcgaggaatgggcctcggactattacgatttcgggcgcgagcaaccatgccaggacccgcgcggggtcgtgggcgtgttcgatatgtggggccagggcacgatggtgaccgtgagctcg

SEQ ID NO: 55463 - RNA, 432 nt, synthetic construct
  misc_feature 1..432: note = derived and/or modified sequence opt11 from anti-HIV_cap256-119-014313_VR-Chain
  source 1..432: mol_type = other RNA
caagtgcaattagtcgagagcgggggcggggtcgtacaaccgggcaggagcttgcgaataagctgtgccgcgagccagttcacgttctcgcgctatggcatgcactgggtcaggcaagcgcccgggaaagggctagagtgggtggcctcgatctcatacgatggcagggactatcaccatgccggggcagtgtgggggcgctttatcataagcagggacaatagcaagaactcgctccatctccagatgaatagcctgcgaccggaagataccgcgctctatttctgtgccagggacctgcgagagagcgagtgcgaggaatgggaatcagactattacaatttctggaaaaagctcccgtgcgtaaaaccgcgcggggtcgtgggcatactcgatatctggggccagggcacggtcgtgaccgtgagctcg

SEQ ID NO: 55464 - RNA, 438 nt, synthetic construct
  misc_feature 1..438: note = derived and/or modified sequence opt11 from anti-HIV_cap256-119-014219_VR-Chain
  source 1..438: mol_type = other RNA
caaatgcaattggtcgagagcgggggcggggtcgtgcaaccgggctcaagcctcaccttgagctgtgccgcgagccagttcacgttctcgaactatggcatgcactgggtcaggcaagcgcccgggaaagggctcgagtgggtggcctcaatctcgaacgatggcacgaaaaagtaccatggcgatagcgtgtgggatcgctttaccataagcagggacaatagcaagaacacgttgttcctccagatgaatagcttgcgcgcggaagataccgcgctctatttctgtgtcaaggaccagcgcgaggacgagtgcgaggaatggtggtcggactattacgatttcgggcgcgagctcccgtgcaggaaatttcgcgggctcgggctagcgggcacgttcgatatctggggccatggcacgatgttgatcgtgagctca

SEQ ID NO: 55465 - RNA, 432 nt, synthetic construct
  misc_feature 1..432: note = derived and/or modified sequence opt11 from anti-HIV_cap256-119-013631_VR-Chain
  source 1..432: mol_type = other RNA
caagtgcaattggtcgagagcgggggcggggtcgtgcaaccgggcaggagcctgcgcttgagctgtgccgcgagccagttcacgttcgggagctatggcatgcactgggtcaggcaaatacccgggaaagggctcgagtgggtggccacgatctcgtacgatggcacgaaaaagtaccatgccgatagcgtgtgggatcgctttatcataagcagggacaatagcaagaacacgctctttctccagatgaatagcttgcgcccggaagataccgcgctctatttctgtgtcaaggaccagcgccaggacgagtgcgaggaatggtggtcggactattacgatttcgggcgcaggctcccgtgcaggaaatcgcgcgggctagcgggcatattcgatgtctggggccatggcacgatggtgaccgtgagctcg

SEQ ID NO: 55466 - RNA, 432 nt, synthetic construct
  misc_feature 1..432: note = derived and/or modified sequence opt11 from anti-HIV_cap256-119-012924_VR-Chain
  source 1..432: mol_type = other RNA
caagtgaccttggtcgagagcgggggcgggttcgtgcaaccgggcgggagcttgcgcttgagctgtgccacgagcgggttcacgttctcgagctatgccatgcactgggtcaggcaagcgcccgggaaagggctcgagtgggtggccgcgatatcgttcgatggcgcggacaagtaccatgccgataacgtgtgggggcgcttgagcataagcagggacaatagcaagagcacgctctatctccagatgaatagcttgcgcccggaagataccgcggtctatttctgtgccaaggacttgagagaggacgagtgcgaggaaaggtggtcggactattacgatttcgggaaacagctcccgtgcaggaaatcgcgcggggtcgcgggcatattcgataactggggccagggcacgatggtgaccgtgagcgcg

SEQ ID NO: 55467 - RNA, 432 nt, synthetic construct
  misc_feature 1..432: note = derived and/or modified sequence opt11 from anti-HIV_cap256-119-011793_VR-Chain
  source 1..432: mol_type = other RNA
caagtgcaattggtcgagagcgggggcggggtcgtgcaaccgggcgggagcttgcgattgagctgtgtcgcgagccagttcacgttctcgcgatatggcatgcactgggtcaggcaagcgcccgggaaagggctcgagtgggtggcctcgatctcgtacgatggcagggacaagtaccatgccgatttcgtgtgggggcgcttgaccataagcagggacgatagcaagaaaacgctctatctccagatggatagcttgcgcgtggacgataccgcgctctattactgtgtcagggacatgcgcgagagtgagtgcgagctctgggaatcggactattacgatttcgggaaaaggctcccgtgcgtgaaaccgcgcggggtcgcgggcatattcgatatctggggccagggcacgatggtgaccgtgagctcg

SEQ ID NO: 55468 - RNA, 432 nt, synthetic construct
  misc_feature 1..432: note = derived and/or modified sequence opt11 from anti-HIV_cap256-119-011413_VR-Chain
  source 1..432: mol_type = other RNA
caagtgcaattggtcgagagcgggggagatgtcgtgcaaccgggcaggagcttgcgcttgagctgtgccgcgagcgggttcacgttctcgacctatggcatgcactgggtcaggcaagcgcccgggaaagggctcgagtgggtggccgcgatctcgttcgcgggcacgaaaaagaactatgccgatagcgtgcgcgggcgatttaccataagcagggactcgagcaagaacacgctatatctcgagatgaatagcttgcgcccggaagataccgcgctctattactgtgccaaggacatgcgcgggtacgagtgcgaggaatggacctcggactattacgatttcgggcgcccgcaaccgtgcatagactcgcgcggggtcgtgggcacgttcgatgtctggggccagggcacgatggtgaccgtgagctcg

SEQ ID NO: 55469 - RNA, 432 nt, synthetic construct
  misc_feature 1..432: note = derived and/or modified sequence opt11 from anti-HIV_cap256-119-011323_VR-Chain
  source 1..432: mol_type = other RNA
caagtgaaattggtcgagagcgggggcggggtcgtgcccccgggcaagagcctgcgattgagctgtaccgcgagccagttcacgttctcgaactttggcatgcactgggtcaggcaagcgcccgggaaagggctcgagtgggtggcctcgatctcgttcgtgggaataaaaacgcactatgccaatagcgtgcgagggcgctttaccataagcagggaccagagcaagaacacgctctatctccagatgaatagcgtgcgagtggaagataccgggcgttattactgtgccagagacatgcgcgagtacgagtgcgagctctgggcctcggactattacgatttcgggaaaccgcaaccgtgcgaggacccgcgcggggtcgtgggcacgttcgatatgtggggcctgggcacgctcgtgaccgtgagctcg

SEQ ID NO: 55470 - RNA, 432 nt, synthetic construct
  misc_feature 1..432: note = derived and/or modified sequence opt11 from anti-HIV_cap256-119-011233_VR-Chain
  source 1..432: mol_type = other RNA
caagtgcacttggtcgagagcgggggcggggtcgtgcaaccgggcaggagcgtgcgcttgagctgtgccgcgagccatttctcgctctcgagctatggcatgcactgggtcaggcaagcgcccgggaaagggctagagtgggtgaccggaatctcgttcgcgggcacgaaaacgtactatggcgatagcgtgcgagggcgctttaccgtaagcagggacataagcaagaacacgctctttctccagatgaatagcttgcgcccggacgataccgcgatgtattactgtgccagggaccagcgctattacgagtgcgaggaatgggcctcggactattacgacttcgggcgcgagcaaccgtgcttggacccgcgcggggtcgtgggcatattcgatctctggggccagggcacgatggtgaccgtgagctcg

SEQ ID NO: 55471 - RNA, 432 nt, synthetic construct
  misc_feature 1..432: note = derived and/or modified sequence opt11 from anti-HIV_cap256-119-009038_VR-Chain
  source 1..432: mol_type = other RNA
caagagcaactggtcgagagcgggggcggggtcgtgcaaccgggcaggagcttacgcttgagctgtgtcgcgagcaggttcacgttctcggccttcggcatgcactgggtcaggcaagcgcccgggaaagggctcgagtgggtggcctcgatatcgttcgcgggcatcaaaaagtactatggcgatagcgtgaaagggcgatttaccataagcagggacaatagcaagaacacgctctatctccagatggatggcctgcgcggggaagacaccgcgctatattactgtgccaaggacttgcgcgagctcgagtgcgaggaatgggcctcggactattacgatttcgggcgcccgcaaccgtgcttggacccgcgcggggtctcgggcataagcaatgtctggggccagggcacgatggtaaccgtgagctcg

SEQ ID NO: 55472 - RNA, 432 nt, synthetic construct
  misc_feature 1..432: note = derived and/or modified sequence opt11 from anti-HIV_cap256-119-008756_VR-Chain
  source 1..432: mol_type = other RNA
caagtgcaattggtcgagagcgggggcggggtcgtgcaaccgggcaagagcttgcgcttgagctgtgtcgtgagccagttcacgttcgggcgctatggcatgcactgggtcaggcaagcgcccgggaaagggctcgagtgggtggcctcgatatcgtacgatggctcggacaagtaccataccagctcattgtgggggcgatttatcgtgagcagggacaatagcaagaacacgctctatctccagatgaatagcttgcgaccggaagataccgcgctctattactgtgtcagggacaggcgcgagagcgagtgcgaggaaaggtggtcggactattacgatttcgggaaacagctcccgtgcgtgaaaccacgcggggtcgcgggcatattcgatatctggggccagggcacgatggtgacagtgagctcg

SEQ ID NO: 55473 - RNA, 438 nt, synthetic construct
  misc_feature 1..438: note = derived and/or modified sequence opt11 from anti-HIV_cap256-119-008055_VR-Chain
  source 1..438: mol_type = other RNA
caaatgcaattggtcgagagcgggggcggggtcgtgcaaccgggcaggagcttgaccttgagctgtgccgcgagccagttctcattcgcgaactatggcatgcactgggtcaggcaagcgcccgggaaagggctcgagtgggtggcctcgatctcgaacgatggcacgaaaaagtaccatgaagagagcgtgtgggggcgctttaccataagcaaggacaatagcaagaacacgctctttctacagatgaatagcttgcgcatagaagataccgcactctatttctgtgtcaaggaccagcgcgaggacgagtgcgaggaatggtggtcggactattacgatttcgggcgcgagctcccgtgcaggaaatcgcgcgggctcgggctcgcgggcatattcgatatgtggggccatggcacgatggtgaccgtgagctcg

SEQ ID NO: 55474 - RNA, 435 nt, synthetic construct
  misc_feature 1..435: note = derived and/or modified sequence opt11 from anti-HIV_cap256-119-006949_VR-Chain
  source 1..435: mol_type = other RNA
caggtccacctcgtggaatcgggcgggggcgtggtccagcccgggcgctcgctcaggctctcgtgcgcggcctcgggctttagcgtgagcaataactatatgaattgggtgcgccaggccccgggcgagggcttggaatgggtcgcgctcatcagctttgacgggcgccagaaagatctcgcggactcggtcaagggcaggttcgcgatatcgcgcgataactcgaaaaataccttgtacttgcaaatgaactcgctcaggctcgaggacacggccttgtactattgcgcgcgcgatctcagagaattggactgtgaagagtggacgctatataactattacgatttcgggagcaggggcccgtgcgtggacccgcgcggggtcgggggctcgttcgatgtctggggccagggcacgatggtgaccgtgagctcg

SEQ ID NO: 55475 - RNA, 432 nt, synthetic construct
  misc_feature 1..432: note = derived and/or modified sequence opt11 from anti-HIV_cap256-119-006685_VR-Chain
  source 1..432: mol_type = other RNA
caagtacaattggtcgagagcgggggcggggtcgtgcaaccgggcaggagcttgcgcgtgagctgtgccgcgagccatttcacgttctcgcgctatggcatgcactgggtcaggcaagcgcccgggaaaggactcgagtgggtagcctcgatctcgtacgatggaagggacttttaccatgccagaagcgtgtgggggcgctttaccataagcagagacaatagcaagaacacgctccatctccagatgaatagcttgcgcccggaagataccgcgctctatttctgtgccagggacttgcgagagagcgagtgcgaggaatgggaatcgtactattacgatttcgggaaaaagggcccgtgcgtgaaaccgcgcggggtcgtgggagtgctagatatctggggccagggcacgctcgtgaccgtgagctcg

SEQ ID NO: 55476 - RNA, 432 nt, synthetic construct
  misc_feature 1..432: note = derived and/or modified sequence opt11 from anti-HIV_cap256-119-006015_VR-Chain
  source 1..432: mol_type = other RNA
caagtgcaactggtcgagagcgggggcggggtcgtgcaaccgggcaagagtttgcgcttgagctgtgccgcgagcagattcacgttcaatcgctatggcatgcactgggtcagacaagcgcccgggaaagggctcgagtgggtggcagcgatctcgttcgatggcacggacaagtaccatagcgatgacgtgtgggggcgctttaccataagcagggacaatagcaagaacacgctctatctccagatgaatagcttgcgcccggaagataccgcgctctattactgtgccaaggacttgcaagaggacgagtgcgaggaatggtggtcggactattacgatttcgggaaacagctaccgtgcaggaaatcgcgcggggtcgcgggcatattcgatgactggggccagggcacgatggtgaccgtgagctcg

SEQ ID NO: 55477 - RNA, 432 nt, synthetic construct
  misc_feature 1..432: note = derived and/or modified sequence opt11 from anti-HIV_cap256-119-005841_VR-Chain
  source 1..432: mol_type = other RNA
caagtgcaattggtcgagagcgggggcggggtcgtgcaaccgggcaggagcttgcgcttgagctgtgccgcgagccagttctcgttcgggaactttggcatgcactgggtcaggcaagcgcccgggaaagggctcgagtgggtggccgcgatctcgttcgcgggcacgaaagagaactatgccaatagcgtgcgcgggcgctttaccataagcagggacaatagcaagaacacgctctatctccagatgaatagcttgcgcgcagaagataccgcgctctattactgtaccaaggacatgcgcgagtacgagtgcgaagaatggacctcggactattacgatttcgggcgcccgcaaccgtgcatagactcgcgcggggtagtgggcacgttcgatgtctggggccagggcacgatggtgaccgtgagctcg

SEQ ID NO: 55478 - RNA, 432 nt, synthetic construct
  misc_feature 1..432: note = derived and/or modified sequence opt11 from anti-HIV_cap256-119-005824_VR-Chain
  source 1..432: mol_type = other RNA
caagtgcaactggtcgagagcgggggcggggtcgtgcaaccgggcgggagcttgcgcttgagctgtgccgcgagcgggttcacgttcaggcgctatgccatgcactgggtcaggcaagcgcccgggaaagggctcgagtgggtggcctcgatctcgtacgatggctcggacaagtaccatacctcgagcttgtgggggcgctttatcgtgagcagggacaatagcaagaacacgctatatctccagatgaatagcttgcgcccggaagataccgcactctattactgtgtaagggacaggcgcgagagcgagtgcgaggaaaggtggtcggactattacgatttcgggaaacagctcccgtgcgtgaaaccgcgcggggtcgcgggcatattcgatatctggggccagggcacgatggtgaccgtgagctca

SEQ ID NO: 55479 - RNA, 432 nt, synthetic construct
  misc_feature 1..432: note = derived and/or modified sequence opt11 from anti-HIV_cap256-119-005494_VR-Chain
  source 1..432: mol_type = other RNA
caagtgcgcctggtcgagagcgggggcggggtcgtgcaaccgggcaggagcttgcgcataagctgtgccgcgagccagttcatgttcaataaatatggcatgcactgggtcaggcaagcgcccgggaaagggctcgagtgggtggcctcgatctcgtacgatggctcggacaagtaccatgccgatctcgtgtgggggcgctttaccataagcagggacaatagcaagaacacgctctatctccagatgaatagcctgcgcgcggaagataccgcgctctattactgtgtcagggacgcgcgcgagagcgagtgcgagctctgggaatcggactattacaatttcgggcgcaagctcccatgcgtgaaaccgcgcggggtcgcgggcacgctcgatatctggggccagggcacgatggtgaccgtgagctcg

SEQ ID NO: 55480 - RNA, 432 nt, synthetic construct
  misc_feature 1..432: note = derived and/or modified sequence opt11 from anti-HIV_cap256-119-004949_VR-Chain
  source 1..432: mol_type = other RNA
caagtgcaattggtcgagagtgggggcggggtcgtgcaaccgggccgcagcttgagactgagctgtgccgcgagcaagttctcgctatcgagctatggcatgcactgggtcaggcaagcgcccgggcgcgggctcgagtgggtggccgggatctcgttcgcggccacgaaaaagtactatcgcccgagcgtgcgcgggcgctttaccgtgagcacggacataagcaagaacacgctctatctcgagatgaatagcttgcgcccggaagatacagcgctctatttctgtgccagggaccagcgctattacgagtgcgaagaatgggcatcggactattacgatttcgggcgcgagcaaccgtgcttggacccgcgcggggtagtgggcatattcgatctctggggccagggcacgatggtgaccgtgagctcg

SEQ ID NO: 55481 - RNA, 432 nt, synthetic construct
  misc_feature 1..432: note = derived and/or modified sequence opt11 from anti-HIV_cap256-119-004422_VR-Chain
  source 1..432: mol_type = other RNA
cacgtacaattggtcgagagcgggggaggggtcgtgcaaccgggcaggagcttgcgcttgagctgtgccgcgagcgggctctcgttctcgagctatgccatgcactgggtcaggcaagcgcccgggaaagggctcgagtgggtggccgtggtctcgtacgatggcacgaccaagttctatgccgatagcgtgaaagggcgctttaccataagcagagacaatagcaagaacacgctctatctccagatgaatagcttgcgcggggaagataccgcgctctattactgtgccaaggacttgcgcgagtacgagtgcgaggaatggacctcggactattacgatttcgggcgcccgcaaccgtgcatagactcgcgcggggtcgtgggcatactcgatatctggagccagggaacgatggtgaccgtgagctcg

SEQ ID NO: 55482 - RNA, 432 nt, synthetic construct
  misc_feature 1..432: note = derived and/or modified sequence opt11 from anti-HIV_cap256-119-003932_VR-Chain
  source 1..432: mol_type = other RNA
caagtgcaattactcgagagcgggggcggggtcgtgcaaccgggcgggagcttgcgcctgagctgtaaagcgagccatttctcgttcgatcgctatggcatgcactgggtcaggcaagcgcccgggaaagggctcgagtgggtggccgcgatctcgttcgatggcgcggacaagtaccatgccgataacgtgtgggggcgattgagcataagcagggacaatagcaagagcacgctctatctccagatgaatagcttgcgcccggaagataccgcggtctatttctgtgccaaggacctgcgcgaggacgagtgcgaggaaaggtggtcggactattacgatttcgggaaacagctcccgtgcaggaaatcgcgcggggtcgcgggcatattcgataactggggccagggcacgatggtgaccgtgagcgcg

SEQ ID NO: 55483 - RNA, 438 nt, synthetic construct
  misc_feature 1..438: note = derived and/or modified sequence opt11 from anti-HIV_cap256-119-003577_VR-Chain
  source 1..438: mol_type = other RNA
caagtgcaattggtcgagagcgggggcgggggcgtgcaaccgggaaggagcttgcgcttgagctgtgccgcgagcgggttcacgttcaggagctatgccatgcactgggtcaggcaagcgcccgggaaagggctcgagtgggtggccgtgatctcgaacgatggcacgaaaaagtaccatgccgagagcgtgtgggatcgctttagcataagcaaggacaatagcaagaacacgctttttctccagatgaatagcttgagagtggaagataccgcgctctatttctgtgtcaaggaccagcgcgaggacgagtgcgaggaatggtggtcggactattacgatttcgggcgcgagctcccgtgcaggaaatcgcgcgggctcgggctcgcgggaatattcgatatgtggggccatggcacgatggtgacagtgagctcg

SEQ ID NO: 55484 - RNA, 432 nt, synthetic construct
  misc_feature 1..432: note = derived and/or modified sequence opt11 from anti-HIV_cap256-119-002155_VR-Chain
  source 1..432: mol_type = other RNA
ctcgggcgcttggtcgcaagcgggggcggggtcgtgcccccgggcaggagcctgcgcttgagctgtgtcgcgagccagttcacgttctcgggctgtggcctgcactgggtcaggcaagtgcccgggaaagggctcgagtgggtggcctcgatatcgttcgcgggcacgaaaacacactatggcaatagtgtgaaagggcgctttagcataagcagggacaatagcataaacacggtatatctacagatgaatagcctgcgagcggaagataccgcgctctattactgtgccaaggacttgcgcgagtacgagtgcgaggaatggacctcggactattacgatttcgggcgaccgcaaccgtgcatagactcgcgcggggtcgtgggaatactcgatatctggagccagggcacgatggtgaccgtgagctcg

SEQ ID NO: 55485 - RNA, 432 nt, synthetic construct
  misc_feature 1..432: note = derived and/or modified sequence opt11 from anti-HIV_cap256-119-002017_VR-Chain
  source 1..432: mol_type = other RNA
caagtgcaattggtcgagagcgggggcggggtcgtgcaaccaggcaggagcttgcgcttgagctgtgccgcgagcgggttcacgttctcgtactatggcatacactgggtcaggcaagcgcccgggaaagggctcgagtgggtggcctcgatctcgtacgatgaaagggacttttaccatgcaaggagcgtgtgggggcgctttgccataagcagggacaatagcaagaacacgctccatctccagatgaatagcttgcgaccggaagataccgcgctctatttctgtgccagggacttgcgcgagagcgagtgcgaggaatgggaatcgtactattacgatttcgggaaaaagggcccgtgcgtgaaaccgcgcggggtcgtgggcgtgctcgatatctggggacagggcacgctagtgaccgtaagctcg

SEQ ID NO: 55486 - RNA, 432 nt, synthetic construct
  misc_feature 1..432: note = derived and/or modified sequence opt11 from anti-HIV_cap256-119-001312_VR-Chain
  source 1..432: mol_type = other RNA
caagtgcaattgatggagagcgggggcggggtcgtgcaaccgggcaggagcttgcgcttggcctgtgccgcgagcgggttcacgttctcgagctatgccatacactgggtcaggcaagcgccagggaaagggctcgagtgggtggccgcgatctcgttcgcgggcacgaaaaagaactatgccgatagcgtgcgcgggcgctttacaataagcagggactcgagcaagaacacgctctacctcgagatgaatagcttgcgcccggaagataccgcactctattactgtgccaaggacatgcgaggatacgagtgcgaggaatggacctcggactattacgatttcgggcgaccgcaaccgtgcatagactcgcgcggggtcgtgggcacgttcgatgtctggggccagggcacgatggtgaccgtgagctcg

SEQ ID NO: 55487 - RNA, 438 nt, synthetic construct
  misc_feature 1..438: note = derived and/or modified sequence opt11 from anti-HIV_cap256-119-001017_VR-Chain
  source 1..438: mol_type = other RNA
caaatgcaattggtcgagagcgggggcggggtcgtgcaaccgggcaggagcttgaccttgagttgtgccgcgagccagttctcgttcacgaactatggcatgcactgggtcaggcaagcgcccgggaaagggctcgagtgggtggcctcgatctcaaacgatggcaataaaaagtaccatggcgagagcgtgtgggatcgatttaccataagcagggacaatagcaagaacacgctctttctccagatgaatcgcttgcgagtggaagataccgcgctctatttctgtgtcaaggaccagcgcgaggacgagtgcgaggaatggtggtcagactattacgatttcgggcgcgagctcccgtgcaggaaatttcgcgggctagggctcgcgggcatattcgatgtctggggccatggcacgatggtgaccgtgagctcg

SEQ ID NO: 55488 - RNA, 432 nt, synthetic construct
  misc_feature 1..432: note = derived and/or modified sequence opt11 from anti-HIV_cap256-119-000594_VR-Chain
  source 1..432: mol_type = other RNA
caagtgcaattggtcgagagcgggggcgggctcgtgcaaccgggcacgagcttgcgcttgagctgtgccgcgagcgcgttcacgttcaagaactatggcatgcactgggtcaggcaagcgcccgggaaagggctcgattgggtggcctcaatctcgtacgatggaagggacaagtaccatagctcgctcgtgtgggggcgcctgaccataagcagagacaatagcaagagcacgctctttctccagatgaatagcttgcgcgcggaagataccgcgctctattactgtgccagggacttgcgcgagagcgagtgcgaggaatggcaatcggactattacgcgttctataaaaagctaccgtgcgtgaaaccgcgcggggtcgcgggcacgctcgatatatggggccagggcacgatggtgaccgtgagctcg

SEQ ID NO: 55489 - RNA, 432 nt, synthetic construct
  misc_feature 1..432: note = derived and/or modified sequence opt11 from anti-HIV_cap256-059-241099_VR-Chain
  source 1..432: mol_type = other RNA
caagtgcaattggtcgagagcgggggcggggtcgtgcaaccgggcaggagcttgcgcttgagctgtgccgcgagcgggttcacgttctcgagctatggcatgcactgggtcaggcaagcgcccgggaaagggctcgagtgggtagcagtgatctcgtacgatggctcgaacaagtactatgtcgatagcgtgcaagggcgctttaccataagcagggacaatagcaagaacacgatgtttctccagatgaatagcctgcgcacggaagataccgcggtctattactgtgccagagacttgggcgagagcgaggtagaggaatgggccacggactattacgatttctcgatcgcgtacccggtcgagggcccgcgaggggtcgtgggcatattcgatatctggggccagggcacgatggtgaccgtgagctcg

SEQ ID NO: 55490 - RNA, 432 nt, synthetic construct
  misc_feature 1..432: note = derived and/or modified sequence opt11 from anti-HIV_cap256-059-207529_VR-Chain
  source 1..432: mol_type = other RNA
caagtgcaattggtcgagagcgggggcggggtcgtgcaaccgggcaggagcttgcgattgagctgtgccgcgagcgggttcacgttctcgagctatggcatgcactgggtcaggcaagcgcccgggaaagggctcgagtgggtggccgggatctcgttcgcgggcataaacaagtactatggcaatagcgtgaaagggcgctttaccataagcagggacaatagcaggaacacgctctatctacagatgaatagcttgcgcgcggaagataccgcgctctattactgtgccagggacttgcgcgagatggagtgcgaggaatgggcctcggactattacgatttcgggcgcgggggcccgtgccaggacccgcgcggggtcgtgggcacgttcgatatctggggccagggcacgatggtgaccgtgagctcg

SEQ ID NO: 55491 - RNA, 435 nt, synthetic construct
  misc_feature 1..435: note = derived and/or modified sequence opt11 from anti-HIV_cap256-059-205541_VR-Chain
  source 1..435: mol_type = other RNA
cagatgcagctcgtggaatcgggcgggggcgtggtccagcccgggggctcgctcaggctctcgtgcgcggcctcgggctttagctttagctattacgcgatggattgggtgcgacaggccccgggcaagggcttggaatgggtcgcgttcataagctcggacgggagcgataaaaattacgcggactcggtcaagggcaggttcacgatctcgcgcgataactcgaaaaataccttgtacttgcaaatgaactcgctcagggccgaggacacggccgtgtactattgcgcaaaagatgtcgggggccataaaaatgacgagtgggcgaccaattactattacgatatctcgatcgcgtacccgatccaggacccgcgcgcggtcgcaggcgcgttcgatgtctggggccagggcacgatggtgaccgtgagctca

SEQ ID NO: 55492 - RNA, 432 nt, synthetic construct
  misc_feature 1..432: note = derived and/or modified sequence opt11 from anti-HIV_cap256-059-188439_VR-Chain
  source 1..432: mol_type = other RNA
caagtgcaattggtcgagagcgggggcggggtcgtgcaaccgggcaggagcttgcgcttgagctgtgccgcgagccagttcacgttctcgaactatggcatgcactgggtcaggcaagcgcccgggaaagggctagagtgggtggccgcgatctcgttcgcgggcataaacaagtactataccgatagcgtgaaagggcgctttaccataagcagggacaatagcaagaacacgctctatctccagatgaatagcttgcgcgcggaagataccgcactctattactgtgccaaggacttgcgcggattcgagtgcgaggaatgggcctcggactattacgatttcgggcgcgatctcccgtgccaggacccgcgcggggtcgtgggcacgttcgatgtctggggacagggcacgaaagtgaccgtgagctcg

SEQ ID NO: 55493 - RNA, 432 nt, synthetic construct
  misc_feature 1..432: note = derived and/or modified sequence opt11 from anti-HIV_cap256-059-187234_VR-Chain
  source 1..432: mol_type = other RNA
caagtgcaactggtcgagagcgggggcggggtcgtgcaagcgggcaggagcttgcgcctgagctgtgccgcgagccagttcacgttcgggagctatggcatgcactgggtcaggcaagcgcccgggaaagggctcgagtgggtggccgcgatctcgttcgcgggcacgaaaatacactatgccgatagcgtgaaagggcgctttaccataagcagggacaatagcaagaacgcgctatatctccagatgcatagcttgcgcgcggaagataccgcgctctattactgtgccaaggacttgcgcgagtacgagtgcgaggaatgggcatcggactattacgatttcgggcgcgatcaaccgtgccaggacccgcgcggggtcgtgggcatattcgatatctggggccagggcacgatggtgaccgtgagctcg

SEQ ID NO: 55494 - RNA, 432 nt, synthetic construct
  misc_feature 1..432: note = derived and/or modified sequence opt11 from anti-HIV_cap256-059-187047_VR-Chain
  source 1..432: mol_type = other RNA
caagtgcaactggtcgagagcgggggcggggtcgtgcaaccgggcaggagcttgcgcctgagttgtgccgtgagccagctcacgttctcgagctatggcatgcactgggtcaggcaagcgcccgggaaagggctcgagtgggtggccgcaatctcgttcgtgggcatcaaaaagtactatgccgacagcgtgaaagggcgctttaccataagcagggacaatagcaagaacacgctctatctccagatgaatagcttgagagtggaagataccgcgctctattactgtgccaaggacttgcgcgagtacgagtgcgaggaatgggcctcggactattacgatttcgggcgcgatcaaccgtgccaggacgcgcgaggggtcgtgggcacgagcgatatatggggccagggcacgatggtgaccgtgagctcg

SEQ ID NO: 55495 - RNA, 432 nt, synthetic construct
  misc_feature 1..432: note = derived and/or modified sequence opt11 from anti-HIV_cap256-059-186068_VR-Chain
  source 1..432: mol_type = other RNA
caagtgcaattggtcgagagcgggggcggggtcgtgcaaccgggcaggagcttgcgattgagctgtgccgcgagccagttctcgttctcgaactatggaatgcactgggtcaggcaagcgcccgggaaagggctcgagtgggtggccgggatctcgttcgcggccacgaaaaagtactatgccgatagcgtgaaagggcgctttagcgtgagcagggacaatagcaagaacgcgctctatctccagatgaatagcctgcgcgcggaagataccgcgctctattactgtgccagggacttgcgagattacgagtgcgaggaatgggcctcggactattacgatttcgggcgcgagtacccgtgccaggacccgcgcggggtcgtgggcacgttcgatatctggggccagggcacgatggtgaccgtgagcacg

SEQ ID NO: 55496 - RNA, 435 nt, synthetic construct
  misc_feature 1..435: note = derived and/or modified sequence opt11 from anti-HIV_cap256-059-182835_VR-Chain
  source 1..435: mol_type = other RNA
caagtccaactcgtcgaatccggcggcggcctagtccaacctggccgctccctccgcctctcctgcgcagcctcaggcttcagcttcaacaacttcgccatggactgggtccgccaagcccccggcaaaggcctagaatgggtcgccttcgtctcctccgacggaagcaacaaaaactacgcagactccgtcaaaggccgattcatcatctcccgcgacaactccaaaaacaccgtctacctccaaatgaactccctccgagtcgaagacaccgccgtctactactgcgcaaaagacctcggcgccaacaaagacgacgaatgggccaccgactactactacgacctctccgtcgcccgccccgtccccgacccccgcgccgtcgtcggcgccttcgacgtctggggccaaggcaccatggtcaccgtcagctcc

SEQ ID NO: 55497 - RNA, 432 nt, synthetic construct
  misc_feature 1..432: note = derived and/or modified sequence opt11 from anti-HIV_cap256-059-176659_VR-Chain
  source 1..432: mol_type = other RNA
cgcgtgcaattggtcgagagcgggggcggggtcgtgcaaccgggcaggagcttgcgcttgagctgtgccgcgagccagttctcgttctcgaactatggaatgcactgggtcaggcaagcgccagggaaagggctcgagtgggtggccgggatatcgttcgcggccatcaaaaagtactatgccgatagcgtgaaagggcgctttaccataagcagggacaatagcaagaacgcgctctatctccagatgaatagcttgcgcgcggaagataccgcgctatattactgtgcaagggacttgcgcgagtacgagtgcgaggaatgggcctcggactattacgatttcgggcgcgagctcccgtgccaggacccgcgcggggtcgtgggcacgttcgatacctggggccagggcacgatggtgaccgtgagcacg

SEQ ID NO: 55498 - RNA, 432 nt, synthetic construct
  misc_feature 1..432: note = derived and/or modified sequence opt11 from anti-HIV_cap256-059-172956_VR-Chain
  source 1..432: mol_type = other RNA
caagtgcaattggtcgagagcgggggcggggtcgtgcaaccgggcaggagcttgcgcttgagctgtgccgcgagccagttctcgttctcgagctatggcatgcactgggtcaggcaagcgcccgggaaaggactagagtgggtggccgcgatgtcgttcgcgggcacgaaccagtactatgccgcgagcgtgaaagggcgctttaccataagcagggacaatagcaagaacacgctctatctccatatgaatagcttgcgcccggaagataccgcgctctattactgtgccagggacttgcgcgagtacgagtgcgaggaatgggccgcggactattacgatttcgggcgcgagtacccgtgccaggacccgcgcggggtcgtgggcatattcgatgtatggggccagggcacgctcgtgacagtgagctcg

SEQ ID NO: 55499 - RNA, 432 nt, synthetic construct
  misc_feature 1..432: note = derived and/or modified sequence opt11 from anti-HIV_cap256-059-171272_VR-Chain
  source 1..432: mol_type = other RNA
caagtgctcttggtcgagagcgggggcggggtcgtgcaaccgggcaggagcttgcgcttgagctgtgccgcgagccagttcacgttctcgaactatggcatgcactgggtcagacaagcgcccgggaaagggctcgagtgggtggccgcgatctcgttcgcgggcatgaaaaagtactatgccgatagcgtgaaaggacgctttaccataagcagggacaatagcaagaacacgctctatctccagatgaatagcttgcgcgcggaagataccgcgctctattactgtgccaaggacctgcgcgagttcgagtgcgaggaatgggcctcggactattacgatttcgggcgagcgcaaccgtgccaggacccgcgcggggtcgtgggcacgttcgatctctggggccagggcacaatggtgaccgtgagctcg

SEQ ID NO: 55500 - RNA, 432 nt, synthetic construct
  misc_feature 1..432: note = derived and/or modified sequence opt11 from anti-HIV_cap256-059-168734_VR-Chain
  source 1..432: mol_type = other RNA
caagtgcaattggtcgagagcggaggcggggtcgtacaaccgggcaggagcctgcgcttgagctgtaccgcgagccagttctcgttctcgagctatggcatgcactgggtcaggcaagcgcccgggaaagggctcgagtgggtggcagcgatctcgttcgcgggcacgaaaaagtactatgtcgggaccgtgaaagggcgctttaccataagcagggacaatagcaagaacacgctctatctccagatgaatagcttgcgcgcggaagataccgcgctctattactgtgccaaggacatgcgcgagtacgagtgcgaggaatgggcctcggactattacgatttcgggcgcgagtacccgtgccaggacccgcgcggggtcgtgggcacgttcgatatctggggccagggcacgatggtgaccgtgagctca

SEQ ID NO: 55501 - RNA, 432 nt, synthetic construct
  misc_feature 1..432: note = derived and/or modified sequence opt11 from anti-HIV_cap256-059-155838_VR-Chain
  source 1..432: mol_type = other RNA
caagtgcaattggtcgagagcgggggcggggtcgtgcaaccgggcaggagcttgcgcttgagctgtgccgtgagccagttcacgttctcgaactatggcatgcactgggtcaggcaagcgcccgggaaagggctcgagtgggtagccgcgatctcgttcgcgggcaccaaaaagagctatgccgcgagcgtgaaagggcgctttacaataagcagggacaatagcaagaacacgctctatctccagatgaatagcttgcgcccggaagataccgcgctctattactgtgccaaggacatgcgcgggttcgagtgcgaggaatgggcctcggactattacgatttcggacgcgagcaaccgtgccaggacccgcgcggggtcgtgggcatattcgatctctggggccagggcacgatggtgagcgtgagctcg

SEQ ID NO: 55502 - RNA, 432 nt, synthetic construct
  misc_feature 1..432: note = derived and/or modified sequence opt11 from anti-HIV_cap256-059-149799_VR-Chain
  source 1..432: mol_type = other RNA
caagtgcacttggtcgagagcgggggcggggtcgtgcaaccgggcaggagcttgcgattgagctgtgccgcgagccagttcacgttctcgaactatggctttcactgggtcaggcaagcgcccgggaaagggctcgagtgggtggccgcgatctcgttcgcgggcgtgaaaaagcactatgccgatagcgtgaaaggacgctttaccataagcagggacaatagcaagaacacgctctatctccagctcaatagcttgcgcgcggaagataccgcactctattactgtgccaaggacttgcgcgagtacgagtgcgaggaatgggcctcagactattacgatttcggacgcgatttcccgtgccaggacccgcgcggggtcgtgggcacgttcgatatctggggccagggcacaatggtgaccgtaagctcg

SEQ ID NO: 55503 - RNA, 432 nt, synthetic construct
  misc_feature 1..432: note = derived and/or modified sequence opt11 from anti-HIV_cap256-059-148168_VR-Chain
  source 1..432: mol_type = other RNA
caagtgcaactggtcgagagcgggggcggggtcgtgcaaccgggcaggagcttgcgcttgagctgtaccgcaagccagttcacgttctcgaactacggcatgcactgggtcaggcaagcgcccggaaaagggctcgagtgggtggccgggatctcgttcgcggccacgaaaaagtactacagcgatagcgtgaaagggcgctttaccataagcagggacaacagcaagaacgcgctctatctccagatgaatagcttgcgcgcggaagataccgcgctctatcactgtgccaaggacttgcgcgagtacgagtgcgaggaatgggcctcggactattacgacttcgggcgcgagcaaccgtgccaggacccgcgcggggtcgtgggcacgttcgatatctggggccagggaacgatggtgaccgtgagcacg

SEQ ID NO: 55504 - RNA, 435 nt, synthetic construct
  misc_feature 1..435: note = derived and/or modified sequence opt11 from anti-HIV_cap256-059-144685_VR-Chain
  source 1..435: mol_type = other RNA
caggtccatctcgtagaatcgggcgggggcgtagtccagcccgggcgctcgctcaggctctcgtgcgcggcctcaggctttacctttagcaatttcgcgatggattgggtgcgccaggccccgggcaagggcttggaatgggtcgcgttcgtgagctcggacgggaacaataaaaattacggggactcggtaaagggcaggttcacgatctcgcgcgataactcgaaaaataccctgttcctgcaaatgaactcgctcagggccgaggacacggccctgtactattgcgtgaaagatgtcggggactataaatcggacgagtgggcgacacattactattacgatctctcgatcgcggacccgatccaggacccgcgcgcggtcgtgggcgcgttcgatatctggggcaggggcacgatggtggccgtgagctcg

SEQ ID NO: 55505 - RNA, 432 nt, synthetic construct
  misc_feature 1..432: note = derived and/or modified sequence opt11 from anti-HIV_cap256-059-140017_VR-Chain
  source 1..432: mol_type = other RNA
caagtgcaattggtcgagagcgggggcggggtcgtgcaaccgggcaggagcttgcgcttgagctgtgccgcgagccagttctcgttcgggaactttggcatgcactgggtcaggcaagcgcccggaaaagggctcgagtgggtggccggaatctcgttcgcgggcacgaaaaagtactatgccgatagcgtgaaagggcgatttacaataagcagggacaatagcaagagcgcgctctttctccagatgaatagcttgcgcgcggaagataccgcgctctattactgtgccaaggacttgcgctattacgagtgcgaggaatgggcctcggactattacgatttcgggcgcgatcaaccgtgccaggacccgcgcggggtcgtgggcacgttcgatatgtggggccagggcacgatggtgaccgtgagctcg

SEQ ID NO: 55506 - RNA, 432 nt, synthetic construct
  misc_feature 1..432: note = derived and/or modified sequence opt11 from anti-HIV_cap256-059-137547_VR-Chain
  source 1..432: mol_type = other RNA
caagtgcaattggtcgagagcgggggcggggtcgtgcaaccgggcaggagcttgcgtttgagctgtgccgcgagccagttcacgttctcgcgctatggcatgcactgggtcaggcaagcgcccgggaaagggctcgagtgggtggccgcgatctcgttcgcgggcatcaaaaagaactatgccgatagcgtgaaagggcgctttaccataagcagggacaatagcaagaacacgctctatctccagatgaatagcttgcgcgcggaagataccgcgctctattactgtgccagggacttgcgcgagttcgagtgcgaggaatgggcctcggactattacgatttcgggcgcgatttcccgtgccaggacccgcgcggggtcgtgggcatattcgatatatggggccagggcacgatggtgaccgtgagctcg

SEQ ID NO: 55507 - RNA, 435 nt, synthetic construct
  misc_feature 1..435: note = derived and/or modified sequence opt11 from anti-HIV_cap256-059-131908_VR-Chain
  source 1..435: mol_type = other RNA
caagtccaactcgtcgaatccggcggcggcgtcgtccaacccggccgctccctacgcctctcctgcaccgccagcggcttcaccttctccaactacggaatccactgggtccgccaagcccccggcaaaggcctcgaatgggtagccgccatctcatacgaaggctccatcaaatactacgtcgactccgtcaaaggccgcttcaccatctcccgcgacgactccaaaaacaccctcttcctccaaatgaactccctccgcaccgaagacaccgccgtatactactgcacccgcgacgtccgcgaatgggaaaccgaagaatgggccaccaactactactacgacctctccatcgcctaccccatccgacacccccgaggcgtcgtcggcatcttcgacgtctggggactcggcacccgcgtcaccgtctcctcc

SEQ ID NO: 55508 - RNA, 432 nt, synthetic construct
  misc_feature 1..432: note = derived and/or modified sequence opt11 from anti-HIV_cap256-059-116006_VR-Chain
  source 1..432: mol_type = other RNA
caagcgcaattggtcgagagcgggggcggagtcgtgcaaccgggcaggagcttgcgcttgagctgtgccgcgagccagttctcgttctcgagctatggcatgcactgggtcaggcaagcgcccgggaaagggctagagtgggtggcctcgatctcgttcgcgggcgtgaaaaagaccaatgccgatagcgtgaaagggcgatttaccataagcagggacaatagcaagaacacgctccatctccagatgaatggcttgcgcaatgacgataccgcgctctattactgtgccagggacttgcgcgatttcgagtgcgaggaatgggcctcggactattacgatttcgggcgagagttcccgtgccaggacccgcgcggggtagtgggcacgttcgatatctggggccagggcacgaaagtgaccgtgagctcg

SEQ ID NO: 55509 - RNA, 411 nt, synthetic construct
  misc_feature 1..411: note = derived and/or modified sequence opt11 from anti-HIV_cap256-059-115783_VR-Chain
  source 1..411: mol_type = other RNA
caagtgcaattggtagagagcgggggcggggtcgtgcaaccgggcaggagcctgcgcttgagctgtgccgcgagccagttcacgttctcgagctatggcatgcactgggtcaggcaagcgcccgggaaagggctcgagtgggtggccgcgatatcgtacgcggactcggtcaagggaaggttcacgatctcacgagataactcgaaaaataccctgtacttgcaaatgaactcgctcagggccgaggacacggccttgtactattgcgcgaaagatctcagggaaatggaatgtgaagagtgggcgagcgattactatgactttggcagggacttgccctgtcaagatccaaggggcgtggtagggaccctggacatatgggggcaagggaccatggtcacggtctcaagc

SEQ ID NO: 55510 - RNA, 432 nt, synthetic construct
  misc_feature 1..432: note = derived and/or modified sequence opt11 from anti-HIV_cap256-059-114609_VR-Chain
  source 1..432: mol_type = other RNA
caagtgcaattggtcgagagcgggggcggggtcgtgcaaccgggcaggagcttgcgcttgagctgtgccgcgagccagctcacgttctcgaactttggcatgcactgggtcaggcaagcgcccgggaaagggctcgagtgggtggccgggatctcgttcgcgggcacgaaaaagtactatgccgatagcgtgaaagggcgctttaccataagcagggacaatagcaagaacgcgctctatctccagatgaataccttgcgcgcggaagataccgcgctctatttctgtgccaaggacttgcgcgagtacgagtgcgaggaatgggcctcggactattacgatttcgggcgagatcaaccgtgccaggacccgcgcggggtcgtgggcatattcgatatctggggccagggcacgatggtgaccgtgagctca

SEQ ID NO: 55511 - RNA, 432 nt, synthetic construct
  misc_feature 1..432: note = derived and/or modified sequence opt11 from anti-HIV_cap256-059-113952_VR-Chain
  source 1..432: mol_type = other RNA
caagcgcaattagtcgagagcgggggcggggtcgtgcaaccgggcaggagcttgcgcttgagctgtgccgcgagccatttcacgttctcgagctatggctttcactgggtcaggcaagcgcccgggaaagggctcgagtgggtggccgggatctcgttcgcggccacgaaaaagtactatgccgatagcgtgaaagggcgctttaccataagcagagacaatagcaaggacgcgctctatctccagatgaatagcctgcgcgcggaagataccgcgctctattactgtgccagggacttgcgcgggtacgagtgcgaggaatgggcctcggactattacgacttcgggcgcgatcaaccgtgccaggacccgcgcggggtcgtgggcatattcgatctctggggccagggcacgatggtgaccgtgagctcg

SEQ ID NO: 55512 - RNA, 432 nt, synthetic construct
  misc_feature 1..432: note = derived and/or modified sequence opt11 from anti-HIV_cap256-059-113878_VR-Chain
  source 1..432: mol_type = other RNA
caggtacagctcgtggaatcgggcgggggcgtggtccagcccgggcgctcactcaggctctcgtgcgcggcctcgggctttacctttagcacgtacgcgatgcattgggtgcgccaggccccgggcaagggcctagaatgggtcgcgctcataagctatgacgcgaccaataaatattacgtggactcggtcaagggcaggttcacgatctcgcgcgataactcgaaaaataccctgtacttgcaaatgagctcgctcacggccgaggacacagccgtgtactattgcgcgaaagatctcgggggcataaaaatagacgagtgggggaccgattactatgacataagcgtgagctatcccgtgcaagatcccagggccgtggccgggatcttcgacgtgtgggggcacgggaccatggtctcggtctcaagc

SEQ ID NO: 55513 - RNA, 432 nt, synthetic construct
  misc_feature 1..432: note = derived and/or modified sequence opt11 from anti-HIV_cap256-059-113622_VR-Chain
  source 1..432: mol_type = other RNA
caagtgcaattggtcgagagcgggggcggggtcgtgcaaccgggcaggagcttgcgattgagctgtgcagcgagccagttcacgttcacgagctatggaatgcactgggtcaggcaagcacccgggaaagggctcgagtgggtggccgggatctcgttcgcgggaacgaaaaagcactatgccgatagcgtgaaagggcgatttaccataagcagggacaatagcaagagcacgctctatctccagatgaatagcttgcgcgcggaagataccgcgctctattactgtgcaaaggacatgcgcgagtacgagtgcgaggaatgggcctcggactattacgatttcgggcgcgatcaaccgtgccaggacccgcgcggggtcgtgggcatattcgatctatggggccagggcacgatggtgaccgtgagctcg

SEQ ID NO: 55514 - RNA, 432 nt, synthetic construct
  misc_feature 1..432: note = derived and/or modified sequence opt11 from anti-HIV_cap256-059-109427_VR-Chain
  source 1..432: mol_type = other RNA
caagtgcaattggtagagagcgggggcggggtcgtgcaaccgggcaggagcctgcgcttgagctgtgccgcgagccagttcacgttctcgaactatggcatgcactgggtcagacaagcgcccgggaaagggctcgagtgggtggcctcgatctcgttcgcgggcatcaaaaagcactataccgatagcgtgaaagggcgctttaccataagcagggacaatagcaagaacacgctctttctccagatgaatagcttgcgcgcggaagataccgcgctctattactgtgccagggacctgcgcgagtacgagtgcgaggaatgggcctcagactattacgatttcggacgcgatcaaccgtgccaggacccgcgaggggtcgtgggcacgagcgatatatggggccagggaacgaaagtgaccgtgagctcg

SEQ ID NO: 55515 - RNA, 432 nt, synthetic construct
  misc_feature 1..432: note = derived and/or modified sequence opt11 from anti-HIV_cap256-059-109081_VR-Chain
  source 1..432: mol_type = other RNA
caagagcaattggtcgagagcgggggcggggtcgtgcaaccgggcaggagcctgcgcttgagctgtgccgcgagccagttctcgttctcggcctatggcatgcactgggtcaggcaagcacccgggaaagggctcgagtgggtggccgggatctcgttcgcggccacgaaaaagtactatgaagatagcgtgaaagggcgctttaccataagcagggacaatagcaagaacacgctctatctccagatgaatagcttgcgcggggaagataccgcgctctattactgtgccaaggacatgcgcgagatggagtgcgaggaatgggcctcggactattacgatttcgggcgcccgcaaccgtgccaggacccgcgcggggtcgtgggcatattcgatatgtggggccagggcacgatggtgaccgtgagctcg

SEQ ID NO: 55516 - RNA, 432 nt, synthetic construct
  misc_feature 1..432: note = derived and/or modified sequence opt11 from anti-HIV_cap256-059-107590_VR-Chain
  source 1..432: mol_type = other RNA
caagagcaattggtcgagagcgggggcggagtcgtgcaaccgggcaggagcttgcgcttgagctgtgccgcgagccagttctcgatctcggcctatggcatgcactgggtcaggcaagcgcccgggaaagggctagagtgggtggccgggatctcgttcgcgggcacgaaaaagtactatgccgatagcgtgaaagggcgctttacaataagcagggacaatagcaagaacacgctctatctccagatgaatagcctgcgcggggaagataccgcgctctattactgtgccaaggacatgcgcgagatggagtgcgaggaatgggcctcggactattacgatttcgggcgagatcaaccgtgccaggacccgcgcggggtcgtgggcatattcgatatgtggggccagggcacgatggtgaccgtgagctcg

SEQ ID NO: 55517 - RNA, 435 nt, synthetic construct
  misc_feature 1..435: note = derived and/or modified sequence opt11 from anti-HIV_cap256-059-107504_VR-Chain
  source 1..435: mol_type = other RNA
caagtgctcttggtcgagagcgggggcggggtcgtgcaaccgggcaagagcttgcgcttgagctgtagcgcgagcaggttcacgttctcgaactatggcatgcactgggtcaggcaagcgcccgggaaagggctcgagtgggtggccgcggtctcgttcgcgggaataaagaaaaccaatgccgatagcgtgaaagggcgctttaccataagcagggacaatagcaagaacacgctctatctccagatgaatagcttgcgcgcggaagataccgcgctatattactgtgccagggacctgcgagatttcgagtgcgaggaatgggcctcagactattacgatttctggggcgatccccagccctgtcaagatcccagaggcgtggtcgggacctttgacttgtgggggcaagggacaatggtcacggtctcgagc

SEQ ID NO: 55518 - RNA, 432 nt, synthetic construct
  misc_feature 1..432: note = derived and/or modified sequence opt11 from anti-HIV_cap256-059-099614_VR-Chain
  source 1..432: mol_type = other RNA
gaagtgctcttgctcgagagcgggggcgggctcgtgcaaccgggcaggagtttgcgcttgagctgtgccgcgagccagttcacgttctcgagctacggcatgcactgggtcaggcaagcgcccgggaaagggctcgagtgggtggccgggatctcgttcgtgggcatcaaaaagtactatgccgatagcgtgaaagggcgctttaccataagcagggacaatagcaagaacacgctctatctccagatgaatagcttgcgcgcggaagataccgcgctctattactgtgccagggacttgcgcgagtacgagtgcgaggaatgggcctcagactattacgatttcgggcgcgatcaaccgtgccaggacccgcgcggggtcgtgggcacgttcgatatatggggccagggcacgatggtgacagtgagctcg

SEQ ID NO: 55519 - RNA, 432 nt, synthetic construct
  misc_feature 1..432: note = derived and/or modified sequence opt11 from anti-HIV_cap256-059-098972_VR-Chain
  source 1..432: mol_type = other RNA
caagtgcaattggtcgagagcgggggcggagtcgtgcaaccgggcaggagcttgcgcttgagctgtgccgcgagccagttcacgttctcgagctatggcatgcactgggtcaggcaagcgcccgggaaagggctcgagtgggtggcctcgatatcgttcgcgggcatcaaaaagaactatcgcgatagcgtgaaagggcgctttaccataagcagggacaatagcaagaacacgctctatctccagatgacgagcttgcgcccggaagataccgcgctatattactgtgccaaggacttgcgcgggttcgagtgcgaggaatgggcctcggactattacgatttcgggcgcgagctaccgtgccaggacccgcgcggggtcgtgggcacgttcgatatgtggggccagggcacgatggtaaccgtgagctcg

SEQ ID NO: 55520 - RNA, 432 nt, synthetic construct
  misc_feature 1..432: note = derived and/or modified sequence opt11 from anti-HIV_cap256-059-097236_VR-Chain
  source 1..432: mol_type = other RNA
caagtgcaactggtcgagagcgggggcggggtcgtgcaaccgggcaggagcttgcgcttgagctgtgccgcgagcgggttctcgttctcgaactttggctttcactgggtcaggcaagcgcccgggaaagggctcgagtgggtggccgcgatctcgttcgtgggcaataaaaagtactatgccgagagcgtgaaagggcgctttaccataagcagggaaaatagcaagaacatgctctttctccagatgaatagcttgcgcggggaagataccgcggtctattactgtgccaaggacttgcgcgagttcgagtgcgaggaatgggcctcggactattacgatttcgggcgcgagcaaccgtgccaggacccgcgcggggtcgtgggctcgatcgatgtctggggccatggctcgctcgtgaccgtgagctcg

SEQ ID NO: 55521 - RNA, 432 nt, synthetic construct
  misc_feature 1..432: note = derived and/or modified sequence opt11 from anti-HIV_cap256-059-091487_VR-Chain
  source 1..432: mol_type = other RNA
caagtgcaattggtcgagagcgggggaggggtcgtgcaaccgggaaggagcctgcgcttgagctgtgccgcgagccagttcacgttcaatcgctatggcatgcactgggtcaggcaagcgcccgggaaagggctcgagtgggtggcagtgatctcgtacgatggaacgaacaagtactatggcgagagcgtgaaagggcgcttcaccataagcagggacaatagcaagaacacgctctatctccagatgaatagcttgcgcgcggaagataccgcgctctattactgtgccaaggacttgcgagaggacgagtgcgaggaatggtggtcggactattacgatttcgggcgcgagctaccgtgcaggaaatcgcgcggggtcgcgggcatattcgatatctggggccagggcacgatggtgaccgtgagctcg

SEQ ID NO: 55522 - RNA, 432 nt, synthetic construct
  misc_feature 1..432: note = derived and/or modified sequence opt11 from anti-HIV_cap256-059-089812_VR-Chain
  source 1..432: mol_type = other RNA
caagtgcaattggtcgagagcgggggcggggtcgtgcaaccgggccggagcttgcgcttgagctgtgccgcgagccagctcacgttctcgagctatggcatgcactgggtcagacaagcgcccgggaaagggctcgagtgggtggccgggatctcgttcgcgggcacgaaaaagcactatagcgatagcgtgaaagggcgctttaccataagcagggacaatagcaagaacgcgctctatctccagatgaatagcttgcgcgcggaagataccgcgctatattactgtgccaaggacttgcgcgagtacgagtgcgaggaatgggcctcggactattacgatttcgggcgcgagcaaccgtgccaggacccgcgcggggtcgtgggcatattcgatatgtggggccagggcacgatggtgaccgtgagctca

SEQ ID NO: 55523 - RNA, 432 nt, synthetic construct
  misc_feature 1..432: note = derived and/or modified sequence opt11 from anti-HIV_cap256-059-088468_VR-Chain
  source 1..432: mol_type = other RNA
caagtgcaattggtcgagagcgggggcggggtcgtgcaaccgggcaggagcttgcgcctgagctgtgccgcgagccagttcacgttctcgagctatggcatgcactgggtcaggcaagcgcccgggaaagggctcgagtgggtggccgcgatctcgttcgtgggcatcaaaaagtactatgccaatagcgtaaaagggcgctttaccataagcagggacaatagcaagaacacgctctatctccagatgaatagcttacgcgcagaagataccgcgctctattactgtgccagggacttgcgagagtacgagtgcgaggaatgggcctcagactattacgatttcgggcgcgggggcccgtgccaggacccgcgcggggtagtgggctcgttcgatatatggggccagggcacgatggtgaccgtgagctcg

SEQ ID NO: 55524 - RNA, 432 nt, synthetic construct
  misc_feature 1..432: note = derived and/or modified sequence opt11 from anti-HIV_cap256-059-088341_VR-Chain
  source 1..432: mol_type = other RNA
caagtgcaattggtcgagagcgggggaggggtcgtgcaaccgggcaggagcttgcgcctgagctgtgccgcgagccagttcacgttctcgagctatggcatgcactgggtcaggcaagcgcccgggaaagggctcgagtgggtggccgcgatctcgttcgcgggcatcaaaaagcactatgccgatagcgtgaaagggcgctttaccataagcagggacaatagcaagaacatggtctttctacagatgaatagcttgcgcgcggaagataccgcgctctattactgtgcaagggacttgcgcgagtacgagtgcgaggaatgggcctcggactattacgatttcgggcgcgatcaaccgtgccaggacccgcgaggggtcgtgggcacgagcgatatatggggccagggcacgatggtgaccgtgagctcg

SEQ ID NO: 55525 - RNA, 432 nt, synthetic construct
  misc_feature 1..432: note = derived and/or modified sequence opt11 from anti-HIV_cap256-059-086533_VR-Chain
  source 1..432: mol_type = other RNA
caagtgctcttggtcgagagcgggggcggggtcgtgcaaccgggcaggagcttgcgcttgagctgtgccgcgagccagttcacgttctcaaactttggcatgcactgggtcaggcaagcgcccgggaaagggctagagtgggtggccgggatatcgttcgtaggcatcaaaaagtactatgccgggagcgtgaaagggcgctttaccataagcagggacaatagcaaaaacacgctctatctccagatgaatagcttgcgcgcggaagataccgcgctctattactgtgccaaggacttgcgcgagttcgagtgcgaggaatgggcctcggactattacgatttcgggcgcccgcaaccgtgccaggacccgcgcggggtcgtgggcacgttcgacctctggggcctgggcacgctcgtgaccgtgagctcg

SEQ ID NO: 55526 - RNA, 432 nt, synthetic construct
  misc_feature 1..432: note = derived and/or modified sequence opt11 from anti-HIV_cap256-059-086043_VR-Chain
  source 1..432: mol_type = other RNA
gaagtgcacttggtcgagagcgggggcgggctcgtgaaaccgggcgggagcttgcgcctgagctgtgccgcgagcgggttcacgttctcgacctatagcatgaactgggtcaggcaagcgcccgggaaagggctcgagtgggtggcctttgtcgcgttcgatgaatcggacaagtactatgccgatagcgtgaaagggcgctttaccataagcagggacaatagcaagaacacgctctcgctccagatgaatagcttgcgcgtggaagataccgcgatctattactgtgccaaggaagtgggcgataacaaggacgatgaatgggcatcggactattacgatctctcgatcgcgtacccgatccaggacccgcgcgcggtcgggcgcgggtacgatatctggggccagggaacgatggtgaccgtgagctcg

SEQ ID NO: 55527 - RNA, 432 nt, synthetic construct
  misc_feature 1..432: note = derived and/or modified sequence opt11 from anti-HIV_cap256-059-084191_VR-Chain
  source 1..432: mol_type = other RNA
caagtgcaactggtagagagcgggggcggggtcgtgcaaccgggcaggagcttgcgcttgagctgtgccgcgagccagttcacgttctcgagctatggcatgcactgggtcaggcaagcgcccggaaaagggctcgagtgggtggcagcgatctcgttcgtgggcatcaaaaagtactatgccgatagcgtgaaagggcgctttaccgtgagcagggacaatagcaagagcacgctctatctacagatgaatagcttgcgcgcggaagataccgcgctatattactgtgccagagacttgagagagtacgagtgcgaggaatgggcctcggactattacgatttcgggcgcgatcaaccgtgccaggacccgcgcggggtcgtgggcatattcgatatatggggccagggcacggccgtgaccgtgagctcg

SEQ ID NO: 55528 - RNA, 417 nt, synthetic construct
  misc_feature 1..417: note = derived and/or modified sequence opt11 from anti-HIV_cap256-059-082135_VR-Chain
  source 1..417: mol_type = other RNA
caggtccagctcgtggaatcgggcgggggcgtggtccagccagggcgctcgctcaggctctcgtgcacggcctcgggctttacctttcgctcgtacgcgatccattgggtgcgccaggccccgggcaagggcttggaatgggtcgcgctcataagctatgacgggagcaataaatattacgcggactcagtcaagggcaggttcacgatctcgcgcgataactcgaaaaataccttgtacttgcaaatgaactcgctaacgagcgaggacacggccgtgtactattgcgcgaaagatctcggaggctcaaaaacggacgagtgggggaccgattactgttacccggtccaggacccacgcgtggtcgtgggcgcgttcgatatctggggacatggcacgatggtgaccgtgagctcg

SEQ ID NO: 55529 - RNA, 432 nt, synthetic construct
  misc_feature 1..432: note = derived and/or modified sequence opt11 from anti-HIV_cap256-059-079417_VR-Chain
  source 1..432: mol_type = other RNA
caggtccagctcgtggaatcgggcgggggcgtggtccagcccggacgctcgctcagactctcatgcgcggcctcgggctttagctttagcaattacgcgatggattgggtgcgccaggccccgggaaagggcttggaatgggtcgcgttcgtgagctcggacgggaacaacaaaaagtacgcggactcggtcaaaggcaggttcacgctctcgcgcgataactataaaaataccgtgtacttgcaaatgaactcgctcacggtcgaggacacggccgtgtactattgcgcgaaagatctcggggccaataaagatgacgagtgggggaccgactactacgacatgagcgtgagctatcccatacccgatcccagggccgtggtcggggcctttgacgtgtgggggcaagggaccttggtcacggtctcaagc

SEQ ID NO: 55530 - RNA, 435 nt, synthetic construct
  misc_feature 1..435: note = derived and/or modified sequence opt11 from anti-HIV_cap256-059-076027_VR-Chain
  source 1..435: mol_type = other RNA
caggtccagctcgtggaatcaggcgggggcgtggtccagcccgggcgctcgctcaggctctcgtgcgcggcctcgggctttagctttagcaagtacgggatgcattgggtgcgccaggccccgggcaagggattggaatgggtcgcgttcgtggcctttgacgagagcgagaaatattacgcggcctcggtcaagggcaggttcacgatctcgcgcgataactcgaaaaataccctgagcttgcaaatgaactcgctcaggaccgaggacacagccatatactattgcgcgaaagaggtcggggacaataaagatgacgagtggacgagcccgtactattacgacatctcgatcgcgtacccggtacatgacccgcgcgcggtcgtgggcgtgagcgatgtctggggccagggcacgatggtgaccgtgagctca

SEQ ID NO: 55531 - RNA, 432 nt, synthetic construct
  misc_feature 1..432: note = derived and/or modified sequence opt11 from anti-HIV_cap256-059-075082_VR-Chain
  source 1..432: mol_type = other RNA
caagtgcaattggtcgagagcgggggcggggtcgtgcaaccgggcaggagcttgcgcctgagctgtgccgcgagccagttcacgttctcgagctatggcatgcactgggtcaggcaagcgcccgggaaagggctcgagtgggtggccgcgatctcgttcgtgggcatcaaaaagtactatgccgatagcgtgaaagggcgatttaccataagcagggacaatagcaagaacacgctctatctccagatgaatagcttgcgcgcggaagataccgcgctctattactgtgccaaggacttgcgcgagatggagtgcgaggaatgggcctcggactattacgatttcgggcgcgatctcccgtgccaggacccgcgcggggtcgtgggcacgctcgatatatggggccagggcacgatggtgaccgtgagctcg

SEQ ID NO: 55532 - RNA, 432 nt, synthetic construct
  misc_feature 1..432: note = derived and/or modified sequence opt11 from anti-HIV_cap256-059-072575_VR-Chain
  source 1..432: mol_type = other RNA
caagggcaattggtcgagagcgggggcggggtcgtgcaaccgggcaggagcttgcgcttgagctgtgccgcgagccagttcacgttctcgaactttggcatgcactgggtcaggcaagcgcccgggaaagggctcgagtgggtggccgtgatctcgtacgatggcacgaaaaagtactatgccgatagcgtgaaagggcgctttaccataagcagggacaatagcaagaacacgctctatctccagatgaatagcttgcgcgcggaagataccgcgctctattactgtgccaaggacatgcgcgaggacgagtgcgaggaatggggcgcggactattacgatttcgggaaagattacccgtgccaggcctcgcgcggggtcgtgggcatattcgatatctggggccagggcacgatggtgaccgtgagcgcg

SEQ ID NO: 55533 - RNA, 432 nt, synthetic construct
  misc_feature 1..432: note = derived and/or modified sequence opt11 from anti-HIV_cap256-059-071926_VR-Chain
  source 1..432: mol_type = other RNA
caagtgcaactggtcgagagcgggggcggggtcgtgcaaccgggcaggagcttgcgcttgagctgtgcagcgagccagctctcgttctcgaactatggcatgcactgggtcaggcaagcgcccgggaaagggctcgagtgggtagccgggatctcgttcgtgggcatcaaaaagtactatcgcgatagcgtgaaagggcgctttaccataagcagggacaatagcaagaacacgctctatctccagatgaatagcttgcgcacggaagataccgcgctctattactgtgtcaaggacttgcgcgagttcgagtgcgaggaatgggcctcggactattacgatttcgggcgagatcaaccgtgcttagacccgcgcggagtcgtgggcacgttcgatatatggggccagggcacgatggtgaccgtgagctcg

SEQ ID NO: 55534 - RNA, 432 nt, synthetic construct
  misc_feature 1..432: note = derived and/or modified sequence opt11 from anti-HIV_cap256-059-069638_VR-Chain
  source 1..432: mol_type = other RNA
caagtgcaactggtcgagagcgggggcggggtcgtgcaaccgggcaggagcttgcgcttgagctgtgccgcgagcgggttcacgttctcgaaaaacgccatgcactgggtcaggcaagcgcccgggcgcgggctcgagtgggtggcctcggtcgcgttcgatggctcggacaagtactatgccgatagcgtgaaagggcgctttaccataagcagggacaatagcaagaacacgctctcgctacagatgaatagcctgcgcgcggaagataccgcggtctattactgtgccaaggaagtggacttgtacaaggacgatgaatggggctcggactattacgatctctcgatcgcgtacccgatccaggacccgcgcgcggtagtgggcgggttcgggatctggggccagggcacgatggtgaccgtgagttcg

SEQ ID NO: 55535 - RNA, 432 nt, synthetic construct
  misc_feature 1..432: note = derived and/or modified sequence opt11 from anti-HIV_cap256-059-069165_VR-Chain
  source 1..432: mol_type = other RNA
ctcgtgcaattggtcgagagcgggggcggggtcgtgcaaccgggcaggagcttgcgattgagctgtgccgcgagcaggttcacgttctcgaactatggcatgcactgggtcaggcaagcacccgggaaagggctcgagtgggtggccgggatctcgttcgcgggcacgaccaagtactatgccgatagcgtgcgcgggcgctttacaataagcagggacaatagcaagaacacgctctatctccagatgaatagcttgcgcgcggaagataccgcgctatattactgtgccaaggacatgcgcgagatggagtgcgaggaatgggcctcggactattacgatttcgggcgaccgcaaccgtgccaggacccgcgcggggtcgtgggcatattcgatatctggggccagggcacgatggtgaccgtgagctcg

SEQ ID NO: 55536 - RNA, 432 nt, synthetic construct
  misc_feature 1..432: note = derived and/or modified sequence opt11 from anti-HIV_cap256-059-068956_VR-Chain
  source 1..432: mol_type = other RNA
caagtacaactcgtcgaatccggcggcggcgtcgtccaacccggccgctccctacgcctctcctgcgccgcctccggcttcaccttctccacctacgccatgcactgggtccgccaagcccccggccgcggcctcgaatgggtcgccctcatctcctacgacggctccaacaaatactacgtcgactccgtcaaaggccgcttcaccatctcccgcgacaactccaaaaacaccctctacctccaaatgaactccctcaccgccgaagacaccgccgtctactactgcgccaaagacctcggcggctccaaagacgacgaatgggccaccgactactacgacctctcaatcgcctaccccatccaagacccccgagccgtcgccggcatattcgacgtctggggccgcggcaccgtcgtcaccgtctcctcc

SEQ ID NO: 55537 - RNA, 432 nt, synthetic construct
  misc_feature 1..432: note = derived and/or modified sequence opt11 from anti-HIV_cap256-059-068876_VR-Chain
  source 1..432: mol_type = other RNA
caagtgcaactggtcgagagcgggggcggggtcgtgcaaccgggcaggagcttgcgcttgagctgtgccgcgagccagttcacgttctcgagctacggcatgcactgggtcaggcaagcgcccgggaaagggctcgagtgggtggccgcgatctcgttcgcgggcacgaaaaagtactatgccaatagcgtgaaagggcgctttaccataagcagggacaatagcaagaacacgctctcgctccagatgaatagcttgcgcggggaagataccgcgcgctattactgtgccagggacccgcgcgagtacgagtgcgaggaatgggcctcggactactacgatttcgggcgcgatcaaccgtgccaggacccgcgcggggtcattggcatattcgatatctggggccagggcacgatggtgaccgtgagctcg

SEQ ID NO: 55538 - RNA, 432 nt, synthetic construct
  misc_feature 1..432: note = derived and/or modified sequence opt11 from anti-HIV_cap256-059-067733_VR-Chain
  source 1..432: mol_type = other RNA
caagtgcaattggtcgagagcgggggcggggtcgtgcaaccgggcaggagcttgcgcttgagctgtaccgcgagccagttctcgttctcgagctatggcatgcactgggtcaggcaagcgcccgggaaagggctcgagtgggtggccgcgatctcattcgcgggcacgaaaaagaactatgtcgatagcgtgaaagggcgctttaccataagcagggacaatagcaagaacacgctctatctccagatgaatagcttgcgcgcggacgataccgcgctctattactgtgccaaggacatgcgcgagtacgagtgcgaggaatgggcctcggactattacgatttcgggagagagtacccgtgcacggacccgcgcggggtcgtgggcacgttcgatgtctggggacagggaacgatggtgaccgtgagctcg

SEQ ID NO: 55539 - RNA, 432 nt, synthetic construct
  misc_feature 1..432: note = derived and/or modified sequence opt11 from anti-HIV_cap256-059-067450_VR-Chain
  source 1..432: mol_type = other RNA
caagtgcaattggtcgagagcgggggcggggtcgtgcaaccgggcaggagcttgcgcttgagctgtgccgcgagccagttcacgttctcgaactatggcatgcactgggtcaggcaagcgcccgggaaagggctcgagtgggtggccgggatctcgttcgcgggcatcaaaaagtactatgccgatagcgtgaaagggcgctttaccataagcagggacaatgccaagaacacgctatatctccagatgaatagcctgcgcgcggaagataccgcgctctattactgtgccaaggacttgcgcgagtacgagtgcgaggaatgggcctcggactattacgatttcgggcgagagctcccgtgccaggacccgcgaggggtcgtgggcacgttcgatatatggggccagggaacgatggtgaccgtgagctcg

SEQ ID NO: 55540 - RNA, 432 nt, synthetic construct
  misc_feature 1..432: note = derived and/or modified sequence opt11 from anti-HIV_cap256-059-065694_VR-Chain
  source 1..432: mol_type = other RNA
caagtgcaattggtcgagagcgggggcggggtcgtgcaaccgggcaggagcttgcgcttgagctgtgccgcgagccagctcacgttcaataactatggcatgcactgggtcaggcaaacgcccgggaaagggctcgagtgggtggccgggatctcgttcgcgggcataaacaagtactatgccgatagcgtgaaagggcgctttaccataagcagggacaatagcaagaacgcgctctatctacagatgacgagcttgcgcgcggaagataccgcgctctattactgtgtcaaggacttgcgcgagatggagtgcgaggaatgggcatcggactattacgatttcggacgagatcaaccgtgccaggacccgcgcggggtcgtaggcacgttcgatatctggggccagggcacgatggtgaccgtgagctcg

SEQ ID NO: 55541 - RNA, 432 nt, synthetic construct
  misc_feature 1..432: note = derived and/or modified sequence opt11 from anti-HIV_cap256-059-065109_VR-Chain
  source 1..432: mol_type = other RNA
caagtgcaattggtcgagagcgggggcggggtcgtgcaaccgggcaagagcttgcgcttaagctgtgccgcgagcgggttcacgttcacgaacaatgccatgaactgggtcaggcaagcgcccgggaaagggctagagtgggtggcctttgtctcgagcgatggcagaaacaagaactatgccgatagcgtaaaagggcgctttaccataagcagggacaatagcaagaacacggtctatctccagatgaatagcttgcgcgtggaagataccgcgctctattactgtgccaaggacttgggcgcgaacaaggacgatgaatgggccacggactattacgatctctcagtagcgtacccgatcccggacccgcgcgcggtcgtgggcgcgttcgatgtctggggccagggcacgatggtgaccgtgagctcg

SEQ ID NO: 55542 - RNA, 432 nt, synthetic construct
  misc_feature 1..432: note = derived and/or modified sequence opt11 from anti-HIV_cap256-059-065060_VR-Chain
  source 1..432: mol_type = other RNA
caagtgcaattggtcgagagcgggggaggggtcgtgcaaccgggcacgagcttgcgcttgagttgtgccgcgagcgggttcacgttctcgaactatgccatgggctgggtcaggcaagcgcccgggaaagggctcgagtgggtggccgtggtctcgtacgatggctcgaaaaagagctatgccgatagcgtgaaagggcgatttaccataagcagggacaatagcaggaacacgctctatctccagctcaatagcttgcgcgcggaagataccgcgatgttttactgtgccaaggacttgggcaagggcgagatcgaggaatgggccacggactattacgattggtcgaaagcgtacccgatcgagggcccgcgcgatgtcgtgggcgcgttcgatacctggggccagggcacgctcgtgaccgtgagctcg

SEQ ID NO: 55543 - RNA, 432 nt, synthetic construct
  misc_feature 1..432: note = derived and/or modified sequence opt11 from anti-HIV_cap256-059-064001_VR-Chain
  source 1..432: mol_type = other RNA
caagtgcaattggtcgagagcgggggcggggtcgtgcaaccgggcaggagcttgcgcttgagctgtgccgcgagccagttcacgttctcgaactatggcatgcactgggtcaggcaagcgcccgggaaagggctcgagtgggtggccgggatctcgttcgcgggcaccaaaaattactatgccaagagcgtgaaagggcgctttacaataagcagggacaatagcaagaacgcgctctatctccagatgaatagcttgcgagcggaagatacagcgctatattactgtgccaaggacatgcgcgagtacgagtgcgaggaatgggcctcggactattacgatttcgggcgagatcaaccgtgccaggacccgcgcggggtcgtgggcacgttcgatatctggggccagggcacgatggtggccgtgagctcg

SEQ ID NO: 55544 - RNA, 432 nt, synthetic construct
  misc_feature 1..432: note = derived and/or modified sequence opt11 from anti-HIV_cap256-059-063270_VR-Chain
  source 1..432: mol_type = other RNA
caagtgcaattggtcgagagcgggggcggggtcgtacaaccgggcaggagcttgcgcctgagctgtgccgcgagccagttcacgttctcgaactatggcatgcactgggtcaggcaagcgcccgggaaagggctcgagtgggtggccgcgatctcgttcgcgggcacgaaaaagcactatgccgatagcgtgaaagggcgctttaccataagcagggacaatagcaagaacgcgctatatctccagatgaatagcttgcgcgcggaagataccgcgctctattactgtgccaaggacttgcgcgagtacgagtgcgaggaatgggcctcggactattacgatttcgggcgcgatcaaccgtgcctggacccgcgcggggtcgtgggcatattcgatatctggggccagggcacgctcgtgaccgtgagctcg

SEQ ID NO: 55545 - RNA, 432 nt, synthetic construct
  misc_feature 1..432: note = derived and/or modified sequence opt11 from anti-HIV_cap256-059-061357_VR-Chain
  source 1..432: mol_type = other RNA
caagtgcaattggtcgagagcgggggaggggtcgtgcaaccgggcaggagcttgcgcttgagctgtgccgcgagcgggttcacgttctcgaactttggctttcactgggtcaggcaagcgcccgggaaagggctcgagtgggtggccgggatatcgttcgcgggaacgaaaatatactatgccgatagcgtgaaagggcgctttaccataagcagggaaaatagcaagaacatgctctatctccagatgaatagcttgcgcggggaagataccgcggtctatttctgtgccaaggacttgcgcgagttcgagtgcgaggaatgggcctcggactattacgatttcgggcgcgagttcccgtgccaggacccgcgcggggtcgtgggcacgttcgatgtctggggccatggcgcggtcgtgaccgtgagctcg

SEQ ID NO: 55546 - RNA, 435 nt, synthetic construct
  misc_feature 1..435: note = derived and/or modified sequence opt11 from anti-HIV_cap256-059-059834_VR-Chain
  source 1..435: mol_type = other RNA
caagtccaactcgtcgaatcaggcggcggcgtagtccaacccggccgctcactccgcctctcctgcgccgcctccggcttcaccttcagcaacttcggcatgcactgggtccgccaagcccccggcaaaggcctcgaatgggtcgccttcgtcgccttcgacgaatccgacaaatactacgccgcctcagtcaaaggccgcttcaccgtctcccgcgacaactccaaaaacaccgtctccctccaaatgaactccctcagaaccgaagacaccgccgtctactactgcgccaaagaagtcggcgacaacaaagacgacgaatggaccagcccctactactacgacttctccatcgcctacccagtacacgacccacgcgcagtcgtcggcggctacgacgtctggggccaaggcaccatggtcaccgtctcctca

SEQ ID NO: 55547 - RNA, 432 nt, synthetic construct
  misc_feature 1..432: note = derived and/or modified sequence opt11 from anti-HIV_cap256-059-059313_VR-Chain
  source 1..432: mol_type = other RNA
caagtgcacctggtcgagagcgggggcggggtcgtgcaaccaggcaagagcttgcgcttgagctgtgccgcgagccagttcacgttctcgaactttggcatgcactgggtcaggcaagcgcccgggaaagggctcgagtgggtggccgggatctcgttcgcgggcacgaaaaagtactatgccgatagcgtgaaagggcgctttaccataagcagggacaatagcaagaacacgctctatctccagatgaatagcgtgcgcgcggaagataccgcgctctattactgtgccaaggacatgcgcgagtacgagtgcgaggaatgggcctcagactattacgatttcgggaaaccgcaaccgtgccaggacccgcgcggggtcgtgggcacgttcgatatgtggggattgggcacgctcgtgaccgtgagctca

SEQ ID NO: 55548 - RNA, 432 nt, synthetic construct
  misc_feature 1..432: note = derived and/or modified sequence opt11 from anti-HIV_cap256-059-057130_VR-Chain
  source 1..432: mol_type = other RNA
caagtgcaattggtcgagagcgggggcggggtagtgcaaccgggcaggagcttgcgcttgagctgtgccgcgagccagttctcgttctcgagctatggcatgcactgggtcagacaagcgcccgggaaagggctcgagtgggtggccgcgatctcgttcgcgggcatcaaaaagcactatgccgatagcgtgaaagggcgctttaccataagcagggacaatagcaagaacacgctctatctccagatgaatagcttgcgcgtggaagataccgcgctctattactgtgcaaaggacttgcgagagtacgagtgcgaggaatgggcctcggactattacgatttcgggcgcccgcaaccgtgccaggacccgagaggggtcgtgggcacgagcgatatatggggccagggcacgatggtgaccgtgagctcg

SEQ ID NO: 55549 - RNA, 411 nt, synthetic construct
  misc_feature 1..411: note = derived and/or modified sequence opt11 from anti-HIV_cap256-059-050520_VR-Chain
  source 1..411: mol_type = other RNA
caggtccagctcgtggaatcgggcgggggcgtggtccagcccgggcgctcgctcaggctatcgtgcgcagcctcacaatttacctttaacaggtacgggatgcattgggtgcgacaggccccgggcaagggcttggaatgggtcgcggtcataagctatgccgatagcgtgaaagggcgctttaccataagcagggacaatagcaagaacacgctctatctccagatgaacagcttgcgcgcggaagataccgcgctctattactgtgccaaggacctgcgcgaggacgagtgcgaggaatggtggtcggactattacgatttcgggcgcgagctcccgtgcaggaaatcgcgcggggtcgcgggcatattcgatatctggggccagggcacgatggtgaccgtgagctcg

SEQ ID NO: 55550 - RNA, 432 nt, synthetic construct
  misc_feature 1..432: note = derived and/or modified sequence opt11 from anti-HIV_cap256-059-049839_VR-Chain
  source 1..432: mol_type = other RNA
caagtgcaactggtcgagagcgggggcggggtcgtgcaaccgggcaggagcttgcgcctgagttgtgccgcgagcgggttctcgttctcgaactatgccatggactgggtcaggcaagcgcccgggaaagggctcgagtgggtggccgtggtctcgagcgatggcaagaccaagaactatgccgatagcgtgaaagggcgctttaccataagcagggacaatagcaagaacacggtctatctccagatgaatagcttgcgcccggaagataccgcagtctattactgtgccaaggacttgggcgcgaacaaggacgatgaatggaccacggactattacgattggtcggtagcgtacccggtcccggacccgcgcgcggtcgtgggcgcgttcgatgtatggggccagggcacgatggtgaccgtgagctcg

SEQ ID NO: 55551 - RNA, 432 nt, synthetic construct
  misc_feature 1..432: note = derived and/or modified sequence opt11 from anti-HIV_cap256-059-048503_VR-Chain
  source 1..432: mol_type = other RNA
caagtgcaattggtcgagagcgggggcggggtcgtgcaaccgggcaggagcttgcgcttgagctgtgccgcgagccagctatcgttctcgaactatggcatgcactgggtcaggcaagcgcccgggaaagggctcgagtgggtggccgggacctcgttcgcgggcacgaaaaagtactatgccgatagcgtgaaagggcgctttaccataagcagggacaatagcaagaacgcgctctatctccagatgaatagcttgcgcgcggaagataccgcgctctactactgtgccaaggacttgcgagagtacgagtgcgaggaatgggcctcggactattacgatttcgggcgcgatcaaccgtgccaggacccgcgcggggtcgtgggcacgttcgatatctggggccagggcacgatggtgaccgtgagcgcg

SEQ ID NO: 55552 - RNA, 432 nt, synthetic construct
  misc_feature 1..432: note = derived and/or modified sequence opt11 from anti-HIV_cap256-059-045516_VR-Chain
  source 1..432: mol_type = other RNA
caagtgcaattggtcgagagcggaggcggggtcgtgcaaccgggcaggagcttgagattgagctgtgccgcgagccagttcacgttctcgggctatggcatgcactgggtcaggcaagcgcccgggaaagggctcgagtgggtggccgcgatctcgttcgcgggcaataaaaggtactttgccgatagcgtgaaagggcgctttaccataagcagagacaatagcaagaacacgctctttctacagatgaatagcttgcgcgcggaagataccgcgctctattactgtgccagggacatgcgagagtacgagtgcgaggaatgggcctcagactattacgatttcgggcgcccgcaaccgtgccaggacccgcgcggggtcgtgggcgtgttcgatatatggggccagggcacgatggtgaccgtgagctcg

SEQ ID NO: 55553 - RNA, 432 nt, synthetic construct
  misc_feature 1..432: note = derived and/or modified sequence opt11 from anti-HIV_cap256-059-044188_VR-Chain
  source 1..432: mol_type = other RNA
caagtgcacctggtcgagagcgggggcggggtcgtgcaaccgggcaggagcttgcgcttgagctgtgccgcgagccagttcacgttctcgagctatggcatgcactgggtcaggcaagcgcccgggaaagggctcgagtgggtggccgggatctcgttcgcgggcacgaacaagtactatgccgatagcgtgaaagggcgctttaccgtgagcagggacaatagcaagaacacgctctatgtccagatgaatagcttgcgagcggaagataccgcgctatattactgtgccagggacttgcgcgagtacgagtgcgaggaatgggcatcggactattacgatttcgggcgcgagcaaccgtgccaggacccgcgcggggtcgtgggcatattcgatatctggggcccgggcacgatggtgaccgtgagctcg

SEQ ID NO: 55554 - RNA, 435 nt, synthetic construct
  misc_feature 1..435: note = derived and/or modified sequence opt11 from anti-HIV_cap256-059-044105_VR-Chain
  source 1..435: mol_type = other RNA
caaggacaactggtagaaagcgggggcggagtagtacaaccgggaaggagcctaagcctaagctgcgccgcaagcggattcagcttcaacaactacgcaatggactgggtaaggcaagcgccaggaaaaggactagaatgggtagcagtagtcagcagcgacggaaacaacaaaaactacgcagacagcgtaaaaggaagattcacaataagcagagacaacagcaaaaacacagtatacctacaaatgaacagcctaagagcagaagacacagcaatatactactgcgcaaaagacgtaggagcaaacaaagacgacgaatgggcaacaaactactactacgactggagcgtggcctacccagtgccagacccaagagcagtaataggagcattcgacgtatggggacaagggacaatggtaacagtcagcagc

SEQ ID NO: 55555 - RNA, 432 nt, synthetic construct
  misc_feature 1..432: note = derived and/or modified sequence opt11 from anti-HIV_cap256-059-042100_VR-Chain
  source 1..432: mol_type = other RNA
caagtgcaattggtcgagagcgggggcggggtcgtgcaaccgggcaggagccagcgcctgagctgtgccgcgagccagttcacgttctcgagctatggcatgcactgggtcagacaagcgcccgggaaagggctcgagtgggtggccgcgatctcgttcgcgggcacgaacaagtactatggcgatagcgtgaaagggcgctttaccataagcagggacaatagcaagaacacgctctatctccagatgaatagcttgcgcgcggaagatacagcgctctatcactgtgcaagggacatgcgcgagtacgagtgcgaggaatgggcctcggactattacgatttcgggcgcgatcaaccgtgccaggacccgcgcggggtcgtgggcatattcgatctctggggccagggcacgatggtgaccgtgagctcg

SEQ ID NO: 55556 - RNA, 432 nt, synthetic construct
  misc_feature 1..432: note = derived and/or modified sequence opt11 from anti-HIV_cap256-059-040742_VR-Chain
  source 1..432: mol_type = other RNA
caagtgcaattggtcgagaccgggggcggggtcgggcaaccgggcaagagcttgcgcttgagctgtgccgcgagcgggttcacgttctcgaactttgccatggactgggtcaggcaagcgcccgggaaagggctagagtgggtagcatttatctcgagcgacggcataaacaagaaatatggagacttcgtgaaagggcgctttaccataagcagggacaatagcaagaacacgctctttctccagatgaatagcttgcgcgcggaagataccgcgctctattactgtgccaaggacgtgggcgattacaagagcgatgaatggggcacggactattacgatctctcgatcgagtacccgatccaggacccgcgcgcggtcgtgggcgcgttcgataactggggccagggcacgatggtgatcgtgagctcg

SEQ ID NO: 55557 - RNA, 432 nt, synthetic construct
  misc_feature 1..432: note = derived and/or modified sequence opt11 from anti-HIV_cap256-059-040554_VR-Chain
  source 1..432: mol_type = other RNA
caagtgcaattggtcgagagcgggggcggagtagtacaaccgggcaggagcttgcgattgagctgtgccgcgagccagttcacgttctcgagctatggcatgcactgggtcaggcaagcgcccgggaaagggctagagtgggtggccgggatctcgttcgcggccacgaacaagtactatggcgggagtgtgaaagggcgctttaccataagcagggacaatagcaagaacacgctctatctccagatgaatagcctgcgcgcggaagataccgcgctctattactgtaccagggacatgcgcgagtacgagtgcgaggaatgggcctcggactattacgatttcgggaaagatcaaccgtgccaggacccgcgcggggtcgtgggcacgctcgatatctggggccagggcacgatggtgaccgtgagctcg

SEQ ID NO: 55558 - RNA, 432 nt, synthetic construct
  misc_feature 1..432: note = derived and/or modified sequence opt11 from anti-HIV_cap256-059-039660_VR-Chain
  source 1..432: mol_type = other RNA
caagtgcaactggtcgagagcgggggcggggtcgtgcaaccgggcaggagcttgcgcttgagctgtgccgcgagccagttctcgttctcgaactatggcatgcactgggtcaggcaagcgcccggaaaagggctcgagtgggtggcctcgatctcgttcgcgggcacgaaaaagaaatatgccgatagcgtgaaagggcgatttaccataagcagggacaatagcaagaacacgctctttctccagatgaatagcctgcgcacggaagatgccgcgctctattactgtgccaaggacatgcgcgagttcgagtgcgaggaatgggcctcggactattacgatttcgggcgcgagcaaccgtgccaggacacgcgcgatgtcgtgggcatattcgacatctggggccagggcacgatggtgaccgtgagctcg

SEQ ID NO: 55559 - RNA, 435 nt, synthetic construct
  misc_feature 1..435: note = derived and/or modified sequence opt11 from anti-HIV_cap256-059-039298_VR-Chain
  source 1..435: mol_type = other RNA
caggtccagctcgtggaatcgggcgggggcgtggtccagcccgggcgctcgctaagactctcgtgcgcggcctcgggctttacctttagcaagtacgggatgcattgggtgcgccaggccccgggcaagggcttggaatgggtcgcgttcgtggcctttgacgagagcgataaatattacgcggcctcggccaagggcaggttcataatctcgcgcgataacagcaaaaataccctgtcactgcaaatgaactcgctcagaaccgaggacacggccgtgtactattgcgcgaaagaggtcggggacaataaagatgacgagtggacgagcccgtactattacgatatctcgatcgcgtacccggtacaggacccgcgcgcggtcgtgggcgggtacgacgtctggggccagggcacgatggtgaccgtgagctcg

SEQ ID NO: 55560 - RNA, 432 nt, synthetic construct
  misc_feature 1..432: note = derived and/or modified sequence opt11 from anti-HIV_cap256-059-037873_VR-Chain
  source 1..432: mol_type = other RNA
caagtgcaattggtcgagagcgggggcggggtcgtgcaaccgggcaggagcctgcgcttgagctgtgccgcgagccagttcacgttctcaaactatggcatgcactgggtcaggcaagcgcccgggaaagggctcgagtgggtggccgcgatctcgttcgcaggcataaacaagtactatgccgatagcgtgaaagggcgatttaccttgagcagagacaataccaagaacacactctatctccagatgaatagcctgcgcgcggaagataccgcgctctattactgtgccagggacttgcgcgagtacgagtgcgaggaatgggcctcagactattacgatttcgggcgcccgcaaccgtgccaggacccgcgcggggtcgtgggcacgagcgatatctggggccagggcacgatggtgaccgtgagctcg

SEQ ID NO: 55561 - RNA, 432 nt, synthetic construct
  misc_feature 1..432: note = derived and/or modified sequence opt11 from anti-HIV_cap256-059-037633_VR-Chain
  source 1..432: mol_type = other RNA
caagtgcaattggtcgagagcgggggcggggtcgtgcaaccgggcaggagcttgcgcttaagctgtgccgcgagccagttcacgttctcgaactttggcatgcactgggtcaggcaagcgcccgggaaagggctcgagtgggtggccgcgatctcgttcgcgggcataaacaagaactatgcagatagcgtgaaagggcgctttaccataagcagggacaatagcaagaacacgctccatctccagctcaatagcttgcgcgcggaagataccgcgctctattactgtgccaaggacttgcgcgagtacgagtgcgaggaatgggcctcagactattacgatttcgggcgcgatcaaccgtgccaggacccgcgcggggtcgtgggcacgttcgatatctggggccagggcacgatggtgaccgtgagctcg

SEQ ID NO: 55562 - RNA, 432 nt, synthetic construct
  misc_feature 1..432: note = derived and/or modified sequence opt11 from anti-HIV_cap256-059-036817_VR-Chain
  source 1..432: mol_type = other RNA
caagtgcaattgctcgagagcgggggcggagtcgtgcaaccgggcaggagcttgcgcttgagctgtgaagcgagccagttcacgttctcgaactttggcatgcactgggtcaggcaagcgcccgggaaagggctcgagtgggtggccgcgatctcgttcgcgggcatcaaaaagaactacgccgatagcgtgaaagggcgctttaccataagcagggacaatagcaagaacacgctctatctccagatgaatagcttgcgcgtggaagataccgcgctctattactgtgccaaggacttgcgcgagtacgagtgcgaggaatgggcatcggactattacgatttcgggcgcgagcaaccgtgccaggacccacgcggggtcataggcacgttcgatatatggggccagggcacgatggtgaccgtaagctcg

SEQ ID NO: 55563 - RNA, 432 nt, synthetic construct
  misc_feature 1..432: note = derived and/or modified sequence opt11 from anti-HIV_cap256-059-032787_VR-Chain
  source 1..432: mol_type = other RNA
caagtgcaattggtcgagagcgggggcggagtcgtgcaaccgggcaggagcttgcgattgagctgtgccgcgagcgggttcacgttctcaaaatatgccatgcactgggtcaggcaagcgcccgggaaaggactcgagtgggtggcctttgtcgcattcgatgaatcggacaagtactatgtcgatagcgtgaaagggcgctttaccataagcagggacaatagcaagaacacgctctcactccagatgaatagcctgcgcgcggaagataccgcggtctactactgtgccaaggaagtgcacgtgaacaaggacgatgaatgggcctcggactattacgatctctcgatcgcgtacccgatccaggacccgcgcgcggtcgtgggcgggctcgatatctggggccagggcacgatggtgaccgtgagctcg

SEQ ID NO: 55564 - RNA, 432 nt, synthetic construct
  misc_feature 1..432: note = derived and/or modified sequence opt11 from anti-HIV_cap256-059-032427_VR-Chain
  source 1..432: mol_type = other RNA
caagtgcaattggtagagagcgggggcggggtcgtgcaaccgggcaggagcctgcgcttgagctgtgccgcgagccagttcacgttctcgaactttggcatgcactgggtcaggcaagcgcccgggaaagggctcgagtgggtggccgggatctcgttcccgggcacgaaaaagtactatgccgatagcgtgaaagggcgctttaccataagcagggacaatagcaagaacgcactctatctccagatgaatagcttgcgcgcggaagataccgcgctctattactgtgccagggacctgcgcgagtacgagtgcgaggaatgggcctcggactattacgatttcgggaaaccgcaaccgtgcctggacccgcgcggggtcgtgggcacgttcgatatctggggccagggcacgatggtgaccgtgagctcg

SEQ ID NO: 55565 - RNA, 435 nt, synthetic construct
  misc_feature 1..435: note = derived and/or modified sequence opt11 from anti-HIV_cap256-059-029390_VR-Chain
  source 1..435: mol_type = other RNA
caggtccagctcgtggaatcgggcgggggagtggtccagcccgggcgctcgctaaggctctcgtgcgcggcctcgggctttacctttaaccagcacgggatgcattgggtgcgccaggccccggacaagggcttggaatgggtcgcgttcgtgggctttgacgagagcgagaaatattacgcggactcggtcaagggcaggttcacgatctcgcgcgataactcgaaaaataccttgagcctgcaaatgaactcgctcagacccgaggacacggccgtgtactattgcgcgaaagaggtcggggacaataaagaggacgagtgggcgagcgattactattacgatctctcgaacgcgtacccgatccatgacccgcgcgcggtcgtgggcgggtacgatatctggggccagggcacgatggtaaccgtatgctcg

SEQ ID NO: 55566 - RNA, 435 nt, synthetic construct
  misc_feature 1..435: note = derived and/or modified sequence opt11 from anti-HIV_cap256-059-027877_VR-Chain
  source 1..435: mol_type = other RNA
caggtccagctcgtggaatcgggcgggggcgtggtccagcccgggcgctcgctcaggctctcgtgctcggcctcggcctttagctttagctatttcgcgatggattgggtgcgccaggccccgggcaagggcttggaatgggtagcattcgtgagctcggacgggaacaataaaaattacgcggactcggtcaagggcaggttcacgatctcgcgcgataactcgaaaaataccgtgttcttgcaaatggactcgctcaggcccgaggacacggccgtatactattgcgcgaaagatctcgggggcaataaagatgacgagtggtcgaccaattactattacgatatctcgatcgcggacccggtcccggacccgcgcgcggtcgcgggcgcgttcgatgtctggggccagggcacgatggtgaccgtgagctcg

SEQ ID NO: 55567 - RNA, 435 nt, synthetic construct
  misc_feature 1..435: note = derived and/or modified sequence opt11 from anti-HIV_cap256-059-026640_VR-Chain
  source 1..435: mol_type = other RNA
caggtccagctcgtggaatcgggcgggggcgtggtccagcccgggcgatcgctcaggctctcgtgcgcggcctcgggctttagctttagcaagtacgggatgcattgggtgcgccaggccccgggcaagggcttggaatgggtcgcgttcgtggcctttgacgagagcgaccgatattacgcggcctcggtcaagggcagattcacgatctcacgcgataactcgaaaaataccttgagcctgcaaatgaactcgctcaggaccgaggacacggccatatactattgcgcgaaagaggtcggggacaataaagatgacgagtggacgagcccgtactattacgatatgtcgatcgcgtacccggtccaggacccgcgcgcggtcgtgggcgggtacgatatctggggccagggcacgatggtgaccgtgagctcg

SEQ ID NO: 55568 - RNA, 432 nt, synthetic construct
  misc_feature 1..432: note = derived and/or modified sequence opt11 from anti-HIV_cap256-059-026017_VR-Chain
  source 1..432: mol_type = other RNA
caagtacaactcgtcgaatccggcggcggcgtcgtacaacccggccgctccctacgcctctcctgcgccgcctccggcttcaccttctccacctacgccatgcactgggtccgccaagcccccggcaaaggcctcgaatgggtcgccctcatctcctacgacggcaccaacaaatactacgtcgactccgccaaaggccgcttcaccatctcccgcgacaactccaaaaacaccctctacctccaaatgaactcactcacccccgaagacaccgccgtcttctactgcgccaaagacctcggcggctacaaagacgacgaatggggcaccgaatactacgacatctccgtctcctaccccgtccaagacccccgcgccgtcgccggcgtcttcgacgtctggggccacggcacaatggtcacagtctcctcc

SEQ ID NO: 55569 - RNA, 432 nt, synthetic construct
  misc_feature 1..432: note = derived and/or modified sequence opt11 from anti-HIV_cap256-059-024100_VR-Chain
  source 1..432: mol_type = other RNA
tgccaggtcctggtcgagagcgggggcggagtcgtgcaaccgggcaggagcttgcgcttgagctgtgccgcgagccagttcacgttctcgagctatggaatgcactgggtcaggcaagcgccagggaaagggctcgagtgggtggccgcgatctcgttcgcgggcacgaaaaagtactatgccgatagcgtgaaagggcgctttgccataagcagagacacgagcaagaacgcgctctatctccagatgaataccctgcgcgcggaagataccgcgctctattactgtgccagggacttgcgcgagttcgagtgcgaggaatgggcctcggactattacgatttcgggcgaccgcaaccgtgccaggacccgcgcggggtcgtaggctcattcgatatctggggccagggcacgatggtgaccgtgagcttg

SEQ ID NO: 55570 - RNA, 432 nt, synthetic construct
  misc_feature 1..432: note = derived and/or modified sequence opt11 from anti-HIV_cap256-059-023966_VR-Chain
  source 1..432: mol_type = other RNA
caagtgcaattggtcgagagtgggggcggggtcgtgcaaccgggcaggagcttgcgcttaagctgtgccgcgagccagttctcgttctcgagctatggcatgcactgggtcaggcaagcgcccgggaaagggctcgagtgggtggccgcgatctcgttcgcgggaatcaaaaagcactataccgatagcgtgaaaggacgctttaccataagcagggacaatagcaagaacacgctctatctccagatgaatagcctgcgcgcggaagataccgcgctctattactgtgccaaggacctgcgcgggttcgagtgcgaggaatgggcctcggactattacgatttcgggcgcgatcaaccgtgccaggacccgcgcggggtcgtgggcacgttcgatatatggggccagggcacgctcgtgaccgtgagctcg

SEQ ID NO: 55571 - RNA, 432 nt, synthetic construct
  misc_feature 1..432: note = derived and/or modified sequence opt11 from anti-HIV_cap256-059-020534_VR-Chain
  source 1..432: mol_type = other RNA
caagtgcaattggtcgagagcgggggcggggtcgtgcaaccgggaaggagcttgcgcttgagctgtgccgcgagccagttcacgttctcgaactacggcatgcactgggtcaggcaagcgcccgggaaagggctcgagtgggtggccgggatgtcgttcgcgggaacgaacacgtactatgccgatagcgtgaaagggcgctttacaataagcagggacaatagcaagaacacgctctatctccagatgaatagcctgcgcgcggtcgataccgcgctctattactgtgccagggacatgcgcgagtacgagtgcgaggaatgggcctcggactattacgatttcgggcgcgagtacccgtgccaggacccgcgaggggtcgtgggcatattcgatctctggggccagggcacgatggtgaccgtaagctcg

SEQ ID NO: 55572 - RNA, 435 nt, synthetic construct
  misc_feature 1..435: note = derived and/or modified sequence opt11 from anti-HIV_cap256-059-019513_VR-Chain
  source 1..435: mol_type = other RNA
caagtgcaactggtcgagagcgggggaggggtcgtgcaaccgggcaggagcttgcgactgagctgcgccgcgagcgggttcacgttctcgaacttcgccatgggctgggtcaggcaagcgcccgggaaagggctcgagtgggtggccgtgatctcgagcgacggcacaaacaagaactacggcgacagcgtaaaaggacgcttcaccataagcagggacaacagcaagaacaccctcttcctccagatgaacagcctgcgcgcggaagacacgtcgctctactactgcgccaaggacctgggcgggtacaagaccgacgaatgggccacgaactactactacgacataagcatagcctcacccatacaagaccccagggccgtggtcggggccttcgacatatggggacaagggacaatggtcacagtcacaagc

SEQ ID NO: 55573 - RNA, 432 nt, synthetic construct
  misc_feature 1..432: note = derived and/or modified sequence opt11 from anti-HIV_cap256-059-012963_VR-Chain
  source 1..432: mol_type = other RNA
caagtgcaattggtcgagagcgggggcggggtcgtgcaaccgggcaggagcttgcgcctgagctgtgtcgcgagcgggttctcgttctcgagctatggcatggcctgggtcaggcaagcgccagggaaagggctcgagtgggtgaccgtgatctcgttcgcgggcgtgaaaacgtactatgccgatagcgtgaaagggcgatttaccataagcagggacaatagcaagggcacgctctatctccagatggatggcttgcgcccggaagataccgcgctctattactgtgccaaggacttggccgagcgagagtgcgaggaatgggcctcggactattacgatttcgggcgcgagctcccgtgccaggacccgcgcggggtcgtgggcacgttcgatgtctggggccagggcacgatggtgaccgtgagctcg

SEQ ID NO: 55574 - RNA, 435 nt, synthetic construct
  misc_feature 1..435: note = derived and/or modified sequence opt11 from anti-HIV_cap256-059-010396_VR-Chain
  source 1..435: mol_type = other RNA
caagtccaactcgtcgaatcaggaggcggcgtcgtccaacccggacgctccctccgcctctcctgcgccgcctccggcttctccttcaacaactacgccatgaactgggtccgacaagccccaggcaaaggcctcgaatgggtcgccttcgtctcctccgacggctccaacaaaaactacgccgactccgtcaccggccgcttcaccctctcccgcgacaactccaaaaacaccgtcttcctccaaatgaactccctccgcgtcgaagacaccgccgtctactactgcgccaaagacgtcggcgccaacaaagacgacgaatggaccaccaactactactacgacatctccatcgccgaccccgtccccgaccccagagcagtcatcggcgcattcgacgtctggggccaaggcaccatggtcaccgtctcctca

SEQ ID NO: 55575 - RNA, 432 nt, synthetic construct
  misc_feature 1..432: note = derived and/or modified sequence opt11 from anti-HIV_cap256-059-008136_VR-Chain
  source 1..432: mol_type = other RNA
caagtccaactcgtcgaatccggcggcggcgtcgtccaacccggccgctcactccgcctctcctgcgccgcctccggcttcaccttcaacacctacgccatgcactgggtccgccaagcccccggcaaaggcctcgaatgggtcgcactcatctcctacgacggcaccgaaaaatactacgccgactcagtcaaaggccgattcaccatctcccgagacaactcccgcaacaccctctacctccaaatgaactcactccgcctcgaagacgccgccctctaccaatgcgcaaaagacctcggcggatcaaaatccgacgaatggggcaccgactactacgacatgtccatctcctaccccatccaagacccccgcgccgtcgccggcgtattcgacatctggggccaaggcaccctagtcaccgtctcctcc

SEQ ID NO: 55576 - RNA, 432 nt, synthetic construct
  misc_feature 1..432: note = derived and/or modified sequence opt11 from anti-HIV_cap256-059-006147_VR-Chain
  source 1..432: mol_type = other RNA
caagtgcaagtggtcgagagcgggggcggggtcgtgcaaccgggcaggagcttgcgattgagctgtaccgcgagcgggttcacgttctcgaactttgccatgggctgggtcaggcaagcgcccgggaaagggctcgagtgggtggcctttatctcgagcgatggctcgaacaagaactatggcgatagcgtgaaagggcgctttaccataagcagggacaatagcaagaacacggtctttctccagatgaatagcttgcgcgtggaagataccgcactctattactgtgccaaggacgtgggcgattacaagagcgatgaatggggcacggaatattacgatatctcgatctcgtacccgatccaggacccgcgcgcgatggtgggcgcgttcgatctctggggccagggcacgatggtgaccgtgagcccg

SEQ ID NO: 55577 - RNA, 432 nt, synthetic construct
  misc_feature 1..432: note = derived and/or modified sequence opt11 from anti-HIV_cap256-059-005081_VR-Chain
  source 1..432: mol_type = other RNA
caagtgcaactggtcgagagcgggggcggggtcgtgcaaccgggcaggagcttgcgattgagctgtgccgcgagccagttcacgttctcgagctatggcatgcactgggtcagacaagcgcccgggaaagggctcgagtgggtggccgggatctcgttcgcggcaacgaaaaagtactatagcgagagcgtgaaaggacgctttaccataagcagggacaatagcaagaacgcgctccatctccatatgaatagcttgcgcgcggaagataccgcgctctattactgtgccaaggacttgcgcgagttcgagtgcgaggaatgggcctcggactattacgatttcgggcgcgatcaaccgtgccaggacccgcgcggggtcgtgggcatattcgatatgtggggccagggcacgatggtgaccgtgagctcg

SEQ ID NO: 55578 - RNA, 432 nt, synthetic construct
  misc_feature 1..432: note = derived and/or modified sequence opt11 from anti-HIV_cap256-059-005006_VR-Chain
  source 1..432: mol_type = other RNA
caagcccaactcgtcgaatccggcggcggcgtcgtccaacccgccaaaagcctaagactatcatgcgccgcatccggcttcaccttcaacaaatacgccatgcactgggtccgacaagcccccggcaaaggcctcgaatgggtcgccttcgtcgccttcgacgaatccgacaaatactacgccgactcagtcaaaggccgcttcaccatctcccgagacaactccaaaaacaccctctccctacaaatgaacaacctccgcgccgaagacaccgcagtctactactgcgccaaagaagtcggcgacaacaaagacgacgaatgggcctcagactactacgacctcagcatcgcctaccccatccaagacccccgagccgtcggccgcggctacgacatctggggccaaggaaccatggtcaccgtctcctcc

SEQ ID NO: 55579 - RNA, 432 nt, synthetic construct
  misc_feature 1..432: note = derived and/or modified sequence opt11 from anti-HIV_cap256-059-004451_VR-Chain
  source 1..432: mol_type = other RNA
caagtacacttggtcgagagcggaggcggggtcgtgcaaccgggcaagagcttgcgcttgagctgtaccgcgagcgggttcacgttcacgaactttgccatggactgggtcaggcaagcgcccgggaaagggctcgagtgggtggcctttatctcgagcgatggctcgaacaagtactatagcgagagcgtgaaagggcgctttaccataagcagggacaatagcaagaacacgctctatgtacagatgaatagcttgcgcacggaagataccgcggtctattactgtgccaaggacctgggcgggtacaaggacgatgaatggagcacggactattacgattggtcgaccgcgtacccggtccaggacccgcgcgcggtcgcgggcgcgttcgatctctggggccagggcacgatggtgagcgtgagctcg

SEQ ID NO: 55580 - RNA, 432 nt, synthetic construct
  misc_feature 1..432: note = derived and/or modified sequence opt11 from anti-HIV_cap256-059-003571_VR-Chain
  source 1..432: mol_type = other RNA
caagagcaattggtcgagagcgggggcggggtcgtgcaaccgggcaggagcttgcgcttgagctgtgccgcgagccagttcacgttcggggcctatggcatgcactgggtcaggcaagcgcccgggaaagggctcgagtgggtggccggggtctcgttcgtgggaaataacaagtactatgccgatagcgtgaaagggcgctttaccataagcagggacaacagcaagaacacgctatatctccagatgaatagcttgcgcggggaagataccgcgctctattactgtgccagggacatgcgagagatggagtgcgaggaatgggcctcggactattacgatttcgggagaccgcaaccgtgccaggacccgcgcggggtcgtgggcatattcgatatgtggggccagggcacgatggtgaccgtgagctcg

SEQ ID NO: 55581 - RNA, 432 nt, synthetic construct
  misc_feature 1..432: note = derived and/or modified sequence opt11 from anti-HIV_cap256-059-003449_VR-Chain
  source 1..432: mol_type = other RNA
caagtgcaattggtcgagagcgggggcggagtcgtgcaaccgggcaagagcttgcgcttgagctgtgccgcgagccaggtcacgttctcgagctatggcatgcactgggtcaggcaagcgcccgggaaagggctcgagtgggtggccgggatctcgttcgcgggcacgaaaaagtactatgccgatagcgtgaaagggcgctttaccataagcagggacaatagcaagaacgcgctatatctccagatgaatcgcttgcgagcgggagataccgcgctctattactgtgccaaggacttgcgcgagtacgagtgcgaggaatgggcctcggactattacgatttcgggcgcgagcaaccgtgccaggacccgcgcggggtcgtgggcatattcgatatctggggcttgggcacgatggtgaccgtgagctcg

SEQ ID NO: 55582 - RNA, 432 nt, synthetic construct
  misc_feature 1..432: note = derived and/or modified sequence opt11 from anti-HIV_cap256-059-002712_VR-Chain
  source 1..432: mol_type = other RNA
caagtgcaattggccgagagcgggggcggggtcgtgcaaccgggaaggagcttgcgcttgagctgtgccgcgagccagttcacgttctcgagctatggcatgcactgggtcaggcaagcgcccgggaaagggctagagtgggtggcagcgatctcgttcgcgggcacgaaaaagcactatgccgatagcgtaaaagggcgctttaccataagcagggacaatagcaagaacacgctcaatctccagatgaatagcttgcgcgcggaagataccgcgctctattactgtgccagggacatgcgcgagtacgagtgcgaggtctgggcctcggactattacgatttcgggcgcgagcaaccgtgccaggacccgcgcggggtcgtgggaacgttcgatatctggggccagggcacgatggtgaccgtgagcccg

SEQ ID NO: 55583 - RNA, 432 nt, synthetic construct
  misc_feature 1..432: note = derived and/or modified sequence opt11 from anti-HIV_cap256-059-001573_VR-Chain
  source 1..432: mol_type = other RNA
caagtgcaattggtcgagagcgggggcggggtagtgcaaccgggcaggagcttgcgcttgagctgtgccgcgagccagttcacgttctcgagctatggcatgcactgggtcaggcaagcgcccgggaaagggctcgagtgggtggccgggatctcgtacgatggaacgagcaagtactatgccgatagcgtgaaagggcgctttaccataagcagagacaatagcaagaacacgctctatctacagatgaatagcttgcgcgcggaagataccgcgctctattactgtgccaaggacttgcgcgaggacgagtgcgaggaatggtggtcggactattacgatttcgggcgcgagctcccgtgcaggaaatcacgcggggtcgcgggaacgttcgatatctggggccatggcacgatggtgaccgtgagctcg

SEQ ID NO: 55584 - RNA, 432 nt, synthetic construct
  misc_feature 1..432: note = derived and/or modified sequence opt11 from anti-HIV_cap256-059-001379_VR-Chain
  source 1..432: mol_type = other RNA
caagtccgcctcgtcgaatccggcggcggcgtcgtccaacccggccgctcactccgcctctcctgcgccgcctctggcttcaccttcaactcctaccccatgcactgggtacgccaagcccccggcaaaggcctcgactgggtagccctcatctcctacgacggcaccaacaaattctacgtcgactccgtcaaaggccgcttcaccatctcacgcgacaactccaaaaacacactctacctccaaatgaactccctcaccgccgaagacaccgccatgtactactgcgccaaagacctcggcggcaacaaagacgacgaatggggaaccgactactacgacatctccgtcgcctaccccatccacgacccccgcgccgtcgccggcatcttcgacgtctggggccacggcaccatggtcaccgtatcctcc

SEQ ID NO: 55585 - RNA, 432 nt, synthetic construct
  misc_feature 1..432: note = derived and/or modified sequence opt11 from anti-HIV_cap256-059-001029_VR-Chain
  source 1..432: mol_type = other RNA
caagagcaattggtccagagcgggggcggggtcgtgcaaccgggcaggagcctgcgcttgagctgtgccccgagccagttcacgttctcggcccatggcatgcactgggtcaggcaagcgcccgggaaagggctcgagtgggtggccgggatctcgttcgcgggcacgaaaaattactatgccgatagcgtgaaagggcgctttaccataagcagggacaatagcaagaacacgctatatctccagatgaatagcctgcgcgtggaagataccgcgctctattactgtgccaaggacatgcgcgagatggagtgcgaggaatgggcctcggactattacgatttcgggcgccatcaaccgtgccaggacccgcgcggggtcgtgggcatattcgatatctggggccagggcacgatggtgaccgtgagctcg

SEQ ID NO: 55586 - RNA, 432 nt, synthetic construct
  misc_feature 1..432: note = derived and/or modified sequence opt11 from anti-HIV_cap256-048-165087_VR-Chain
  source 1..432: mol_type = other RNA
gaagtgaaattgctagagagcgggggcgggctcgtgcaaccgggcgggtacaggcgcttgagctgtgccgcgagcgggttcacgttctcgcgatatgcaatgcactgggccaggcaagcgcccgggaaagggctcgagtgggtggccgtggtctcggacgatggcgtgaaaaagtactatccagatagcgtgcgcgggcgctttaccataagcagggacaatagcagaaacacggtctcgctccagatgaatagcttgcgcccggaagataccgcggtctattactgtgccaaggacgtgggcgcgaacaaggacgatgaatgggccacggactattacgatctctcgatagcgtacccggtcccggacccgcgcgcggtcgtgggcgcgttcgatatctggggacagggcacgatggtgaccgtgagctcg

SEQ ID NO: 55587 - RNA, 432 nt, synthetic construct
  misc_feature 1..432: note = derived and/or modified sequence opt11 from anti-HIV_cap256-048-158861_VR-Chain
  source 1..432: mol_type = other RNA
gaagtgcaattggtcgagagcgggggcgggctcgtgcaaccgggcgggagcttgcgattgagctgtgtcgatttcgggttcaggttctcggaatattggatgagctgggtcaggcaagcgccaggaaaagggctcgagtgggtggccgtgatctcgtacgatggcacgaacaagtactatgccgatagcgtgaaagggcgctttaccataagcagggacaatagcaagaacacgctctatctccagatgaatagcttgcgcgcggaagataccgcgctctattactgtgccaaggacatgcgcgagagcgagtgcgaggaatgggcctcggactattacgatttcgggaaagattacccgtgccaggacccgcgcggggtcgtgggcacgttcgatatctggggccagggcacgatggtgaccgtgagctcg

SEQ ID NO: 55588 - RNA, 435 nt, synthetic construct
  misc_feature 1..435: note = derived and/or modified sequence opt11 from anti-HIV_cap256-048-158280_VR-Chain
  source 1..435: mol_type = other RNA
caagtgcacctagtcgagagcgggggcggagtcgtgcaaccgggcaggagcctacgcatatactgcgccgtgagcgagttcacgttcaggaactacgccatgcactgggtcaggctcgcacccgggaaagggctccagtgggtggccgtgatctcgcacgacggcataaacgactactacgccgacagcgtgaaagggcgattcacaataagcagggacaacagcaagaacacggtctcgctccagatgaacagcctgcgcccggaagacaccgcggtctactactgcgccaaggacctgggcgcgaacaaggacgacgaatgggccacggactactacgacctctcgatcgcgtacccagtaccggacccaaccgggccctggttcggggccttcgacatatgggggcaaggaaccatggtcacggtctcgagc

SEQ ID NO: 55589 - RNA, 432 nt, synthetic construct
  misc_feature 1..432: note = derived and/or modified sequence opt11 from anti-HIV_cap256-048-157928_VR-Chain
  source 1..432: mol_type = other RNA
caagtgcaattgatggagagcgggggcggggtcgtgcaaccgggcaggagcctgcgattgagctgtgccataagcgggttcacgttctcgaactattggatgagctgggtcaggcaagcgcccgggaaagggctcgagtgggtggccgtgatctcgagcgatggctcgagcaagaactatgccgatagcgtgaaagggcgctttaccataagcagggacaatagcaagaacacggtctcgctacagatgaatagcttgcgcccggaagataccgcggtctattactgtgccaaggacgtgggcgcgaacaaggacgatgaatgggccacggactattacgatctctcgatcgcgtacccggtcccggacccgcgcgcggtcgtgggcgcgttcgatatctggggccagggcacgatggtgaccgtgagctcg

SEQ ID NO: 55590 - RNA, 432 nt, synthetic construct
  misc_feature 1..432: note = derived and/or modified sequence opt11 from anti-HIV_cap256-048-157056_VR-Chain
  source 1..432: mol_type = other RNA
caagtccaactcgtcgaatccggcggcggcgtcgtccaacccggccgctccctccgcctatcctgcgccgcatccggcttcaccctctcctcctacgccatgcactgggtccgccaagccccaggcaaaggcctcgaatgggtagccttcatctccaacgacggctccaacaaatacttcgccgactcagtcaaaggccgattcaccatctcacgcgacaactccaaaaacaccctatacctccaaatgaactccctccgcgccgaagacaccgccgtctactactgcgccaaagacctcggaggcaacaaagacgacgaatgggccaccgactactacgacctctccatcgcctaccccgtccaagacccccgcgtagtcgtcggcatcttcgacatctggggccaaggcaccatggtcacagtctccagc

SEQ ID NO: 55591 - RNA, 432 nt, synthetic construct
  misc_feature 1..432: note = derived and/or modified sequence opt11 from anti-HIV_cap256-048-156422_VR-Chain
  source 1..432: mol_type = other RNA
caagtgcaattggtcgagagcgggggcacggtcgtgcaaccgggaaggagcttgcgcttgagctgtgtcgggagcgggttctcgctctcgtactatgccatacactgggtcaggcaagcgcccgggaaagggctcgagtgggtggccgtgatctcgtacgatggctcgaactattactatgccgatagcgtgaaagggcgctttacaataagcagggacaatagcaagaacacggtctatctccagatgaatagcttgcgcggggtcgataccgcggtctattactgtgccaaggacctgggcgggggcgaggtcgaggaatgggccacggactattacgattggtcgatcgcgtacccggtagagcacccgcgcgcggtcgtgggcgtgttcgatatctggggccagggcacgaaagtgaccgtgagctcg

SEQ ID NO: 55592 - RNA, 432 nt, synthetic construct
  misc_feature 1..432: note = derived and/or modified sequence opt11 from anti-HIV_cap256-048-152863_VR-Chain
  source 1..432: mol_type = other RNA
gaagtgcaactgctcgagagcgggggcgggctcgtgcaaccgggcgggagcttgcgcttgagctgtgccgggagcgggttcacgttctcaaaacatggcatgcactgggtcaggcaagcgcccgggaaagggctcgagtgggtggcctttgtcgcgttcgatgaatcggacaagtactatgccgatagcgtgaaagggcgctttaccataagcagggacaatagcaagaacacgctctcgctccagatgaatagcctgcgcgcggaagataccgcgatgtattactgtgccaaggaagtgggcgataacaaggacgatgaatgggcctcggactattacgatctctcgatcgcgtacccggtccatgacccgcgcgcggtcgtgggcgggtacgatatctggggccagggcacgatggtgaccgtgagctcg

SEQ ID NO: 55593 - RNA, 432 nt, synthetic construct
  misc_feature 1..432: note = derived and/or modified sequence opt11 from anti-HIV_cap256-048-152770_VR-Chain
  source 1..432: mol_type = other RNA
caagtgcaattggtcgagagcgggggcggggtcgtgcaaccaggcaggagcttgcgattgagctgtgccgcgagcgggttcacgttcaggagcaatgcaatgcactgggtcaggcaagcgcccgggaaagggctcgagtgggtggccgtgatctcatacgatggctcgaaaacatactatgccgatagcgtgaaagggcgctttaccataagcagggacaatagcaagaacacgctctacctccagatgaatagcttgagagcggaagataccgcggtctattactgtgccaaggacttgggcgagtacaagagcgatgaatgggccacggactattacgatctctcgatcgcgtacccggtccaggacccgcgaggggtcgcgggcgcgttcgatatctggggccagggcacgatggtgaccgtgagctcg

SEQ ID NO: 55594 - RNA, 432 nt, synthetic construct
  misc_feature 1..432: note = derived and/or modified sequence opt11 from anti-HIV_cap256-048-150027_VR-Chain
  source 1..432: mol_type = other RNA
gaagtgcaattggtcgagagcgggggcgggctcgtgcaaccgggcgggagcttgcgcttgagctgtgccgtgagcgggttcacgttctcgagctatatcatgcactgggtcaggcaagcgcccgggaaagggctagagtgggtggccgtgatctcatacgatggctcgaacaaggactatgccgatagcgtgaaagggcgctttacaataagcagggacaatagcaagaacacgctatatctacagatgaatagcttgcgcgcggaagataccgcgctctattactgtgccaaggacttgcgcgagtacgagtgcgaggaatgggcctcggactattacgatttcgggcgagattacccgtgccaggacccgcgcggggtcgtgggcacgttcgatatatggggccagggcacgatggtgaccgtgagctcg

SEQ ID NO: 55595 - RNA, 432 nt, synthetic construct
  misc_feature 1..432: note = derived and/or modified sequence opt11 from anti-HIV_cap256-048-148246_VR-Chain
  source 1..432: mol_type = other RNA
caagtgcaattggtcgagagcgggggcggggtcgtgcaaccgggcaggagcttgcgattgagctgtgccacgagcggattcacgttctcaacctatagcatgcactgggtcaggcaagcgcccgggaaaggactcgagtgggtggcagtgatctcgtacgatggctcgaacgagtactatgtcgatagcgtgaaagggcgctttacaataagcagggacaatagcaagaacacgctctatctccagatgaatagcttgcgcgtggaagatacagcgctatattactgtgccaaggacttgggcgggaacaaggacgatgaatggggcacggactattacgatttctcggtcgcgtacccggtccaggacccgcgcgcggtctcgggcatattcgatgtctggggccatggcacgatggtgaccgtgagctcg

SEQ ID NO: 55596 - RNA, 432 nt, synthetic construct
  misc_feature 1..432: note = derived and/or modified sequence opt11 from anti-HIV_cap256-048-147428_VR-Chain
  source 1..432: mol_type = other RNA
caagtgcaattggtcgagagcgggggaggggtcgtgcaaccgggcaggagcttgcgcttgagctgtagcgcgagcgggttcacgttctcgaactatggcatgcactgggtcaggcaagcgcccgggaaagggctcgagtgggtggccgtgatctcgttcgatggctcaaacaaggtctatgccgatagcgtgaaagggcgctttaccataagcagggacaatagcaagaacacactctatctcgagatgaatagcttgcgcgcggaagatacagcggaatattactgtgccaaggacttgggcgagagcgataaagaggaatggccctcggactattacgatttcgggcgcgatttcacgggccaggtcccgcgcgcggtcgtgggcatattcgatatgtggggccagggcacgatggtgaccgtgagctcg

SEQ ID NO: 55597 - RNA, 432 nt, synthetic construct
  misc_feature 1..432: note = derived and/or modified sequence opt11 from anti-HIV_cap256-048-146603_VR-Chain
  source 1..432: mol_type = other RNA
gaagtgcaattggtagagagcgggggcgggctcgtgcaaccgggcaggagcttgcgcctgagctgtgccgcgagcgggttcacgttcgatgactatgccatacactgggtcaggcaagcgcccgggaaagggctcgagtgggtggccttgatctcgtacgatggcacggacaagtactatgccgatagcgtgaaagggcgctttaccataagcagggacaatagcaagaacacgctatatctacagatgaatagcttgcgcgtggaagataccgcggtctatcactgtgccaaggacttgggcgggaccaagagcgatgaatgggccacggactattacgatctctcgatcgcgtacccgatccaggacccgggcgcggtcgtgggcgtgttcgacatctggggccagggcacgatggtgaccgtgagctcg

SEQ ID NO: 55598 - RNA, 432 nt, synthetic construct
  misc_feature 1..432: note = derived and/or modified sequence opt11 from anti-HIV_cap256-048-145735_VR-Chain
  source 1..432: mol_type = other RNA
caagtgcaattggtccagagcgggggcggggtcgtgcaaccgggcaggagcttgcgcttgagctgtggagcgagcgggttcacgttctcgaactatgccatgcactgggtcaggcaagcgcccgggaaagggctagattgggtggccgtgatctcgtacgatggcacgaacgagaaccatgccgatagcgtgaaagggcgctttaccataagcagagacaatagcaagaacacggtctatctacagatgaatagcttgcgcgcggaagataccgcggtctattactgtgccaaggacgtgggcgggagcaaggacgatgaatgggccacggactattacgatctctcgatcgcgtacccggtcccggacccgcgagcggtcgtgggcgcgttcgatatctggggccaaggcacgatggtgaccgtgagctcg

SEQ ID NO: 55599 - RNA, 432 nt, synthetic construct
  misc_feature 1..432: note = derived and/or modified sequence opt11 from anti-HIV_cap256-048-145116_VR-Chain
  source 1..432: mol_type = other RNA
caagtgcacttggtcgagagcgggggcggggtcgtgcaaccgggcgggagcttgcgactgagctgtgccgcgagcgggttcacgttctcgaactatggcatgcactgggtcaggcaagcgcccgggaaagggctcgagtgggtggccgcgatctcgttcgcgggcacgaacaagtactatgccgatagcgtgaaagggcgctttaccataagcagggacaatagcaagaacgcgctatatctccagatgaatagcttgcgcgcggaagataccgcgctctattactgtgccaaggacttgcgcgagagcgagtgcgaggaatgggcctcggactattacgatttcgggcgcgattacccgtgccaggacccgcgaggggtcgtgggaacgctagatatctggggccagggcacgatggtgaccgtgagctcg

SEQ ID NO: 55600 - RNA, 432 nt, synthetic construct
  misc_feature 1..432: note = derived and/or modified sequence opt11 from anti-HIV_cap256-048-144077_VR-Chain
  source 1..432: mol_type = other RNA
caagtgaaattagtcgagagcgggggcggggtcgtgcaaccgggcaggagcttgcgcttgagctgtgccgcgagcgggttcacgctctcaagctacgccatgcactgggtcaggcaagcgcccgggaaagggctagagtgggtggccgtgatctcgtacgatggctcaaacaggtacacggccgatagcgtgaaagggcgctttaccataagcagggacaatagcaagaacacgctcaatctccagatgaatagcctgcgcccggaagataccgcggtctattactgtgcaaaggacgtgggcgcgaacaaggacgatgaatgggccacggactattacgatctctcgatcgcgtacccggtcccggacccgcgagcggtcgtgggcgcgttcgatatctggggccagggcacgacagtgaccgtgagctcg

SEQ ID NO: 55601 - RNA, 432 nt, synthetic construct
  misc_feature 1..432: note = derived and/or modified sequence opt11 from anti-HIV_cap256-048-142876_VR-Chain
  source 1..432: mol_type = other RNA
caagtgcaattggtcgagagcgggggcggggtcgtgcaaccgggcgggagcttgcgcttgagctgtgtcgcgagcgggttcacgttctcaacctatggcatgcactgggtcaggcaagcgcccgggaaagggctcgagtgggtggcctttatgaggttcgatggctcgaacaggtactatggagatagcgtgaaagggagatttaccataagcagggacaatagcaagaacacgctctatctccagatgatcagcttgcgcgcggaagataccgcggtctatcactgtgccaaggacttgggcgggaacaagcccgatgaatgggccacggactattacgatctctcgatagcgtacccggtccaggacccgcgagcagtcgtgggcgtgttcgatatctggggccagggcacgatcataaccgtgagctca

SEQ ID NO: 55602 - RNA, 432 nt, synthetic construct
  misc_feature 1..432: note = derived and/or modified sequence opt11 from anti-HIV_cap256-048-140582_VR-Chain
  source 1..432: mol_type = other RNA
caagtgcaattggtcgagagcgggggcggggtcgtgcaaccgggcaggagcttgcgcctgagctgtgccgcgagcgggttctcgttctcgaactacgccatggactgggtcaggcaagcgcccgggaaagggctcgagtgggtggcctttgtctcgagcgatggctcgaacaagaactatgccgatagcgtgaaagggcgctttaccataagcagggacaatagcaagaacacggtctatctacagatgaatagcctgagagtggaagataccgcggtctattactgtgccaaggacttgggcgcgaacaaggacgatgaatgggccacggactattacgatctatcggtcgcgtacccggtcccggacccgcgcgcggtcgtgggcgcgttcgatgtctggggccagggcacgatggtgaccgtgagctca

SEQ ID NO: 55603 - RNA, 432 nt, synthetic construct
  misc_feature 1..432: note = derived and/or modified sequence opt11 from anti-HIV_cap256-048-139355_VR-Chain
  source 1..432: mol_type = other RNA
caagtgcaattggtagagagcgggggcggggtcgtgcaaccgggcaggagcttgcgcttgagctgtgccgcgagcgggttcacgttctcgagctatgccatgcactgggtcaggcaagcgcccgggaaagggctcgagtgggtggccataatctcgtacgatggctcgaacaagtactatgccgatagcgtgaaagggcgctttaccataagcagggacaatagcaagggcacgctctatcttcagatggatggcccgcgcccggaagataccgcgctctattactgtgccaaggacttgggcgagcgcgagtgcgaggaatgggcctcggactattacgatttcgggcgcgatttcccgtgccaggacccgcgcggggtcgtgggcacattcgatatctggggccagggcacgatggtgaccgtgagctcg

SEQ ID NO: 55604 - RNA, 432 nt, synthetic construct
  misc_feature 1..432: note = derived and/or modified sequence opt11 from anti-HIV_cap256-048-139151_VR-Chain
  source 1..432: mol_type = other RNA
caagtgcaactggtcgagagcgggggcggggtcgtgcaaccgggcaagagcttgcgcttaagctgtgccgcgagcgggttcacgttcaatacctatggcatgcactgggtcagacaagcgcccgggaaagggctcgagtgggtggccgtaatctcgtacgatggctcgatccagaaatatgccgatagcgtgaaagggcgctttaccataagcagggacaatagcaagaacacgctctatctccagatgaatagcttgagcgtggaagacaccgcggtctattactgtgccaaggacctgggcaagaacaaggacgatgaatgggccacggactattacgatatctcgatcgcatacccggtcccggacccgcgcgcggtcgtgggcgtgttcgatatctggggccagggcacggtcgtgaccgtgagctcg

SEQ ID NO: 55605 - RNA, 432 nt, synthetic construct
  misc_feature 1..432: note = derived and/or modified sequence opt11 from anti-HIV_cap256-048-137672_VR-Chain
  source 1..432: mol_type = other RNA
gaagtgcaattggtagagagcgggggcggggtcgcgcgcccgggcgggagcctgcgcttgagctgtgccgcgagcgggttcatattcacgcactatgccatggactgggtcaggcaagcgcccgggaaagggctcgagtgggtggccgtgatctcgagcgatggctcgagcaagaactatgccgatagcgtaaaagggcgatttaccataagcagggacaatagcaagaacacggtctcgctccagatgaatagcttgcgcccggaagataccgcggtctattactgtgccaaggacgtgggcgcgaacaaggacgatgaatgggccacggactattacgatctctcgatcgcgtacccggtcccggacccgcgcgcggtcgtgggcgcgttcgatatctggggccagggcacgatggtgaccgtgagctcg

SEQ ID NO: 55606 - RNA, 432 nt, synthetic construct
  misc_feature 1..432: note = derived and/or modified sequence opt11 from anti-HIV_cap256-048-137506_VR-Chain
  source 1..432: mol_type = other RNA
caagtgcgcttggtcgatagcgggggcggggtcgtgcaaccgggcgggagcttgcgcttgagctgtgccgcgagcgggttcacgttctcgacctatggcatgcactgggtcaggcaagcgcccgggaaagggctcgagtgggtggcctttatcaggagcgatggctcgaacaagtactatgccgatagcgtgcaagggcgctttagcataagcagggacaatagcaagaacacgctctatctccagatgaatagcttgcgagcggaagataccgcggtctattactgtgccaaggacttgggcgagagcgataaagaggaatggccctcggactattacgatttcgggcgcgatttcacgggccaggacccgcgcgcggtcgtgggcgtgttcgatatctggggccagggcacgaccgtgatcgtgagctcg

SEQ ID NO: 55607 - RNA, 432 nt, synthetic construct
  misc_feature 1..432: note = derived and/or modified sequence opt11 from anti-HIV_cap256-048-137270_VR-Chain
  source 1..432: mol_type = other RNA
caagtgcaactggtagagagcgggggcggggtcgtgcaaccgggcaggagcctacgcttgagctgtgccgcgagcgggttcacgttctcgagctatgccatgcactgggtcagacaagcgcccgggaaaggactcgagtgggtggccgtgatgtcgccagatggctcgaacagatactataccgatagcgtgaaagggcgatttaccataagcagggacaatagcaagaacacgctctcgctccagatgaatagcttgcgcccggaagataccgcggtctattactgtgccaaggacgtgggcgcgaacaaggacgacgaatgggccacggactattacgatctctcgatcgcgtacccggtcccagacccgcgcgcggtcgtgggcgcgttcgatatctggggccagggcacgatggtgaccgtaagctcg

SEQ ID NO: 55608 - RNA, 432 nt, synthetic construct
  misc_feature 1..432: note = derived and/or modified sequence opt11 from anti-HIV_cap256-048-135447_VR-Chain
  source 1..432: mol_type = other RNA
gaagtgcagctagtcgagagcgggggcgcggtagtgcaaccgggcaggagcttgcgcttgagctgtaccgcgagcgggttctcgttcacgagctataccatacactgggtcaggcaagcgcccgggaaagggctcgagtgggtggcctttatctcgtacgatggcacggaaaagaaatataccgatagcgtgaaagggcgctttaccataagcagggacaatagcaagaacacgctctcgctccaaatgaatagcttgcgcccggaagataccgcggtctattactgtgccaaggacttgggcgcgagcaaggacgatgaatgggccacggactattacgatttctcgatcgcgtacccggtccaggacccgcgcgcggtcgtgggcgcgttcgatatctggggccagggcacgatggtgaccgtgagctcg

SEQ ID NO: 55609 - RNA, 432 nt, synthetic construct
  misc_feature 1..432: note = derived and/or modified sequence opt11 from anti-HIV_cap256-048-131966_VR-Chain
  source 1..432: mol_type = other RNA
caagagcaattggtcgagagcgggggcggggtcgtgcaaccgggcaggagcttgcgcttgagctgtgccgcgagcgggttcacgttctcgaactatgccatgcactgggtcaggcaagcgcccgggaaagggctagagtgggtggccgcgatgtcgcacgatggctcggacaagtactatgccgatagcgtgaaagggcgctttaccataagcagggacaatagcaagaacacgctctatatgcagatgaatagcttgcgcgcggaagataccgcggtctattactgtgccaaggaccagggcgagagcgagaaagaggaatgggcctcggactattacgatttcgggcgcgattacccgggacaggacccgcgcagggtcgtggccacgttcgcgatctggggccagggcacgatggtgaccgtgagctcg

SEQ ID NO: 55610 - RNA, 432 nt, synthetic construct
  misc_feature 1..432: note = derived and/or modified sequence opt11 from anti-HIV_cap256-048-131008_VR-Chain
  source 1..432: mol_type = other RNA
gaagtgcgcttggtcgagagcgggggcgggctcgtgaaaccgggcgggagcttgcgcttgagctgtgccgcgagcgggttcacggtctcgagcaattacatgagctgggtcaggcaagcgcccgggaaagggctcgagtgggtggccgcgatctcgttcgcgggcacgaacaagtactatgccgatagcgtgaaagggcgatttaccataagcagggacaatagcaagaacgcgctctatctccagatgaatagcttgcgcgcggaagataccgcgctctattactgtgccaaggacctgcgcgagagcgagtgcgaggaatgggcctcggactattacgatttcgggcgcgattacccgtgccaggacccgcgcggagtcgtgggcacgctcgatatctggggccagggcacgatggtgaccgtgagctcg

SEQ ID NO: 55611 - RNA, 432 nt, synthetic construct
  misc_feature 1..432: note = derived and/or modified sequence opt11 from anti-HIV_cap256-048-129369_VR-Chain
  source 1..432: mol_type = other RNA
caagtgcaattggtcgagagcgggggcggggtcgtgcaaccgggaaggagcttgcgcttgagctgtgccgcgagcgggttcacgttctcgaactatgtcatgcactgggtcagacaagcgcccgggaaagggctcgagtgggtggccttggtctcgttcgatggctcgaacaagtactatgccgatagcgtgaaagggcgctttaccataagcagggacaatagcaagaacacggtctatctccagatgaatagcttgcgcggggtcgataccgcggtctattactgtgccaaggacttgggcgggggcgaggtcgaggaatgggccacggactattacgattggtcgatcgcgtacccggtcgagcacccgcgcgcggtcgtgggcgtgttcgatatctggggccagggcacgaaagtgaccgtgagctcg

SEQ ID NO: 55612 - RNA, 432 nt, synthetic construct
  misc_feature 1..432: note = derived and/or modified sequence opt11 from anti-HIV_cap256-048-128476_VR-Chain
  source 1..432: mol_type = other RNA
gaagtgcaagtgctcgagagcgggggcgggctcgtgcaaccgggcgggagcctgcgcctggcctgtgccgcgagcgggttctcgttctcgagctatggcatgcactgggtcaggcaagcgcccgggaaagggctcgagtgggtgagctttatcaggtacgatggcgcaaacaagtaccatgccgatagcgtgaaagggcgctttatcataagcagggacgatagcaagaacacggtctcgctacagatgaatagcttgcgcccggaagataccgcggtctattactgtgccaaggacttgggcgcgaacaaggacgatgaatgggccacggactattacgatctctcgatcgcgtacccggtcccggacccgcgcgcggtcgtgggcgcgttcgatatctggggccagggcacgatggtgaccgtgagctcg

SEQ ID NO: 55613 - RNA, 432 nt, synthetic construct
  misc_feature 1..432: note = derived and/or modified sequence opt11 from anti-HIV_cap256-048-128270_VR-Chain
  source 1..432: mol_type = other RNA
caagtccaactcgtcgaatccggcggcggcgtcgtccaacccggccgatccctccgcctctcatgcacagcctccggcttcaccttccgctcctacgccatgcactgggtccgccaagcccccggcaaaggcctagaatgggtcgccctaatctcatacgacggctccaacaaatactacgccgactccgtcaaaggccgcttcaccatctcccgcgacaactcaaaaaacaccctctacctacaaatgaactccctcacatccgaagacaccgccgtctactactgcgccaaagacctcggcggctccaaaaccgacgaatggggcaccgactactacgaattctggaacgcctaccccgtccaagacccccgcgtcgtcgtcggcgccttcgacatctggggccacggcaccatggtaaccgtctcctca

SEQ ID NO: 55614 - RNA, 432 nt, synthetic construct
  misc_feature 1..432: note = derived and/or modified sequence opt11 from anti-HIV_cap256-048-126220_VR-Chain
  source 1..432: mol_type = other RNA
caagtgcaattggtagagagcgggggcggggtcgtgcaaccaggcaggagcctgcgcctgagctgtgccgcgagcgggttcatattctcgccctatggcatacactgggtaaggcaagcgcccggaaaagggctcgagtgggtagccctgatctcacacgatggcagcaaaaagtactacgccgattcagtgaaagggcgctttaccataagcagagacaatttcaaggacacgctatatctacagatgaatagcttgcgcggggtcgataccgcggtctattactgtgccaaggacctgggcgggggcgaggtcgaggaatgggccacagactattacgattggtcgaccgcgtacccggtcgagcacccgcgcgcggtcgtgggcgtgttcgatatctggggccagggaacgaaagtgaccgtgagctcg

SEQ ID NO: 55615 - RNA, 432 nt, synthetic construct
  misc_feature 1..432: note = derived and/or modified sequence opt11 from anti-HIV_cap256-048-125713_VR-Chain
  source 1..432: mol_type = other RNA
gaagtgcaattggtcgagagcgggggcgggctcgtgcaaccgggcgggagcttgcgcctgagctgtgaagcgagcgggttctcgttctcgacctatgaattgaactgggtcaggcaagcgcccgggaaagggctcgagtgggtggccgtgatctcgtacgatggctcgaactattactatgccgatagcgtgaaagggcgctttaccataagcagagacaatagcaagaacacgctctatctacagatgaatagcttgcgcgcggaagataccgcggtatattactgtgccaaggacgtgggcgcgaacaaggacgatgaatgggccacggactattacgatctctcgatcgcgtacccggtcccggacccgcgcgcggtcgtgggcgcgttcgatatctggggacagggcacgatggtaaccgtgagctcg

SEQ ID NO: 55616 - RNA, 432 nt, synthetic construct
  misc_feature 1..432: note = derived and/or modified sequence opt11 from anti-HIV_cap256-048-123934_VR-Chain
  source 1..432: mol_type = other RNA
caagtgcaattggtcgagagcgggggcggggtcgtgcaaccgggccgcagcttgagattgagctgtgccgcgagcgggttcacgttctcgagctatggcatggcctgggtcaggcaagcgcccgggaaagggctcgagtgggtgaccgcaatctcgttcgcgggcacgaacaagtactatgccgatagcgtgaaaggacgctttacaataagcagggacaatagcaaggacacgctctatctccagatggatggcttgcgcccggaagataccgcgctctattactgtgccaaggacttgggcgagcgcgagtgcgaggaatgggcctcggactattacgatttcgggcgcgatttcccgggccaggaccagcgcgcggtcgcgggagtgttcgatatgtggggacagggcacgatggtgaccgtgagctcg

SEQ ID NO: 55617 - RNA, 432 nt, synthetic construct
  misc_feature 1..432: note = derived and/or modified sequence opt11 from anti-HIV_cap256-048-122673_VR-Chain
  source 1..432: mol_type = other RNA
gaagtgcaagtggtcgagagcgggggcgggctcgtgaaaccgggcgggagcttgcgcttgagctgtgccgcgagcggattcacgttctcgagccatgtcatgaactgggtcaggcaagcgcccgggaaagggctagagtgggtgagctcgatctcaggcgggagctcgagtaaggactatgccgatagcgtgaaagggcgcttcaccataagcagggacaatagcaagaacacgctctcgctccagatgaatagcctgcgcccggaagataccgcggtctattactgtgccaaggacgtgggcgcgaacaaggacgatgaatgggccacggactattacgatctctcgatcgcgtacccggtcccggacccgcgcgcggtcgtgggcgcgttcgatatctggggccagggcacgatggtgaccgtgagctcg

SEQ ID NO: 55618 - RNA, 432 nt, synthetic construct
  misc_feature 1..432: note = derived and/or modified sequence opt11 from anti-HIV_cap256-048-122208_VR-Chain
  source 1..432: mol_type = other RNA
cgcgtgcaagtggtcgagagcgggggcggggtcgtgaaaccgggcgggagcctgcgcttgagctgtggcgcgagcgggttcacgttctcgaacgcgtggttgagctgggtcaggcaagcgcccgggaaagggctcgagtgggtggccgtgatatcgagcgatggctcgagcaagaactatgccgatagcgtgaaagggcgatttaccataagcagggacaatagcaagaacacggtctcgctccagatgaatagcttgcgcccggaagataccgcggtctattactgtgccaaggacgtgggcgcgaacaaggacgatgaatgggccacggactattacgatctctcgatcgcgtacccggtcccggacccgcgcgcggtcgtgggagcgttcgatatctggggccagggcacgatggtgaccgtgagctcg

SEQ ID NO: 55619 - RNA, 432 nt, synthetic construct
  misc_feature 1..432: note = derived and/or modified sequence opt11 from anti-HIV_cap256-048-121552_VR-Chain
  source 1..432: mol_type = other RNA
caagtgcaattggtcgagagcgggggcggggtcgtgcaaccgggcgggagcttgcgcctgagctgtgccgcgagcgggttcacgttctcgagctatgccatgcactgggtcaggcaagcgccagggaaagggctcaagtgggtggcagatatctcgtacgatgcctcgagcaagtactatgccgatagcgtgaaagggcgctttaccataagcagggacaatagcaagaacacgctatatctcgagatgaatagcttgcgcccggaagataccgcggtctattactgtgccaaggacttgggcgagcgcgagtgcgaggaatgggcctcggactattacgatttcgggcgcgatttcccgtgccaggacccgcgcggggtcgtgggcacgttcgatatctggggccagggcacgatggtgaccgtgagctcg

SEQ ID NO: 55620 - RNA, 432 nt, synthetic construct
  misc_feature 1..432: note = derived and/or modified sequence opt11 from anti-HIV_cap256-048-120643_VR-Chain
  source 1..432: mol_type = other RNA
caagtgcaactggtcgagagcgggggcggggtcgtgcaaccgggcaggagcctgcgattgagctgtgccgcgagcgggttcacgctctcagcctataccatgcactgggtcaggcaagcgcccgggaaagggctcgagtgggtgagcgtgatctcgttcgcgggcaataacaagtactatgccgatagcgtgaaagggcgctttaccataagcagggaaaatagcaagaacatgctatatctccagatgaatagcttgcgcggggaagataccgcggtctattactgtgccaaggacttgcgagagttcgagtgcgaggaatgggcctcagactattacgatttcgggcgcgattacccgtgccaggacccgcgcggggtcgtgggcacgttcgatgtctggggccatggctcgctcgtgaccgtgagttcg

SEQ ID NO: 55621 - RNA, 432 nt, synthetic construct
  misc_feature 1..432: note = derived and/or modified sequence opt11 from anti-HIV_cap256-048-118458_VR-Chain
  source 1..432: mol_type = other RNA
caagtgcaattggtcgagagcgggggcggggtcgtgcaaccgggcaggagcctgcgcttgagctgtgccgcgagcgggttcacgttctcgacctcgggcatgcactgggtcaggcaagcgcccgggaaagggctcgagtgggtggcctttatctcgagcgaccgctcgaacaagttctatgccgatagcgtgaaagggcgctttagcataagcagggacaatagcaagtacacgctctatctccagatgaatagcctgcgcgcggacgataccgcggtctacttctgtgccaaggacttgggcgtgaacaagaacgatgaatgggccacggactattacgatctctcggtcgcgtacccggtccaggacccgcgcggggtcgcgggcatattcgatatctggggccagggcacaatggtgaccgtgagctcg

SEQ ID NO: 55622 - RNA, 432 nt, synthetic construct
  misc_feature 1..432: note = derived and/or modified sequence opt11 from anti-HIV_cap256-048-118112_VR-Chain
  source 1..432: mol_type = other RNA
caagagcaattggtcgagagcgggggcggggtcgtgcaaccgggcaggagcttgcgcctgagctgtgccgcgagccagttcacgttctcgaactatggcatgcactgggtcaggcaagcgcccgggaaagggctcgtatgggtggccgggatctcgttcgcgggcacgaacaagtactatgccgcgagcgtgaaagggcgctttaccataagcagggacaatagcaagaacacgctctatctccagatgaacagcttgcgcgcggaagataccgcgctctattactgtgccaaggacatgcgcgagtacgagtgcgaggaatgggcatcggactattacgatttcgggcgcgattacccgtgccaggacccgcgcggggtcgtgggaacgttcgatatctggggacagggcacgatggtgaccgtgagctca

SEQ ID NO: 55623 - RNA, 432 nt, synthetic construct
  misc_feature 1..432: note = derived and/or modified sequence opt11 from anti-HIV_cap256-048-116469_VR-Chain
  source 1..432: mol_type = other RNA
caagtgcaactggtcgagagcgggggcggggtcgtgcaaccgggcagaagcctgcgcttgagctgtgccgcgagcgggttcacgttctcgagctatgccatgcactgggtcaggcaagcgcccgggaaagggctcgagtgggtggccataatctcgtacgatggctcgaacaagtactatgccgatagcgtgaaagggcgctttaccataagcagggacaatcccaagaacacgctctatctccagatgaatagcttgcgcgcggaagataccgggctctattactgtgccaaggacatgggcgagagcgagaaagaggaatgggcctcggactattacgatttcgggcgcgattacccgggccaggaaccacgcgcgatggtgggcacgttcgatatctggggccagggcacaatggtgaccgtaagctcg

SEQ ID NO: 55624 - RNA, 432 nt, synthetic construct
  misc_feature 1..432: note = derived and/or modified sequence opt11 from anti-HIV_cap256-048-113917_VR-Chain
  source 1..432: mol_type = other RNA
gaagtgcaattggtcgagagcgggggcgggctcgtgcaaccgggcgggagcttgcgcttgagctgtgccgcgagcgggctaacggtctcggacacgtacatgaactggctcaggcaagcgcccgggaaagggctcgagtgggtggccgtggtctcgagcgatggctcgaacaagaactatgccgacagcgtgaaagggcgctttacaataagcagggacaacagcaagaacacggtctatctccagatgaatagcttgcgcgcggaagataccgcggtctattactgtgccaaggacttgggcgcgaacaaggacgatgaatgggccacggactattacgatctctcggtcgcgtacccggtcccggacccgagagcggtcgtgggcgcgttcgacgtctggggccagggaacgatggtgaccgtgagctcg

SEQ ID NO: 55625 - RNA, 432 nt, synthetic construct
  misc_feature 1..432: note = derived and/or modified sequence opt11 from anti-HIV_cap256-048-112368_VR-Chain
  source 1..432: mol_type = other RNA
caagtacaattggtcgagagcgggggcggggtcgtgcaaccgggcaggagcttgcgcttgagctgtgccgcgagcgggttcacgttctcgcgaaatgccatgcactgggtaaggcaagcgcccgggaaagggctcgagtgggtggccgtgatctcgtacgatggctcgaacaagtactatgccgatagcgtgaaagggcgctttaccataagcagggacaatagcaagaacacgctctatctccagatgaatagcttgcgagcggaagataccgcggtctattactgtgccaaggacttgggcgggggcgaggtcgaggaatgggccacggactattacgattggtcgacagcgtacccggtcgagcacccgcgagcggtcgtgggcgtgttcgatatctggggccagggcacgaaagtgaccgtgagctcg

SEQ ID NO: 55626 - RNA, 432 nt, synthetic construct
  misc_feature 1..432: note = derived and/or modified sequence opt11 from anti-HIV_cap256-048-112047_VR-Chain
  source 1..432: mol_type = other RNA
gaagtgcaattggtcgagagcgggggcgggctagtgcaaccgggcgggagcttgcgcttgagctgtgccgcgagcgggctcacggtctcgggctattacatgagctgggtcaggcaagcgccagggaaagggctagagtggttggcctttatccatttcgatggctcgaaaatacactatgcagggagcgtgaaagggcgaataacagtgagcagggacaatagcaagaacacgctcgatctccagatgaatagcttgcgcgcggaagataccgcggtctattactgtgccaaggacgtgggcgatagcaagagcgatgaatgggccacggactattacgatctctcggtcgcgtacccggtcccggacccgcgcgcggtcgtgggcgcgttcgatatctggggccagggcacgatggtgaccgtgagttcg

SEQ ID NO: 55627 - RNA, 432 nt, synthetic construct
  misc_feature 1..432: note = derived and/or modified sequence opt11 from anti-HIV_cap256-048-112029_VR-Chain
  source 1..432: mol_type = other RNA
caagtgcaattggtcgagagcgggggcggggtcgtacaaccgggcaggagcttgcgcttgagctgtgccgcgagccagttcacgttctcgagctatggcatgcactgggtcaggcaagcgcccgggaaagggctcgagtgggtggccgggatctcgttcgcgggcatcaaaaagtactatgccgatagcgtgaaagggcgctttaccataagcagggacaatagcaagaacacgctctatctccagatgaatagcttgcgaggggaagataccgcgctctattactgtgccaaggacttgcgcgagtacgagtgcgaggaatgggcctcggactattacgatttcgggcgcgattacccgtgccaggacccgcgcggggtcgtaggcatattcgatatatggggccagggcacgatggtgaccgtgagctcg

SEQ ID NO: 55628 - RNA, 432 nt, synthetic construct
  misc_feature 1..432: note = derived and/or modified sequence opt11 from anti-HIV_cap256-048-110957_VR-Chain
  source 1..432: mol_type = other RNA
caagtgcgattggtcgagagcgggggaggggtcgtgcgctcgggcaggagcttgcgattgagctgtgccgcgagcgggttcacgttctcgaactttgccttgcactgggtcagacaagcgcccgggaaagggctcgagtgggtggcagtgatctcgtacgatggcaatagcaagttctatgccgatagcgtgaaagggcgctttacaataagcacggacaatagcaagaacacgctctacctccagatgaatagcctgaccgcggaagataccgcggtctattactgtgccaaggacctgggcgggaacaaggacgacgaatggggcacggactattacgatttctcggtcgcgtacccggtccaggacccgcgcgcggtctcgggcatattcgatgtatggggccatggcacaatggtgaccgtgagctcg

SEQ ID NO: 55629 - RNA, 432 nt, synthetic construct
  misc_feature 1..432: note = derived and/or modified sequence opt11 from anti-HIV_cap256-048-110526_VR-Chain
  source 1..432: mol_type = other RNA
caagtgcaattggtcgagagcgggggcggggtcgtgcaaccgggcaggagcctgcgcttgagctgtgcagcgagcgggttcacgttctcgaactttggctttcactgggtcaggcaagcgcccgggaaagggctcgagtgggtggccgcgatctcgttcgcgggcaataacaagtactatgccgatagcgtgaaaggacgctttaccataagcagggaaaatagcaagaacatactctatctccagatgaatagcttgcgcggggaagataccgcggtctattactgtgccaaggacttgcgcgagttcgagtgcgaggaatgggcctcggactattacgattggtcgaccgcgtacccggtcgagcacccgcgcgcggtcgtgggcgtgttcgatatctggggccagggcacgaaagtgaccgtgagctca

SEQ ID NO: 55630 - RNA, 432 nt, synthetic construct
  misc_feature 1..432: note = derived and/or modified sequence opt11 from anti-HIV_cap256-048-109336_VR-Chain
  source 1..432: mol_type = other RNA
gaagtgcaattggtcgagagcgggggcgggctcgtgcaaccgggcgggagccagcgcttgagctgtgccgcgagcgggctaacggtcaatagcaattacatgacctgggtcaggcaagcgcccgggaaagggctcgagtgggtggccataatctcgagcgatggctcgggccagtactatgcagatagcgtgaaaggacgctttaccataagcagggacaatagcaagaacacgctctcgctccagatgaatagcttgcgcccggaagataccgcggtctattactgtgccaaggacttgggcgcgagcaaggacgatgaatgggccacggactattacgatttctcgatcgcgtacccggtccaggacccgcgcgcggtcgtgggcgcgttcgatatctggggccagggcacgatggtgaccgtgagctcg

SEQ ID NO: 55631 - RNA, 432 nt, synthetic construct
  misc_feature 1..432: note = derived and/or modified sequence opt11 from anti-HIV_cap256-048-108152_VR-Chain
  source 1..432: mol_type = other RNA
caagcgcaattggtcgagagcggaggcggggtcgtgcaaccgggaaggagcctggtactgagctcggtcgcgagcgggttctcgttctcgacctatgccatgcactgggtcaggcaagcgcccgggaaagggctagagtgggtggccgtgatctcatacgatggcgggaacaagtactatgccgatagcgtgaaagggcgctttagcataagcagggacaatagcaagaacacggtctatctccagatcaatagcttgcgcgcggaagataccgcggtctattactgtgccaaggacctgggcgcgaacaaggacgatgaatgggccacggactattacgatctctcggtcgcgtacccggtcccggacccgcgcgcggtcgtgggcgcgttcgatgtctggggccagggcacgatggtgaccgtgagctca

SEQ ID NO: 55632 - RNA, 432 nt, synthetic construct
  misc_feature 1..432: note = derived and/or modified sequence opt11 from anti-HIV_cap256-048-107799_VR-Chain
  source 1..432: mol_type = other RNA
gaagtgcaagtagtcgagagcgggggcggggtcgtgcaaccgggcaggagcttgcgcttgagctgtgccgcgagcgggttcacgttctcgaactatgccatggactgggtaaggcaagcgcccgggaaagggctcgagtgggtggcctttgtctcaagcgatggctcgaacaagaactatgccgatagcgtgaaagggcgctttacaataagcagggacaatagcaagaacacgctatcgctccagatgaatagcttgcgcgcggaagataccgcggtctattactgtgccaaggaagtgggcgagaacaaggacgatgaatgggcctcggactattacgatctctcgatcgcgtacccgatccatgacccgcgagcggtcgtgggcgggttcgatatctggggccagggaacgatggtgacagtgagctcg

SEQ ID NO: 55633 - RNA, 432 nt, synthetic construct
  misc_feature 1..432: note = derived and/or modified sequence opt11 from anti-HIV_cap256-048-107384_VR-Chain
  source 1..432: mol_type = other RNA
gaagtgcgcttggtcgagagcgggggcgcgctcgtgaaaccgggcacgagcttgcgcttaagctgtgccgcaagcgggttcacgttcacgcactatgccatggactgggtcaggcaagcgcccgggaaagggctcgagtgggtggcaataatctcgagcgatggctcgaccaagaactatgcagatagcgtgaaagggcgctttaccataagcagggacaatagcaagaacacgctctcgctccagatgaatagcctgcgcccggaagatacagcggtctattactgtgccaaggacgtgggcgcgaacaaggacgatgaatgggccacggactattacgatctctcgatcgcgtacccggtcccggacccgcgagcggtcgtgggcgcgttcgacatctggggccagggcacgatggtgaccgtgagctcg

SEQ ID NO: 55634 - RNA, 432 nt, synthetic construct
  misc_feature 1..432: note = derived and/or modified sequence opt11 from anti-HIV_cap256-048-106530_VR-Chain
  source 1..432: mol_type = other RNA
gaagtgcaattgctagagagcgggggcgggctcgtgcaaccgggcgggagcttgcgcttgagctgtgccgcgagcgggttcacgttctcgagttatgccatggactgggtcaggcaagcgcccgggaaagggctcgagtgggtggcagtgatctcgagcgatggctcaaacaagaactatgccgatagcgtgaaagggcgctttaccataagcagggacaatagcaagaacacgctctatctccagatgtcgagcttgcgcccggaagataccgcggtctattactgtgccaaggacgtgggcgatagcaagagcgatgaatgggccacggactattacgatttctcgatcgcgtacccgatccaggacccgcgcgcggtcgtgggcgcgttcgatatctggggccagggcacgatggtgaccgtgagctcg

SEQ ID NO: 55635 - RNA, 432 nt, synthetic construct
  misc_feature 1..432: note = derived and/or modified sequence opt11 from anti-HIV_cap256-048-106464_VR-Chain
  source 1..432: mol_type = other RNA
gaagtgcaaatggtccagagcgggggcgggctcgtgcaaccgggcgggagcttgcgcttgagctgtgccgcgttcgggttcacgttcacgaaccatgccatggactgggtcaggcaagtgcccgggaaagggctcgagtgggtggcctttatctcgagcgatggctcgaacaagaactatgccgatagcgtgaaagggcgctttaccataagcagggacaatagcaagaacacggtctatctccagatgagctcattgcgcccggaagataccgcggtctattactgtgccaaggacgtgggcgatagcaagagcgatgaatgggccacggactattacgatctctcggtcgcatacccggtcccggacccgagagcggtcgtgggcgcgttcgatatctggggccagggcacgatggtgaccgtgagctcg

SEQ ID NO: 55636 - RNA, 432 nt, synthetic construct
  misc_feature 1..432: note = derived and/or modified sequence opt11 from anti-HIV_cap256-048-106411_VR-Chain
  source 1..432: mol_type = other RNA
caagtgcaattggtcgagagcgggggcggggtcgtgcaaccgggcaggagcttgcgcctgagctgtgccgcgagcgggttcacgttctcgtactcgggcatgcactgggtcaggcaagcgcccgggaaagggatggagtgggtggcagtaatctcgtacgatggctcgaacaagtactatgccgatagcgtgaaagggcgctttaccataagcagggacaacagcaagaacacgctctatctccagatgaatagcttgcgcgtggaagataccgcggtctatcactgtgccaaggacttgggcgggaccaagagcgatgaatgggccacggactattacgatctctcgatcgcgtacccgatccaggacccgggcgcggtcgtgggcgtgttcgatatctggggccagggcacgatggtgaccgtgagctcg

SEQ ID NO: 55637 - RNA, 432 nt, synthetic construct
  misc_feature 1..432: note = derived and/or modified sequence opt11 from anti-HIV_cap256-048-106306_VR-Chain
  source 1..432: mol_type = other RNA
gaagtgcaattggtcgagagcgggggcggactcgtgcaaccgggcgggagcttgcgcttgagctgtgaagcgagcgggttcacgttcaataactatggaatggtctgggtcaggcaagcgcccgggaaagggctcgagtgggtggccataatctcgtacgatggcacggaaaagtactatgtcgatagcgtgaaagggcgctttaccataagcagggacaatagcaagaacacgctctcgctacagatgaatagcttgcgcgcggaagataccgcggtctattactgtgccaaggaagtgggagagaacaaggacgatgaatgggcatcagactattacgatctctcgatcgcgtacccgatccatgacccgcgcgcggtcgtgggcgggttcgatatctggggccagggcacgatggtgaccgtgagctcg

SEQ ID NO: 55638 - RNA, 432 nt, synthetic construct
  misc_feature 1..432: note = derived and/or modified sequence opt11 from anti-HIV_cap256-048-104496_VR-Chain
  source 1..432: mol_type = other RNA
caagtgcaattggtcgagagcgggggcgggctcgtgaaaccgggcgggagcctgcgcttgagctgtgccgcgagcgggttcacgttctcgagctatggcatgcactgggtcaggcaagcgcccgggaaagggctcgagtgggtggcctttgtctcaagcgatggcaataataagaactatgccgatagcgtgaaagggcgctttaccataagcagggacaatagcaagaacacggtctatctccagatgaatagcttgcgcgtggaagataccgcggtctattactgtgccaaggacttgggcgcgaacaaggacgatgaatgggccacggactattacgatctatcggtcgcgtacccggtcccggacccgcgcgcggtcgtgggcgcgttcgatgtctggggccagggcacgatggtgaccgtgagctcg

SEQ ID NO: 55639 - RNA, 432 nt, synthetic construct
  misc_feature 1..432: note = derived and/or modified sequence opt11 from anti-HIV_cap256-048-103074_VR-Chain
  source 1..432: mol_type = other RNA
caagtgcacttggtcgagagcggggccggggtcgtgcaaccgggcgggagcctgcgcttgagctgtgccgtgagcgggttcacgttcaatagctatggcatgcactgggtcaggcaagcgcccgggaaagggctcgagtgggtggccgtgatctcgtacgatggctcggacaagtactatgcagatagcgtgaaagggcgctttaccataagcagggactcgagcaagaacacgctctatctccagatgaatagcttgcgcgtggaagataccgcggtctattactgtgcaaaggacttgggcgcaaacaaggacgatgaatgggccacggactattacgatctctcggtcgcgtacccggtcccggacccgcgcgcggtcgtgggcgcgttcgatgtctggggccagggcacgatggtgaccgtgagctcg

SEQ ID NO: 55640 - RNA, 432 nt, synthetic construct
  misc_feature 1..432: note = derived and/or modified sequence opt11 from anti-HIV_cap256-048-100832_VR-Chain
  source 1..432: mol_type = other RNA
caagtgcaactggtcgagagcgggggcggggtcgtgcaaccgggcaggagcttgcgcttgagctgtgccgcgagcgggttcacgttctcgagctatggcatgcactgggtcaggcaagcgcccgggaaagggctcgagtgggtggccgtggtctcgagcgatggcacgaacaagaactatggcgatagcgtgaaagggcgctttaccataagcagggacaatagcaggaacacggtctatctccagatgtcgagcttgcgcccggaagataccgcggtctattactgtgccaaggacgtgggcgataccaagagcgatgaatgggccacggactattacgatttctcgatcgcgtacccggtccaggacccacgcgcggtcgtgggcgcgttcgatatctggggacagggcacgatggtgaccgtgagctcg

SEQ ID NO: 55641 - RNA, 432 nt, synthetic construct
  misc_feature 1..432: note = derived and/or modified sequence opt11 from anti-HIV_cap256-048-100188_VR-Chain
  source 1..432: mol_type = other RNA
caagtgcacctggtcgagagcgggggcggggtcgtgcaaccgggcaggagcttgcgaatatactgtgccgtgagcgagttcacgttcaggaactatgccatgcactgggtcaggctagcgcccgggaaagggctccagtgggtggccgtgatctcgtacaatggcgggaaaaagtactatgccgatagcgtgaaagggcgctttacaataagcagggacaatagcaagaacgcgctctatctccagatgaatagcctgcgagcggaagataccgggctctattactgtgccaaggacttgcgagagttcgagtgcgaggaatgggcctcggactattacgatttcgggcgcgagtacccgtgccaggacccgcgaggggtcgtgggcacgttcgatatctggggccagggcacgatggtgaccgtgagctcg

SEQ ID NO: 55642 - RNA, 432 nt, synthetic construct
  misc_feature 1..432: note = derived and/or modified sequence opt11 from anti-HIV_cap256-048-099645_VR-Chain
  source 1..432: mol_type = other RNA
caagtccaactcgtcgaatccggcggcggcgtagtccaacccggccgctcactccgcctctcctgcgccgcatccggcttcaccttctcccgatacgccctccactgggtccgccaagcccccggcaaaggactcgaatgggtcgccgtcatctcctacgacggcagctccaaatactacgccgactccgtcaaaggccgcttctccatctcccgcgacaactccaaatacaccctctacctccaaatgaactccctccgcgccgacgacacagccgtctacttctgcgccaaagacctcggcgtcaacaaaaacgacgaatgggccaccgactactacgacctctcagtcgcctaccccgtccaagacccccgcggcgtcgccggcatcttcgacatctggggccaaggcaccatggtcaccgtctcatcc

SEQ ID NO: 55643 - RNA, 432 nt, synthetic construct
  misc_feature 1..432: note = derived and/or modified sequence opt11 from anti-HIV_cap256-048-098137_VR-Chain
  source 1..432: mol_type = other RNA
caagtgcaattggtcgagagcggaggcggagtcgtgcaaccgggcaggagcctgcgcttgagctgtgccgcgagcgggttcacgctcaggaactatgccatgcactgggtcaggcaagcgccagggaaagggctcgagtgggtggccgtaatctcgagcgatggcaataacaagtactatgccgatagcgtgaaagggcgctttaccgtgagcagagacaatagcaaggacacgctatatctccagatgaatagtttgcgcccggaagataccgcgctctattactgtgccaaggacctgggcgagcgcgagtgcgaggaatgggcctcgaactattacgatttcgggcgcgattacccgtgccaggacccgcgcggggtcgtgggcacgttcgatatctggggccagggcacgatggtgaccgtgagctca

SEQ ID NO: 55644 - RNA, 432 nt, synthetic construct
  misc_feature 1..432: note = derived and/or modified sequence opt11 from anti-HIV_cap256-048-097878_VR-Chain
  source 1..432: mol_type = other RNA
caagtgcaattgctcgagagcgggggcggggtagtgcaaccgggcaagagcttgcgcttgagctgtgccgcgagcgggttcacgttcaatacctatggcatgcactgggtcagacaagcgcccgggaaagggctccagtgggtggccgtgatctcgtacgatggcacgatccagaaatatgccgatagcgtgaaagggcgctttacaataagcagggaaaatagcaagaacatgctctatctccagatgaatagcttgcgaggggaagataccgcggtctattactgtgccaaggacttgcgcgagttcgagtgcgaggaatgggcctcggactattacgatttcgggcgcgattacccgtgccaggacccacgaggggtcgtgggcacgttcgatgtctggggccatggctcgctcgtgaccgtgagctcg

SEQ ID NO: 55645 - RNA, 432 nt, synthetic construct
  misc_feature 1..432: note = derived and/or modified sequence opt11 from anti-HIV_cap256-048-097510_VR-Chain
  source 1..432: mol_type = other RNA
caagtgcaattggtcgagagcgggggcggggtcgtgcaaccgggcaggagcttgtggttgagctgtgccgcgagcgagttcacgctcaggagctatggcatgcactgggtcaggcaagcgcccgggaaagggctcgagtgggtggcctttgtcgcgttcgatgaatcggacaagtactatgccgacagcgtgaaagggcgctttaccataagcagggacaatagcaagaacacgctatcgctccagatgaatagcttgcgcgcggaagataccgcggtctattactgtgccaaggaagtgggcgataacaaggacgatgaatgggcctcggactattacgatctctcgatcgcgtacccggtccatgacccgcgcgcggtcgtgggagggttcgatatctggggccagggaacgatggtgaccgtgagctcg

SEQ ID NO: 55646 - RNA, 432 nt, synthetic construct
  misc_feature 1..432: note = derived and/or modified sequence opt11 from anti-HIV_cap256-048-097313_VR-Chain
  source 1..432: mol_type = other RNA
caagtgcaattggtcgagagcgggggcgggctcgtgcaaccgggcggggccctgcgcttgagctgtctcgtgagcgggttcacgttcgatgactatgccttgcactgggtcaggcaagcgcccgggaaagggcccgagtgggtggccgtgctctcgagcgatggctcgtacaagtactataccgagagcgtgcaagggcgctttaccataagcagggacaatagcaagaacacggtatatctccagatgaatagcttgagaggggtcgataccgcggtctattactgtgccaaggacttgggcgggggcgaggtcgaggaatgggccacggactattacgattggtcgatcgcgtacccggtcgagcacccgcgcgcggtcgtgggcgtgttcgatatctggggccagggcacgaaagtgaccgtgagctcg

SEQ ID NO: 55647 - RNA, 432 nt, synthetic construct
  misc_feature 1..432: note = derived and/or modified sequence opt11 from anti-HIV_cap256-048-096626_VR-Chain
  source 1..432: mol_type = other RNA
gaagtccaactcgtcgaatccggcggcggcctcgtccaacccggcgaatccctacgcctctcctgcgccggctccggcttcaccttctcctcctactggatgtcctgggtccgccaagcccccggaaaaggcctcgaatggatggccctcatctcctacgacggctccaacaaatactacgtagactccgtaaaaggccgcttcaccatctcccgcgacaactccaaaaacaccctctacctccaaatgaactcactccgcgccgaagacaccgccgtctactactgcgccaaagacctcggcggcaacaaagacgacgaatgggccaccgactactacgacctctccatcgcctaccccgtccaagacccccgcgtcgtcgtcggcatcttcgacatctggggccaaggcaccatggtcaccgtctcctcc

SEQ ID NO: 55648 - RNA, 432 nt, synthetic construct
  misc_feature 1..432: note = derived and/or modified sequence opt11 from anti-HIV_cap256-048-096483_VR-Chain
  source 1..432: mol_type = other RNA
gaagtgcaattggtcgagagcgggggcggactcgtgcaaccgggcaggagcttgcgcttgagctgtgccgcgagcgggttctcgttcgaggactatgccatgcactgggtcaggcaagcgcccgggaaagggctcgagtgggtggccgggatctcgttcgcgggcacgaaaaagtactatgccgatagcgtgaaagggcgctttaccataagcagggacaatagcaagaacgcgctctatctccagatgaatagcttgcgcgcagaagataccgcgctctattactgtgccaaggacttgcgcgagtacgagtgcgaggaatgggcctcggactattacgatttcgggcgcgattacccgtgccaggacccgcgcggggtcgtgggcacgttcgatatctggggccagggaacgatggtgaccgtgagctcg

SEQ ID NO: 55649 - RNA, 432 nt, synthetic construct
  misc_feature 1..432: note = derived and/or modified sequence opt11 from anti-HIV_cap256-048-095691_VR-Chain
  source 1..432: mol_type = other RNA
caagtgcaattggtcgagagcgggggcggggtcgtgcaaccgggcaggagcctgcgcttgagctgtgccgcgagcgggttcacgttctcaagctatggcatggcctgggtcaggcaagcgcccgggaaagggctcgagtgggtgaccgcgatctcgttcgcgggcacgaacaagtactatgccgatagcgtgaaagggcgctttaccataagcagggacaatagcaaggacacgctctatctccagatggatggcctgcgcccggaagataccgcgctctattactgtgccaaggacttgggcgagcgcgagtgcgaggaatgggcctcgaactattacgatttcgggcgcgattacccgtgccaggacccgcgcggggtcgtgggcacgttcgatatctggggccagggcacgatggtgaccgtgagctcg

SEQ ID NO: 55650 - RNA, 432 nt, synthetic construct
  misc_feature 1..432: note = derived and/or modified sequence opt11 from anti-HIV_cap256-048-095525_VR-Chain
  source 1..432: mol_type = other RNA
caagtgcaactggtccagagcgggggctcagtcgtgcaaccgggcaagagcttgcgcctgagctgtgccgcgagcgggttcacgttctcgagctttggcatgcactgggtcaggcaaacgcccgggaaagggctcgagtgggtggccgtgatctcgtacgatggctcggaaaagagctatgccgatagcgtgaaagggcgctttaccataagcagggacaatagcaagaacacgctctatctccagatgaatagcttgcgcgcggaagataccgcggtctattactgtgccaaggacttgggcgggaccaaggacgatgaatgggccacggactattacgacatctcgatcgcgtacccggtccaggacccgcgcgcggtcgcgggcgcgttcgatatctggggccagggcacgatggtgaccgtgagctca

SEQ ID NO: 55651 - RNA, 432 nt, synthetic construct
  misc_feature 1..432: note = derived and/or modified sequence opt11 from anti-HIV_cap256-048-094783_VR-Chain
  source 1..432: mol_type = other RNA
gaggtgcagttggtggagagcgggggggggctggtaaagccgggagggagcttgaggttgagctgtgcggcgagcgggataacgttcagtacgtatgagatgaactgggtgaggcaggcgccggggaaggggatggagtgggtggcggtgataagttacgatggaagtaacaagtactatgcggatagcgtgaaggggaggtttacgataagcagggacaatagcaagaacacggtgtatctgcagatgaatagcttgaggggggtggatacggcggtgtattactgtgcgaaggacttgggggggggggaggtggaggagtgggcgacggactattacgattggagtatagcgtacccggtggagcacccgagagcggtggtgggggtgttcgatatatgggggcaggggacgaaggtgacggtgagtagt

SEQ ID NO: 55652 - RNA, 432 nt, synthetic construct
  misc_feature 1..432: note = derived and/or modified sequence opt11 from anti-HIV_cap256-048-094356_VR-Chain
  source 1..432: mol_type = other RNA
caagtccaactcgtagaatctggcggcggtgtcgtccaacccggccgctccctacgcctctcctgcgccgcctctggcttcatcttcacccactacgccatggactgggtccgccaagcccccggcaaaggcctcgaatgggtcgccgtcatctcctccgacggctcctccaaaaactacgccgactccgtcaaaggccgcttcaccatctcccgcgacaactctaaaaacaccgtctccctccaaatgaactccctccgccccgaagacaccgccgtatactactgcgccaaagacgtcggcgacaacaaatccgacgaatgggccaccgactattacgacttctccatcgcctacccagtccccgacccccgcgccgtcgtcggcgccttcgacctctggggccaaggcaccatggtcaccgtctcctcc

SEQ ID NO: 55653 - RNA, 432 nt, synthetic construct
  misc_feature 1..432: note = derived and/or modified sequence opt11 from anti-HIV_cap256-048-090756_VR-Chain
  source 1..432: mol_type = other RNA
caagtgcaattggtcgagagcgggggcggggtagtgcgcccgggcaggagcttgcgcttgagctgtgcagtgagcgggttcacgttctcgaactatgccatacactgggtcaggcaagcgcccgggaaagggctcgagtgggtggccgtgatctcgtacgatggctcggacaagtactatgccgatagcgtgaaagggcgctttaccataagcagggaaaatagcaagaacatgctctatctccagatgaatagcttgcgcggggaagataccgcggtctattactgtgccaaggacctgcgcgagttcgagtgcgaggaatgggcctcggactattacgatttcgggcgcgattacccgtgccaggacccgcgcggggtcgtgggcacgttcgatgtctggggccatggctcgctcgtgaccgtgagctcg

SEQ ID NO: 55654 - RNA, 432 nt, synthetic construct
  misc_feature 1..432: note = derived and/or modified sequence opt11 from anti-HIV_cap256-048-089065_VR-Chain
  source 1..432: mol_type = other RNA
caagtccaactcgtcgaatccggaggcggcgtcgtccaacccggccgctccctccgactctcatgcgccgcctccggcttcaccttctccacctacgcaatgcactgggtccgccaagcccccggcaaaggactcgaatgggtagccctcatctcctacgacggcaccaacaaatactacgtcgactcagtcaaaggccgcttcaccatctcacgcgacaactccaaaaacaccctatacctccaaatgaactcactcaccgccgaagacaccgccgtatactactgcgcaaaagacctcggcggcaacaaagacgacgaatggggcaccgactactacgacttctccgtcgcctaccccgtccaagacccacgcgccgtctccggcatcttcgacgtctggggccacggcaccatggtcaccgtctcctcc

SEQ ID NO: 55655 - RNA, 432 nt, synthetic construct
  misc_feature 1..432: note = derived and/or modified sequence opt11 from anti-HIV_cap256-048-084986_VR-Chain
  source 1..432: mol_type = other RNA
caagtccaactcgtcgaatccggcggaggcgtcgtccaacccggccgctccctacgcctctcctgcgccgcctccggcttcaccttctccgactacgccatgcactgggtccgccaagcccccggcaaaggactcgaatgggtcgccctcatctcctacgacggctccaacaaatactacgccgactccgtcaaaggccgcttcaccatctcacgcgacaactccaaaaacaccctctacctacaaatgtcctccctcaccgccgaagacaccgccgtctactactgcgccaaagacctcggcggcaacaaaaacgacgaatgggccaccgactactacgacctatccatcgcctaccccatccacgacccccgcgccgtcctcggcgccttcgacgtctggggccaaggcaccatgctcaccgtctcctcc

SEQ ID NO: 55656 - RNA, 432 nt, synthetic construct
  misc_feature 1..432: note = derived and/or modified sequence opt11 from anti-HIV_cap256-048-083355_VR-Chain
  source 1..432: mol_type = other RNA
caagtgcaattggtcgagagcgggggcggggtcgtgcaaccgggccgcagcttgagattgagctgtgccgtgagcgggttcatattctcgagctatgccatgcgctgggtcaggcaagcgcccggaaaagggctcgagtgggtggcagtgatctcgtacgatggctcgaaaacgaactatgccgatagcgtgaaagggcgctttaccataagcagggacaatagcaagaacacgctctatctccagatgaatagcttgacctcggaagataccgcggtctattactgtgccaaggacttgggcgggagcaagaccgatgaatggggcacggactattacgagttctggaacgcgtacccggtccaggacccgcgcgtggtcgtgggcgcgttcgatatctggggccatggcacgatggtgaccgtaagctcg

SEQ ID NO: 55657 - RNA, 432 nt, synthetic construct
  misc_feature 1..432: note = derived and/or modified sequence opt11 from anti-HIV_cap256-048-082462_VR-Chain
  source 1..432: mol_type = other RNA
caagtgcacctggtcgagagcgggggcggggtcgtgcaaccgggcaagagcttgcgattgagctgtaccgcgagcaggttcatattcaggaactatgccatggactgggtcaggcaagcgcccgggaaaggactcgagtgggtggccgtgatctcgtacgatggcgtgaaagagcactatgccgagagcgtgaaagggcgctttaccataagcagggacaatagcaagaacacggtctatctccagatgaatagcttgcgcgtggaagataccgcggtctattactgtgccaaggacctgggcgcgaacaaggacgatgaatgggccacggactattacgatctctcggtcgcgtacccggtcccggacccgcgcgcggtcgtgggagcgttcgatgtctggggccagggcacgatggtgaccgtgagctcg

SEQ ID NO: 55658 - RNA, 432 nt, synthetic construct
  misc_feature 1..432: note = derived and/or modified sequence opt11 from anti-HIV_cap256-048-082246_VR-Chain
  source 1..432: mol_type = other RNA
caagtgcacttggtcgagagcgggggcggggtcgtgcaaccgggaaggagcttgcgaataagctgtgccgcgagcgggttcacgttctcgaaaaatgccatgcactgggtcaggcaagcgcccgggaaagggctcgaatgggtggcctttgtcgcgttcgatgaatcggacaagtactatgccgatagcgtgaaagggcgctttaccataagcagggacaatagcaagaacatactctcgctccagatgaatagcttgcgagcggaagataccgcggtctattactgtgcaaaggaagtggacgagtacaaggacgatgaatgggcctcggactattacgacctctcaatagcgtacccggtcagggacccgcgcgcggtcgtgggcgggttcgatatctggggccagggcacgatggtgaccgtgagcgcg

SEQ ID NO: 55659 - RNA, 432 nt, synthetic construct
  misc_feature 1..432: note = derived and/or modified sequence opt11 from anti-HIV_cap256-048-080752_VR-Chain
  source 1..432: mol_type = other RNA
caagtgcaattggtcgagagcgggggcggggtcgtgcaaccgggcgggagcttgcgactgagctgtgccgcgagcggattcacgttctcgaactatggcatgcactgggtcaggcaagcgcccgggaaagggctcgagtgggtggcctttatcaggtacgatggcgatatcacgtactatgtcgatagcgtgaaagggcgctttaccataagcagggacaatagcaagaacgcgctctatctccagatgaatagcttgcgcgcggaagataccgcgctctactactgtgcaaaggacttgcgagagtacgagtgcgaggaatgggcctcggactattacgatttcgggcgcgagtacccgtgccaggacccgcgcggggtcgtgggcacgttcgatatctggggccagggcacgatggtgaccgtgagctcg

SEQ ID NO: 55660 - RNA, 435 nt, synthetic construct
  misc_feature 1..435: note = derived and/or modified sequence opt11 from anti-HIV_cap256-048-078409_VR-Chain
  source 1..435: mol_type = other RNA
caggtccagctcgtggaatcgggcgggggcgtggtccagcccgggcgctcgctcaggctctcgtgcgcggcctcgggctttacctttaacaattacgcgatggattgggtgcgccaggccccgggcaagggcctggaatgggtcgcgctcataagctatgacgggagcaataaatattacgcggaatcggtcaagggcaggttcacgatctcgcgcgataactcgaaaaataccttgtacttgcaaatgaactcgctcagagccgaggacacggccgtgtactattgcgcgaaagatgtcggggaaaagcaatcgatgatgcgatgggccacggactattacgatctctcgatcgcatacccggtcccggacccgcgcgcggtcgtgggcgcgttcgatctctggggcaggggcacgatggtgaccgtgagctcg

SEQ ID NO: 55661 - RNA, 432 nt, synthetic construct
  misc_feature 1..432: note = derived and/or modified sequence opt11 from anti-HIV_cap256-048-078273_VR-Chain
  source 1..432: mol_type = other RNA
gaagtacaactcgtcgaaagcggaggaggactcgtccaacccggcggatccctacgcctcagctgcgccgcaagcggattcacagtctcaagcaactacatgagctgggtcagacaagcccccggaaaaggactcgaatgggtagccgtaatctcaagcgacggctcaaacaaaaactacgccgacagcgtaaaaggccgcttcaccataagccgagacaacagcaaaaacacactcttcctccaaatgaacagcctacgcccagaagacaccgccgtctacttctgcgccaaagacctaggcgcaaacaaagacgacgaatgggccacagactactacgacctctcaatcgcctacccagtccacgacccccgcgcagtcgtcggcatattcgacctctggggccaaggcacaatggtaaccgtcagctcc

SEQ ID NO: 55662 - RNA, 432 nt, synthetic construct
  misc_feature 1..432: note = derived and/or modified sequence opt11 from anti-HIV_cap256-048-078062_VR-Chain
  source 1..432: mol_type = other RNA
gacgtgtacttggtcgagagcgggggcgggctcgtgcaaccgggcgggagcttgcgcttgagctgtaccgcgagcgggatcacgttctcgacctatgaaatgaactgggtcaggcaagcgcccgggaaagggctcgagtgggtggcctttgtcgcgttcgatggctcggacaagtactatgccgatagcgtgaaagggcgctttgtcataagcagggacaatagcaagaacacgctctcgctccagatgaatagcttgagagcggaagataccgcggtctattactgtgccaaggaagtgggcgaggacaaggacgatgaatgggcctcggactattacgatctctcgatcgcgtacccggtccatgacccgcgcgcggtcgtgggcgggttcgatatctggggccagggcacgatggtgaccgtgagctcg

SEQ ID NO: 55663 - RNA, 432 nt, synthetic construct
  misc_feature 1..432: note = derived and/or modified sequence opt11 from anti-HIV_cap256-048-077798_VR-Chain
  source 1..432: mol_type = other RNA
caagtgcaattggtcgagagcgggggcggggtcgtgcaaccgggcaggagcttgcgattgagctgtgccgcgagcgggttcacgttctcgaactatggcatgcactgggtcaggcaaacgcccgggaaagggctagagtgggtggccgtgatctcgtacgatggctcgaacaagttctatgccgatagcgtgaaagggcgctttaccataagcagggacaatagcaagaacacgctatatctccagatgaatagcttgcgcgtggaagataccgcggtctatcactgtgccaaggacttgggcgggagcaagagcgatgaatgggcaacggactattacgattggtcgatcgcgtacccggtccatgacccgcgcgcggtcgtgggcgtgttcgatatctggggccagggcacgctagtgaccgtgagctcg

SEQ ID NO: 55664 - RNA, 432 nt, synthetic construct
  misc_feature 1..432: note = derived and/or modified sequence opt11 from anti-HIV_cap256-048-073853_VR-Chain
  source 1..432: mol_type = other RNA
gaagtgcaattggtcgagagcgggggcgggctcgtgaaaccgggcgggagcttgcgattgagctgtgccgcgagcgggttcacgttctcggacgcgtggatgaactgggtcaggcaagcgcccgggaaagggctcgagtgggtggccgggatctcgttcgcgggaacgaacaagtactatgccgatagcgtgaaagggcgctttaccataagcagggacaatagcaagaacacgctctatctccaaatgaatagcttgcgcgcggaagataccgcgctctattactgtgccaaggacatgcgcgagtacgagtgcgaggaatgggcctcggactattacgatttcgggcgcgattacccgtgccaggacccgcgcggggtcgtgggcacgttcgatatctggggccagggcacgatggtgaccgtgagctcg

SEQ ID NO: 55665 - RNA, 435 nt, synthetic construct
  misc_feature 1..435: note = derived and/or modified sequence opt11 from anti-HIV_cap256-048-071661_VR-Chain
  source 1..435: mol_type = other RNA
caagtgcaactggtcgagagcgggggcggggtcgtgcaaccgggcagaagcctgggcttgagctgcgaagtgagcgggttcacgttctcggactatttcatgagctggatcaggcaagcgcccgggaaagggctcgagtgggtggccgtgatatcgcacgatggcaataacaagtactatcccgacagcgtgcaaggacgcttcaccataagcagggaaaatagcaagaacacgctatatctccagatgaacagcttgaaaccggaagataccgcggtctatttctgtgccaaggacctgggcggggaatcggaagtggaagagtgggcgagcgattactatgactttggcagggacatacccgggcccgatcccagaggcgtggtcgggacattggacatatgggggcacgggaccatggtcacggtctcaagc

SEQ ID NO: 55666 - RNA, 432 nt, synthetic construct
  misc_feature 1..432: note = derived and/or modified sequence opt11 from anti-HIV_cap256-048-071360_VR-Chain
  source 1..432: mol_type = other RNA
caagtgcaattggtcgagagcgggggaggggtcgtgcaaccgggcaggagcttgcgattgagctgtgccgcgagcgggttcacgctcacgaactatgcaatggactgggtcaggcaagcgcccgggaaagggctcgagtgggtggccgtgatctcgagcgatggctcgaacaagaactatgaagatagcgtgaaagggcgctttaccataagcagggacaatagcaagaacacgctctatctccagatgtcgagcttgcgcccggaagataccgcagtctattactgtgccaaggacgtgggcgataacaagagcgatgaatgggccacggactattacgatttctcgatcgcgtacccggtcccggacccgcgagcggtcgtgggcgcgttcgatctctggggccagggcacgatggtgaccgtgagctcg

SEQ ID NO: 55667 - RNA, 432 nt, synthetic construct
  misc_feature 1..432: note = derived and/or modified sequence opt11 from anti-HIV_cap256-048-070955_VR-Chain
  source 1..432: mol_type = other RNA
gaagtgcaattggtcgagagcgggggcgggctcgtgcaaccgggcgggagcgtgcgattgagctgtgccgtgagcgggttcacgttctcgagctattggatgagctgggtcaggcaagcgcccgggaaagggctcgagtgggtggccgtgatctcggactcgggctcgaacaagtactatgccgatagcgtgaaagggcgctttaccataagcagggacaatagcaagaacacgctctatctccagatgaatagcttgcgcgcggaagataccgcggtctatttctgtgcaaaggacttgggcgggcgcgagaccgaggaatgggcatcggactattacgatttcgggcgcgatttcccgggccaggaccagcgcgcggtcgcgggcgtgttcgatatgtggggccagggcacgatggtgaccgtgagctcg

SEQ ID NO: 55668 - RNA, 432 nt, synthetic construct
  misc_feature 1..432: note = derived and/or modified sequence opt11 from anti-HIV_cap256-048-070061_VR-Chain
  source 1..432: mol_type = other RNA
gaagtgcaattgctcgagagcgggggcgggctcgtgcaaccgggcgggagcttgcgcttgagctgtgccgcgagcggattcacgttctcgagctatgccatgcactgggtcaggcaagcgcccgggaaagggctcgagtgggtggccgtaacctcgtacgatggctcgaacaagtactatgccgatagcgtgaaagggcgctttaccataagcagggacaatagcaagaacacgctctatatgcagatgaatagcttgcgagcggaagataccgcggtctattactgtgccaaggaccagggcgagagtgagaaagaggaatgggcctcggactattacgatttcgggagagattacccgggcagggacccgcgcagggtcgtggccacgttcgcgatctggggccagggcacgatggtaaccgtgagctcg

SEQ ID NO: 55669 - RNA, 432 nt, synthetic construct
  misc_feature 1..432: note = derived and/or modified sequence opt11 from anti-HIV_cap256-048-069669_VR-Chain
  source 1..432: mol_type = other RNA
caagtgcaattggtcgagagcgggggcggggtcgtgcaaccgggcaggagcttgcgcttgagctgtgccgtgagcgggttcacgttctcgaaatttcccatgcactgggtcaggcaagcgcccgggaaaggactcgagtgggtggccgtgatctcatacgatggcaataaaaagtactatgtcgatagcgcgaaagggcgctttaccataagcagggacaatagcaggaaaacgctctatctccagatgacgggcttgcgaccggaagataccgcggtctattactgtgccaaggacttgggcgggggcgagtgcgagacctgggcctcggactattacgatttcgggaaagattacccgtgcttggacccgcgagatgtcgtgggcacgttcgatatctggggccagggcacgctagtgaccgtgagctcg

SEQ ID NO: 55670 - RNA, 432 nt, synthetic construct
  misc_feature 1..432: note = derived and/or modified sequence opt11 from anti-HIV_cap256-048-069205_VR-Chain
  source 1..432: mol_type = other RNA
caagtgcaattggtcgagagcgggggcggggtcgtgcaaccgggcaggagcttgcgcttgagctgtgccgcgagcgggttcacgttctcgagctatgccatgcactgggtcaggcaagcgcccgggaaagggctcgagtgggtggtcgtgatctcgaacgatggcaataacaagtactatgccgatagcgtgaaagggcgctttaccataagcagggacaatagcaagaacacggtctatctccagatgaatagcttgcgcgcggaagataccgcggtctattactgtgccaaggacgtgggcgataccaagaaagatgaatgggccacggactattacgatctctcgatcgcgtacccggtccaggacccgcaagcggtcgtgggagcgttcgatatctggggccagggcacgatggtgaccgtgagctcg

SEQ ID NO: 55671 - RNA, 432 nt, synthetic construct
  misc_feature 1..432: note = derived and/or modified sequence opt11 from anti-HIV_cap256-048-068882_VR-Chain
  source 1..432: mol_type = other RNA
caagtgcaattggtcgagagcgggggcggggtagtgcaaccgggaaggagcctgcgcctgagctgtgccgcgagcgggttcacgttctcgacctatgccatgcactgggtcaggcaagcgcccgggaaaggactcgagtgggtggccttgatctcgtacgatggcacggacaagtactatgcagatagcgtgaaagggcgctttaccataagcagggacaatagcaagaacacggtctatctccagatgaatagcttgcgcggggtcgataccgcggtgtattactgtgccaaggacttgggcgggggcgaggtcgaggaatgggcaacggactattacgattggtcgaccgcgtacccggtcgagcacccgcgcgcggtggtgggcgtgttcgatatatggggccagggcacgaaagtgacagtgagctcg

SEQ ID NO: 55672 - RNA, 432 nt, synthetic construct
  misc_feature 1..432: note = derived and/or modified sequence opt11 from anti-HIV_cap256-048-067764_VR-Chain
  source 1..432: mol_type = other RNA
gaagtgcaattggtccagagcgggggcgggctcgtgaaaccgggcgggagcttgcgcttgagctgtgccgcgagcgggttcacgttctcgacctatagcatgaactgggtcaggcaagcgcccgggaaagggctcgagtgggtggccgtgatctcgagcgatggctcgagcaagaactatgccgatagcgtgaaagggcgctttaccataagcagggacaatagcaagaacacggtctcgctccagatgaatagcttgcgaccggaagataccgcggtctattactgtgccaaggacgtgggagcgaacaaggacgatgaatgggccacggactattacgatctctcgatcgcgtacccggtcccggacccgcgcgcggtcgtgggcgcgttcgatatctggggccagggcacgatggtgaccgtgagctcg

SEQ ID NO: 55673 - RNA, 432 nt, synthetic construct
  misc_feature 1..432: note = derived and/or modified sequence opt11 from anti-HIV_cap256-048-066845_VR-Chain
  source 1..432: mol_type = other RNA
caagtgctcttggtcgagagcgggggcggggtcgtgcaaccgggcgggagcttgaccctgagctgtgccgcgagcgggttcacgttctcgaactatggcatgcactgggtcaggcaagcgcccgggaaagggctcgagtgggtggcctttatcaggtacgatggcaataacaagtactatgccgatagcgtgaaagggcgctttaccataagcagggacaatagcaaggacacgctctatctacagatggatggcttgcgaccggaagataccgcgctctattactgtgccaaggacttgggcgagcgagagtgcgaggaatgggcctcgaactattacgatttcgggcgcgattacccgtgccaggacccgcgcggggtcgtgggcacgttcgatatctggggccagggcacgatggtgaccgtgagctcg

SEQ ID NO: 55674 - RNA, 432 nt, synthetic construct
  misc_feature 1..432: note = derived and/or modified sequence opt11 from anti-HIV_cap256-048-065226_VR-Chain
  source 1..432: mol_type = other RNA
gaagtgcaactggtcgagagcgggggcgggctcgtgaaaccgggcgggagcttgcgcttgagctgtgtcgcgagcgggttcacgttctcgaactatggcatgcactgggtcaggcaagcgccagggaaagggctagtgtgggtggccgggatctcgttcgcgggcacgaacaagtactatgccgcgagcgtgaaagggcgctttaccataagcagggacaatagcaagaacacgctctatctccagatgaatagcttgcgcgcggaagataccgcgctctattactgtgccaaggacatgcgcgagtacgagtgcgaggaatgggcctcggactattacgatttcgggcgcgattacccgtgccaggacccgcgaggggtcgtgggcacgttcgatatctggggccagggcacgatggtgaccgtgagctcg

SEQ ID NO: 55675 - RNA, 432 nt, synthetic construct
  misc_feature 1..432: note = derived and/or modified sequence opt11 from anti-HIV_cap256-048-063717_VR-Chain
  source 1..432: mol_type = other RNA
caagtgcaactggtcgagagcgggggcggggtcgtgcaaccgggcaggagcttgcgactgagctgtgcagcgagcgggttctcgttctcgaaccatgccatggactgggtaagacaagcgcccgggaaagggctagagtgggtggccgtgatctcgagcgatggatcggacaagatctatgcagagagcgtgaaagggcgctttaccataagcagggacaatagcaagaacacgctctatctacaaatgaatagcttgcgcgtggaagatacagcggtctatttctgtgccaaggacttgggcgcgaacaaggacgatgaatgggccacggactattacgatctctcgatagcgtacccggtcccggacccgcgcgcggtcgtgggagcgttcgatatctggggccagggcacgatggtgagcgtaagctcg

SEQ ID NO: 55676 - RNA, 432 nt, synthetic construct
  misc_feature 1..432: note = derived and/or modified sequence opt11 from anti-HIV_cap256-048-063150_VR-Chain
  source 1..432: mol_type = other RNA
gaagtgcaactggtcgagagcgggggcggggtcgtgcaaccgggcaggagcttgcgcctgagctgtgccgcgagcgggttcacgttctcgagctatgccatgcactgggtcaggcaagcgcccgggaaagggctcgagtgggtggcccatatcaggtacgatggctcgaacaagtactatatcgatagcgtgcaagggcgctttaccataagcagagacaatcccaagaacacgctctatctccagatgaatagcttgcgcacggaagataccgcggtctattactgtgccaaggacttgggcgggggcgaggtcgaggaatgggccacggactattacgattggtcgatcgcgtacccggtcgagcacccgcgcgcggtcgtgggcgtgttcgatatctggggccagggcacgaaagtgaccgtgagctcg

SEQ ID NO: 55677 - RNA, 432 nt, synthetic construct
  misc_feature 1..432: note = derived and/or modified sequence opt11 from anti-HIV_cap256-048-062431_VR-Chain
  source 1..432: mol_type = other RNA
caagtgcaactggtcgagagcgggggcggggtcgtgcaaccgggcaggagcttgcgcctgagctgtgccgcgagcgggttcacgttctcgaacttcgccatggactgggtcaggcaagcgcccgggaaagggctcgagtgggtggccgtgatctcgagcgatggctcgaaaaagaactatggagatagcgtaaaagggcgctttaccataagcagggacaatagcaagaacacgctctttctccagatgaatagcttgcgcccggaagataccgcgctctattactgtgccaaggacctgggcgggtacaagagcgatgaatgggccacggactattacgatctctcgatcgcgtacccggtccaggacccgcgcccgtggttggaattgctctatatctggggccagggcgcgatggtaaccgtgagctcg

SEQ ID NO: 55678 - RNA, 432 nt, synthetic construct
  misc_feature 1..432: note = derived and/or modified sequence opt11 from anti-HIV_cap256-048-060745_VR-Chain
  source 1..432: mol_type = other RNA
caagtgcaattggtcgagagcgggggctcggtcgtgcaaccgggcaggagcctgcgcctgacctgtaccgcgagcgggttcacgttctcgcactatgccatggactgggtcaggcaagcgcccgggaaagggctcgagtgggtggccgtgatctcgagcgatgccacgaacaagaactatgccgatagcgtgaaagggcgctttaccataagcagggacaatagcaagaacacggtctatctacagatggatagcttgcgcgcggaagatacagcggtctattactgtgccaaggacgtgggcgattacaaggacgatgaatgggccacggactattacgatttctcgatcgcgtacccggtcccggacccgcgcgcggtcgtgggcgcattcgatttctggggccagggcacgatggtgaccgtgagctcg

SEQ ID NO: 55679 - RNA, 432 nt, synthetic construct
  misc_feature 1..432: note = derived and/or modified sequence opt11 from anti-HIV_cap256-048-060420_VR-Chain
  source 1..432: mol_type = other RNA
caagtgcaattggtcgagagcgggggcggggtcgtgcaaccgggcaggagcttgcgattgagctgtgccgcgagcgggttcacgttctcgagctatggcatggcctgggtcaggcaagcgcccgggaaagggctcgagtgggtgaccgtgatctcgttcgcgggcgtgaaaaagtactatgccgatagcgtgaaagggcgctttaccataagcagggacaatagcaagggcacgctatatctccagatgaatagcttgcgcgcggaagataccgcggtatattactgtgccaaggacgtgggcgataccaagaaagatgaatgggccacggactattacgatctctcgatcgcgtacccggtccaggacccgcaagcggtcgtgggcgcgttcgatatctggggccagggcacgatggtgaccgtgagctcg

SEQ ID NO: 55680 - RNA, 435 nt, synthetic construct
  misc_feature 1..435: note = derived and/or modified sequence opt11 from anti-HIV_cap256-048-060014_VR-Chain
  source 1..435: mol_type = other RNA
caggtccagctcgtggaatcgggcggaggcgtggtccagcccgggcgctcgctcaggctctcttgcgcggcctcgggctttacctttagcaattacgggatgcattgggtgcgacaggccccgggcaagggcttggaatgggtcgcgctcataagccatgacggaagcaataaaaatttcgcggactcagtcaagggcaggttcacgatctcgcgcgataactcgaaaaataccttgtacttacaaatgaactcgctcaggaccgaggacacggccatatactattgcgcgaaagatctcgggggcgagagcgagatcgaggaatggccctcggactattacgatttcgggcgcgattacccggtcccggacccacgcggggtcgtgggcacgttcgatttctggggccagggcacgatggtgaccgtaagctcg

SEQ ID NO: 55681 - RNA, 432 nt, synthetic construct
  misc_feature 1..432: note = derived and/or modified sequence opt11 from anti-HIV_cap256-048-059747_VR-Chain
  source 1..432: mol_type = other RNA
caagtgcaattggtcgagagcgggggcggggtcgtgcaaccgggcaggagcttgcgcttgagctgtgccgcgagcgggttcacgttcacgcactatgcaatggactgggtcaggcaagcgcccgggaaagggctcgagtgggtggcagtgatctcgagcgatggctcgagcaaggactatgccgatagcgtgaaagggcgctttaccataagcagggacaatagcaagaacacgctctcactccagatgaatagcttgcgcccggaagatacagcggtctattactgtgcaaaggacttgggcgcgagcaaggacgatgaatgggccacggactattacgatctctcgatcgcgtacccggtccatgacccgcgagcggtcgtgggcgggttcgatatatggggccagggcacgatggtgaccgtgagctcg

SEQ ID NO: 55682 - RNA, 432 nt, synthetic construct
  misc_feature 1..432: note = derived and/or modified sequence opt11 from anti-HIV_cap256-048-058393_VR-Chain
  source 1..432: mol_type = other RNA
caagtccaactcgtcgaatccggcggcggcgtcgtacaacccggcggctcactccgactctcctgcgccgcctccggcttcaccttcaacacctacggcatgcactgggtccgccaagcccccggaaaaggcctcgaatgggtcaccttcatccgctacgacggctccaacgaatactacgccgactccgtcaaaggccgcttcaccatctcccgcgacaactccaaaaacaccctctacctacaaatgaactcactctccgtcgaagacaccgccgtctactactgcgccaaagacctcggcaaaaacaaagacgacgaatgggccaccgactactacgacatctcaatcgcctaccccgtccccgacccccgcgcagtagtcggcgtattcgacatctggggccaaggcacagtcgtcaccgtctcaagc

SEQ ID NO: 55683 - RNA, 432 nt, synthetic construct
  misc_feature 1..432: note = derived and/or modified sequence opt11 from anti-HIV_cap256-048-058159_VR-Chain
  source 1..432: mol_type = other RNA
caagtgcaattggtcgagagcgggggcggggtcgtgcaaccgggcaggagcttgcgcctgagctgtgccgcgagcgggttcacgttctcgagctatcccatgcactgggtcaggcaagcgcccgggaaagggctcgagtgggtggccgtaatctcgttcgcgggcacgaacaagtactatgcccatagcgtgaaagggcgcttcaccataagcagggacaatagcaagaacacgctctatctccagatgaatagcctgcgcgcggaagataccgcgctctattactgtgccagggacttgcgcgagagcgagtgcgaggaatgggcctcagactattacgatttcgggcgagagtacccgtgccaggacccgcgcggggtcgtgggcacgttcgatatctggggcaggggcacgatggtgaccgtgagctcg

SEQ ID NO: 55684 - RNA, 432 nt, synthetic construct
  misc_feature 1..432: note = derived and/or modified sequence opt11 from anti-HIV_cap256-048-057127_VR-Chain
  source 1..432: mol_type = other RNA
gacgtgtacttggtcgagagcgggggcgggctcgtgcaaccgggcgggagcttgcgcttgagctgtgtcgcgagcgggatcacgttctcgagctatggcatgcactgggtcagacaagcgcccgggaaagggctcgagtgggcggcctttatcaggtacgatggcaggaacaagtactatgccgatagcgtgaaagggcgctttaccataagcagggacaatagcaagaacacgctatcgctccagatgaataacttgcgcgcggaagataccgcggtctattactgtgccaaggaagtgggcgataacaaggacgatgaatgggcctcggactattacgatctctcgatcgcgtacccggtccaggacccgcgcgcggtcgtgggcgggtacgatatctggggacagggcacgatggtgaccgtgagctcg

SEQ ID NO: 55685 - RNA, 432 nt, synthetic construct
  misc_feature 1..432: note = derived and/or modified sequence opt11 from anti-HIV_cap256-048-056251_VR-Chain
  source 1..432: mol_type = other RNA
gaagtgcaattggtcgagagcgggggcgggctcgtgcaaccgggcaggagcttgcgcttgagctgtgccgggagcgggttcacgttctcgaactttggctttcactgggtcaggcaagcgcccgggaaagggctcgagtgggtggccgcgatctcgttcgcgggctataacaagtactatgccgatagcgtgaaagggcgctttaccataagcagggaaaatagcaataacatgctctatctccagatgtcgagcttgcgcgcggaagataccgcggtctattactgtgccaaggacttgcgcgagagcgagtgcgaggaatgggcctcggactattacgatttcgggaaagattacccgtgccaggacccgcgcggggtcgtgggaacgttcgatgtatggggacatggctcgctcgtgaccgtgagctcg

SEQ ID NO: 55686 - RNA, 432 nt, synthetic construct
  misc_feature 1..432: note = derived and/or modified sequence opt11 from anti-HIV_cap256-048-055421_VR-Chain
  source 1..432: mol_type = other RNA
caagtgcaactggtcgagagcgggggcggagtcgtacaaccggccaggagcttgcgcttgagctgtgccgcgagcgggttcatattctcgacctatggcatgcactgggtcagacaagcgcccgggaaaggactcgaatgggtagccgtgatctcaagcgatggctcgagcaaggactatgccgacagcgttaaaggacgctttaccataagcagggacaatagcaagaacacgctctcgctacagatgaatagcctgcgcccggaagacaccgcggtctactactgtgccaaggacttgggcgcgagcaaggacgatgaatgggccacagactattacgatttctcgatcgcgtacccggtccaggacccgcgcgcggtcgtgggcgcgttcgatatctggggccagggcacgatggtgaccgtaagctcg

SEQ ID NO: 55687 - RNA, 432 nt, synthetic construct
  misc_feature 1..432: note = derived and/or modified sequence opt11 from anti-HIV_cap256-048-054989_VR-Chain
  source 1..432: mol_type = other RNA
caagtgcaattggtcgagagcgggggcggggtcgtgcaaccgggcgggagcttgcgcctgagctgtgccgcgagcgggttcacgttctcgaccaatggaatgcactgggtcaggcaagcgcccgggaaagggctcgagtgggtggcctttatcaggtacgatggctcaaacaagtactatgccgatagcgtgaaagggcgcttcaccataagcagggacaatagcaagaacacggtctatctccagatgaatagcttgcgcggggtcgataccgcggtctattactgtgccaaggacttgggagggggcgaggtcgaggaatgggccacggactattacgattggtcaatagcgtacccggtcgagcacccgcgagcggtcgtgggcgtgttcgatatatggggccagggcacgaaagtaaccgtgagctcg

SEQ ID NO: 55688 - RNA, 435 nt, synthetic construct
  misc_feature 1..435: note = derived and/or modified sequence opt11 from anti-HIV_cap256-048-054759_VR-Chain
  source 1..435: mol_type = other RNA
caggtccagctcgtggaatcgggcgggggcgtggtccagcccgggcgctcactcaggctatcgtgcgcggcctcgggctttagctttagcaagaacgggatgcattgggtgcgccaggccccgggcaagggattggaatgggtcgcgttcgtggcctttgacgagagcgataaatattacgcagactcggtcaagggcaggttcacgatctcgcgcgataactcgaaaaataccttgagcctgcaaatgaactcgctaagggtcgaggacacggccgtgtactattgcgcgaaagaggtcggggaaaataaagatgacgagtgggcggccccggactattacgatttctcgatcgcgtacccggtccaggacccgcgcgcggtcgtgggcgggttcgatatctggggccagggcacgatggtgaccgtgagctcg

SEQ ID NO: 55689 - RNA, 432 nt, synthetic construct
  misc_feature 1..432: note = derived and/or modified sequence opt11 from anti-HIV_cap256-048-052573_VR-Chain
  source 1..432: mol_type = other RNA
caagtgaaattggtcgagagcgggggcggggtcgtacaaccgggcaggagcctgcgcttgagctgtgcagcgagcgggttctcgttctcgaactatgccatggactgggtcaggcaagcgccagggaaagggctcgagtgggtggccgtggtatcgagcgatggatcgaacaagaactatgccgatagcgtgaaagggcgctttaccataagcagggacaatagcaagaacacggtctatctccagatgaatagcttgcgcgcggaagataccgcggtctattactgtgccaaggacttgggcgcgaacaaggacgatgaatgggccacggactattacgattggtcgatcgcgtacccggtccatgacccgcgagcggtcgtgggcgtgttcgatatctggggacagggcacgctcgtgaccgtaagctcg

SEQ ID NO: 55690 - RNA, 432 nt, synthetic construct
  misc_feature 1..432: note = derived and/or modified sequence opt11 from anti-HIV_cap256-048-051477_VR-Chain
  source 1..432: mol_type = other RNA
caagagcaattggtcgagagcgggggcggggtcgtgcaaccgggcaggagcctgcgcttgagctgtgcagcgagcgggttcacgttctcgaactatgccatgcactgggtcaggcaagcgcccgggaaagggctcgagtgggtggccgcgatgtcgcacgatggctcggacaagtactatgccgatagcgtgaaagggcgctttaccataagcagggacaatagcaagaacacgctctatatgcagatgaatagcttgcgcgcggaagataccgcggtctattactgtgccaaggaccagggcgagagcgagaaagaggaatgggcctcggactattacgatctctcgatcgcgtacccgatccaggacccgcgcgcgatggtgggcgcgttcgatatctggggccagggcacgatggtaaccgtgagctcg

SEQ ID NO: 55691 - RNA, 432 nt, synthetic construct
  misc_feature 1..432: note = derived and/or modified sequence opt11 from anti-HIV_cap256-048-051299_VR-Chain
  source 1..432: mol_type = other RNA
caagtgcaactggtcgagagcggaggcggagtcgtacaaccgggccgcagcctgcgcctgagctgcgccgcaagcgggttcacattctcgaccttcggcatgcactgggtcaggcaagcgcccgggaaagggctcgagtgggtggccctgatctcacacgacggcaacaacaaatactacgccgacagcctgaaagggcgcttcacaataagcagagaaaacagcaagaacacactcttcctccagatgaacagcctacgcgcagaagacacctcagtctactactgcgccaaggacctgggcgacagcgaatgcgaagaatgggcctcagactactacgacttcgggaaagactacccatgcctgcacccacgcggagtcgtgggcacattcgacttctggggccacggcacaatggtgaccgtaagctca

SEQ ID NO: 55692 - RNA, 432 nt, synthetic construct
  misc_feature 1..432: note = derived and/or modified sequence opt11 from anti-HIV_cap256-048-050815_VR-Chain
  source 1..432: mol_type = other RNA
caagtgcaattggtcgagagcgggggaggggtcgtgcaaccgggcgggagcttgcgcttgagctgtgtcgtgagcgggttcacgttctcgagctatggcatgcactgggtcaggcaagcgcccgggaaagggctagagtgggtgagctttatcaggttcgatggcaattacgagtactatgtcgatagcgtgaaagggcgctttaccataagcagggacaatagcaagaacacggtctatctacagatggatagcttgcgcgcggaagatacagcggtctattactgtgccaaggacgtgggcgattacaaggacgatgaatgggccacggactattacgatttctcgatcgcgtacccggtcccggacccgcgcgcggtcgtgggcgcgttcgatttctggggccagggcacgatggtgaccgtgagctcg

SEQ ID NO: 55693 - RNA, 432 nt, synthetic construct
  misc_feature 1..432: note = derived and/or modified sequence opt11 from anti-HIV_cap256-048-049884_VR-Chain
  source 1..432: mol_type = other RNA
caagtgcaattggtcgagagcgggggcggggtcgtgcaaccgggcaggagcctgcgcttgagctgtgccgcgagcgggttctcattcaatacctatgccatgcactgggtcaggcaagcgcccgggaaagggctagagtggatggccctgatctcgtacgatggctcgaacaagtactatgtcgacagcgtgaaaggacgctttaccataagcagggacaatagcaagaacacgctctatctacagatgaatagcctgcgcgcggaagataccgcggtctattactgtgccaaggacctgggcgggaacaaggacgatgaatgggccacggactattacgatctctcgatcgcgtacccggtccaggacccgcgcgtggtagtgggcatattcgatatctggggccagggcacgatggtgaccgtgagctcg

SEQ ID NO: 55694 - RNA, 432 nt, synthetic construct
  misc_feature 1..432: note = derived and/or modified sequence opt11 from anti-HIV_cap256-048-049170_VR-Chain
  source 1..432: mol_type = other RNA
caagtgcaattggtcgagagcgggggcggggtcgtgcaaccgggaaggagcttgcgcttgagctgtgccgcgagcgggttcatattctcgagctatggaatgcactgggtcaggcaagcgcccgggaaagggctcgagtgggtggccgtgatctcgggcgatggcacgaaaaaggactttgccgatagcgtgaaagggcgctttaccataagcaaggacaatagcaagaacatggtctcgctccagatgaatagcttgcgcgcggaagatgccgcggtctattactgtgccaaggacctgggcgagagcgataacgaggaatggccctcggactattacgatttcgggcgcgatttcacgggccagaacccgcgcgcggtcgtgggcacgttcgatctctggggccagggcacgatggtgaccgtgagctcg

SEQ ID NO: 55695 - RNA, 435 nt, synthetic construct
  misc_feature 1..435: note = derived and/or modified sequence opt11 from anti-HIV_cap256-048-048531_VR-Chain
  source 1..435: mol_type = other RNA
caagtgcaattggtcgagagcgggggcggggtcgtgcaaccgggcaggagcttgcgcctgagctgtgccgcgagcgggttcacgttctcgagctatggcctgcactgggtcaggcaagcgcccgggaaagggctagaatgggtggcctttatctcgtacgatggcaataacaagcactatgtcgatagcgtgaaagggcgatttaccataagcagggacaatagcaagaacacgctctatctccagatgaatagcctgcgcgcggaagataccgcggtctattactgtgccaaggacctgggcggggaatcggaaatagaagagtgggcgaccgattactatgactttagcatagcctatcccgtgaaagagagcaggggcgtggtcgggatctttgacatgtgggggcaagggaccatggtcacggtctcgagc

SEQ ID NO: 55696 - RNA, 432 nt, synthetic construct
  misc_feature 1..432: note = derived and/or modified sequence opt11 from anti-HIV_cap256-048-048259_VR-Chain
  source 1..432: mol_type = other RNA
caagtgcaattggtcgagagcgggggcggggtcgtgcaaccgggaaggagcttgcgcctgagctgtgccgcgagcgggttcacgttctcgacctgtgccatgcactgggtaaggcaagcgcccgggaaagggctcgagtgggtggccgtgatctcgtacgatggctcgaacaagtactatgtcgatagcgtgaaagggcgctttaccataagcagggacaatagcaagaacacgctctatctacagatgaatagcctgcgcgcggaagataccgcggtctattactgtgcaaaggaagtggacataaacaaggaagatgaatgggcctcggactattacgatttctcgatcgcgtacccggtccaggacccgcgagcggtcgtgggcgggttcgatatctggggccagggcacgatggtgaccgtgagctcg

SEQ ID NO: 55697 - RNA, 432 nt, synthetic construct
  misc_feature 1..432: note = derived and/or modified sequence opt11 from anti-HIV_cap256-048-047313_VR-Chain
  source 1..432: mol_type = other RNA
caagtgcaattggtcgagagcgggggcggggtcgtgcaaccgggcaggagcttgcgcctgagctgtgccgcgagcgggttcacgttctcgacatttggcatgcactgggtcaggcaagcgcccgggaaagggctcgagtgggtggccgtaatctcacacgatggcaataacaagtactatgccgatagcgtgaaagggcgctttaccataagcagggacaatagcaagaacacggtctatctccagatgaatagcttgcgcgcggaagataccgcggtctattactgtgccaaggacttgggcgcgaacaaggacgatgaatgggccacggactattacgatctctcggtcgcgtacccggtcccggacccgcgcgcggtcgtgggcgcgttcgatgtctggggccagggcacgatggtgaccgtaagctcg

SEQ ID NO: 55698 - RNA, 432 nt, synthetic construct
  misc_feature 1..432: note = derived and/or modified sequence opt11 from anti-HIV_cap256-048-046596_VR-Chain
  source 1..432: mol_type = other RNA
caagtgcaattggtcgagagcgggggcggggtagtgcaaccgggcgggagcttgcgattgagctgtgccgcgagcgggttcacgttctcaagctatggcatgcactgggtcaggcaagcgcccgggaaagggctagagtgggtagcctttatgaggtttgatggctcgaacaggtactatggcgatagcgtgaaagggcgctttaccataagcagggacaatagcaagaacacgctctatctccagatgaatagcttgcgcacggaagatgccgcgctctattactgtgccaaggacatgcgcgagttcgagtgcgaggaatgggcctcggactattacgatttcgggcgcgattacccgtgccaggacccgcgcggggtcgtgggcatattcgatatctggggccagggcacgatggtgaccgtgagctcg

SEQ ID NO: 55699 - RNA, 432 nt, synthetic construct
  misc_feature 1..432: note = derived and/or modified sequence opt11 from anti-HIV_cap256-048-044781_VR-Chain
  source 1..432: mol_type = other RNA
caagtgcaactggtcgagagcgggggcggggtcgtgcaaccgggcagatcattgcgattgagctgtgccgcgagcgggttcacgttcacgagctatgccatacactgggtaaggcaagcgcccgggaaagggctcgagtgggtggccgtgatctcgtacgatggcagcaaaaagaactatgccgatagcgtgaaagggcgatttaccataagcagggacaatagcaagaacacgctctatgtccagatgaatagcctgcgcgcggaagataccgcggtctattactgtgccaaggaagtgggcgaggacaaggacgatgaatgggcctcggactattacgatctctcgatcgcatacccggtccatgacccgcgagcggtcgtgggagggttcgatatctggggccagggcacgatggtgaccgtgagctcg

SEQ ID NO: 55700 - RNA, 432 nt, synthetic construct
  misc_feature 1..432: note = derived and/or modified sequence opt11 from anti-HIV_cap256-048-042599_VR-Chain
  source 1..432: mol_type = other RNA
caagtgcaattggtcgagagcgggggcggggtcgtgcaaccgggccgcagcttgagattgagctgtgccgcgagcgggttcacgttctcgaactatggcatgcactgggtcaggcaaacgcccgggaaagggctcgagtgggtggccgtgatctcatacgatggatcgaacaagttctatgccgatagcgtgaaagggcgctttaccataagcagggacaatagcaagaacacgctctatctccagatgtcgagcttgcgcgcggacgataccgcggtctattactgtgccaaggaagtgggcgaggacaaggacgatgaatgggcctcggactattacgatctctcgatcgcgtacccggtccatgacccgcgcgcggtcgtgggcgggttcgatatctggggccagggcacgatggtgaccgtgagctcg

SEQ ID NO: 55701 - RNA, 432 nt, synthetic construct
  misc_feature 1..432: note = derived and/or modified sequence opt11 from anti-HIV_cap256-048-041276_VR-Chain
  source 1..432: mol_type = other RNA
caagtgcaactggtcgagagtgggggcggggtcgtgcaaccgggcaggagcttgcgcttgagctgtgccgcgagcaggttcacgttctcgagctatgccatgcactgggtcaggcaagcgcccgggaaagggctcgagtgggtggccataatctcgtacgacggctcgaacaagtactatgccgatagcgtgaaagggcgctttaccataagcagggacaatagcaagaacacgctctttctccagatgaatagcctgcgcgcggaagataccgcgctatattactgtgccaaggacttgggagggtacaagagcgatgaatgggccacggactattacgatctctcgatcgcgtacccgatccaggacccgcgcgcggtcgtgggcgcgttcgatatctggggccagggcacgatggtaaccgtgagctcg

SEQ ID NO: 55702 - RNA, 432 nt, synthetic construct
  misc_feature 1..432: note = derived and/or modified sequence opt11 from anti-HIV_cap256-048-040200_VR-Chain
  source 1..432: mol_type = other RNA
caagtgcaattggtcgagagcgggggcggggtcgtgcaaccgggcaggagcctgcgcttgagctgtgtcgcgagcgggttcacattctcgagctttggcatgcactgggtcaggcaagcgcccgggaaagggctcgagtgggtggcagtgatctcgcacgatggccataacaagtactatgccgatagcttgaaagggcgctttaccgtgagcagggaaaatagcaagaacacgctctttctccagatgaatagcttgcgcgcggaagatacctcggtctattactgtgccaaggacttgggcgggggcgagtgcgaggaatgggcctcggactattacgatttcgggcgcgattacccgtgcttgaccccgcgcggggtcgtgggcacgttcgatatctggggccatggcacgaccgtgaccgtgagctcg

SEQ ID NO: 55703 - RNA, 432 nt, synthetic construct
  misc_feature 1..432: note = derived and/or modified sequence opt11 from anti-HIV_cap256-048-039061_VR-Chain
  source 1..432: mol_type = other RNA
gaagtgcaattgctcggaagcggaggcgggctcgtgcaaccgggcgggagcctgcgcttgacctgtgccgtgagcgggttcacgttctcgagctttgccatgagctgggtcaggcaagcgcccgggaaagggctagagtgggtggccttgatctcgtacgatggcacggacaagtactatgcagatagcgtaaaagggcgcttcaccataagcagggacaatagcaagaacacgctctacctacagatgaatagcttgcgcgtggaagataccgcgatctatcactgtgccaaggacctgggcgggaccaagagcgatgaatgggcaacggactattacgatctctcgatcgcgtacccgatccaggacccaggcgcggtcgtgggcgtgttcgatatctggggccagggcacgatggtgaccgtaagctcg

SEQ ID NO: 55704 - RNA, 432 nt, synthetic construct
  misc_feature 1..432: note = derived and/or modified sequence opt11 from anti-HIV_cap256-048-038515_VR-Chain
  source 1..432: mol_type = other RNA
caagtgcaattggtcgagagcgggggcggggtcgtacaaccgggcaggagcttgcgcctgagctgtgccgcgagcgggttcacgttctcgacctatgccatgcactgggtcaggcaagcgcccgggaaagggctagagtgggtggtcgtgatatcgtacgatggctcgaacaagtactatgccgatagcgtgaaagggcgatttacaataagcagggacaatagcaagaacacgctctttctccagatgaatagcttgcgagcggaagataccgcgctctattactgtgccaaggacgtgggcgagtacaagagcgatgaatgggccacggactattacgatctctcgatcgcgtacccgatccaggacccgcgcgcgatggtgggcgcgttcgatatctggggccagggcacgatggtgaccgtgagctcg

SEQ ID NO: 55705 - RNA, 432 nt, synthetic construct
  misc_feature 1..432: note = derived and/or modified sequence opt11 from anti-HIV_cap256-048-038255_VR-Chain
  source 1..432: mol_type = other RNA
caagtgcaattggtcgagagcgggggcggggtcgtgcaaccgggcaggagcttgcgcttgagctgtgccgcgagcgggttcacgctctcaagctatgccatgcactgggtcaggcaagcgcccgggaaagggctcgagtgggtggccgtgatctcgtacgatggctcgaacaagtactatgccgatagcgtgaaagggcgctttaccataagcagggacaatagcaagaacgcgctctatctccagatgaatagcttgcgagcggaagataccgcgctctattactgtgccaaggacttgcgcgagtacgagtgcgaggaatgggcctcagactattacgatttcgggcgcgattacccgtgccaggacccgcgcggggtcgtgggcacgttcgatatctggggccagggcacgatggtgaccgtgagctcg

SEQ ID NO: 55706 - RNA, 432 nt, synthetic construct
  misc_feature 1..432: note = derived and/or modified sequence opt11 from anti-HIV_cap256-048-038177_VR-Chain
  source 1..432: mol_type = other RNA
caagtacaactcgtcgaatccggcggcggcgtcgtccaacccggacgctccctccgcctctcctgcgccgcatccggcttcaccttcaacacctacggcatccactgggtccgacaagcccccggcaaaggcctcgaatgggtcgccctcatctcctacgacggcaccgacaaatactacgccgactccgtcaaaggccgcttcaccatctcccgcgacaactccaaaaacaccctctacctccaaatgaactcactccgcgtcgaagacaccgccatctaccactgcgccaaagacctcggcggcaccaaatcagacgaatgggccacagactactacgacctctccatcgcctaccccatccaagaccccggcgccgtcgtcggcgtcttcgacatctggggccaaggcaccatggtcaccgtctcctcc

SEQ ID NO: 55707 - RNA, 432 nt, synthetic construct
  misc_feature 1..432: note = derived and/or modified sequence opt11 from anti-HIV_cap256-048-035513_VR-Chain
  source 1..432: mol_type = other RNA
caagtgcaattggtcgagagcgggggcggggtcgtgcaaccgggcaggagcttgagattgagctgtgccgcgagcgggttcacgttctcgagctatggcatggcctgggtcaggcaagcgcccgggaaagggctcgagtgggtgaccgtgatctcgttcgcgggcgtgaaaaagtactatgccgatagcgtgaaagggcgctttaccataagcagggacaatagcaagggcacgctctatctccagatggatggcttgcgaccggaagataccgcgctctattactgtgccaaggacttgggcgagcgcgagtgcgaggaatgggcctcggactattacgatttcgggcgcgatttcccgtgccaggacccgagaggggtcgtgggcacgttcgatatctggggccagggcacgatggtgaccgtgagctcg

SEQ ID NO: 55708 - RNA, 432 nt, synthetic construct
  misc_feature 1..432: note = derived and/or modified sequence opt11 from anti-HIV_cap256-048-034112_VR-Chain
  source 1..432: mol_type = other RNA
caaatgcaattggtcgagagcgggggcggagtagtgcaaccgggcaggagcctgcgcttgagctgtgccgcgagcgggttcacgttcaatagctatgccatgcactgggtcaggcaagcgcccgggaaagggctcgagtgggtggccgtgatctcgtacgatggctcgaacaagtactatgccgatagcgtgaaagggcgctttacaataagcagggacaacagcaagaacacagtctatctacagatgaatagcttgcgcggggtcgatacagcggtctattactgtgcaaaggacttgggcgggggcgaggtcgaggaatgggccacggactattacgattggtcgatcgcgtacccggtcgagcacccgcgcgcagtcgtgggcgtgttcgatatctggggccagggcacgaaagtgaccgtaagctcg

SEQ ID NO: 55709 - RNA, 432 nt, synthetic construct
  misc_feature 1..432: note = derived and/or modified sequence opt11 from anti-HIV_cap256-048-033983_VR-Chain
  source 1..432: mol_type = other RNA
caagtgcaattggtcgagagcgggggcggggtcgtgcaaccgggcgagagcttgcgcttaagctgtgccgcgagcgggttcacgctctcgagccatggcatacactgggtcaggcaagcgcccgggaaagggctcgagtgggtggcctttatctcgagcgatggctcgaacaagaactatggcgatagcgtgaaagggcgctttaccataagcagggacaatagcaagaacacgctctttctccagatgaatagcttgcgcgcggaagataccgcgctctattactgtgccaaggacgtgggcgagtacaagagcgatgaatgggccacggactattacgatctctcgatcgcgtacccgatccaggacccgcgcgcgatggtgggcgcgttcgatatctggggccagggcacgatggtgaccgtgagctcg

SEQ ID NO: 55710 - RNA, 432 nt, synthetic construct
  misc_feature 1..432: note = derived and/or modified sequence opt11 from anti-HIV_cap256-048-032688_VR-Chain
  source 1..432: mol_type = other RNA
caagtgcaattggtcgagagcgggggcggggtcgtgcaaccgggcaggagcttgcgcttgagctgtgccgcgagcgggttcatattcaatagctatggcatgcactgggtcaggcaagcgcccgggaaagggctcgagtgggtggccgtggtccatggagatggagggaacaagtactatgccgatagcgtgaaagggcgctttaccataagcagggacaatagcaagaacacgctctatctcgagatgaatagcttgcgagcggaagataccgcggaatattactgtgccaaggacttgggagagagcgataaagaggaatggccatcggactattacgatttcgggcgcgatttcacgggccaggtcccgcgcgcggtcgtgggcgcgttcgatatctggggccagggcacgatggtaaccgtgagctcg

SEQ ID NO: 55711 - RNA, 432 nt, synthetic construct
  misc_feature 1..432: note = derived and/or modified sequence opt11 from anti-HIV_cap256-048-031092_VR-Chain
  source 1..432: mol_type = other RNA
caagtgcaattggtcgagagcgggggcggggtcgtgcaaccgggcaggagcctgcgattgagctgtgccgcgagcgggttctcgttctataactttgccatggactgggtcaggcaagcgcccgggaaagggctcgagtgggtggccgtgatatcgagcgatggcgggaacaagaactatgtagatagcgtgaaagggcgctttaccataagcagggacaatagcaagaacacgctctatctccagatgaatagcttgcgcgcggaagataccgcggtctattactgtgccaaggacttgggcgggaccaaggacgatgaatgggccacggactattacgatatctcgatcgcgtacccggtacaggacccgcgcgcggtcgcgggagcgttcgatatctggggccagggcacgatggtgaccgtgagctcg

SEQ ID NO: 55712 - RNA, 435 nt, synthetic construct
  misc_feature 1..435: note = derived and/or modified sequence opt11 from anti-HIV_cap256-048-030464_VR-Chain
  source 1..435: mol_type = other RNA
caggtccagctcgtggaatcgggagggggcttggtcaagcccgggggctcgctcaggctatcgtgcgaggcctcgggctttagctttaccaattactatatgtcgtggatacgccaggccccgggcaagggcctggaatgggtcgcggtcatcagctttaacgggcgcaataaatattacgcggactttgtcaagggcaggttcacgatatcgcgagataactcgaaaaataccttgagcctgcaaatgaactcgctcagggtcgaggacacggccgtgtactattgcgcgaaagaggtcggggaaaataaagatgacgagtgggcggccccggactattacgatttctcaatcgcgtacccggtccaggacccgcgcgcggtcgtgggcgggttcgatatctggggccagggcacgatggtgaccgtaagctcg

SEQ ID NO: 55713 - RNA, 432 nt, synthetic construct
  misc_feature 1..432: note = derived and/or modified sequence opt11 from anti-HIV_cap256-048-030289_VR-Chain
  source 1..432: mol_type = other RNA
caagtgcaattggtagagagcgggggcggggtcgtgcaaccgggcgggagcttgcgcttgagctgtgccgcgagcgggttcacgttctcgagctatggcatgcactgggtaaggcaagcgcccgggaaagggctcgagtgggtggcctttatcaggtacgacggctcgaacaagtactatgcagatagcgtgaaagggcgattcaccataagcagggacaatagcaagaacacggtctatctccagatgaatagcttgcgagtggaagataccgcggtctattactgtgccaaggacttgggcgcgaacaaggacgatgaatgggccacggactattacgatctctcggtcgcgtacccggtcccggacccgcgcgcggtcgtgggcgcgttcgatgtctggggacagggcacgatggtgaccgtgagctcg

SEQ ID NO: 55714 - RNA, 432 nt, synthetic construct
  misc_feature 1..432: note = derived and/or modified sequence opt11 from anti-HIV_cap256-048-030261_VR-Chain
  source 1..432: mol_type = other RNA
caagtgcaattggtcgagagcggaggcggggtcgtgcaaccgggcgggagcctgcgcttgagctgtgccgcgagcgggttcacgttctcaacatttggcatgcactgggtaaggcaagcgcccgggaaagggctcgagtgggtggccgtgatctcgcacgatggctcgaacaagtactatgccgatagcctgaaagggcgctttaccataagcagggaaaatagcaagaacacgctatatctccagatgaatagcttgcgcctggaagataccgcggtctatcactgtgcaaaggacttgggcgggagcaagagcgatgaatgggcaacggactattacgatctctcggtcgcgtacccggtccaggacccgcgcgcggtcgtgggcgtattcgatatctggggccagggcacgatggtgaccgtgagctcg

SEQ ID NO: 55715 - RNA, 432 nt, synthetic construct
  misc_feature 1..432: note = derived and/or modified sequence opt11 from anti-HIV_cap256-048-029362_VR-Chain
  source 1..432: mol_type = other RNA
caagtgcaattggtcgagagcgggggcggggtcgtgcaaccgggcaggagcctgcgcttgagctgtgccgcgagccagttcacgttctcgagctacggcatgcactgggtcaggcaagcgcccgggaaagggctcgagtgggtggccgggatctcgttcgcgggcacaaacaagtactatgcagatagcgtgaaagggcgctttaccataagcagggacaatagcaagaacacgctctatctccagatgaatagcttgcgaacggaagatgccgcgctctattactgtgccaaggacatgcgagagttcgagtgcgaggaatgggcctcagactattacgatttcgggcgcgattacccgtgccaggacccgcgcggggtcgtgggcatattcgatatctggggacagggcacgatggtgaccgtgagctcg

SEQ ID NO: 55716 - RNA, 432 nt, synthetic construct
  misc_feature 1..432: note = derived and/or modified sequence opt11 from anti-HIV_cap256-048-027638_VR-Chain
  source 1..432: mol_type = other RNA
caagtgcaattggtcgagagcgggggcggggtcgtgcaaccgggcaggagcttgcgcttgagctgtgtcgcgagcgggttcatattctcgagctatggaatacactgggtcaggcaagcgcccgggaaagggctcgagtgggtggcagtgatctcgggcgatggcacgaacaagtactgtgccgatagcgtgaaagggcgctttaccataagcagggacaatagcaagaacacggtctttctccagatgaatagcttgcgcgcggaagataccgcggtcttttactgtgccaaggacctgggcgagagcgataaagaggaatggccatcggactattacgatttcgggcgcgatttcacgggccaggtcccgcgcgcggtcgtgggcgcgttcgatatctggggccagggcacgatggtgaccgtgagctcg

SEQ ID NO: 55717 - RNA, 432 nt, synthetic construct
  misc_feature 1..432: note = derived and/or modified sequence opt11 from anti-HIV_cap256-048-027613_VR-Chain
  source 1..432: mol_type = other RNA
gtccagcaattggtcgagagcgggggcgatgtcgtgcaaccgggaacgagcctgagattgagctgtgaagcgagcgggctaatactctcgggctatggattgcactgggtcaggcaagcgccagggaaagggatggagtgggtggccgtgatctcgtacgacggctcgaacaagtactatgccgatagcgtgaaagggcgctttaccataagcagggacaatagcaagaacacggtctatcttcagatgaatagcttgcgcggggtcgataccgcggtctattactgtgccaaggacttgggagggggcgaggtcgaggaatgggccacggactattacgattggtcgaccgcgtacccggtagagcacccgcgagcggtcgtgggagtgttcgatatctggggccagggcacgaaagtgaccgtgagctcg

SEQ ID NO: 55718 - RNA, 432 nt, synthetic construct
  misc_feature 1..432: note = derived and/or modified sequence opt11 from anti-HIV_cap256-048-026627_VR-Chain
  source 1..432: mol_type = other RNA
caagtgcaattgctcgggagcgggggcgggagcgtgcaaccgggcgggagcttgcgcttgacctgtgccgtgagcgggttcacgttctcgagctttgccatgagctgggtcaggcaagcgcccgggaaagggctcgagtgggtggcctttatctcgagcgatggcacgaacaagaactatggcgatagcgtgaaagggcgctttaccataagcagggacaatagcaagaacacgctctttctccagatgaatagcctgcgcgcggaagataccgcgctatattactgtgccaaggacttgggcgggtacaagagcgatgaatgggccacggactattacgatctctcgatcgcgtacccgatccaggacccgcgagcggtcgtgggcgcgttcgatatctggggccagggcacgatggtgaccgtgagttcg

SEQ ID NO: 55719 - RNA, 432 nt, synthetic construct
  misc_feature 1..432: note = derived and/or modified sequence opt11 from anti-HIV_cap256-048-026239_VR-Chain
  source 1..432: mol_type = other RNA
caaatgcaattggtcgagagcgggggcggggtcgtgcaaccgggcaggagcttgcgcttgagctgtgccgcgagcgggttcacgttcaatagctatgccatgcactgggtcaggcaagcgcccgggaaagggctcgagtgggtggccgtgatctcgtacgatggctcgaacaagtactatgccgatagcgtgaaagggcgctttaccataagcagggacaatagcaagaacacgctctatctccagatgaatagcttgcgcacggaagatgccgcgctctattactgtgccaaggacatgagagagttcgagtgcgaggaatgggcctcggactattacgatttcgggcgcgattacccgtgccaggacccgcgcggggtcgtgggcatattcgatatctggggccagggcacgatggtgaccgtgagctcg

SEQ ID NO: 55720 - RNA, 432 nt, synthetic construct
  misc_feature 1..432: note = derived and/or modified sequence opt11 from anti-HIV_cap256-048-025518_VR-Chain
  source 1..432: mol_type = other RNA
caagtccaactcgtcgaatccggcggcggcgtcgtccaacccggccgatccctccgactctcatgcgccgtctccggcttcaccttctcccaacacgccatgcactgggtccgccaagcccccggcaaaggactcgaatgggtcaccctcatctccaacgacggcaccgaaaaattctacgccgactccgtcaaaggccgcttcaccatctcacgcgacaactccaaaaacacactatacctccaaatgaactccctctccgtcgaagacaccgccgtctactactgcgccaaagacctcggcaaaaacaaagacgacgaatgggccaccgactactacgacatctcaatcgcctaccccgtccccgacccccgagcagtcgtcggcgtcttcgacatctggggccaaggcaccgtcgtcaccgtatcctcc

SEQ ID NO: 55721 - RNA, 432 nt, synthetic construct
  misc_feature 1..432: note = derived and/or modified sequence opt11 from anti-HIV_cap256-048-024854_VR-Chain
  source 1..432: mol_type = other RNA
caagtgcaattggtcgagagcgggggcggggtcgtgcaaccgggcaggagcctgaccttgagctgtgccgcgagcgggttcacgttcaataactatgacatgcactgggtcaggcaagcgcccgggaaagggctcgagtgggtggcctttaccaggtacgatggctcgaaccagtactatgccgatagcgtgaccgggcgctttacaataagcagggacaatagcaagaacacggtatatctccagatgaatagcctgcgaggggtcgataccgcggtctattactgtgccaaggacttgggcgggggcgaggtagaggaatgggcaacggactattacgattggtcgatcgcgtacccggtcgagcacccgcgcgcggtcgtgggagtgttcgatatctggggccagggcacgaaagtgaccgtgagctcg

SEQ ID NO: 55722 - RNA, 432 nt, synthetic construct
  misc_feature 1..432: note = derived and/or modified sequence opt11 from anti-HIV_cap256-048-024537_VR-Chain
  source 1..432: mol_type = other RNA
caagtgcaattggtagagagcgggggcgcggtcgtgcaaccgggcaggagcttgcgcttgagctgtgtcgcgagcgggttcacgttctcgagctatgccatgcactgggtcaggcaagcgcccgggaaagggctcgattgggtggccttgatatcgtacgatggctcgaacaagtactttgccgatagcgtgaaagggcgatttgccataagcagggacaatagcaagaacacgctctatctccagatgaatagcctgcgcccggaagataccgcggtctattactgtgccaaggacttgggcgggggcgagtgcgagacctgggcctcggactattacgatttcgggaaagattacccgtgcttggacccgcgcgatgtcgtgggcacgttcgatatatgggtccagggcacgctcgtgaccgtgagctcg

SEQ ID NO: 55723 - RNA, 432 nt, synthetic construct
  misc_feature 1..432: note = derived and/or modified sequence opt11 from anti-HIV_cap256-048-021781_VR-Chain
  source 1..432: mol_type = other RNA
caagtgcacttggtcgagagcgggggcgggctcgtgaaaccgggcgggagcttgcgcttgagctgtgaagcaagcgggttctcgttctcgaactatgccatggactgggtcaggcaagcgcccgggaaagggctcgagtgggtggcctttgtatcgagcgatggctcgaacaagaactatgccgatagcgtgaaagggcgctttaccataagcagggacaacagcaagaacacggtctatctacagatgaatagcttgcgcgtggaagataccgcggtctattactgtgccaaggacttgggagcgaacaaagacgatgaatgggccacggactattacgatctatcggtcgcgtacccggtcccggacccacgcgcggtcgtgggcgcgttcgatgtctggggccagggcacgatggtgaccgtgagctcg

SEQ ID NO: 55724 - RNA, 432 nt, synthetic construct
  misc_feature 1..432: note = derived and/or modified sequence opt11 from anti-HIV_cap256-048-021758_VR-Chain
  source 1..432: mol_type = other RNA
caagtgcaactggtcgagagcgggggcggggtcgtgcaaccaggcaggagcctgcgattgagctgtgccgcgagcgggttcacgttctcgcgctatggcatgcactgggtcaggcaagcgcccgggaaagggctcgagtgggtggccgtgatctcgtacgatggatcgaaagagtactatgccgatagcgtgaaagggcgctttaccataagcagggacaatagcaaggacacgctctatctccagatgtcgagcttgcgagtggaagataccgcggtctattactgtgccaaggacgtgggagcgaacaaggacgatgaatgggccacggactattacgatctatcgatcgcgtacccggtcccggacccgcgcgcggtcgtaggcgcgttcgatatctggggccagggcacgatggtgaccgtgagctcg

SEQ ID NO: 55725 - RNA, 432 nt, synthetic construct
  misc_feature 1..432: note = derived and/or modified sequence opt11 from anti-HIV_cap256-048-020988_VR-Chain
  source 1..432: mol_type = other RNA
caagtgcaattggtcgagagcgggggcggggtcgtgcaaccgggcaggagcttgcgcttgagctgtgaagcgagcgcgttcacgttctcgagctatggcatgcactgggtcaggcaagcgcccgggaaagggctcgagtgggtgacctttatctcgtactcgggcaataacaagtactatgccgatagcgtgaaagggcgatttaccgtgagcagggacaatagcaagaacacgctctatctccagatgaatagcttgacctcggaagataccgcggtctattactgtgccaaggacttgggcggaagcaagaccgatgaatggggcacggactattacgagttctggaacgcgtacccggtacaggacccgcgcgtggtcgtgggcgcgttcgatatctggggccatggcacgatggtgaccgtgagctcg

SEQ ID NO: 55726 - RNA, 435 nt, synthetic construct
  misc_feature 1..435: note = derived and/or modified sequence opt11 from anti-HIV_cap256-048-020663_VR-Chain
  source 1..435: mol_type = other RNA
caagtacaactcgtagaaagcgggggcggggtcgtacaaccgggcatgagcctacgcctaagctgcgccgcgagcgggttcacattctccaacttcggcatgcactgggtcagacaagcccccggaaagggactagaatgggtggccgtaatctcacacgacggcaacaacaaatactaccccgacagcgtacaagggcgcttcaccataagcagagaaaacagcaaaaacacgctctacctccaaatgaacagcctgaaaccagaagacaccgcggtctacttctgcgccaaggacctgggcggagaatcggaagtggaagagtgggcaagcgactactacgacttcggcagggacatacccgggcccgaccccagaggcgtagtcggaacactagacatatggggacacgggaccatggtcacagtctcgagc

SEQ ID NO: 55727 - RNA, 432 nt, synthetic construct
  misc_feature 1..432: note = derived and/or modified sequence opt11 from anti-HIV_cap256-048-020590_VR-Chain
  source 1..432: mol_type = other RNA
caagtgcaattggtcgagagcgggggaggggtcgtgcaaccgggcggagtcccgcgattggcctgtgccgcgagcgggttcacgttctcgagctatgccatgcactgggtaaggcaagcgcccgggaaagggctcgagtgggtgaccgtaatctcgtacgatggctcgaacaagtactatgccgatagcgtgaaagggcgatttaccataagcagggacaatagcaagaacacgctatatctccagatgaatagcttgcgcgcggaagataccgcggtctattactgtgccaaggacttgggcgggaccaaggacgatgaatgggccacggactattacgatatctcgatcgcgtacccggtccaggacccgcgcgcggtcgcgggcgcgttcgatatctggggccagggcacgatggtgaccgtgagctcg

SEQ ID NO: 55728 - RNA, 432 nt, synthetic construct
  misc_feature 1..432: note = derived and/or modified sequence opt11 from anti-HIV_cap256-048-019765_VR-Chain
  source 1..432: mol_type = other RNA
caagtgcaattggtcgagagcgggggcggggtcgtgcaaccgggcaggagcttgcgcttgagctgtgccgcgagcgggttcatattcacgaactatgccatggactgggtcaggcaagcgcccgggaaagggctcgagtgggtggccgtgatctcgagcgatggctcgaacaagaactatgccgatagcgtgaaagggcgatttaccataagcagggacaatagcaagaacacggtctcgctccagatgaatagcttgcgcgcggaagataccgcggtctattactgtgccaaggacttgggcgatagcaagaaagatgaatgggccacggactattacgatctctcgatcgcgtacccggtcccggacccgagagcggtcgtgggcgcgttcgatatctggggccagggcacgatggtgaccgtgagctcg

SEQ ID NO: 55729 - RNA, 432 nt, synthetic construct
  misc_feature 1..432: note = derived and/or modified sequence opt11 from anti-HIV_cap256-048-019254_VR-Chain
  source 1..432: mol_type = other RNA
caagtgcaattggtcgagagcgggggcggggtcgtgcaaccgggcaggagcctgcgactgagctgtgccgcgagcgggttcacgagctcgacctatgccatgcactgggtcaggcaagcacccgggaaagggctcgagtgggtagccctgatctcgtacgatggcacagacaagtactacgccgacagcgtgaaagggcgcttcaccataagcagggacaatagcaagaacacgctctatctccagatgaatagcttgcgcgtggaagacaccgcggtctatcactgtgccaaggacctgggcgggaacaagcccgatgaatgggccacggactactacgacctctcgatcgcatacccggtccaggacccgcgcgcagtcgtaggcgtgttcgacatctggggccaaggcacaatcataaccgtgagctcg

SEQ ID NO: 55730 - RNA, 432 nt, synthetic construct
  misc_feature 1..432: note = derived and/or modified sequence opt11 from anti-HIV_cap256-048-018073_VR-Chain
  source 1..432: mol_type = other RNA
caagtgcaactggtcgagagcgggggcggggtcgtgcaaccgggcaggagcttgcgcctgagctgtgccgcgagcgggttctcgctctcaagctatgccatggactgggtcaggcaagcgcccgggaaagggctcgagtgggtggccgtgatctcgagcgatggcacgaacaagtactatgccgatagcgtgaaagggcgctttaccataaccagggacaatagcaagaacacgctatatctacagatgaatagcttgcgcgtggaagataccgcgctctattactgtgccaaggacatgggcgagagcgagaaagaggaatgggcctcggactattacgatttcgggcgagatatcccgggccaggacccgcgcggggaagtgggatcgttcgatatctggggccagggcacgatggtgaccgtaagctcg

SEQ ID NO: 55731 - RNA, 432 nt, synthetic construct
  misc_feature 1..432: note = derived and/or modified sequence opt11 from anti-HIV_cap256-048-016775_VR-Chain
  source 1..432: mol_type = other RNA
gaagtgcaattggtcgagttcgggggcgggctcgtgcaaccgggcaggagcttgcgattgagctgtgccgcgagcgcgttcacgttctcgcactatggcatacactgggtaaggcaagcgcccgggaaagggctcgagtgggtggccgtgatctcgcacgatggctcgacaaaggactatgccgatagcgtgaaagggcgctttaccataagcagggacaatagcaagaacacgatgtacctccagatgaatagcttgcgcgcggaagataccgcggtctattactgtgccagggacttgggcgagagcgagaccgaggaatgggccacggactattacgatttctcgatcgcgtacccggtccagaacccgcgaggggtcataggcgtgctcgatatctggggcttgggcacgatggtgaccgtgagctca

SEQ ID NO: 55732 - RNA, 432 nt, synthetic construct
  misc_feature 1..432: note = derived and/or modified sequence opt11 from anti-HIV_cap256-048-016069_VR-Chain
  source 1..432: mol_type = other RNA
caggtccagctcgtggaatcaggcgggggcgtagtccagcccgggcgctcgctcaggctctcatgcgcggcctcgggctttacctttagcaagtacgcgatgcattgggtgcgacaggccccgggcaagggcctggaatgggtcgcgttcgtggcatttgacgagagcgcaaaattttacgcggactcggtcaagggcagattcacgatctcgcgcgataactcgaaaaataccctgagcctgcaaatgaactcgctcagggccgaggacacggccgtgtactattgcgcgaaagaggtcggggaaaataaagatgacgagtgggcgagcgattactatgacttaagcatagcctatcccgtgcacgatcccagggccgtggtcgggggctttgacgtgtgggggcaagggaccatggtcacggtctcgagc

SEQ ID NO: 55733 - RNA, 432 nt, synthetic construct
  misc_feature 1..432: note = derived and/or modified sequence opt11 from anti-HIV_cap256-048-015867_VR-Chain
  source 1..432: mol_type = other RNA
caagtgcaattggtcgagagcgggggcggggtcgtgcaaccgggaaggagcttgcgcttgagctgtagcgcgagcgggttctcgttcacgaactatgccatggactgggtcaggcaagcgcccgggaaagggctcgagtgggtagccgtgatctcaagcgatggctcaaacaagaactatgccgatagcgtgaaagggcgctttaccataagcagggacaatagcaagaacacgctctttctccagatgaatagcctgcgcccggaagataccgcggtctatttctgtgccaaggacttgggcgcgaacaaggacgatgaatgggccacggactattacgatctatcgatcgcgtacccggtccatgacccgcgcgcggtcgtgggaatattcgatctctggggccagggaacgatggtgaccgtgagctcg

SEQ ID NO: 55734 - RNA, 432 nt, synthetic construct
  misc_feature 1..432: note = derived and/or modified sequence opt11 from anti-HIV_cap256-048-015673_VR-Chain
  source 1..432: mol_type = other RNA
caagtgcacttggtcgagagcgggggcggggtcgtgcaaccgggcaggagcctgcgcttgagctgtgccgcgagcgggttcacgttctcgaactttgccatgggctgggtcaggcaagcgcccgggaaagggctcgagtgggtggcctttatctcgagcgatggcacgaacaagaactatggcgatagcgtgaaagggcgctttaccataagcagggacaatagcaagaacacgctctttctccagatgaatagtctgcgcgcggaagataccgcgctctattactgtgccaaggacttgggcgggtacaagagcgatgaatgggccacggactattacgatctctcgatcgcgtacccgatccaggacccgcgcgcggtcgtgggcgcgttcgatatctggggccagggcacgatggtgaccgtgagctcg

SEQ ID NO: 55735 - RNA, 432 nt, synthetic construct
  misc_feature 1..432: note = derived and/or modified sequence opt11 from anti-HIV_cap256-048-015156_VR-Chain
  source 1..432: mol_type = other RNA
caagtccaactcgtcgaatccggcggcggcgtcgtccaacccggccgctccctacgcctctcatgcgccgcctccggcttcaccttctccgtctacgctctacactgggtccgccaaacccccggcaaaggcctcgaatgggtcgccctaatctcctacgacggcaccaacaaatactacgtcgactccgtcaaaggccgattcaccatctcccgcgacaactccaaaaacaccctctacctccaaatgaactccctaaccgccgaagacaccgccgtatactactgcgccaaagacctcggcggctccaaaaacgacgaatgggccaccgactactacgacctctcaatcgcctaccccatccaagacccccgcgccgtcgccggaatcttcgacgtctggggccgcggcaccatggtcaccgtctcctcc

SEQ ID NO: 55736 - RNA, 432 nt, synthetic construct
  misc_feature 1..432: note = derived and/or modified sequence opt11 from anti-HIV_cap256-048-014521_VR-Chain
  source 1..432: mol_type = other RNA
gaagtgcaattggtcgagagcgggggcgggctcgtgcaaccgggcaggagcctgcgcttgagctgtgccgcgagcgggttcatattctcgagctatggcatacactgggtcaggcaagggcccgggaaagggctcgagtgggtggccttgatctcgggcgatggcaataacaagtactatgccgatagcgtgcaagggcgatttagcataagcagggacaatagcaagaacacgctctatctccagatgaatagcttgcgcgcggaagataccgcggtctattactgtgccaaggacttgggcgagagcgataaagaggaatggccctcggactattacgatttcgggcgcgatttcacgggccaggacccgagagcggtagtgggcgtgttcgatatctggggccagggcacgaccgtgatcgtgagctcg

SEQ ID NO: 55737 - RNA, 432 nt, synthetic construct
  misc_feature 1..432: note = derived and/or modified sequence opt11 from anti-HIV_cap256-048-014475_VR-Chain
  source 1..432: mol_type = other RNA
caagtccaactcgtcgaatccggcggcggcgtcgtccaacccggccgctcactacgcctctcctgcgccgcctccggcttcaccttcaacacattcggcatgcactgggtcagacaagcccccggaaaaggcctcgaatgggtcgccgtcatctcccacgacggcaacaacaaatactacgccgactccctcaaaggccgcttcaccatctcccgcgaaaactccaaaaacaccctcttcctccaaatgaactccctccgcgccgaagacacctcagtctactactgcgccaaagacctcggccacggcgaatgcgaagaatgggcctccgactactacgacttcggaaaagactacccctgcctaacaccccgaggcgtcgccggcaccttcgacatctggggccacggaaccaccgtcaccgtctcctca

SEQ ID NO: 55738 - RNA, 432 nt, synthetic construct
  misc_feature 1..432: note = derived and/or modified sequence opt11 from anti-HIV_cap256-048-013798_VR-Chain
  source 1..432: mol_type = other RNA
caagtgcaattggtcgagagcgggggcggggtcgtgcaaccgggcaggagcttgcgcctgagctgtgcagcgagcgggttcacgttcaataactatggcacgcactgggtcaggcaagcgcccgggaaagggctcgagtgggtggccgtgatctcggactcgggctcgaacaagtactatgccgatagcgtgaaagggcgctttaccataagcagggacaatagcaagaacacgctctatctccagatgaatagcttgcgcgcggaagataccgcggtctatttctgtgccaaggacttgggcgggcgcgagaccgaggaatgggcctcggactattacgatttcgggcgcgatttcccgggccaggaccagcgcgcagtcgcgggcgtgttcgatatgtggggccagggcacgatggtgaccgtgagctcg

SEQ ID NO: 55739 - RNA, 432 nt, synthetic construct
  misc_feature 1..432: note = derived and/or modified sequence opt11 from anti-HIV_cap256-048-013271_VR-Chain
  source 1..432: mol_type = other RNA
gaagtgcaattggtcgagagcgggggcggggtcgtgcgcccgggcgggagcttgcgcttgagctgtgccgcgagcgggttcatattctcgagctatggcatacactgggtcaggcaagcgcccgggaaagggctcgagtgggtggccgtgatctcgggcgatggcacgaacaagtactgtgccgacagcgtgaaagggcgctttaccataagcagggacaatagcaagaacacgctctatctccagatcaatagcttgcgcgtggaagataccgcggtctattactgtgccaaggacttgggcaagaacaaggacgatgaatgggccacggactattacgatctctcgatagcgtacccggtcccggacccgcgcgcggtcgtgggcgtgttcgatatctggggccagggcacggtcgtgaccgtgagctcg

SEQ ID NO: 55740 - RNA, 432 nt, synthetic construct
  misc_feature 1..432: note = derived and/or modified sequence opt11 from anti-HIV_cap256-048-013180_VR-Chain
  source 1..432: mol_type = other RNA
caagtgcaactggtcgagagcgggggcggggtcgtgcaaccgggcaggagcttgcgcttgagctgtgccgcgagcgggttcacgttctcgaaaaatggcatgcactgggtcaggcaagcgccagggaaagggctcgagtgggtggcctttgtcgcgttcgatggatcggacaagtactatgccgatagcgtgaaagggcgctttgtcataagcagggacaatagtaagaacacgctctcgctccagatgaatagcttgcgcgcggaagataccgcggtctattactgtgccaaggaagtgggcgaggacaaggacgatgaatgggcctcggactattacgatctctcgatcgcgtacccagtacatgacccgcgagcggtcgtgggcgggttcgatatctggggccagggaacgatggtgaccgtgagctcg

SEQ ID NO: 55741 - RNA, 432 nt, synthetic construct
  misc_feature 1..432: note = derived and/or modified sequence opt11 from anti-HIV_cap256-048-012148_VR-Chain
  source 1..432: mol_type = other RNA
caagtgcaattggtcgagagcgggggcggagtcgtgcaaccgggcaggagcttgcgattgagctgtgccgcgagcgggttcacgttcacgcactatgccatggactgggtcaggcaagcgccagggaaagggctagagtgggtggccgtgatctcgagcgatggctcgagcaagaactatgccgatagcgtacgcgggcgctttaccataagcagggacaatagcaagaacacgctatcgctattgatgaatggattgcgcccggaagataccgcggtctattactgtgccaaggacgtgggcgatgtcaagaacgatgaatgggccacggactattacgatctctcgatcgcgtacccggtacaggacccgcgagcggtcgtgggcgcgttcgatttctggggccagggcacgatggtgaccgtgagcgcg

SEQ ID NO: 55742 - RNA, 432 nt, synthetic construct
  misc_feature 1..432: note = derived and/or modified sequence opt11 from anti-HIV_cap256-048-011870_VR-Chain
  source 1..432: mol_type = other RNA
caagtgcaattggtcgagagcgggggcggggtcgtgcaaccgggcaggagcttgcgcttgagctgtgccgtgagcgggttcacgttctcgttctatggcatgcactgggtcaggcaagcgcccgggaaagggctcgagtgggtggccgtgatctcgtacgatggcaataacaagtactatgtcgatagcgtgaaagggcgctttatcataagcagggacaatagcaagaacacgctctatctccagatgaatagcttgcgcgtggaagataccgcggtctattactgtgccagggacttgggcgagcgcgagaacgaggaatgggccacggactattacgatttctcgatcgcgtacccgatcgagggcccgcgcggggtcgtgggcgtgttcgatatctggggcaggggcacgatggtgaccgtgagctcg

SEQ ID NO: 55743 - RNA, 432 nt, synthetic construct
  misc_feature 1..432: note = derived and/or modified sequence opt11 from anti-HIV_cap256-048-011530_VR-Chain
  source 1..432: mol_type = other RNA
caagtgcacttggtcgagagtgggggcggggtagtgcaaccgggcaggagcttgcgcttgagctgtgccgcgagcgggttctcgttcaggaactatgccatggactgggtcaggcaagcgcccgggaaagggctcgagtgggtggccgtgatctcgagcgatggctcagacaagcactatgccgatagcgtgcgcgggcgctttaccataagcagggacaatagcaagaacacgctctatctccagatgaatagcttgcgcgtggaagatacagcggtctattactgtgccaaggacttgggcgcgaacaagaacgatgaatgggccacggactattacgatttctcgatcgcgtacccggtcccggacccgcgcgcggtagtgggagcgttcgatatctggggccagggcacgatggtgaccgtgagctcg

SEQ ID NO: 55744 - RNA, 432 nt, synthetic construct
  misc_feature 1..432: note = derived and/or modified sequence opt11 from anti-HIV_cap256-048-010968_VR-Chain
  source 1..432: mol_type = other RNA
caagtgcaattggtcgagagcgggggcggggtcgtgcaaccgggcaggagcttgcgcctgagctgtgccgcgagcgggttcatattctcgagctatggcatgcactgggtcaggcaagcgcccgggaaagggctcgagtgggtggccttgatctcaggcgatggctcgaacaagtactatgccgatagcgtgaaagggcgctttaccataagcagggacaatagcaagaacacgctatatctccagatgaatagcttgcgcgcggaagatagcgcgctctatttctgtgccaaggacttgggcgagagtgataaagaggaatggccctcggactattacgatttcgggcgcgatttcacgggccaggtcccgcgcgcggtcgtgggcatattcgatatgtggggccagggaacgatggtgaccgtgagctcg

SEQ ID NO: 55745 - RNA, 426 nt, synthetic construct
  misc_feature 1..426: note = derived and/or modified sequence opt11 from anti-HIV_cap256-048-010224_VR-Chain
  source 1..426: mol_type = other RNA
gaagtgcacttggtcgagagcgggggcgatctcgtgcaaccgggcgggagcttgcgcttgagctgtgtcgtgagcgagttcacgttctcgagctatggcatgcactgggtcaggcaagcgcccgggaaagggctcgagtgggtggcctttatcaggtacgatggctcgaacaagtactatgccgatagcgtgaaagggcgctttaccataagcagggacaatagcaaggtctatctcgagatgaatagcttgcgcgcggaagataccgcggtctattactgtgccaaggaagtgggcgagaacaaggacgatgaatgggcctcggactattacgatctctcgatcgcgtacccgatccatgacccgcgcgcggtcgtgggcgggttcgatatctggggccagggcacgatggtgaccgtgagctca

SEQ ID NO: 55746 - RNA, 432 nt, synthetic construct
  misc_feature 1..432: note = derived and/or modified sequence opt11 from anti-HIV_cap256-048-009749_VR-Chain
  source 1..432: mol_type = other RNA
caagtgcaattggtcgagagcgggggcggggtcgtgcaaccgggcaggagcttgcgattgagctgtggcgcgagcgggttcacattctcaagctatgccatgcactgggtcaggcaagcgcccgggcgcgggctcgagtgggtggcctttacctcgagcgatggctcgaacaagaactatggcgatagcgtgaaagggcgctttacaataagcagggacaatagcaagaacacgctatttctccagatgaatagcttgcgcgcggaagataccgcgctctattactgtgccaaggacgtgggcgagtacaagagcgatgaatgggccacggactattacgatctctcgatcgcgtacccgatacaggacccgcgcgcgatggtgggcgcgttcgatatctggggccagggcacgatggtgaccgtgagctcg

SEQ ID NO: 55747 - RNA, 432 nt, synthetic construct
  misc_feature 1..432: note = derived and/or modified sequence opt11 from anti-HIV_cap256-048-009623_VR-Chain
  source 1..432: mol_type = other RNA
caagtgcaattggtcgagagcgggggcggggtcgtgcaaccgggcaggagcttgcgcctgagctgtgccgcgagcgggttctcgttctcgaaatatggcatgcactgggtcaggcaagcgcccgggaaagggctcgagtgggtggcctttgtcgcgttcgatgaaggggacaagtactatgtcgatagcgtgaaagggcgctttaccataagcagggacaatagcaagaacacgctatcgctccagatgaatagcttgcgcgcggaagataccgcggtctattactgtgccaaggaagtgggagagaacaaggacgatgaatgggcctcggactattacgatctctcgatcgcgtacccgatccatgacccgcgcgcggtcgtgggcgggttcgatatctggggccagggcacaatggtgaccgtgagctca

SEQ ID NO: 55748 - RNA, 432 nt, synthetic construct
  misc_feature 1..432: note = derived and/or modified sequence opt11 from anti-HIV_cap256-048-008234_VR-Chain
  source 1..432: mol_type = other RNA
caagtgcaattggtcgagagcgggggcggggtcgtgcaaccgggcaggagcttgcgcttgagctgtgcagcgagcgggttcacgttcacgaactatgccatggactgggtcaggcaagcgcccgggaaagggctcgagtgggtggccgtgatctcgagcgatggctcgaacaagaactatgccgatagcgtgaaagggcgctttaccataagcagggacaatagcaaaaacacggtatatctccagatgtcgagcttgcgcccggaagataccgcggtctattactgtgccaaggacgtgggcgataccaagagcgatgaatgggccacggactattacgatctctcgatcgcgtacccggtccaggacccgcgcgcggtagtgggcgcgttcgatatatggggccagggcacgatggtgaccgtgagctcg

SEQ ID NO: 55749 - RNA, 432 nt, synthetic construct
  misc_feature 1..432: note = derived and/or modified sequence opt11 from anti-HIV_cap256-048-008149_VR-Chain
  source 1..432: mol_type = other RNA
caagtccaactcgtcgaatccggcggcggcgtcgtccaacctggccgctccctccgactctcctgcgccgcctcaggcttcaccttctccgtctacaccatgcactgggtccgacaagcccccggcaaaggcctcgaatgggtcgccgtcatctcctacgacggccgcaacaagtactacgccgacagcgtaaaaggccgcttcaccatctcccgcgacaactccaaaaacaccgtctacctacaaatgaactccctccgcgtcgaagacaccgccgtctactactgcgccaaagacctaggcgcaaacaaagacgacgaatgggccacagactactacgacctctccgtcgcctaccccgtcccagacccccgcgccgtcgtcggcgccttcgacgtctggggccaaggaaccatggtcaccgtctcctcc

SEQ ID NO: 55750 - RNA, 432 nt, synthetic construct
  misc_feature 1..432: note = derived and/or modified sequence opt11 from anti-HIV_cap256-048-007301_VR-Chain
  source 1..432: mol_type = other RNA
caagtccaactcgtcgaatccggcggcggcgtcgtccaacccggccgctccctccgcctctcctgcgccgcctccggcttctccttcaactactacgccatggactgggtccgccaagcccccggcaaaggcctcgaatgggtcgccgtaatatcatccgacggccgcaacaaaaactacgccgactccgtcaaaggccgcttcaccatctcacgcgacaactccaaaaacaccctctacctccaaatgaactccctctccgtcgaagacaccgccgtctactactgcgccaaagacctcggcaaaaacaaagacgacgaatgggccaccgactactacgacatctccatcgcctaccccgtccccgaccccagagccgtagtcggcgtattcgacatctggggccaaggcacagtcgtcaccgtctcatcc

SEQ ID NO: 55751 - RNA, 432 nt, synthetic construct
  misc_feature 1..432: note = derived and/or modified sequence opt11 from anti-HIV_cap256-048-007174_VR-Chain
  source 1..432: mol_type = other RNA
caagtgcaattggtcgagagcgggggcggggtcgtgcaaccgggcaggagcttgcgcctaagctgtgccgcgagcgggttcacgttcaatagctatggcatggcctgggtcaggcaagcgcccgggaaagggctcgagtgggtggccttgatctcgtacgatggctcgaacaagtactatgccgatagcgtgcgcggacgctttaccataagcagggacaatagcaaggacacgctctatctacagatggatggcttgcgcccggaagataccgcgctctattactgtgccaaggacttgggcgagagcgagtgcgaggaatgggcctcggactattacgatttcgggcgagattacccgtgcttggccccgcgcggggtcccgggcacgttcgatatctggggccagggcacgatggtgaccgtgagctcg

SEQ ID NO: 55752 - RNA, 432 nt, synthetic construct
  misc_feature 1..432: note = derived and/or modified sequence opt11 from anti-HIV_cap256-048-007079_VR-Chain
  source 1..432: mol_type = other RNA
caagtccaactcgccgaatccggcggcggcgtcgtccaacccggccgctccctccgcctatcctgcgccgcctccggcttcaccttctccatctacggcatgcactgggtccgccaagcccccggcaaaggcctcgaatgggtcgccttcatcctctctgacggcaccgacaaatactccgccgactccgtcaaaggccgcttcaccatctcccgcgacaactccaaaaacaccctctacctccaaatgaactcactccgcgccgaagacaccgccgtctactactgcgccaaagacctcggcaaagccaaagacgacgaatgggccaccgactactacgacttctccatcgcctaccccgtccacgacccccgcggcgtcgccggcatcttcgacatctggggccaaggcaccatggtaaccgtctcctcc

SEQ ID NO: 55753 - RNA, 432 nt, synthetic construct
  misc_feature 1..432: note = derived and/or modified sequence opt11 from anti-HIV_cap256-048-007033_VR-Chain
  source 1..432: mol_type = other RNA
caagtgcaattggtcgagagcgggggcggggtcgtgcaaccgggcaggagcttgcgattgagctgtgccgcgagcgggttcacgttctcgaactttggatttcactgggtcaggcaagcgcccggaaaagggctcgagtgggtggccgcgatctcgttcgcgggcaataacaagtactatgccgatagcgtgaaagggcgctttaccataagcagggaaaatagcaagaacatactctatctccagatgaatagcttgcgaggggaagatacagcggtctattactgtgccaaggacttgcgcgagttcgagtgcgaggaatgggcctcggactattacgatttcgggcgcgattacccgtgccaggacccacgcggggtcgtgggcacgttcgatgtctggggccatggctcgctcgtgaccgtgagctcg

SEQ ID NO: 55754 - RNA, 432 nt, synthetic construct
  misc_feature 1..432: note = derived and/or modified sequence opt11 from anti-HIV_cap256-048-006128_VR-Chain
  source 1..432: mol_type = other RNA
caagtccaactcgtcgaatccggcggcggcgtcgtccaacccggccgctccctccgcctctcctgcgccgcctccggcttcaccttctccacctacgccatgcactgggtccgacaagcccccggcaaaggcctagaatgggtcgccctcatctcctacgacggcaccgacaaatactacgccgactcagtcaaaggccgcttcaccatctcccgcgacaactccaaaaacaccctatacctccaaatgaactctctccgcgtcgaagacaccgccgtctaccactgcgccaaagacctcggcggctccaaatccgacgaatgggccaccgactactacgactggtcaatcgcctaccccgtccacgacccccgcgcagtcgtcggcgtcttcgacatctggggccaaggcaccctagtcaccgtatcctca

SEQ ID NO: 55755 - RNA, 432 nt, synthetic construct
  misc_feature 1..432: note = derived and/or modified sequence opt11 from anti-HIV_cap256-048-005999_VR-Chain
  source 1..432: mol_type = other RNA
caagtccaactcgtcgaatccggaggcggcgtcgtccaacccggccgctccctccgactctcctgcgccgcctccggcttcaccttcacccacttcgccatggactgggtccgccaagcccccggcaaaggcctcgaatgggtcgccgtcatctcctctgacggcagctccaaaaactacgccgactccgtcaaaggccgattcaccatctcccgcgacaactccaaaaacaccgtctccctccaaatgaactccctccgccccgaagacaccgccgtctactactgcgccaaagacctcggcgccaacaaagacgacgaatgggccaccgactactacgacctctccatcgcctaccccgtccccgacccccgcgccgtcgtcggcgccttcgacatctggggccaaggcaccatggtcaccgtctcatcc

SEQ ID NO: 55756 - RNA, 432 nt, synthetic construct
  misc_feature 1..432: note = derived and/or modified sequence opt11 from anti-HIV_cap256-048-005394_VR-Chain
  source 1..432: mol_type = other RNA
caagtgcaattggtcgagagcgggggcggggtcgtgcaaccgggcaggagcttgcgcttgagctgtgccgcgagccagttcacgttctcgagctatggcatgcactgggtcaggcaagcgcccgggaaagggctcgagtgggtggccgcgatctcgttcgcgggcacgaacaagtactatgccgatagcgtgaaagggcgctttaccataagcagagacaatagcaagaacgcgctctatctccagatgaatagcctgcgcgcggaagataccgcgctctattactgtgcaaaggacttgcgagagttcgagtgcgaggaatgggcctcggactattacgatttcgggcgcgattacccgtgccaggacccgcgcggggtcgtgggcacgttcgatatctggggccagggcacgatggtgaccgtgagctcg

SEQ ID NO: 55757 - RNA, 432 nt, synthetic construct
  misc_feature 1..432: note = derived and/or modified sequence opt11 from anti-HIV_cap256-048-004226_VR-Chain
  source 1..432: mol_type = other RNA
caagtgcaattggtcgagagcgggggcggggtcgtgcaaccgggcaggagcttgcgcctgagctgtgccgcgagcgggttcacgttcaataaacatggcatgcactgggtaaggcaagcgcccgggaaagggctcgagtgggtggcctttgtcgcgttcgatggctcggacaagtactatgccgatagcgtgaaagggcgctttaccataagcagggacaatagcaagaacacgctatcgctccagatgaataacttgcgcgcggaagataccgcggtctattactgtgccaaggaagtgggcgataacaaggacgatgaatgggcctcggactattacgatctatcgatcgcgtacccggtccaggacccgcgcgcggtcgtgggcgggtacgatatctggggccagggcacgatggtgaccgtgagctcg

SEQ ID NO: 55758 - RNA, 432 nt, synthetic construct
  misc_feature 1..432: note = derived and/or modified sequence opt11 from anti-HIV_cap256-048-004097_VR-Chain
  source 1..432: mol_type = other RNA
caagtccaactcgtcgaatccggcggcggcgtcgtccaacccggccgctcactccgcctctcttgcgccgcctccggcttcaccttctccgcctacaccgtccactgggtccgacaagcccccggccgcggcctcgaatgggtctccgtcatctcatacgacgaccgcaacaaatactacgcccactcagtcaaaggccgcttcaccatctcccgcgacaactccaaaaacaccctctacctccaaatgaactcactccgccgcgaagacaccgccgtctactactgcgccaaagacctaggcgccaacaaagacgacgaatgggccaccgactactacgacctctccatcgcctaccccgtccccgacccccgcgccgtcgtcggcgccttcgacatctggggccaaggcaccatggtaaccgtatcctcc

SEQ ID NO: 55759 - RNA, 432 nt, synthetic construct
  misc_feature 1..432: note = derived and/or modified sequence opt11 from anti-HIV_cap256-048-003289_VR-Chain
  source 1..432: mol_type = other RNA
caagtgcaactggtcgagagcgggggcggggtcgtgcaaccgggcaggagcctgcgcttgagctgtgccgcgagcgggttcacgttctcgaaatatggcatgcactgggtcaggcaagcgcccgggaaagggctcgagtgggtggcctttgtcgcgttcgatggatcgagcaagaactatgccgatagcgtgaaagggcgatttaccataagcagggacaacagcaagaacacggtctcgctccagatgaatagcttgcgcccggaagataccgcggtctattactgtgccaaggacttgggcgcgaacaaggacgatgaatgggccacggactattacgatctctcgatcgcgtacccggtcccggacccgcgagcggtcgtgggcgcgttcgatatctggggccagggcacgatggtgaccgtgagctcg

SEQ ID NO: 55760 - RNA, 432 nt, synthetic construct
  misc_feature 1..432: note = derived and/or modified sequence opt11 from anti-HIV_cap256-048-002601_VR-Chain
  source 1..432: mol_type = other RNA
caagtgcaattggtcgagagcgggggcggggtagtacaaccgggcaggagcttgcgattgagctgtgccgcgagcgggttctcgttcaataactatgccatggactgggtaaggcaagcgcccgggaaagggctcgagtgggtggccgtgatctcgagcgacggcaggaacaagaactatgccgagagcgtgaaagggagatttaccataagcagggacaatagcaagaacacggtctatctccagatgaatagcttgcgcgcggaagataccgcggtctattactgtgccaaggacgtgggcgataccaagaaagatgaatgggccacggactattacgatctctcgatcgcgtacccggtccaggacccgcaagcggtcgtgggcgcgttcgatatctggggccagggcacgatggtgaccgtgagctcg

SEQ ID NO: 55761 - RNA, 432 nt, synthetic construct
  misc_feature 1..432: note = derived and/or modified sequence opt11 from anti-HIV_cap256-048-002129_VR-Chain
  source 1..432: mol_type = other RNA
caagtgcaattggtcgagagcggaggcggggtcgtgcaaccgggcaggagcttgcgcttgagctgtgccgcgagcgggttcacgttctcgacctatgccatgcactgggtcaggcaagcgcccgggaaagggctcgagtgggtggcattgatctcgtacgatggcacggacaagtactatgccgatagcgtgaaagggcgctttatcataagcagggacaatagcaggagcacgctctatctccagatgaatagcttgcgcttggaagataccgcggtctatcactgtgccaaggacttgggcgggagcaagagcgatgaatgggccacggactattacgatctctcggtcgcgtacccggtccaggacccgcgagcggtcgtgggcgtgttcgatatctggggccagggcacgatggtgaccgtgagctcg

SEQ ID NO: 55762 - RNA, 432 nt, synthetic construct
  misc_feature 1..432: note = derived and/or modified sequence opt11 from anti-HIV_cap256-048-001875_VR-Chain
  source 1..432: mol_type = other RNA
caagtgcaattggtcgagagcgggggcggggtagtgcaaccgggcgggagcttgcgcttgagctgtgccacgagcgggctcacgttctcgaactatggcatgcactgggtcaggcaagcgcccgggcgagggctcgagtgggtggcctttaccaggtacgatggcacgtacaattactatgccgatagcgtgaaagggcgctttaccataagcagggacaatagcaagggcacgctatatctccagatggatggcctgcgcccggaagataccgcgctctattactgtgccaaggacttgggagagcgcgagtgcgaggaatgggcctcggactattacgatttcgggcgcgatttcccgtgccaggacccgcgcggggtcgtgggcacgttcgatatctggggccagggcacgatggtgaccgtgagctcg

SEQ ID NO: 55763 - RNA, 432 nt, synthetic construct
  misc_feature 1..432: note = derived and/or modified sequence opt11 from anti-HIV_cap256-048-001302_VR-Chain
  source 1..432: mol_type = other RNA
caagtgcaattggtcgagagcgggggcggagtcgtgcaaccgggcaggagcttgcgcttgagctgtgcagcgagcgggttcacgttctcgtactcgggcatgcactgggtcaggcaagcgcccggaaaagggatggagtgggtggccgtgatctcgtacgatggctcgaacaagtactatgccgatagcgtgaaagggcgatttacaataagcagggacaatagcaagaacacggtctatctccagatgaatagcttgcgaggggtcgataccgcggtttattactgtgccaaggacttgggcgggggcgaggtcgaggaatgggccacggactattacgattggtcgatcgcgtacccggtcgagcacccgcgcgcggtcgtgggcgtgttcgatatctggggccagggaacgaaagtgacagtgagctcg

SEQ ID NO: 55764 - RNA, 432 nt, synthetic construct
  misc_feature 1..432: note = derived and/or modified sequence opt11 from anti-HIV_cap256-048-001203_VR-Chain
  source 1..432: mol_type = other RNA
caagtgcaattggtcgagagcgggggcggggtcgtgcaaccgggcaggagcttgcgcttgagctgtgccgcgagcgggttcacgttctcgagctatgccatgcactgggtcaggcaagcgcccgggaaagggctcgagtgggtggccataatctcgtacgatggcacgatcaagtactatgccgatagcgtgaaagggcgctttacaataagcagggacaatagcaagaacacggtctcgctccagatgaatagcttgcgcccggaagataccgcggtctattactgtgccaaggacgtgggcgcgaacaaggacgatgaatgggccacggactattacgatctctcgatagcgtacccggtcccggacccgcgcgcggtcgtgggcgcgttcgatatctggggccagggcacgatggtgaccgtgagctcg

SEQ ID NO: 55765 - RNA, 432 nt, synthetic construct
  misc_feature 1..432: note = derived and/or modified sequence opt11 from anti-HIV_cap256-048-000383_VR-Chain
  source 1..432: mol_type = other RNA
caagtgcaattagtcgagagcgggggcggggtcgtgcaaccgggcaggagcttgcgcttgagctgtaccgcgagcgggttcacgttcaatcactatgccatggactgggtcaggcaagcgcccgggaaagggctcgagtgggtggccgtgatctcgagcgatggctcggacaagacctatgccgatagcgtaaaagggcgctttaccataagcagggacaatagcaagaacacggtatatctacagatgaatagcttgcgcgcggaagataccgcggtctattactgtgccaaggacgtgggcgggagcaaggacgatgaatgggccacggactactacgatctatcgatcgcgtacccggtaccggacccgcgcgcggtcgtgggcgcgttcgatttctggggcccgggcacgatggtgacagtgagctcg

SEQ ID NO: 55766 - RNA, 432 nt, synthetic construct
  misc_feature 1..432: note = derived and/or modified sequence opt11 from anti-HIV_cap256-038-261791_VR-Chain
  source 1..432: mol_type = other RNA
caagtgcaattggtcgagttcgggggcggggtcgtgcaaccgggcgggagcctgcgactgagctgtgccgcgttcgggttcacgatctcgagctatggcatgcactgggtcaggcaagcgccagggaaagggctccagtgggtggcctttatcaggtacgatgaatcgagtaagttctatgccgatagcgtgaaagggcgctttaccataagcagggacaatagcgagaacacgctctatctccagatgaatagcttgcgcgcggaagataccgcggtctattactgtgccaaggacttgggcgagagcgagaacgaggaatgggccacggactattacgatttctcgatcgcgtacccgggccaggacccgcgcggggtcgtgggcatattcgatatctggggccagggaacgatggtgaccgtgagctcg

SEQ ID NO: 55767 - RNA, 432 nt, synthetic construct
  misc_feature 1..432: note = derived and/or modified sequence opt11 from anti-HIV_cap256-038-241540_VR-Chain
  source 1..432: mol_type = other RNA
caagtgcaattggtcgagagcgggggcggggtcgtgcaaccgggcaggagcttgcgcctgagctgtgccgcgagcgggttcacgttctcgaactcggccatgcactgggtcaggcaagcgcccgggaaagggctcgagtgggtggccttgatctcgtacgtgggcgggaacatatactatgccgatagcgtgaaagggcgctttaccgtgagcagggacaatagcaagaaaacactctatctccagatgaatagcttgcgcgtggaagataccgcagtctattactgtgtcaaggacgtgggcgagagcgagaacgaggaatgggcctcggactattacgatttcgggcgcgattacccgggccaggacacgcgcgcagtcgtgggcgcgttcgatatctggggccagggcacgatggtgaccgtgagctcg

SEQ ID NO: 55768 - RNA, 432 nt, synthetic construct
  misc_feature 1..432: note = derived and/or modified sequence opt11 from anti-HIV_cap256-038-235677_VR-Chain
  source 1..432: mol_type = other RNA
ctcgtgcaactggtcgagagcgggggcggggtcgtgcaaccgggcgggagcttgcgcttgagctgtgccgcgagcgggttcaggttctcgagctatggcatgcactgggtcaggcaagcacccgggaaagggctcgagtgggtggcctttatcaggtacgatggctcgttcaaggactatgccgatagcgtgcgcgggcgctttaccataagcagggaaaatagcaagaacacgctctatctccagatgaatagcttgcgcacggacgataccgcggtctattactgtgccaaggacttgggcgagagcgagaccgaggaatggccctcggactattacgatttcgggcgcgattacccgggccaggacccgcgaggggtagtgggcacgttcgatatctggggccatggcacgatggtgaccgtgagctcg

SEQ ID NO: 55769 - RNA, 435 nt, synthetic construct
  misc_feature 1..435: note = derived and/or modified sequence opt11 from anti-HIV_cap256-038-234314_VR-Chain
  source 1..435: mol_type = other RNA
gaagtgcaattgctagagagcgggggagggctcgtgcaaccgggagggagcctgcgcttgagctgtgccgcgagcgggttcacgttctcgcgctatgccatgagctgggtcaggcaagcgcccgggaaagggctcgagtgggtggcagtgatctcatacgacggctcgaacaagtactatgccgatagcgtgaaagggcgctttaccataagcagggacaatagcaagaacacgctctatctccagatgaatagcttgcgagcggtcgatacagcggtctattactgtgccaaggacttgggcgagggcgagaacgaggaatgggccacggactattacgatttctcgtactggctcccgtgcccgaaatatcacggggcctggctcgagctcttgtacatatgggggcaagggaccatggtcacggtctcgagc

SEQ ID NO: 55770 - RNA, 432 nt, synthetic construct
  misc_feature 1..432: note = derived and/or modified sequence opt11 from anti-HIV_cap256-038-234273_VR-Chain
  source 1..432: mol_type = other RNA
gaagtgcaattggtcgagagcgggggcgggctcatacaaccgggcgggagcctgcgcttgagctgtgccgcgagcgggttcacggtctcgaccaatttcatgagctgggtcaggcaagcgcccgggaaagggctcgagtgggtggccgtgatctcgtacgatggcaataacaagtactatgccgatagcgtgaaagggcgctttaccataagcagggaaaacagcaagaacacgctctatctccagatgaatagcctgagaacggacgataccgcggtctattactgtgccaaggacttgggcgagagcgagaccgaggaatggccatcggactattacgatttcgggcgcgattacccgggccaggacccgcgaggggtcgtgggcacgttcgatatctggggccatggcacgatggtgaccgtgagctca

SEQ ID NO: 55771 - RNA, 432 nt, synthetic construct
  misc_feature 1..432: note = derived and/or modified sequence opt11 from anti-HIV_cap256-038-223164_VR-Chain
  source 1..432: mol_type = other RNA
gaagtgcaattggtcgagagcgggggagggctcgtgcgcccgggcgggagcttgcgcttgagctgtgccgcgagcgggttctcgctagggagctattggatgacctgggtcaggcaagcgcccgggaaagggctagagtgggtggccgtgatctcgtacgatggctcaaacaagtactatgccgatagcgtgaaaggacgatttaccataagcagggacaatagcaagaacacgctatatctccagatgaatagcctgcgcgcggaagataccgcgctctattactgtgccaaggacttgggcgagagcgagaacgaggaatgggcctcggactattacgatttcgggcgcgattacccgggccaggacccgcgcggggtcgtgggcacgttcgatatctggggccagggcacgatggtgaccgtgagctcg

SEQ ID NO: 55772 - RNA, 432 nt, synthetic construct
  misc_feature 1..432: note = derived and/or modified sequence opt11 from anti-HIV_cap256-038-220289_VR-Chain
  source 1..432: mol_type = other RNA
gaagtgcaactggtcgagagcgggggcgggctcgtgcaaccgggcgggagcttgcgcttgagctgtaccgcgagcgggttcacgttctcgagctatgaaatgaactgggtaaggcaagcgcccgggaaagggccagagtgggtggccgtgatctcgtacgacggcaataacaagtactatgccgatagcgtgaaagggcgctttaccataagcagagaaaatagcaagaacacgctatatctccagatgaatagcctgcgcacggacgataccgcagtctattactgtgccaaggacttgggcgagagcgagaccgaggaatggccctcggactattacgatttcgggcgcgattacccgggccaggacccgcgcggggtcgtgggcacgttcgatatctggggccatggcacgatggtgaccgtgagctcg

SEQ ID NO: 55773 - RNA, 432 nt, synthetic construct
  misc_feature 1..432: note = derived and/or modified sequence opt11 from anti-HIV_cap256-038-220020_VR-Chain
  source 1..432: mol_type = other RNA
caagtgcaattggtcgagagcgggggcggggtcgtgcaaccgggcaggagcttgcgcttgagctgtgccgcgagcgggttcacgttctcgcgcaatgccatgcactgggtcaggcaagcgcccgggaaagggctcgagtgggtggccttgatctcgtacgatggctcgaacaagtactatgtagatagcgtgaaagggcgatttaccataagcagggacaatagcaagaacacgctctatctccagatgaatagcttgcgcgcggacgataccgcggtctattactgtgccaaggacttgggcgagagcgagaccgaggaatggggcacggactattacgatttctcgaccgggtacccggtccaggacccgcgcggggtcgtgggcgcgttcgatatctggggccagggcacgatggtgagcgtgagctcg

SEQ ID NO: 55774 - RNA, 432 nt, synthetic construct
  misc_feature 1..432: note = derived and/or modified sequence opt11 from anti-HIV_cap256-038-216853_VR-Chain
  source 1..432: mol_type = other RNA
caagtgcaattggtcgagagcgggggcggggtcgtgcaaccgggacgcagcttgagattgagctgtgccgcgagcgggttcacgttctcgagctatgccatgcactgggtaaggcaagcgcccgggaaagggctcgagtgggtggccgtgatctcgtacgatggctcgaacaagtactatgccgatagcgtgaaagggcgctttaccataagcagggacaatagcaagaacacgctatatgtccagatgaatagcttgcgcgcggaagataccgcggtctattactgtgccagggacttgggcgagagcgagaccgaggaatggccctcggactattacgatttcgggcgcgattacccgggccaggacccgcgaggggtcgtgggaacgttcgatatctggggccatggcacgatggtgaccgtgagctcg

SEQ ID NO: 55775 - RNA, 432 nt, synthetic construct
  misc_feature 1..432: note = derived and/or modified sequence opt11 from anti-HIV_cap256-038-213466_VR-Chain
  source 1..432: mol_type = other RNA
gaagtgcaattggtcgagagcgggggcgggctcgtgcaaccgggccgcagcttgagagtgagctgtgccgcgagcgggttcacgttcgaggactatgcaatgcactgggtcaggcaagcgcccgggaaagggctcgagtgggtggcagtgatctcggacgatggcaataacaagtactatgccgatagcgtgaaagggcgctttaccataagcagggacaatagcaagaacacgctctatctccagatgaatagcttgcgcgtggaagataccgcggtctattactgtgtcaaggacgtgggcgagagcgagaacgaggaatgggcctcggactattacgatttcgggcgagattacccgggacaggacacgcgcgcggtcgtgggcgcgttcgatatctggggccagggcacgatggtgacagtgagctcg

SEQ ID NO: 55776 - RNA, 432 nt, synthetic construct
  misc_feature 1..432: note = derived and/or modified sequence opt11 from anti-HIV_cap256-038-213212_VR-Chain
  source 1..432: mol_type = other RNA
caagtgcaattagtcgagagcgggggcggggtcgtgcaaccgggcgggagcttgcgcttgagctgtgccgcgagcgggttcatattctcggactatggcatgcactgggtaaggcaagcgcccgggaaagggctcgagtgggtggcctcgatctggcacgatggctcgaagaaatactatgccgatagcgtgaaagggcgctttaccataagcagggaaaatagcaaaaacacgctctatctccagatgaatagcctgcgcgcggaagataccgcggtctatcactgtgccaaggacctgggcgagagcgagatcgaggaatggacctcggactattacgatttcgggcgcgattacccgggccaggacccgcgcggggtctttggcacgttcgatatctggggccatggcacgatggtgaccgtgagctcg

SEQ ID NO: 55777 - RNA, 432 nt, synthetic construct
  misc_feature 1..432: note = derived and/or modified sequence opt11 from anti-HIV_cap256-038-213120_VR-Chain
  source 1..432: mol_type = other RNA
caagtgcacttggtcgagagcgggggcgggctagtgaaaccgggcgggagcctgcgcttgagctgtgccgcgagcgggttcacgttctcagactattacatgatctggatcaggcaagcgcccgggaaaggactcgagtgggtggccgtaatctcgagcgatggctcgaacaagaactatgcagatagcgtgaaagggcgctttaccataagcagagacaatagcaagaacacgctctatctccagatgaatagcttgcgcgcggaagataccgcggtctactactgtgccaaggacttgggcgagagcgagaacgaggaatgggccacggactattacgatttcgcgaccgggtacccggtccaggacccgcgcgcggtcgtgggcgcgttcgacatctggggccagggcacgatggtgaccgtgagcccg

SEQ ID NO: 55778 - RNA, 432 nt, synthetic construct
  misc_feature 1..432: note = derived and/or modified sequence opt11 from anti-HIV_cap256-038-212592_VR-Chain
  source 1..432: mol_type = other RNA
ctcgtgcaactggtcgagagcgggggcggggtcgtgcaaccgggcaagagcttgcgcttgagctgtgccgcgagcgggttcacgttctcgagctatgccatgcactggatcaggcaagcgcccgggaaagggctcgagtgggtggccgtgatctcggacgatggctcgatcaagaactatgccgatagcgtgaaagggcgctttaccataagcagggacacgagcaagaaattgatgtatctccagatgaatagcttgagcgcgaacgataccgcggtctattactgtgccaaggacttgggcgagcgagagaacgaggaatgggcatcggactattacgatttcgggcgcgattacccgggccaggacccgcgaggggtcgtaggctcgatcgatacctggggccatggcacgatggtgaccgtgagctcg

SEQ ID NO: 55779 - RNA, 432 nt, synthetic construct
  misc_feature 1..432: note = derived and/or modified sequence opt11 from anti-HIV_cap256-038-211790_VR-Chain
  source 1..432: mol_type = other RNA
gaactgcaattggtcgagagcgggggcgggctcgtgcaaccgggcgggagcttgcgcttgagctgtgtcgtgagcgggttcacggtctcgaccaattacataagctgggtcagacaagcgcccgggaaagggctcgagtgggtggccgtgatctcgtacgatggctcgaacaagtactatgccgatagcgtgaaagggcgctttacaataagcagggacaatagcaagaacacgctctatctccagatgaatagcttgcgcgcggaagataccgcgctctattactgtgccaaggacttgggagagagcgagaacgaggaatgggcctcggactattacgatttcgggcgcgattacccgggccaggacccgcgcggggtcgtgggcacgttcgatatctggggccagggcacgatggtgaccgtaagctcg

SEQ ID NO: 55780 - RNA, 432 nt, synthetic construct
  misc_feature 1..432: note = derived and/or modified sequence opt11 from anti-HIV_cap256-038-209916_VR-Chain
  source 1..432: mol_type = other RNA
caagtgcaattggtcgagagcggaggcggggtcgtgcaaccgggcgggagcttgcgcttgagctgtgccgcgagcgggttcacgttctcgagctttggaatgcactgggtcaggcaagcgcccgggaaagggctcgagtgggtgagctttatcaggaacgatggcgggatcaggtactcggccgatagtgtgcgcgggcgctttaccataagcagggacaatagcaagaacacgctctatctccagatgaatagcttgcgcacggacgataccgcggtctattactgtgccaaggacttgggcgagagcgagaccgaggaatggccatcggactattacgatttcgggcgcgattacccgggacaggacccgcgcggggtcgtgggcacgttcgatatctggggccatggcacgatggtgaccgtgagctcg

SEQ ID NO: 55781 - RNA, 432 nt, synthetic construct
  misc_feature 1..432: note = derived and/or modified sequence opt11 from anti-HIV_cap256-038-207938_VR-Chain
  source 1..432: mol_type = other RNA
caagtgcaattggtcgagagcgggggaggggtcgtgcacccgggcaggagcttgcgcttgagctgtgcagcgagcgggttcacgttctcgagctatggcatgcactgggtcaggcaagcgcccgggaaagggctcgagtgggtagccgtgatctcgcacgatggctcgaacaagtactatgccgatagcgtgaaagggcgctttaccataagcagggacaatagcaaaaacacgctctatctccagatgaatagcttgcgcgcggaagataccgcggtctattactgtgccaaggacttgggcgagagcgagaacgaggaatgggcctcggactattacgatttcgggcgcgattacccgggccaggacccgcgcggggtcgtaggcgtgttcgatatctggggccagggcacgatggtgaccgtgagctcg

SEQ ID NO: 55782 - RNA, 432 nt, synthetic construct
  misc_feature 1..432: note = derived and/or modified sequence opt11 from anti-HIV_cap256-038-202245_VR-Chain
  source 1..432: mol_type = other RNA
caagtacacttggtcgagagcgggggcggggtcgtgcaaccgggcaggagcttgcgcttgagctgtaccgtgagcgggttcacgttcgggagctatgccttgcactgggtcaggcaagcgcccgggaaagggctcgagtggttgagcgtaatctcgtacgatggcaataacaagtactatgccgatagcgtgaaagggcgctttaccataagcagggaaaatagcaagaacacgctctatctccagatgaatagcctgcgcgcggaagataccgcggtctatcactgtgccaaggacttgggagagagcgagaaagaggaatgggcctcggactattacgatttcgggcgcgattacccgggccaggacccgcgcggggtcgtgggcacgttcgatatctggggccatggcacgatggtgaccgtgagctcg

SEQ ID NO: 55783 - RNA, 432 nt, synthetic construct
  misc_feature 1..432: note = derived and/or modified sequence opt11 from anti-HIV_cap256-038-197721_VR-Chain
  source 1..432: mol_type = other RNA
caagtgcaactggtagagagcgggggcggggtcgtgcaaccgggcaagagcttgcgcttgagctgtgccgggagcgggttcatattctcgaactatcccatgcactgggtcaggcaagcgcccgggaaagggctcgagtggatggccgatgtctcgtacgatggctcgaacaaggactatgccgatagcgtgaaagggcgatttaccataagcagggacaatagcaagaacacgctatatctacagatgaatagcttgcgcgcggaagataccgcggtctattactgtgtcaaggacgtaggcgagagcgagaacgaggaatgggcctcggactattacgatttcgggcgcgattacccgggccaggacacgcgcgcggtcgtgggcgcgttcgatatctggggccagggcacgatggtgaccgtgagctcg

SEQ ID NO: 55784 - RNA, 432 nt, synthetic construct
  misc_feature 1..432: note = derived and/or modified sequence opt11 from anti-HIV_cap256-038-196679_VR-Chain
  source 1..432: mol_type = other RNA
gaagtacaattgctagagagcgggggcgggctcgtgcaaccgggcgggagcttgcgcctgagctgtgccgcgagcgggttcacgttctcgagctatgccatgagctgggtcagacaagcgcccgggaaagggctcgagtgggtggccgtgatctcatacgatggagggaacaagtactatgccgatagcgtgaaagggcgctttaccataagcagggacaatagcaagaacacgctctatctacagatgaatagcttgcgcgcggaagataccgcgctctattactgtgccaaggacttgggcgagagcgagaacgaggaatgggcctcggactattacgatttcgggcgcgattacccgggccaggactcgcgcggggtcgtgggaacgttcgatgtatggggccagggcacgatggtgacagtgagctcg

SEQ ID NO: 55785 - RNA, 438 nt, synthetic construct
  misc_feature 1..438: note = derived and/or modified sequence opt11 from anti-HIV_cap256-038-196118_VR-Chain
  source 1..438: mol_type = other RNA
caagtgcaattggtagagagcgggggcggggtcgtgcaaccgggagggagcttgcgcttgagctgtgccgcgagcgggttcacgttctcgacatatggcatgcactgggtcaggcaagcgcccgggaaagggctcgagtgggtgacctttatcaggaacgatggcacgaacaagtactatgccgatagcgtgaaagggcgctttaccataagcagggacaataccaagaacacgctctatctccagatgtatagcttgagagcggaagataccgcggtctattactgtgccaaggacttgggcgagagcgagaacgaggacgaggaatgggcctcggactattacgatttcgggcgagattacccgggccaggactcgcgcggggtcgtgggcacgttcgacatgtggggccagggcacgatggtgacagtgagctcg

SEQ ID NO: 55786 - RNA, 429 nt, synthetic construct
  misc_feature 1..429: note = derived and/or modified sequence opt11 from anti-HIV_cap256-038-195382_VR-Chain
  source 1..429: mol_type = other RNA
caagtgcacttggtcgagagcgggggcggggtcgtgcaaccaggcaggagcttgcgcttgagctgtgcagcgagcgggttcacgttctcgaactatcccgtgcactgggtcaggcaagcgcccgggaaagggctcgagtgggtggccgtgatctcgttcgatggcataaacaattacgcgggctcggtcaagggcaggttcataatctcgcgcgataactcgaaaaataccttgtacctgcaaatgaactcgctcagggccgaggacacggccgtgtactattgcgtgaaagatctcggggaatcggaaaaggaagagtggccgagcgattactatgactttggcagggactatcccgggcaagatagcaggggcgtggtcggggtctttgacatatgggggcaagggaccatggtcacggtctcgagc

SEQ ID NO: 55787 - RNA, 432 nt, synthetic construct
  misc_feature 1..432: note = derived and/or modified sequence opt11 from anti-HIV_cap256-038-180001_VR-Chain
  source 1..432: mol_type = other RNA
gaagtgcaattggtcgagagcgggggcgggctcgtgcaaccgggcaggagcttgcgcttgagctgtaccgcgagcgggttcacgttcggggactatgccatgagctggttcaggcaagcgcccgggaaagggctcgagtgggtggccgatatctcgtacgatggctcgaacaagtactatgccgatagcgtgaaagggcgcttgaccataagcagggacaatagcaagaacacgctctatctccagatgaatagcctgcgcgcggaagataccgcggtctattactgtgtcaaggacttgggcgagagcgagaaagaggaatggccctcggactattacgatttcgggcgcgattacccgggccaggactcgcgcggggtcgtgggcgtgttcgatatctggggccagggcacgatggtgaccgtgagctcg

SEQ ID NO: 55788 - RNA, 432 nt, synthetic construct
  misc_feature 1..432: note = derived and/or modified sequence opt11 from anti-HIV_cap256-038-178021_VR-Chain
  source 1..432: mol_type = other RNA
caagtgaaattggtcgagagcgggggcggggtcgtgcaaccgggcgggagcttgcgcttgagctgtgccgcagccgggttcatattctcgaactcgggcatgcactgggtcaggcaagcgcccgataaagggctcgagtgggtggcctttgtcccgtacgatggctcgaacaagtactatgccgatagcgtgaaagggcgctttacaataagcagggacaatagcaagaacacgctctcgctccagatgaatagcttgcgcacggaagataccgcggtctattactgtgccaaggacttgggcgagagcgagaccgaggaatggccctcggactattacgatttcgggcgcgattacccgggccaggacccgcgcggggtcgtgggcacattcgatatctggggccatggcacgatggtgaccgtgagctcg

SEQ ID NO: 55789 - RNA, 432 nt, synthetic construct
  misc_feature 1..432: note = derived and/or modified sequence opt11 from anti-HIV_cap256-038-177104_VR-Chain
  source 1..432: mol_type = other RNA
gaagtgcaattgctagagagcgggggcgggctcgtgcaaccgggcgggagcttacgcttgagctgtgccgcgagcgggttcacgttctcaagctatgccatgaactgggtcaggcaagcgcccgggaaagggctcgagtgggtggccgtgatctcgtacgatggcggggacaagtactatgccgatagcgtgaaagggcgctttaccataagcagggacaatagcaagaacacgctctatctacagatgaatagcttgcgcgtggaagataccgcggtctattactgtgtcaaggacgtgggcgagagcgagaacgaggaatgggcctcggactattacgatttcgggcgagattacccgggccaggacacgcgcgcggtcgtgggcgcgttcgatatctggggccagggcacgatggtgacagtgagctcg

SEQ ID NO: 55790 - RNA, 432 nt, synthetic construct
  misc_feature 1..432: note = derived and/or modified sequence opt11 from anti-HIV_cap256-038-171261_VR-Chain
  source 1..432: mol_type = other RNA
caagtgcaattggtagagagcgggggcggggtcgtgcaaccgggcaggagcttgcgcttgagctgtgccgcgagcgggttcacgttctcgagctatgccatgtactgggtcaggcaagcgcccgggaaagggctcgagtgggtggccgtgatctcgagcgatggctcggacaagaactatgcagatagcgtgaaagggcgctttaccataagcagggacaatagcaacaacacgctctatctccagatgaatagcttgcgcgcggaagataccgcggtctattactgtgccagggacttgggcgagagcgagaacgaggaatggccctcggactattacgatttcgggcgcgattacccgggccaggacccgcgcggggtcataggcacgttcgatgtctggggacagggcacgatggtgaccgtgagctcg

SEQ ID NO: 55791 - RNA, 432 nt, synthetic construct
  misc_feature 1..432: note = derived and/or modified sequence opt11 from anti-HIV_cap256-038-169090_VR-Chain
  source 1..432: mol_type = other RNA
caagtgcaattggtcgagagcgggggcggggtcgtgcaaccgggcaggagcttgcgcctgagctgtgccgcgagcaggttcacgttcaagacctataccatgcactgggtcaggcaagcgcccgggaaagggctcgagtgggtggccttgatctcgtacgatggctcgaacaagtactatgccgatagcgtgaaagggcgattgaccataagcagggacaatagcaagaacacgctatacctccagatgaatagcttgcgcgcggaagataccgcggtctactactgtgtcaaggacttgggcgagagcgagaaagaggaatggccctcggactattacgatttcgggcgcgattacccgggacaggactcgcgcggggtcgtgggcgtgttcgatatctggggccagggcacgatggtgaccgtgagctcg

SEQ ID NO: 55792 - RNA, 432 nt, synthetic construct
  misc_feature 1..432: note = derived and/or modified sequence opt11 from anti-HIV_cap256-038-168705_VR-Chain
  source 1..432: mol_type = other RNA
gaggtgcagttggtggagagcgggggggggctggtgaagccgggggggagcttgaggttgagttgtgcggcgagcgggttcacgttcagtagctatagcatgaactgggtgaggagggcgccggggaaggggctggagtgggtggcgttgataagttacgatgagaataagaagtactatgcggatagcgtgaaggggaggtttacgataagcagggagaatagcaagaacacgctgtatctgcagatgaatagcttgagggcggaggatacggcggtgtattactgtgcgaaggacttgggagagagggagaacgaggagtgggcgtcggactattacgatttcgggagggattacccggggcaggacccgaggggggtggtggggagtatagatacgtgggggcatgggacgatggtgacggtgagcagt

SEQ ID NO: 55793 - RNA, 432 nt, synthetic construct
  misc_feature 1..432: note = derived and/or modified sequence opt11 from anti-HIV_cap256-038-167685_VR-Chain
  source 1..432: mol_type = other RNA
caagtgcaattggtcgagagcgggggcggggtcgtgcaaccgggcaggagcttgcgcctgagctgtgccgcgagcgggatcacgttctcgagctatgccatacactgggtcaggcaagcgcccgggaaagggctcgagtgggtggccgtgatctcgtacgatggctcaaacaagtactatgccgatagcgtgaaagggcgctttaccataagcagggacaatagcaagaacacgctctatctacagatgaatagcttgcgcgcggaagataccgcggtctattactgtgccaaggacttgggcgagagcgagaacgaggaatgggccacggactattacgatttctcgatagggtacccgggccaggacccgcgaggggtcgtgggcgcgttcgatatatggggccagggcacgatggtgaccgtgagcttg

SEQ ID NO: 55794 - RNA, 432 nt, synthetic construct
  misc_feature 1..432: note = derived and/or modified sequence opt11 from anti-HIV_cap256-038-158775_VR-Chain
  source 1..432: mol_type = other RNA
caagtgcaattggtcgagagcgggggcggggtcgtgcaaccgggcgggagcctgcgcctgagctgtgccgcgagcgggttcacgttctcgacctatggcatgcactgggtcaggcaagcgccagggaaagggctagagtgggtggcctttatcagggacaatggctcgaacaagtactatgccgatagcgtgaaagggcgatttaccataagcagggacaatagcaagaacacgctatatctccagatgaatagcttgcgcgcggaagataccgcgctatattactgtgccaaggacttgggagagagcgagaacgaggaatgggcctcggactattacgatttcgggcgcgattacccgggccaggactcgcgcggggtcgtgggcacgttcgatgtctggggccagggcacgatggtgaccgtgagctcg

SEQ ID NO: 55795 - RNA, 432 nt, synthetic construct
  misc_feature 1..432: note = derived and/or modified sequence opt11 from anti-HIV_cap256-038-157318_VR-Chain
  source 1..432: mol_type = other RNA
cacgtgcaattggtcgagagcgggggcggggtcgtgcaaccgggcaggagcttgcgcttgagctgtgccgcgagcgggatcacgttctcgacctatgacatgcactgggtcaggcaagcgcccgggaaagggctcgagtgggtagccgtgatctcgaacgatggctcgaacaagtactatgccgatagcgtgaaagggcgctttaccataagcagggacaatagcaagaacacgctctatctccagatgaatagcttgcgcgcggaagataccgcgctctattactgtgccaaggacttgggcgagagcgagaaagaggaatgggcctcggactattacgatttcgggcgcgattacccgggccaggacccgcgcggggtcgtggccacgttcgatatctggggccagggcacgatggtgaccgtgagctcg

SEQ ID NO: 55796 - RNA, 432 nt, synthetic construct
  misc_feature 1..432: note = derived and/or modified sequence opt11 from anti-HIV_cap256-038-153058_VR-Chain
  source 1..432: mol_type = other RNA
caagtgcaattggtcgagagcgggggcggggtcgtgcaaccgggcaggagcttgcgcttgagctgtgccgcgagcgggttcacgttctcaacatacgccatgcactgggtcaggcaagcgcccgggaaagggctcgagtgggtggccgtgatctcgtacgatggctcgcactcgtactatgccgggagcgtgaaagggcgctttaccacgagcagggacaatagcaagaacacgctcaatctccagatgaatagcttgcgcccggaagataccgcgctctattactgtgccaaggacttgggcgagagcgagaacgaggaatgggcctcggactattacgatttcgggcgcgattacccgggccaggactcgcgcggagtcgtgggcacgttcgatgtctggggccagggcacgatggtgaccgtgagctcg

SEQ ID NO: 55797 - RNA, 432 nt, synthetic construct
  misc_feature 1..432: note = derived and/or modified sequence opt11 from anti-HIV_cap256-038-150027_VR-Chain
  source 1..432: mol_type = other RNA
ctcgtgcaattggtcgagagcgggggcggggtcgtgcaaccgggcgggagcctgcgcttgagctgtgccgcaagcgggttcaggttctcgagctatggcatgcactgggtcaggcaagcgcccgggaaagggctcgagtgggtggcctttatcaggtacgatggctcgttcaaggactatgccgatagcgtgcgcgggcgctttaccataagcagggacaatagcaagaacacggtctatgtccagatgaatagcttgcgagcggaagataccgcggtctattactgtgccaaggacttgggcgagagcgagaacgaggaatgggccacggactattacgatttcgcgaccgggtacccggtccaggacccgcgcgcggtcgtgggcgcgttcgatatctggggccagggaacgatggtgacagtgagccca

SEQ ID NO: 55798 - RNA, 432 nt, synthetic construct
  misc_feature 1..432: note = derived and/or modified sequence opt11 from anti-HIV_cap256-038-146372_VR-Chain
  source 1..432: mol_type = other RNA
caagtgcaattggtcgagagcgggggcggggtcgtgcaaccgggcaggagcttgcgattgagctgtgccgcgagcgggttcacgttctcgagctttggcatgcactgggtcaggcaatcgcccgggaaagggctcgagtgggtggccgtgatctcgtacgatggcaataacaagtactatgccgatagcgtgaaagggcgctttaccataagcagggaaaatagcaagaacacgctctatctccagatgaatagcttgcgcacggacgataccgcggtctattactgtgccaaggacttgggcgagagcgagaccgaggaatgggccacggactattacgatttcgcgaccgggtacccggtccaggacccgcgagcggtcgtgggcgcgttcgatatctggggccagggcacgatggtgaccgtgagcccg

SEQ ID NO: 55799 - RNA, 432 nt, synthetic construct
  misc_feature 1..432: note = derived and/or modified sequence opt11 from anti-HIV_cap256-038-141868_VR-Chain
  source 1..432: mol_type = other RNA
gaattgcgcctggtcgagagcgggggcaatctcgtgcaaccgggcgggagcttgaccttgagctgtgtcgcgagcgggttcacgttcgatagctatggcatgagctgggtcaggcaagcgcccgggaaagggctcgagtgggtggcattgatctcgtacgatgaaaataaaaagtactatgccgatagcgtgaaagggcgctttaccataagcagggaaaatagcaagaacacgctctatctccagatgaatagcttgcgcgcggaagatacagcggtctattactgtgccaaggacctgggcgagcgcgagaacgaggaatgggcctcggactattacgatttcgggcgcgattacccgggccaggacccgcgcggggtcgtgggctcgatagatacctggggccatggaacgatggtgaccgtgagctcg

SEQ ID NO: 55800 - RNA, 432 nt, synthetic construct
  misc_feature 1..432: note = derived and/or modified sequence opt11 from anti-HIV_cap256-038-141616_VR-Chain
  source 1..432: mol_type = other RNA
gaagtgcaactgctcgagagcgggggcgggctcgtgcaaccgggcgggagcttgcgcttgagctgtgcagcgagcgggttcacgttctcgagctatgccatgagctgggtcaggcaagcgcccgggaaagggctcgagtgggtggcagtgatctcgaaagatggctcggacaatagctatgtcgatagcgtgaaagggcgctttaccataagcagggacaatagcaagaacacgctctatctccagatgaatagcctgcgcgcggaagataccgcggtctattactgtgccagggacttgggcgagagcgagaacgaggaatggccctcggactattacgatttcgggcgcgattacccgggccaggacccgcgaggggtcataggcacgttcgatgtctggggccagggcacgatggtgaccgtgagctcg

SEQ ID NO: 55801 - RNA, 432 nt, synthetic construct
  misc_feature 1..432: note = derived and/or modified sequence opt11 from anti-HIV_cap256-038-127989_VR-Chain
  source 1..432: mol_type = other RNA
caagcgcaattggtcgagagcgggggcggggtcgtgcaaccgggcaggagcttgcgcttgagctgtgccgcgagcgggttcacgttctcgaactttgccatgcactgggtcaggcaagcgcccgggaaagggctcgagtgggtggcagtgatgtcggacgatggatcgaacaagtactatgccgatagcgtgaaagggcgctttacaataagcagggacaatagcgagaacacgctatatctccagatgaatagcttgagagcggaagataccgcggtctattactgtgccaaggacttgggcgagagcgagaccgaggaatgggccacggactattacgatttcgggaccgggtacccgggccaggacccgcgcgcgatgataggcacgttcgatatctggggcaggggcacgatggtgaccgtgagctcg

SEQ ID NO: 55802 - RNA, 432 nt, synthetic construct
  misc_feature 1..432: note = derived and/or modified sequence opt11 from anti-HIV_cap256-038-118109_VR-Chain
  source 1..432: mol_type = other RNA
caagtgcaattggtcgagagcgggggcggggtcgtgcaaccgggcgggagcttgcgattgagctgtacagcgagcgggttcacgttctcggcctatgacatgcactggatcaggcaagcgcccgggaaagggctcggatgggtagcctttatcacgaacgagggctcgagcaagaactatgtcgatagcgtgaaagggcgctttacaataagcagggacaatagcaagaacacgctctatctccagatgaatagcttgcgcgcggaagataccgcggtctattactgtgcaaaggacttgggcgagagcgagaacgaggaatgggccacggactattacgatttctcgatcgcgtacccgggccaggacccacgcggggtcgtgggcatattcgatatctggggccagggcacgatggtgaccgtgagctca

SEQ ID NO: 55803 - RNA, 432 nt, synthetic construct
  misc_feature 1..432: note = derived and/or modified sequence opt11 from anti-HIV_cap256-038-112226_VR-Chain
  source 1..432: mol_type = other RNA
gaagtgcaactggtcgagagcgggggcgggctagtgcaaccgggcgggagcctgcgattgagctgtgccgcgagcgggttcacgttctcgagctattggatgacctgggtcaggcaagcgcccgggaaagggctcgagtgggtggccgtgatctcagacgatggcaataacaagtactatgccgatagcgtgaaaggacgctttaccataagcagggacaatagcaagaacacgctctatctccagatgaatagcttgcgcgtagaagataccgcggtctattactgtgtcaaggacgtgggcgagagcgagaacgaggaatgggcctcggactattacgatttcgggcgcgattacccgggccaggacacgcgcgcggtcgtgggcgcgttcgatatctggggccagggcacgatggtgaccgtgagctcg

SEQ ID NO: 55804 - RNA, 432 nt, synthetic construct
  misc_feature 1..432: note = derived and/or modified sequence opt11 from anti-HIV_cap256-038-105918_VR-Chain
  source 1..432: mol_type = other RNA
gaagtacaactactagaaagcggaggcggactcgtacaaccaggcggaagcctacgcctaagctgcgccgcaagcgggttcacattcaacatccaccccatgcactgggtcagacaagcacccggcaaaggactagaatgggtagccgtaatctcatacgacggcaacaacaaatactacgccgacagcgtaaaaggacgcttcaccataagcagagaaaactccaaaaacacactctacctccaaatgaacagcctccgcaccgacgacaccgcagtctactactgcgccaaggacctaggcgaaagcgaaacagaagaatggccctcggactactacgacttcggacgcgactacccaggccaagacccacgcggagtagtaggcacattcgacatctggggccacggcacaatggtaacagtaagctca

SEQ ID NO: 55805 - RNA, 432 nt, synthetic construct
  misc_feature 1..432: note = derived and/or modified sequence opt11 from anti-HIV_cap256-038-104487_VR-Chain
  source 1..432: mol_type = other RNA
ctcgtgcaattggtcgagagcgggggcggggtcgtgcaaccgggcaagagcttgcgcttgagctgtgccgcgagcgggttcacgttctcgagctatgccatgcactggatcaggcaagcgcccgggaaagggctcgagtgggtggccgtgatctcggacgatggctcgataaagaactatgccgatagcgtgaaagggcgctttaccataagcagggacaatagcaagaacacgctatatctacagatgaatagcttgcgagcggaagataccgcggtctattactgtgccaaggacttgggcgagagcgagaacgaggaatgggccacggactattacgggttctcgatcgggtacccgggccaggacccgagaggggtcgtgggcatattcgatatctgggcccagggcacgatggtgaccgtgagctca

SEQ ID NO: 55806 - RNA, 432 nt, synthetic construct
  misc_feature 1..432: note = derived and/or modified sequence opt11 from anti-HIV_cap256-038-102308_VR-Chain
  source 1..432: mol_type = other RNA
caagtgcaattggtagagagcgggggcggggtcgtgcaaccgggcgggagcttgcgattgagctgtgccgcgctcgatttcccgttctcgagctttggcatgcactgggtcaggcaaacgcccgggcgcgggctcgagtgggtggccataatctggagcgatggctcgaacaggtactatgtcgatagcgtgaaagggcgctttaccataagcagggacaatagcaagaacacgctatatctccagatgaatagcttgcgcccggacgatacagcggtctattactgtgtcaaggacctgggcgagagcgagaacgaggaatgggccacggactattacgatttctcggtagggtacccgggacagggcccgcgaggggtcgtgggcatattcgatatctggggccagggcacgatggtgaccgtgagctca

SEQ ID NO: 55807 - RNA, 432 nt, synthetic construct
  misc_feature 1..432: note = derived and/or modified sequence opt11 from anti-HIV_cap256-038-091115_VR-Chain
  source 1..432: mol_type = other RNA
caagtgcaattggtcgagagcgggggcggggtcgtgcaaccgggcaggagcttgcgcttgagctgtgccgtgagcgggttcacgttctcgagctatggcttgcactgggtcaggcaagcgcccgggaaagggctcgagtgggtggccgtgatctcgtacgatggctcgaacaagtactatgccgatagcgtgaaagggcgctttaccataagcagggacaatagcaagaacacgctctatctccagatcaatagcttgcgcgcggaagataccgcggtctattactgtgccaaggacttgggcgagagcgagaacgaggaatgggccacggactattacgatttctcgatcgggtacccgggccaggacccgcgcgcggtcgtgggcgcgttcgatatctggggccagggcacgatggtgaccgtgagctcg

SEQ ID NO: 55808 - RNA, 432 nt, synthetic construct
  misc_feature 1..432: note = derived and/or modified sequence opt11 from anti-HIV_cap256-038-090262_VR-Chain
  source 1..432: mol_type = other RNA
caagtgcaattggtcgagagcgggggcggggtcgtgcaagcgggcgggagcttgcgcttgagctgtgccgcgagcgggttcacgttcaataactatggaatgcactgggtcaggcaagcgcccgggaaagggctcgagtgggcggcctttatcaggtacgatggctcgaacaagtactatgccgatagcgtgcgcggacgctttaccataagcagggacaatagcaagaacacgctctatctccagatgaatagcttgcgcgcggaagataccgcggtctattactgtgtcaaggacgtgggcgagagcgagaacgaggaatgggcctcggactattacgatttcgggcgcgattacccgggccaggacacgcgcgcggtcgtgggcgcgttcgatatctggggccagggcacgatggtgaccgtgagctcg

SEQ ID NO: 55809 - RNA, 432 nt, synthetic construct
  misc_feature 1..432: note = derived and/or modified sequence opt11 from anti-HIV_cap256-038-083260_VR-Chain
  source 1..432: mol_type = other RNA
caagtgcaattggtcgagagcgggggcggactcgtgaaaccgggcgggagcttgcgcttgagctgtgccgcgagcggattcacgttctcggactattacatgacctggatcaggcaagcgcccgggaaagggctcgagtgggtggccgtgatctcgtacgatggcgggaacaagtactatgccgatagcgtgaaagggcgctttaccataagcagggacaatagcaagaacacgctctatctccagatgaatagcttgcgagcggaagataccgcgctctattactgtgccaaggacttgggagagagcgagaacgaggaatgggcctcggactattacgatttcgggcgcgattacccgggccaggactcgcgcggggtcgtgggcacgttcgatgtctggggccagggcacgatggtgaccgtgagctcg

SEQ ID NO: 55810 - RNA, 432 nt, synthetic construct
  misc_feature 1..432: note = derived and/or modified sequence opt11 from anti-HIV_cap256-038-080981_VR-Chain
  source 1..432: mol_type = other RNA
caagtgcaattggtagagagcgggggcggggtcgtgcaaccgggcaggagcttgcgcttgagctgtgccgcgagcgggttcacgttctcgagctatggaatgcactgggtcaggcaagcgcccgggaaagggatggagtgggtggccgtgatctcgtacgatggctcgaacaagtactatgccgatagcgtgaaagggcgatttaccataagcagggacaatagcaagaacacgctctatctccagatgaatagcttgcgcgcggtcgataccgcggtctattactgtgccaaggacttgggcgagggcgagaacgaggaatgggccacggactattacgatttctcgatcgggtacccgggccaggacccgcgcggggtcgtgggcgcgttcgatatctggggccagggcacgatggtgaccgtgagctcg

SEQ ID NO: 55811 - RNA, 432 nt, synthetic construct
  misc_feature 1..432: note = derived and/or modified sequence opt11 from anti-HIV_cap256-038-080873_VR-Chain
  source 1..432: mol_type = other RNA
ctcgtgcaattggtcgagagcgggggcggggtagtgcaaccgggcgggagcttgcgattgagctgtgccgcgagcgggttcaggttctcaagctatggcatgcactgggtcaggcaagcgcccgggaaagggctcgagtgggtggcctttatcaggtacgatggctcgttcaaggactatgccgatagcgtgcgcgggcgatttaccataagcagggacaatagcaagaacacggtctatctccagatgaatagcttgcgcgcggaagataccgcggtctattactgtgtcaaggacttgggcgagagcgagaaagaggaatggccctcggactattacgatttcgggcgcgattacccgggccaggactcgcgcggggtcgtgggcgtgttcgatatctggggccagggaacgatggtgaccgtgagctcg

SEQ ID NO: 55812 - RNA, 432 nt, synthetic construct
  misc_feature 1..432: note = derived and/or modified sequence opt11 from anti-HIV_cap256-038-074413_VR-Chain
  source 1..432: mol_type = other RNA
caagtgcaattggtcgaaagcgggggcggggtcgtgcaaccgggcgggagcttgcgcttgagctgtgccgcgagcgggttcacgttctcgacctatggcatgcactgggtcaggcaaccgcccgggaaaggactagagtgggtggcctttatcaggtacgatggctcgaacacgtactatgccgatagcgtgaaagggcgatttaccataagcagggacaatagcaagaacacgctctatctccagatgaatagcttgcgcgcggaagataccgcggtctattactgtgccaaggacttgggcgagagcgagaacgaggaatgggcatcggactattacgatttcgggcgcgattacccgggccaggacccgcgcggggtcgtgggcgtgttcgatatctggggccagggcacgatggtgaccgtgagctcg

SEQ ID NO: 55813 - RNA, 432 nt, synthetic construct
  misc_feature 1..432: note = derived and/or modified sequence opt11 from anti-HIV_cap256-038-073153_VR-Chain
  source 1..432: mol_type = other RNA
caagtgcaattggtcgagagcgggggcggggtcgtgcaaccgggcaggagcttgcgcttgagctgtgccgcgagcgggttcacgttctcgagctatggcatgcactgggtcaggcaagcgcccgggaaagggctcgagtgggtggccttgatctcatacgatggcacgaacaagtactatgccgatagcgtgaaagggagatttaccataagcagggacaatagcaagaacacgctctttctccagatgaatagcttgcgcgcggaagataccgcgctctattactgtgccaaggacttgggcgagagcgagaacgaggaatgggcctcggactattacgatttcgggcgcgattacccgggccaggacccgcgcggggtcgtgggcacgttcgatatctggggccagggcacgatggtgaccgtgagctcg

SEQ ID NO: 55814 - RNA, 432 nt, synthetic construct
  misc_feature 1..432: note = derived and/or modified sequence opt11 from anti-HIV_cap256-038-064227_VR-Chain
  source 1..432: mol_type = other RNA
gaggtgcaagtggtggagagcgggggagggctagtgcaaccgggagggagcttgagattgagctgtgcggcgagcgggttcacgttctcgaactattggatgagctgggtaaggcaagcgccggggaaagggctggagtgggtggcagtgatgtcgttctcggggagtggaagttactatgcggatagcgtgaaagggagatttacaataagctcggacgatagcatgaacacggtatatctacagatgaatagcttgagggcggaagatacggcggtatattactgtgcgaaggacttgggggagagggagaacgaggaatgggcaagtgactattacgatttcgggagagattacccgggacaggacccgagaggggtggtgggatcgatagatacatgggggcatgggacgatggtgacagtgagcagt

SEQ ID NO: 55815 - RNA, 432 nt, synthetic construct
  misc_feature 1..432: note = derived and/or modified sequence opt11 from anti-HIV_cap256-038-061640_VR-Chain
  source 1..432: mol_type = other RNA
caagtgcaactggtagagagcgggggcggggtcgtgcaaccgggcaggagcttgcgcttgagctgtaccgcgagcaggttctcgttcaataactatgcaatgcactgggtcaggcaagcgccagggaaagggctcgagtgggtggccataatctcgaaagatggctcagacaatagctatgtcgatagcgtgaaagggcgctttaccataagcagggacaatagcaagaacacgctctatctccagatgaatagcttgcgcgcggaagataccgcggtctattactgtgccagggacttgggcgagagcgagaacgaggaatggccatcggactattacgatttcgggcgcgattacccgggccaggacccgcgcggggtcataggcacgttcgatgtctggggccagggcacgatggtgaccgtgagctcg

SEQ ID NO: 55816 - RNA, 414 nt, synthetic construct
  misc_feature 1..414: note = derived and/or modified sequence opt11 from anti-HIV_cap256-038-059482_VR-Chain
  source 1..414: mol_type = other RNA
cgcggggtccagtgccaggtccagctagtggaatcgggcgggggcgtggtccagcccgggttcacgttctcgagctatgtcatgcactgggtaaggcaagcgcccggaaaagggctcgagtgggtggccgatatctcgtacgatggctcgaacaagtactatgccgatagcgtgaaagggcgcttgaccataagcagggacaatagcaagaacacgctctatctccagatgaatagcttgcgcgcggaagataccgcggtctattactgtgtcaaggacttgggagagagcgagaaagaggaatggccctcggactattacgatttcgcgaccgggtacccggtccaggacccgcgcgcggtcgtgggcgcgttcgatatctggggccagggcacgatggtgaccgtgagcccg

SEQ ID NO: 55817 - RNA, 432 nt, synthetic construct
  misc_feature 1..432: note = derived and/or modified sequence opt11 from anti-HIV_cap256-038-054000_VR-Chain
  source 1..432: mol_type = other RNA
gaagtgcaattggtcgagagcgggggctcggtcgtgcgaccgggcgggagcttgcgcttgagctgtgcagcgagcgggttcacgttcgatgactcgggcatgagctgggtcaggcaagggcccgggaaagggctcgagtgggtggccgtgatctcgtacgatggcgggaacaagtactatgcagatagcgtgaaagggcgctttacaataagcagggacaatagcaagaacacgctctatctccagatgaatagcttgcgagcggaagataccgcgctctattactgtgccaaggacttgggcgagagcgagaacgaggaatgggcctcggactattacgatttcgggcgcgattacccgggccaggactcgcgcggggtcgtgggcacgttcgatgtctggggccagggcacaatggtgaccgtgagctcg

SEQ ID NO: 55818 - RNA, 432 nt, synthetic construct
  misc_feature 1..432: note = derived and/or modified sequence opt11 from anti-HIV_cap256-038-050554_VR-Chain
  source 1..432: mol_type = other RNA
gaagtgcaattgctcgagagcgggggcgatctcgtgcaatcgggcgggagcctgcgattgagctgtgtcgcgagcgggttcacgttctcgacccatgccatgacctgggtcaggcaagcgcccgggaaagggctcgagtgggtggccgtgatctcgagcgatggctcgaacaagaactttgccgatagcgtgaaagggcgctttaccataagcagggacaatagcaagaacacgctctatctccagatgaatagcttgcgcccggaagataccgcggtctattactgtgccaaggacttgggcgagagcgagaacgaggaatgggccacggactattacgatttctcgaccgggtacccggtccaggacccgcgcgcggtcgtgggagcgttcgatatctggggccagggcacgatggtgaccgtgagctcg

SEQ ID NO: 55819 - RNA, 432 nt, synthetic construct
  misc_feature 1..432: note = derived and/or modified sequence opt11 from anti-HIV_cap256-038-044256_VR-Chain
  source 1..432: mol_type = other RNA
caagtgcaattggtagagagcgggggcggggtcgtgcaaccgggaaggagcttgcgattgagctgtgccgcgagcgggttcacgttctcgagctatgccatgcactgggtcaggcaagcgcccgggaaagggcttgagtgggtggccgtgatctcgtacgatggctcgaacaagtaccatgccgggagcgtgaaagggcgctttatcataagcagggacaatagcaagaacacgctctatctccagatgaatagcttgcgcgcggaagataccgcgctctattactgtgccaaggacctgggagagagcgagaacgaggaatgggcctcggactattacgatttcgggcgagattacccgggccaggacccgcgcggggtcgtgggcacgttcgatatctggggccagggcacgatggtgaccgtgagctcg

SEQ ID NO: 55820 - RNA, 432 nt, synthetic construct
  misc_feature 1..432: note = derived and/or modified sequence opt11 from anti-HIV_cap256-038-040944_VR-Chain
  source 1..432: mol_type = other RNA
caagtgcaattggtcgagagcgggggcggggtcgtgcaaccgggcaggagcctgcgcttgagctgtgccgcgagcgggttcacgttctcgaactatgccatggactgggtcaggcaagcgcccgggaaagggctcgagtgggtggccgtgatctcgtacgatggctcgaacaagtactatgccgatagcgtgaaagggcgctttaccataagcagggacaatagcaagaacacgctctatctccagatgaatagcttgcgcgcggaagataccgcggtctattactgtgccaaggacttgggcgagagcgagaacgaggaatgggccacggactattacgatttctcgaccgggtacccgggccaggacccgcgagcggtcgtgggcgcgttcgatatctggggccagggcacgatggtgaccgtgagctcg

SEQ ID NO: 55821 - RNA, 432 nt, synthetic construct
  misc_feature 1..432: note = derived and/or modified sequence opt11 from anti-HIV_cap256-038-040090_VR-Chain
  source 1..432: mol_type = other RNA
caagtgcaattggtcgagagcgggggcggggtcgtgcaaccgggcaggagcttgcgcttgagctgtgccgcgagcgggttctcgttctcgaactatgccatggactgggtaagacaagcgcccgggaaagggctcgagtgggtggccgtgatctcgagcgatggctcgaacaagaactacgccgatagcgtgaaagggcgctttaccataagcagggacaatagcaagaacacgctctatctccagatggatagcctgcgcgcggacgataccgcggtctattactgtgccaaggacttgggcgagagcgagaacgaggaatgggccacggactattacgatttctcgatcgggtacccggtccaggacccgcgcggggtcgtgggcatattcgatatatggggccagggcacgatggtgaccgtgagctcg

SEQ ID NO: 55822 - RNA, 432 nt, synthetic construct
  misc_feature 1..432: note = derived and/or modified sequence opt11 from anti-HIV_cap256-038-032874_VR-Chain
  source 1..432: mol_type = other RNA
caagtgcaattggtcgagagcgggggcggggtcgtgcaaccgggcgggagcctgcgcttgagctgtgccgcgagcgggttcacgttctcgagctatggcatgcactgggtcaggcaagcgcccgggaaagggctcgagtgggtggcctttatcaggtacgatggcaataacaagtactatgccgatagcgtgaaagggcgctttaccataagcagagaaaatagcaagaacacgctctatctccagatgaatagcttgcgcgcggaagataccgcggtctatcactgtgccaaggacttgggcgagagcgagaaagaggaatgggcctcggactattacgatttcgggcgcgattacccgggccaggacccgcgcggggtcgtgggaacgttcgatatctggggccatggcacgatggtgaccgtgagctcg

SEQ ID NO: 55823 - RNA, 432 nt, synthetic construct
  misc_feature 1..432: note = derived and/or modified sequence opt11 from anti-HIV_cap256-038-025899_VR-Chain
  source 1..432: mol_type = other RNA
caagtgcaattggtcgagagcgggggcggggtcgtgcaaccgggaaggagcttgcgcttgagctgtgtcgcgagcgggttcacgttctcgaactatgccatgtactgggtcaggcaagcgcccgggaaagggctagagtgggtgaccataatctcgttcgatggctcgaaccagtactatgccgatagcgtgaaagggcgctttaccataagcagagaaaatagcaagaacacgctctatctccagatgaatagcttgcgcgcggaagataccgcggtctattactgtgccaaggacttgggagagcgcgagaacgaggaatgggcctcggactattacgatttcgggcgcgattacccgggccaggacccgcgcggggtcgtgggctcgatcgatacctggggccatggcacgatggtgaccgtgagctcg

SEQ ID NO: 55824 - RNA, 432 nt, synthetic construct
  misc_feature 1..432: note = derived and/or modified sequence opt11 from anti-HIV_cap256-038-024581_VR-Chain
  source 1..432: mol_type = other RNA
cacatacaactggtcgagagcgggggcggggtcgtgcaaccgggcgggagcctgcgcttgagctgtgccgcgagcgggttcccgttctcgagctttggcatgcactgggtcaggcaaacgcccgggcgcgggctagagtgggtggccataatctggagcgatggctcgcacaaggaatatacagatagcgtgaaagggcgctttaccataagcagagacaatagcaggagcacgatggatctacagatgaataacttgcgcccggaagataccgcggtctattactgtgccaaggacttgggcgagcgcgagaacgaggaatgggcctcggactattacgatttcgggcgcgattacccgggccaggacccgcgcggggtcgtgggatcgatcgatacctggggacatggcacgatggtgaccgtgagctca

SEQ ID NO: 55825 - RNA, 432 nt, synthetic construct
  misc_feature 1..432: note = derived and/or modified sequence opt11 from anti-HIV_cap256-038-013345_VR-Chain
  source 1..432: mol_type = other RNA
caagtgcaattggtcgagagcgggggcggggtcgtgcaaccgggaaggagcttgcgcctgagctgtgccgtgagcgggttcacgttctcaagctatggcatgcactgggtcaggcaagcgcccgggaaagggctcgagtgggtggccgcgatctcgtacgatggctcgaacaagtactatgtcgatagcgtgaaagggcgatttaccataagcagggacaatagcaagaacacgctctatctccagatgaatagcttgcgagcggaagataccgcggtctattactgtgccagggacttgggcgagcgcgagatcgaggaatgggccacggactattacgatttctcgatcgggtacccgggccaggacccgcgcggggtcgtgggcgtgttcgatatctggggccagggcacgatggtgaccgtgagctcg

SEQ ID NO: 55826 - RNA, 438 nt, synthetic construct
  misc_feature 1..438: note = derived and/or modified sequence opt11 from anti-HIV_cap256-038-011559_VR-Chain
  source 1..438: mol_type = other RNA
caagtgcaattggtcgagagcgggggcggggtcgtgcaaccgggcaggagcttgcgattgagctgtgaagcgagcgggttcacgttctcgagctatggcatggactgggtcaggcaagcgcccgggaaagggctcgagtgggtggcattgatctcgcacgatggatcgaacaagcactatgccgatagcgtgaaagggcgatttaccataagcagggacaatagcaggaacacgctctatctccagatgaatagcttgcgcgcggaagataccgcgctctattactgtgccaaggacttgggcgagagcgagaacgaggacgaggaatgggcctcggactattacgatttcgggcgagattacccgggccaggactcgcgcggggtcgtgggcacgttcgatatgtggggccagggcacgatggtgacagtgagctcg

SEQ ID NO: 55827 - RNA, 432 nt, synthetic construct
  misc_feature 1..432: note = derived and/or modified sequence opt11 from anti-HIV_cap256-038-009634_VR-Chain
  source 1..432: mol_type = other RNA
caagtgcaattggtcgagagcgggggcggggtcgtgcaaccgggcaggagcttgcgcttgagctgtgccgcgagcgggttcacgttcacgagctttggcatgcactgggtcaggcaagcgccagggaaagggctcgagtgggtggccgtgatatcgtacgatggcaataacaagtactatgccgatagcgtgaaagggcgctttaccataagcagggaaaatagcaagaacacgctctatctccagatgaatagcttgcgcgcggaagatacagcggtctatcactgtgccaaggacttgggcgagagcgagatcgaggaatggacctcggactattacgatttcgggcgcgattacccgggccaggacccgcgcggggtctttggaacgttcgatatctggggccatggcacgatggtgaccgtgagctcg

SEQ ID NO: 55828 - RNA, 432 nt, synthetic construct
  misc_feature 1..432: note = derived and/or modified sequence opt11 from anti-HIV_cap256-038-006730_VR-Chain
  source 1..432: mol_type = other RNA
caagtgcaactggtcgagagcgggggcggggtcgtgcaaccgggcaggagcttgcgcttgagctgtgccgcgagcgggttcacgttctcgagctttggaatgcactgggtcaggcaagcgcccgggaaagggctcgagtgggtggccgtgatctcgaaagatggctcggacaatagctatgtagatagcgtgaaagggcgatttaccataagcagagacaatagcaagaacacgctctatctccagatgaatagcctgcgcgcggaagataccgcggtctattactgtgccagggacttgggcgagagcgagaacgaggaatggccctcggactattacgatttcgggcgcgattacccgggccaggacccgcgcggggtcataggcacgttcgatgtctggggccagggcacgatggtgaccgtgagctcg

SEQ ID NO: 55829 - RNA, 432 nt, synthetic construct
  misc_feature 1..432: note = derived and/or modified sequence opt11 from anti-HIV_cap256-038-004887_VR-Chain
  source 1..432: mol_type = other RNA
caagtgcaattggtcgagagcgggggcggggtcgtgcaaccgggcaggagcttgcgattgagctgtgccgcgagcgggttctcgttctcgacctcgggcatgcactgggtcaggcaagcgccagggaaagggatggagtgggtggccgtgatctcatacgatggatcgaacaagtactatgccgatagcgtgaaagggcgctttaccataagcagggacaatagcaagaacacgctctatctccagatgaatagcttgcgcgcggtcgataccgcggtctattactgtgcaaaggacttgggcgagggcgagaacgaggaatgggccacggactattacgatttctcgatcgggtacccggtccagaacccgcgagggctcgtgggcgcgttcgatatctggggccagggcacgatggtgaccgtgagctcg

SEQ ID NO: 55830 - RNA, 432 nt, synthetic construct
  misc_feature 1..432: note = derived and/or modified sequence opt11 from anti-HIV_cap256-038-004840_VR-Chain
  source 1..432: mol_type = other RNA
caagtgcaactggtcgagagcgggggcggggtcgtgcaaccgggcaggagcttgcgcttgagctgtgccgcgagcgggttcacgttctcgagctttggcatgcactgggtcaggcaatcgcccgggaaagggctcgagtgggtggccgtgatctcgtacgatggcaataacaagtactatgccgatagcgtgaaagggcgctttaccataagcagggaaaatagcaagaacacgctctatctccagatgaatagcctgcgcacggacgataccgcggtctattactgtgccaaggacttgggcgagagcgagaccgaggaatggccctcggactattacgatttcgggcgcgattacccgggccaggacccgcgcggggtcgtgggcacgttcgatatctggggccatggcacgatggtgaccgtgagctcg

SEQ ID NO: 55831 - RNA, 432 nt, synthetic construct
  misc_feature 1..432: note = derived and/or modified sequence opt11 from anti-HIV_cap256-038-002181_VR-Chain
  source 1..432: mol_type = other RNA
gaagtgcaattggtcgagagcgggggcgggctcgtgcaaccgggcaggagcttgcgattgagctgtgccgcgagcgggttcacgttcgaggactatgccatgcactgggtcaggcaagcgcccgggaaagggctcgagtgggtggccgtgatctcgtacgatggctcgaacaagtactatgtcgatagcgtgaaagggcgctttaccataagcagggacaatagcaagaacacgctctatctccagatgaatagcttgcgcgcggaagataccgcggtctattactgtgccaaggacttgggcgagagcgagaacgaggaatgggccacggactattacgatttctcgatcgggtacccgggccaggacccgcgaggggtcgtgggcatattcgatatctggggccagggcacgatggtgaccgtgagctcg

SEQ ID NO: 55832 - RNA, 432 nt, synthetic construct
  misc_feature 1..432: note = derived and/or modified sequence opt11 from anti-HIV_cap256-038-001902_VR-Chain
  source 1..432: mol_type = other RNA
caagtgcaattggtcgagagcgggggaggggtcgtgcaaccgggcaggagcttgcgcttgagctgtgccgcgagcgggttcacgttctcgagctttggcatgcactgggtcaggcaagcgcccgggaaagggctcgagtgggtggccgtgatctcatacgatggcaataacaagtactatgccgatagcgtgaaagggcgctttaccataagcagggaaaatagcgagaacacgctctatctccagatgaatagcttgcgcgcggacgataccgcggtctattactgtgccaaggacttgggcgagagcgagaacgaggaatgggcctcggactattacgatttcgggcgcgattacccgggccaggacacgcgaggggtcgtgggcacgttcgatatctggggacatggcacgatggtgaccgtgagctcg

SEQ ID NO: 55833 - RNA, 432 nt, synthetic construct
  misc_feature 1..432: note = derived and/or modified sequence opt11 from anti-HIV_cap256-038-000976_VR-Chain
  source 1..432: mol_type = other RNA
caagtgcaattggtcgagagcgggggaggggtcgtgcaaccgggcaggagcttgcgcttgagctgtgccgcgagcgggttcacgttctcgagctttggcatgcactgggtcaggcaagcgcccgggaaagggctcgagtgggtggccgtgatctcggacgatggcaataacaagtactatgccgatagcgtgaaagggcgctttaccataagcagggacaatagcaagaacacgctctatctacagatgaatagcttgcgcgtggaagataccgcggtctattactgtgtcaaggacgtgggcgagagcgagaacgaggaatgggcctcggactattacgatttcgggcgcgattacccgggccaggacacgcgcgcggtcgtgggcgcgttcgatatctggggccagggcacgatggtgaccgtgagctcg

SEQ ID NO: 55834 - RNA, 432 nt, synthetic construct
  misc_feature 1..432: note = derived and/or modified sequence opt11 from anti-HIV_cap256-038-000384_VR-Chain
  source 1..432: mol_type = other RNA
caagtgcaattggtcgagagcgggggcggggtagtgcaaccgggaaagagcttgcgcctgagctgtgccgcgagcgggttcacgttctcgagctatgtaatgcactgggtcaggcaagcgcccgggaaagggctcgagtgggtggccgatatctcgtacgatggctcgaacaagtactatgccgatagcgtgaaaggacgcttgaccataagcagggacaatagcaagaacacgctctatctacagatgaatagcttgcgcgcggaagataccgcggtctattactgtgtcaaggacttgggcgagagcgagaaagaggaatggccctcagactattacgatttcgggcgcgattacccgggccaggactcgcgcggggtcgtgggcgtgttcgatatctggggccagggcacgatggtgaccgtgagctcg

SEQ ID NO: 55835 - RNA, 321 nt, synthetic construct
  misc_feature 1..321: note = derived and/or modified sequence opt11 from anti-HIV_206-314431_VR-Chain
  source 1..321: mol_type = other RNA
caattcgtcctcacccaacccccctccgtctccgccgcccccggccaaaacgtcaccatctcctgctccggccccccctcccacatcgaaaaaaacgacgtctcctggtaccaacgcctccccggcatggcccccaaaatggtcatctacgaatcccgccgccgccccctcggcatccccgtccgcttcaccgcctcccgctccggctcctccgccaccctcgtcatcaccggcctccaaaccgccgacgaagccgactactactgcggcacctgggacggccgcatgaacttcggcaccggcaccaccgtcaccgtcctc

SEQ ID NO: 55836 - RNA, 321 nt, synthetic construct
  misc_feature 1..321: note = derived and/or modified sequence opt11 from anti-HIV_206-247594_VR-Chain
  source 1..321: mol_type = other RNA
caatccatcctcacccaacccccctccgtctcagccgcccccggccaaaacgtcaccatctcctgctccggccccccctcccacatcgaaaaaaacgacgtctcctggtaccaacgcttccccggcatggccccaaaaatgatcatctacgaatccaaacgccgccccttcggcgtccccggccgcttctccgcctcccgatccggcaaatccgccaccctcgccatcaccggcctccaaaccggcgacgaagccgactactactgcggcacctgggacggccgcatgaacttcggcaccggcaccaccgtcaccgtcctc

SEQ ID NO: 55837 - RNA, 321 nt, synthetic construct
  misc_feature 1..321: note = derived and/or modified sequence opt11 from anti-HIV_206-116890_VR-Chain
  source 1..321: mol_type = other RNA
caatccgtcctcacccaacccccctccgtctccgccgcccccggccaaaacgtcaccatctcctgctccggccccccctcccacatcgaaaaaaacgacgtctcatggtaccaacacctccccggcgaagcccccaaaatgatcatctacgaatcctggcgccgccccgccggcatccccgcccgcttctccgcctcccgctccggcaaatccggcaccctcgccatcaccggcctccaaaccggcgacgaagccgactactactgcggcacctggaacggccgcatgaacttcggcaccggcaccaccgtcaccgtcctc

SEQ ID NO: 55838 - RNA, 333 nt, synthetic construct
  misc_feature 1..333: note = derived and/or modified sequence opt11 from anti-HIV_206-072383_VR-Chain
  source 1..333: mol_type = other RNA
caatccgtcctcacccaaccaccctcagtctccgccgcccccggccaacgcgtcatcatctcctgctccggcaacaactccaccatcggcaacaacttcgtctcctggtaccaacaagtccccggcaccgcccccaaactcctaatctacgaaaccaaccgccgcccctccggcatccccgaccgcttctcaggctccaaatccggcacctccgccaccctcgccatctccggcctccaaaccggcgacgaagccgacttctactgcaccgtctggggcgtccgcaaaggcgtcgccgccgtcttcggcaccggcacccgcctcaccgtcctc

SEQ ID NO: 55839 - RNA, 333 nt, synthetic construct
  misc_feature 1..333: note = derived and/or modified sequence opt11 from anti-HIV_206-037527_VR-Chain
  source 1..333: mol_type = other RNA
caatcggtcttgacccagcccccgagcgtgagcgcggccccgggccagaaagtgatcataagctgtagcgggaacaatagcacgatcgggaaaatactcgtgagctggtaccagcaagtgcccgggaccgcgcccaagctcgtgatctatgaaacgaacaggcgcccgagcgggatcccggacaggttctcgggctcgaaatcgggcacgagcgcgaccttggccataaccgggctccagaccggggacgaggccgattacttttgcaaggtctggggcgtgcgcaagggcgtggccgcggtctttggcacgggcacgaaagtgaccgtgctc

SEQ ID NO: 55840 - RNA, 333 nt, synthetic construct
  misc_feature 1..333: note = derived and/or modified sequence opt11 from anti-HIV_206-009095_VR-Chain
  source 1..333: mol_type = other RNA
caatccgtcctcacccaacccccctccgtctccgccgcccccgcccaacgcgtcatcatctcctgctccggcgacaactccaccatcggcaacaacttcgtctcctggtaccaacaagtccccggcgccgcccccaaactcctcatctacgaaaccaaccgccgcccctccggcatccccgaccgcttctcaggctccaaatccggcaccaccgccaccctcgccatctccggcctccaaaccggcgacgaagcagactaccactgcaccgtctggggcgtccgaaaaggcgtcgccgccgtcttcggcaccggcaccaaagtcaccgtcctc

SEQ ID NO: 55841 - RNA, 321 nt, synthetic construct
  misc_feature 1..321: note = derived and/or modified sequence opt11 from anti-HIV_176-503620_VR-Chain
  source 1..321: mol_type = other RNA
caatccgtcctcacccaacccccctccgtctccaccgcccccggccaaaccgtcaccgtctcctgctccggaggcacctccaacaccggcaacaacttcgtctcctggtaccaacacctccccggcaccgcccccaaactcctcatctacgaaaacaacaaacgccccctcggcgtccccgaccgcttctccggcgccaaatccggcacctccgccaccctcgccctcaccggcctccaaaccggcgacgaaggcgactactactgcgccacctggtccggctccctcaacatcggcaccggcaccaaagtctccgtcctc

SEQ ID NO: 55842 - RNA, 321 nt, synthetic construct
  misc_feature 1..321: note = derived and/or modified sequence opt11 from anti-HIV_176-478726_VR-Chain
  source 1..321: mol_type = other RNA
caatccgtcctcacccaacccccctccgtctccgccgcccccggccaaaacgtcaacatctcctgctccggccccccctcccacatcgaacgcaacgacgtctcctggtaccaacacctccccggcgccgcccccaaaatgatcatctacgaatcctggcgccgccccgccggcatccccgaccgcttctccgcctcccgctccggcgcctccgccaccctcgccatcaccggcctccaaaccggcgacgaagccgactactactgcggcacctggaacggccgcatgaacttcggcaccggcaccaccgtcaccgtcctc

SEQ ID NO: 55843 - RNA, 321 nt, synthetic construct
  misc_feature 1..321: note = derived and/or modified sequence opt11 from anti-HIV_176-245056_VR-Chain
  source 1..321: mol_type = other RNA
caatccgtcctcacccaacccccctccgtctccgccgcccccggccaaaacgtcaccatctcctgctccggccccccctcccacatcgaaaaaaacggcgtctcctggtaccaacaattccccggcatggcccccaaaatggtcatctacgaatccaaacgccgccccttcggcgtccccgcccgcttctccgcctcccgctccggcaaatccgccaccctagccatcaccggcctccaaaccggcgacgaagccgactactactgcggcacctgggacggccgcatgaacttcggcaccggcaccaccgtcaccgtcctc

SEQ ID NO: 55844 - RNA, 321 nt, synthetic construct
  misc_feature 1..321: note = derived and/or modified sequence opt11 from anti-HIV_176-164413_VR-Chain
  source 1..321: mol_type = other RNA
caatccgtcctcacccaacccccctccgtctccgccgcccccggccaaaaagtcaccatctcctgctccggcggcacctccaacatcggcaacaactacgtctcctggtaccaacgcctccccggcaccgcccccaaactcctcatctacgaaaacaacaaacgcccctccggcatccccgaccgcttctccggccccaaatccggcacctccgccaccctcgccatcaccggcctccaacccggcgacgaagccgactactactgcgccacctggtccggctccctcaacttcggcaccggcaccaaagtcaccgtcctc

SEQ ID NO: 55845 - RNA, 333 nt, synthetic construct
  misc_feature 1..333: note = derived and/or modified sequence opt11 from anti-HIV_176-094308_VR-Chain
  source 1..333: mol_type = other RNA
caatccgtcctcacccaacccccctccgtctccgccgcccccggccaaaaagtcatcatctcctgctccggcaacaactccaccatcggcaacaacttcgtctcctggtaccaacaagtccccggcacagcccccaaactcctcgtctacgaaacctaccgacgcccctccggcatccccgaccgctcctccggctccaaatccggcacaaccgccacccaagccatctccggcctccaaaccggcgacgaagccgactaccactgcaccgtctggggcgtccgcaaaggcgtcgccgccgtcttcggcaccggcaccaaagtcaccgtcctc

SEQ ID NO: 55846 - RNA, 333 nt, synthetic construct
  misc_feature 1..333: note = derived and/or modified sequence opt11 from anti-HIV_176-065321_VR-Chain
  source 1..333: mol_type = other RNA
caatcggtcttgacccagcccccgagcgtgagcgcggccccgggcaggcgcgtgatcataagctgtagcgggaacaatagcacaatcgggaacaatttcgtgagctggtaccagcaagtgcccgggaccgcgcccaaactcttggtctatgaaacgaacaggcgcccgagcgggatcccagacaggttctcgggctcgaaatcgggcacgagcgcgaccttggccataagcgggctccagaccggggacgaggccgattactattgcacggtctggggcgtgcgcaagggcgtggccgcggtctttggcacgggcacgaaagtgaccgtgctc

SEQ ID NO: 55847 - RNA, 324 nt, synthetic construct
  misc_feature 1..324: note = derived and/or modified sequence opt11 from anti-HIV_119-099719_VR-Chain
  source 1..324: mol_type = other RNA
caatccgtcctcacccaacccccctccgtctccgcagcccccggccaaaaagtcaccatctcctgctcaggctccaactcctacatcggcaacaaatacatctcctggtaccaacaattccccggcaccgcccccaaactcctcatctacgaaaacaacaaacgcccctccggcgtccccgaccgcttctccgcctccaaatccgccacctccgccaccctcgccatcaccggcctccacaccggcgacgaagcagactactactgcgaaacctgcgacggctccggcggcgtcttcggcaccggcaccaaagtcaccgtcctc

SEQ ID NO: 55848 - RNA, 327 nt, synthetic construct
  misc_feature 1..327: note = derived and/or modified sequence opt11 from anti-HIV_119-099536_VR-Chain
  source 1..327: mol_type = other RNA
gaactcacccaacccccctccgtctccgccgcctccggccaaaacgtcaacatctcatgctccggcggctcctccaacatcggctccaactacgtctcctggtaccaacaattccccggcaccgcccccaaactcctcatctacgaaaccaacaaacgcccctccggcatccccgaccgcttctccggctccaaatcaggcgcctccgccaccctcgccatcaccggcctccaaaccggcgacgaagccgactactactgcgccacctgggccgactccctaaactccgcccgcgtcttcggcacaggcaccaaagtcaccgtcctc

SEQ ID NO: 55849 - RNA, 333 nt, synthetic construct
  misc_feature 1..333: note = derived and/or modified sequence opt11 from anti-HIV_119-098907_VR-Chain
  source 1..333: mol_type = other RNA
caatcggtcttgacccagcccccgagcgtgagcgcgaccccgggccagaaagtgaccataagctgtagcgggagcaatagcaatatcggggacaagtacgtgagctggtaccagcactttcccgggaccgcgcccaagctcttggtctatgaaacgtacaggcgcccgagcgggatcccggacaggttctcgggctcgaaatcgggcacgagcgcgaccttggccataaccgggctccagaccggggacgaggccgattactattgcacgatctggggcgtgcgcaagggcgtgggcgcggtctttggcacgggcacgaaagtgatcgtgctc

SEQ ID NO: 55850 - RNA, 324 nt, synthetic construct
  misc_feature 1..324: note = derived and/or modified sequence opt11 from anti-HIV_119-098555_VR-Chain
  source 1..324: mol_type = other RNA
caatccgtcctcacccaacccccctccgtctccgccgcccccggccaaaacgtcacaatctcctgctcaggctccgcctccaacatcggcaaaaacttcgtctcctggtaccaacaactccccggcaccgcccccaaactcctcatctacggctccaacaaccgcccctccggcgtccccgaccgcttctccggctccaaatccggcacctccgcctccctcgcaatcaccggcctacaaaccggcgacgaagccgactactactgcgaaacctgggacggctccggcgccgtcttcggcaccggcaccaaagtcaccgtcctc

SEQ ID NO: 55851 - RNA, 324 nt, synthetic construct
  misc_feature 1..324: note = derived and/or modified sequence opt11 from anti-HIV_119-097828_VR-Chain
  source 1..324: mol_type = other RNA
caatccgtcctcacccaacccccctccgtctccgccgcccccggccaaaaagtcaccatctcctgctccggctcctcctccaacatcggcaaaaactacgtctcctggtaccaactcctccccggcaccgccccccgcctcgtcatctacgaaaacgacgaacgcccctccggcacccccgaccgcttctccggctccaaatccggcacctccgccaccctcgccatcaccggcctccacaccggcgacgaagccgactactactgcgaaacctgggacggctccggcggcgtcttcggcaccggcaccaaagtcaccgtcctc

SEQ ID NO: 55852 - RNA, 324 nt, synthetic construct
  misc_feature 1..324: note = derived and/or modified sequence opt11 from anti-HIV_119-096480_VR-Chain
  source 1..324: mol_type = other RNA
caatccgtcctcacccaacccccctccgtctccggcgcccccggccaacgcatcaccatctcctgctccggctcaacctccaacatcggccaaaactacgtctcctggtaccaacaactccccggcaccgcccccaaactactcatctccgacaacaaccgccgcccctcctggacccccgaccgcttctccggctccaaatccggcacctccgccaccctcgccatcaccggcctccaaaccggcgacgaagccgactactactgcgaaacctgggacggctccggcggcgtcttcggccccggcacccgcgtcaccgtcctc

SEQ ID NO: 55853 - RNA, 324 nt, synthetic construct
  misc_feature 1..324: note = derived and/or modified sequence opt11 from anti-HIV_119-095664_VR-Chain
  source 1..324: mol_type = other RNA
caatccgtcctcacccaacccccctccgtctccgccgcccccggccaaaaagtcaccatctcctgctccggcggcgccgccaacatcggcaaaaactccgtctcctggtaccaacaactccccggcaccgcccccaaactcctcatctacgacaacaaccgccgcccctccggcacccccgaccgcttctccggctccaaatccggcacctccgccaccctcgccatctccggcctccaaaccggcgacgaagccgactactactgcgaaacctggcacggctccggcggcgtcttcggcaccggcaccaaagtcaccgtcctc

SEQ ID NO: 55854 - RNA, 321 nt, synthetic construct
  misc_feature 1..321: note = derived and/or modified sequence opt11 from anti-HIV_119-095212_VR-Chain
  source 1..321: mol_type = other RNA
caatccgtcctcacccaacccccctccgtctccgccgcccccggccaaaaagtcaccatctcctgctccggctccacctccaacatcggcaaatccgacgtcttctggtaccaacaactccccggcaccgcccccaaactcctcatctccgaaacctcccgccgcccctccggcatccccgaccgcttctccggcgccaaatccggcacctccgccaccctcgccatcaccggcctccaaaccggcgacgaagccgactacttctgctccacctggtccggctcactcaacttcggcaccggcacccgcgtcaccgtcctc

SEQ ID NO: 55855 - RNA, 333 nt, synthetic construct
  misc_feature 1..333: note = derived and/or modified sequence opt11 from anti-HIV_119-094773_VR-Chain
  source 1..333: mol_type = other RNA
caatccgtcctcacccaatcccccaccgtctccgccgcccccggccaaaccgtcaccatctcctgctccggcggcacctccaacgtcggcaaaaacttcgtctcctggtaccaacaattcccccgcaccgcccccaaactcctcatctacgaaaacaacaaacgcccctccggcatccccgaccgcttctccggctccaaatccggcacctccgccaccctagtcatcaccggcctccaaaccggcgacgaagccgacttctactgcggcacctgggacggctccctccgcaccggcggcgtaatcggcaccggcacacgcgtcaccgtcctc

SEQ ID NO: 55856 - RNA, 324 nt, synthetic construct
  misc_feature 1..324: note = derived and/or modified sequence opt11 from anti-HIV_119-094508_VR-Chain
  source 1..324: mol_type = other RNA
caatccgtcctcacccaacccccctccgtctccgccacccccggccaacgcgtcaccgtctcctgctccggctcctcctccaacatcggcaaccactacgtctcctggtaccaacaagtccccggcaccgcccccaaactcctcatctccgaaaactcccgccgcccctccggcacccccgaccgcttctccggctccaaatccggcacctccgccaccctcgccatcaccggcctccaaaccggcgacgaagccgactactactgcgaaacctgggacggctccggcggcgtcttcggcaccggaaccaaagtcaccgtcctc

SEQ ID NO: 55857 - RNA, 324 nt, synthetic construct
  misc_feature 1..324: note = derived and/or modified sequence opt11 from anti-HIV_119-093795_VR-Chain
  source 1..324: mol_type = other RNA
caatccgtcctcacccaacccccctccgtctcagccgcccccggccaaaaagtcaccatctcctgctccggatcctcctccaacatcggcaacaactacgtctcctggtaccaatacctccccggcaccgcccccaaactcctcatctccgaaaacaaccgccgcccctccggcacccccgaccgcttctccggctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55858 - RNA, 321 nt, synthetic construct
  misc_feature 1..321: note = derived and/or modified sequence opt11 from anti-HIV_119-093732_VR-Chain
  source 1..321: mol_type = other RNA
caatcagtcctgacccagcccccaagcgtaagcgcagccgcaggccaaaacgtaaacataagctgcagcggacgcaaaagcaacgtcggaggcaactacgtaagctggtaccaacaattccccggaaccgcacccaaactcctaatctacgaagacaacaaacgcccaagctggatcccagacagattcacagcctcacgctcaggcacaagcgcaaccctaggcataaccggactccagaccggagacgaagccgactacttctgctcaacctggagcggaagcctaaacttcggcacaggcacacgcgtaaccgtactc

SEQ ID NO: 55859 - RNA, 333 nt, synthetic construct
  misc_feature 1..333: note = derived and/or modified sequence opt11 from anti-HIV_119-092903_VR-Chain
  source 1..333: mol_type = other RNA
caatccgtcctcacccaacccccctccgtctccgccgccccccgccaaaaagtcaccatctcctgctccggctcctcctccaacatcggcaaccactacgtctcctggtaccaacaactccccggcaccgcccccaaactcctcatctacgaaaacaacaaacgcccctccggcatccccgaccgcttctccggctccaaatccggcacctccgccaccctcgccatcaccggcctccaaaccggcgacgaagccgactactactgcgccacctgggccccccgcctcaactccgcccgcgtcttcggcaacggcaccatggtcaccgtcctc

SEQ ID NO: 55860 - RNA, 333 nt, synthetic construct
  misc_feature 1..333: note = derived and/or modified sequence opt11 from anti-HIV_119-092284_VR-Chain
  source 1..333: mol_type = other RNA
caatcggtcttgacccagcccccgagcgtgagcggggccccgggccagcgcgtgaccataagctgtaccgggagctcgagcaatatcgggggctatgacgtacactggtaccagcaagtgcccgggaccgcgcccaagctcttactctatgaaaatgacagacgcccgagcgggatcccggacaggttctcgggctcgaaatcgggcacgagcgcgaccttggtcataaccgggctacagaccggggacgaggccgatttctattgcgggacctgggacgggagcctgcgcacgggcggggtcataggcacgggcacgcgagtgaccgtgctc

SEQ ID NO: 55861 - RNA, 333 nt, synthetic construct
  misc_feature 1..333: note = derived and/or modified sequence opt11 from anti-HIV_119-091586_VR-Chain
  source 1..333: mol_type = other RNA
caatcggtcctgacccagcccccaagcatgagcgcggcaccgggccagcgcgtgaccataagctgtagcgggacctcgagcgatatcgggcgcaattacgtgagctggtaccagcaatttcccggggccgcgcccaaggtcttgatctatgaaaatagcaatcgcccgagcgggatcccggacaggttctcgggctcgaaatcgggcacgagcgcaaccttggccataagcgggctccagaccggggacgaggccgattactgttgcgcggtctggggcgtgcgcagaggcgcgggcgcggtctttggcgcgggcacgaaagtgaccgtgctc

SEQ ID NO: 55862 - RNA, 333 nt, synthetic construct
  misc_feature 1..333: note = derived and/or modified sequence opt11 from anti-HIV_119-091023_VR-Chain
  source 1..333: mol_type = other RNA
caatccgtcctcacccaaccaccctccgtctccgccgcccccggccaacgcgtcaccatctcctgctccggctccacctccaacatcggcaacaacttcgtctcctggtaccaccacgtccccggcaccgcccccaaactcctcatctacgacaacgtcaaacgccccaccaacgtccccgaccgcttctccggctccaaatccggcacctccgccaccctcgccatctccggcctccaaaccggcgacgaagccgactactggtgcgccgtctggggcgtccgccgaggcgccggcgccgtcttcggcgccggcaccaaagtcaccgtactc

SEQ ID NO: 55863 - RNA, 333 nt, synthetic construct
  misc_feature 1..333: note = derived and/or modified sequence opt11 from anti-HIV_119-090334_VR-Chain
  source 1..333: mol_type = other RNA
caatcggtcttgacccagcccccgagcgtgagcggggccccgggccagcgcgtgaccataagctgtaccgggagcgcgagcaatatcggggactcggacgtgcactggtaccagcaattgcccgggaccgcgcccaagctcttaatctttgacaatgacaagcgcccgagcgggatcccagacaggttctcgggctcgaaatcgggcacgagcgcgaccttggccataaccgggctccagagcggggacgaggccgattactactgcgcggtctggggcgtgcgccagggcgcgggcgcggtctttggcacgggcacgaaagtgaccgtgctc

SEQ ID NO: 55864 - RNA, 333 nt, synthetic construct
  misc_feature 1..333: note = derived and/or modified sequence opt11 from anti-HIV_119-088694_VR-Chain
  source 1..333: mol_type = other RNA
caatccgtcctcacccaacccccctccgtctccgccgcccccggccaaaaagtcaccatctcctgctccggctcctcctccaacatccccatcaacggcgtctcctggtaccaacaattccccggcaccgcccccaaactcctcgtctacgaaacctaccgccgcccctccggcatccccgaccgcttctccggctccaaatccggcacctccgccaccctcgccatcaccggcctacaaaccggcgacgaagccgactactactgcaccgtctggggcgtccgaaaaggcgtcggcgccgtcttcggcaccggcaccaaagtcaccgtcctc

SEQ ID NO: 55865 - RNA, 333 nt, synthetic construct
  misc_feature 1..333: note = derived and/or modified sequence opt11 from anti-HIV_119-088499_VR-Chain
  source 1..333: mol_type = other RNA
caatccgtcctcacccaacccccctccgtctccgccgcccccggccaaaaagtcaccatctcctgctccggctccaactcctacatcggcaacaaatacgtctcctggtaccaacaattccccggcaccgcccccaaactcctcatctacgaaaccaacaaacgcccctccggcatcccagaccgcttctccggctccaaatccggcacctccgccaccctcgccatcaccggcctccaaaccggcgacgaagccgactactactgcgccacctgggccccccgcctcaactccgcccgcgtcttcggcaacggcacaatggtcaccgtcctc

SEQ ID NO: 55866 - RNA, 333 nt, synthetic construct
  misc_feature 1..333: note = derived and/or modified sequence opt11 from anti-HIV_119-088298_VR-Chain
  source 1..333: mol_type = other RNA
caatcggtcttgacacagcccccgagcgtgagcgcggccccgaaagagaaagtgaccataagctgtagcgggggcacgagcaatatcgggcgcaattacgtgagctggtaccagcaagtgcccgggaccgcgcccaagctcttgatctatgaaaataacaagcgcccgagcgggatcccggacaggttctcgggctcgaaatcgggcacgagcgcgaccttggtcataaccgggctccagaccggggacgaggccgatttctattgcgggacctggggcgggagcttgcgcacgggcggggtcttgggcacgggcacgcgcgtgaccgtgctc

SEQ ID NO: 55867 - RNA, 324 nt, synthetic construct
  misc_feature 1..324: note = derived and/or modified sequence opt11 from anti-HIV_119-087488_VR-Chain
  source 1..324: mol_type = other RNA
caatccgtcctcacccaacccccctccgtctccgccgcccccggccaaaaagtcaccatcttctgctccggccgctactccaacatcgaatccaactacgtctcctggtaccaacaactccccggcaccgcccccaaactcctcatccacgaaaacaaccgccgcccctccggcacccccgaccgcttctccggctccaaatccggcacctccgccaccctcgccatcaccggcctccacaccggcgacgaagccgactactactgcgaaacctgggacggctccggcggcgtcttcggcaccggcaccaaagtcaccgtcctc

SEQ ID NO: 55868 - RNA, 333 nt, synthetic construct
  misc_feature 1..333: note = derived and/or modified sequence opt11 from anti-HIV_119-087423_VR-Chain
  source 1..333: mol_type = other RNA
caatccgtcctaacccaacccccctccgtctccgccgcccccggccaaaaagtcaccatctcctgctccgcctcctcctccaacatcggcaacaactacgtctcctggtaccaacaactccccgcaaccgcccccaaactcctcatctacgacaccgacaaacgcccctccggcatccccgaccgcttctccggctccaaatccggcacctccgccaccctcgccatcaccggcctccaaaccggcgacgaagccgactactactgcaccgtctggggcgtccgcaaaggcgtcggcgccgtcttcggcaccggcaccaaagtcaccgtcctc

SEQ ID NO: 55869 - RNA, 324 nt, synthetic construct
  misc_feature 1..324: note = derived and/or modified sequence opt11 from anti-HIV_119-087371_VR-Chain
  source 1..324: mol_type = other RNA
caatcggtcttgacccagcccccgagcttgagcgcggccccgggccagcgcgtgaccataagctgtagcgggggcgcgagcaatatcgggaaaaatagcgtgagctggtacgtgcaagtgcccgggaccgcgcccaagctcttgatctatgaaaataaccagcgcccgagcgggatctcggacaggttctcgggctcgaaatcgggctcgagcgcgaccttgggcataaccgggctccagaccgcggacgaggccgattactattgcgagacctgggacgggagcgggggcgtgttcgggaccgggaccaaggtcacggtcttg

SEQ ID NO: 55870 - RNA, 321 nt, synthetic construct
  misc_feature 1..321: note = derived and/or modified sequence opt11 from anti-HIV_119-087279_VR-Chain
  source 1..321: mol_type = other RNA
caatccgtcctcacccaacccccctccgtctccgccgcccccggccaaaaagtcaccatctcctgctccggctcctcctccaacatcggcaaaaactacgtctcctggtaccaacaattccccggcaccgcccccaaactcctcatgtacgaaaacaacaaacgcccctccggcgtccccgaccgcttctccggctccaaatctggcacctccgccaccctcgacatctccggcctccaaaccggcgacgaagccgactactactgctccacctggtccggctccctcaacttcggcaccggcacccgcgtaaccgtcctc

SEQ ID NO: 55871 - RNA, 324 nt, synthetic construct
  misc_feature 1..324: note = derived and/or modified sequence opt11 from anti-HIV_119-087146_VR-Chain
  source 1..324: mol_type = other RNA
caatccgtcctcacccaacccccctccgtctccgccgcccccggccaaaaagtcaccatctcatgctcaggctcctcctccaacatcggcaaaaactccgtctcctggtaccaacaattccccggcaccgcccccaaactcctcatctacgaaaacaacaaacgcccctccggcatccccgaccgcttctccggctccaaatccggcacctccgccaccctcgccatcaccggcctccacaccggcgacgaagccgactactactgcgaaacctgggacggctccggcggcgtcttcggcaccggcaccaaagtcacagtcctc

SEQ ID NO: 55872 - RNA, 324 nt, synthetic construct
  misc_feature 1..324: note = derived and/or modified sequence opt11 from anti-HIV_119-087048_VR-Chain
  source 1..324: mol_type = other RNA
cagttcgtgctcacgcaaccgccctcggtctcggccgcgcccaggcaaaaggtcataatctcgtgctcgggctcgagctcgaacataggcaagaactacgtctcatggtatcaacagctaccgggcacggccccgaaattgctcatatacgataacgataaaaggccctcgggcataagcgatcgctttagcgcgagcaagagcgggacctcggccacgctcgcgatcacgggcctgcacacgggcgatgaagcggactattactgtgaaacgtgggatggctcgggcggggtctttggcacgggcacgaaagtgaccgtgctc

SEQ ID NO: 55873 - RNA, 321 nt, synthetic construct
  misc_feature 1..321: note = derived and/or modified sequence opt11 from anti-HIV_119-085802_VR-Chain
  source 1..321: mol_type = other RNA
caatccatcctcacccaacccccctccgtctccgccgcccccggccaacgcgtcaccatcccctgcttcggcggccactccaacatcggctccaactacgtctcatggtaccaacacctccccggcaccgcccccaaactcctcatcttcgaaaacaacaaacgcccctccggcatccccgaccgcttctccggcgccaaatccggcacatccgccaccctcgccatcaccggcctccaaaccggcgacgaagccgactacttctgcgccacctggtccggcggcctcaacttcggcaccggcaccaaagtcaccgtcctc

SEQ ID NO: 55874 - RNA, 324 nt, synthetic construct
  misc_feature 1..324: note = derived and/or modified sequence opt11 from anti-HIV_119-085784_VR-Chain
  source 1..324: mol_type = other RNA
caatccttcctcacccaaccaccctccgtctccgccgcccccggacaaaaagtcaccatctcctgctccggctccaactccaacatcggcaacaactacgtctcctggtaccaatacctccccggcaccgcccccaaactcctcatctacgaaaacgaccgccgcccctccggcacccccgaccgcttctccggctccaaatcaggcacctccgccaccctcgccatcaccggcctacaaaccggcgacgaagccgactactactgcgaaacctgggacggctccggcggcgtcttcggcaccggcaccaaagtcaccgtcctc

SEQ ID NO: 55875 - RNA, 333 nt, synthetic construct
  misc_feature 1..333: note = derived and/or modified sequence opt11 from anti-HIV_119-085370_VR-Chain
  source 1..333: mol_type = other RNA
caatccgtcctcacccaacccccctccgtctccgccgcccccggccaaaccgtcaccatctcctgctccggctcctcctccaacatcggcaacacctacgtctcctggtaccaacacctccccggcaccgcccccaaactcctcatctacgacaacaacatccgcccctccggcatccccgaccgcttctccgcctccaaatccggcacctccgccaccctcgccatcaccggcctccaaaccggcgacgaagccgactactactgcgccacctgggccccctccctcaactccgcccgcgtcttcggctccggcacccgcgtcgccgtcctc

SEQ ID NO: 55876 - RNA, 321 nt, synthetic construct
  misc_feature 1..321: note = derived and/or modified sequence opt11 from anti-HIV_119-085276_VR-Chain
  source 1..321: mol_type = other RNA
caatccatcctcacccaaccaccctccgtctccgccgcccccggccaacgcgtcaccatctcctgctccggctcctcctccaacatcggcaacaactacgtctcctggtaccaacacgtccccggcaccgcccccaaactcctcatctacgaaaacaaccgccgaccctccggcacccccgaccgcttctccggcgccaaatccggcacctccgccaccctcgccatcaccggcctccaaaccggcgacgaagccgactacttctgctccacctggtccggctccctcaacttcggaaccggcaccaaagtcaccgtcctc

SEQ ID NO: 55877 - RNA, 333 nt, synthetic construct
  misc_feature 1..333: note = derived and/or modified sequence opt11 from anti-HIV_119-084885_VR-Chain
  source 1..333: mol_type = other RNA
caatcagtcttgacccagcccccgagcgtgagcgcggccccgggcgagaaagtgaccataagctgtagcgggagctcgagcaagatcgggaacaatttcgtgagctggtaccagcaagtgcccgggaccgcgcccaagctcttggtctatgaatcgtacaggcgcccgagcgggatcccggacaggttctcgggatcgaaatcgggcacgagcgcgaccttggccataaccgggctccagaccggggacgaggccgattactattgcacggtctggggcgtgcgcaagggcgtgggcgcggtctttggcacgggcacgaaagtgaccgtgctc

SEQ ID NO: 55878 - RNA, 333 nt, synthetic construct
  misc_feature 1..333: note = derived and/or modified sequence opt11 from anti-HIV_119-084874_VR-Chain
  source 1..333: mol_type = other RNA
caatcggtcctgacccagcccccgagcgtgagcggggccccgcgccagcgcgtaaccataagctgtagcgggagcgcgagcaatatcgggaaaaatagcgtgagctggtaccagcaagtgcccgggaccgcgcccaagctcttgatctatgaaaataacaagcgcccgagcggaatcccggacaggttctcgggctcgaaatcgggcacgagcgcgaccttggtcataaccgggctccagaccggggacgaggccgatttctattgcgggacctgggacgggagcttgcgcacgggcggggtcataggcacgggcacacgcgtgaccgtgctc

SEQ ID NO: 55879 - RNA, 333 nt, synthetic construct
  misc_feature 1..333: note = derived and/or modified sequence opt11 from anti-HIV_119-084691_VR-Chain
  source 1..333: mol_type = other RNA
caatccgtcctcacccaacccccctccgtctccgccgcccccggccaaaaagtcgtcatctcctgctccggctcatcctccatcatcgaaaaaaactccatctcatggtaccaacaaggccccggcgccgcccccaaactcctcatctacgaaaacgacaaacgcccctccggcatccccgaccgcttctccggctccaaatccgccacctccgccaccctcgccatcgtcggcctccaaaccggcgacgaagccgactactgctgcgccgtctggggcgtccgccgcggcgccggcgccgtattcggcgccggcaccaaagtcaccgtcctc

SEQ ID NO: 55880 - RNA, 324 nt, synthetic construct
  misc_feature 1..324: note = derived and/or modified sequence opt11 from anti-HIV_119-083793_VR-Chain
  source 1..324: mol_type = other RNA
caatccgtcctcacccaacccccctccgtctccgccgcccccggccaaaaagtcaccatctcctgctccggctcctcctccaacatcggcaaaaactccgtctcctggtaccaacaactccccgccaccgcccccaaactcctcatctacgaatccaacaaacgcccctccggcatccccgaccgcttctccggctccaaatccggcacctccgccaccctcgccatcaccggcctccaaaccggcgacgaagccgactactactgcgccacctgggacggccgcgtctccgtcatcggcaccggcaccaaagtcaccgtcctc

SEQ ID NO: 55881 - RNA, 324 nt, synthetic construct
  misc_feature 1..324: note = derived and/or modified sequence opt11 from anti-HIV_119-083163_VR-Chain
  source 1..324: mol_type = other RNA
caatccgtcctcacccaacccccctccgtctccggcgcccccggccaacgcgtcatcatctcctgcaccggctcctcctccaacatctggggctacgacgtccaatggtaccaacaactccccggcaccgcccccaaactcctcctctacgaaaacgaccgccgaccctccggcacccccgaccgcttctccggctccaaatccggcacctcagccaccctcgccatcaccggcctccacaccggcgacgaagccgactactactgcgaaacctgggacggctccggcggcgtcttcggcaccggcaccaaagtcaccgtcctc

SEQ ID NO: 55882 - RNA, 333 nt, synthetic construct
  misc_feature 1..333: note = derived and/or modified sequence opt11 from anti-HIV_119-082331_VR-Chain
  source 1..333: mol_type = other RNA
caatcggtcttgacccagcccccgagcataagcgcggccccgggccagaaagtgaccataagctgtagcgggggctcgagcaatatcggggccaattacgtgagctggtaccagcacttgcccgggaccgcgcccaagctcttgatctatgaaacgaacaagcgcccgagcgggatcccggacaggttctcgggctcgcaatcgggcacgagcgcgaccttagtcataaccgggctccagaccggggacgaggccgatttctattgcggaacctggggcgggagcttgcgcgcgggcggggtcataggcacgggcacgcgcgtgaccgtgctc

SEQ ID NO: 55883 - RNA, 324 nt, synthetic construct
  misc_feature 1..324: note = derived and/or modified sequence opt11 from anti-HIV_119-082070_VR-Chain
  source 1..324: mol_type = other RNA
cagagcgtgctcacgcaaccgccatcggtctcggccgcgcccgggcaaaaggtcgtgatctcgtgctcgggctcaagctcgatcatagaaaagaactcgatctcgtggtatcaacagggcccgggcgcggccccgaaattgctcatatacgagaacgatcgcaggccctcgggcacgcccgatcgctttagcgggagcaagagcgggacctcggccacgctcgcgatcacgggcttgcaaacgggcgatgaagcggactattactgtgaaacgtgggatggctcgggcggggtctttggcacgggcacgaaagtgaccgtgctc

SEQ ID NO: 55884 - RNA, 333 nt, synthetic construct
  misc_feature 1..333: note = derived and/or modified sequence opt11 from anti-HIV_119-081512_VR-Chain
  source 1..333: mol_type = other RNA
caatccgtcctcacccaaccaccctccgtctccgccgcccccggccaaaacgtcaccttctcctgctccggctccaactccaacatcggcgacaactacgtctcctggtaccaacaaatccccggcaccgcccccaaactcgtcatctacgacaacaacaaacgcccctccggcatccccgaccgcttctccggctccaaatccggcacctccgccaccctcgtcatcaccggcctccaaaccggcgacgaagcagacttctactgcggcacctgggacggctccctccgcaccggcggcgtcatcggcaccggcacacgcgtcaccgtcctc

SEQ ID NO: 55885 - RNA, 333 nt, synthetic construct
  misc_feature 1..333: note = derived and/or modified sequence opt11 from anti-HIV_119-080816_VR-Chain
  source 1..333: mol_type = other RNA
caactcgtcctcacccaacccccctccgcctccggcacccccggccaacgcgtcaccatctcctgctccggctcctcctccaacatcggctccaacttcgtctcctggtaccaacaacgccccggcaccgcccccaaactcctcatctacgaaaccaacaaacgcccctccggcatccccgaccgcttctccggctccaaatccggcacctccgccaccctcgccataaccggcctccaaaccggcgacgaagccgactactactgcgccacctgggccccccgcctcaactccgcccgcgtcttcggcaacggcaccatggtcaccgtcctc

SEQ ID NO: 55886 - RNA, 333 nt, synthetic construct
  misc_feature 1..333: note = derived and/or modified sequence opt11 from anti-HIV_119-079302_VR-Chain
  source 1..333: mol_type = other RNA
caatccgtcctcacccaaccaccctccgtctccgccgcccccggccaaaaagtcaccatctcctgctccggctcctcctcctacatcggcaacaaatacgtctcctggtaccaacaattccccggcaccgcccccaaactcctaatctacgaaaacaacaaacgcctctccggcatccccgaccgcttctccgcctccaaatccgccacctccgccaccctcgccatctcaggcctccaaaccggcgacgaagccgacttctactgcggcacctgggacggctccctccgcaccggcggcgtcatcggcaccggcacccgcgtcaccgtcctc

SEQ ID NO: 55887 - RNA, 327 nt, synthetic construct
  misc_feature 1..327: note = derived and/or modified sequence opt11 from anti-HIV_119-079292_VR-Chain
  source 1..327: mol_type = other RNA
caatccgtcctcacccaacccccctccgtctccgccgcccccggccaaaaagtcaccatctcctgctccggctccaactccaacatcggcaacaactacgtctcctggtaccaacaactccccggcaccgcccccaaactcctcatctacgacaacaacaaacgcccctccggcatccccgaccgcttctccggctccaaatccggcacctccgccaccctcggcatcaccggcctccaaaccggcgacgaagccaactactactgcggcacctgggacacctccctatcaggcgtcttcggcaccggcaccgaagtcatcgtcctc

SEQ ID NO: 55888 - RNA, 321 nt, synthetic construct
  misc_feature 1..321: note = derived and/or modified sequence opt11 from anti-HIV_119-079289_VR-Chain
  source 1..321: mol_type = other RNA
caatccgccctcacccaacccccctccgtctccgccgcccccggccaacgcgtcaccatctcctgctccggcaacaactccaacatcggcaacaacttcgtctcctggtaccaactcctccccggcaccgcccccaaactcctcatctacgaaaacaacaaacgctcctccggcatccccgaccgcttctccggctcaaaatccggcacctccgccaccctcggcatcaccggcctccaaaccggcgacgaagccgactacttctgctccacctggtccggctccctcaacttcggcaccggcacccgcgtcaccgtcctc

SEQ ID NO: 55889 - RNA, 324 nt, synthetic construct
  misc_feature 1..324: note = derived and/or modified sequence opt11 from anti-HIV_119-078935_VR-Chain
  source 1..324: mol_type = other RNA
caatccgtcctcacccaacccccctccgtatccgccgcccccggccaacgcgtcaccatctcctgctccggcacctccgccaacatcgaaaactactacgtctcctggtaccaacaactccccggcaccgcccccaaactcatcatctacgacgacaacaaacgcccctccggcatcccccaacgcttctccggctccaaatccggcacctccgccacactcggcatcaccggcctccaaaccggcgacgaagccgaatactactgcgaaacctgggacggctccggcggcgtcttcggcaccggcaccaaagtcaccgtcctc

SEQ ID NO: 55890 - RNA, 324 nt, synthetic construct
  misc_feature 1..324: note = derived and/or modified sequence opt11 from anti-HIV_119-078702_VR-Chain
  source 1..324: mol_type = other RNA
caatcagtcctaacccagcccccaagcgtaagcgcagccccaggccaaaaagtaaccataagctgcagcggaagctcaagcgtattcggcaaaaactacgtaagctggtaccaacacctacccggaaccgcacccaaactcctaatctacgaaaacaccaaacgcccaagcggaatcccagacagattctcaggatcaaaatcaggcacaagcgcaaccctggccataaccggactccagaccggagacgaagccgactactactgcgaaacctgggacggaagcggaggcgtattcggaagcggaaccaaagtcacagtccta

SEQ ID NO: 55891 - RNA, 324 nt, synthetic construct
  misc_feature 1..324: note = derived and/or modified sequence opt11 from anti-HIV_119-078593_VR-Chain
  source 1..324: mol_type = other RNA
caatccttcctcacccaacccccctccgtctccgccgcccccggccaaaaagtcaccatctcctgctccggctccaactccaacatcggcaacaactacgtctcctggtaccaacaagtccccggcaccgcccccaaactcctcatctacgaaaacaacaaacgcccctccggcatccccgaccgcttctccggctccaaatccggcacctccgccaccctcgtcatcaccggcctccacaccggcgacgaagccgactactactgcgaaacctgggacggctccggcggcgtcttcggcaccggctccaacgtcaccctcctc

SEQ ID NO: 55892 - RNA, 333 nt, synthetic construct
  misc_feature 1..333: note = derived and/or modified sequence opt11 from anti-HIV_119-077708_VR-Chain
  source 1..333: mol_type = other RNA
caatccgtcctcacccaacccccctcactctccgccgcccccggccaaaaagtcaccatctcctgctccggcaccacctccaacatcggcaacaactacgtctcctggtaccaacacctccccggcaccgcccccaaactcctcatctacgaaaacaccaaacgcccctccggcatccccgaccgcttctccggctccaaatccggcacctccgccaccctcggcatcaccggcctccaaaccggcgacgaagccgactactactgcaccgtctggggcgtccgcaaaggcgtcggcgccgtcttcggcaccggcaccaaagtcaccgtcctc

SEQ ID NO: 55893 - RNA, 321 nt, synthetic construct
  misc_feature 1..321: note = derived and/or modified sequence opt11 from anti-HIV_119-076904_VR-Chain
  source 1..321: mol_type = other RNA
caatccgtcctcacccaacccccctccgtctccgccgcccccggacaaaaagtcaccatctcctgctcccgctcctcctcccacatcgaaaactcctacgtctcctggtatcaacacctccccggcaccgcccccaaactcctcatctacgaaaacaacaaacgcccctccggcatccccgaccgattctccggctccaaatccggcacctccgccaccctcggcatctccggcctccaaaccggcgacgaagccgactacttctgctccacctggtccggctccctcaacttcggcaccggcacccgcgtcaccgtcctc

SEQ ID NO: 55894 - RNA, 324 nt, synthetic construct
  misc_feature 1..324: note = derived and/or modified sequence opt11 from anti-HIV_119-075862_VR-Chain
  source 1..324: mol_type = other RNA
caatccgtcctcacccaacccccctccatctccgcagcccccggccaaaaagtcaccatctcctgctccggctccgcctccaacatcggcaaaaactccgtctcatggtaccaacaattccccggcaccgcccccaaactcctcatctacgaaaacaaccgccgcccctccggcacccccgaccgattctccggctcaaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55895 - RNA, 333 nt, synthetic construct
  misc_feature 1..333: note = derived and/or modified sequence opt11 from anti-HIV_119-075465_VR-Chain
  source 1..333: mol_type = other RNA
caatccgtcctcacccaacccccctccgtctccgccgcccccggccaaaaagtcgtcatctcctgctccggatcctcctccatcatcggcaacaactacgtctcctggtaccaacaactccccggcaccgcccccaaactcctcatctacgaaaacaaccgccgcccctccggcatccccgaccgcttctccggctccaaatccggcacctccgccaccctcgccatctccggcctccaaaccggcgacgaagccgactactgctgcgccgtctggggcgtccgccgcggcgccggcgccgtcttcggcgccggcaccaaagtcaccgtcctc

SEQ ID NO: 55896 - RNA, 330 nt, synthetic construct
  misc_feature 1..330: note = derived and/or modified sequence opt11 from anti-HIV_119-074822_VR-Chain
  source 1..330: mol_type = other RNA
tcggtcttgacccagcccccgagcgtgagcgcggccccgggccagaacataaccataagctgtagcgggggctcgagcaatatcgcgaaaaattacataagctggtaccagcacttgcccgggaccgcgcccaagatcgtgatctatgacaatgacaaacgcccgctcgggatcccggacaggttctcggcctcgaaatcgggcacgagcgcgaccttgggcataaccgggctacagaccggggacgaggccgattactattgcgcggtctggggcgtgcgcaggggcgtgggcgcggtctttggcgcgggcacgaaagtgatcgtgctc

SEQ ID NO: 55897 - RNA, 333 nt, synthetic construct
  misc_feature 1..333: note = derived and/or modified sequence opt11 from anti-HIV_119-074629_VR-Chain
  source 1..333: mol_type = other RNA
caatcggtcttgacccagcccccgagcgagagcgcggccccgggccagaaagtgaccataagctgtagcgggggcacgagcaatatcgggaacaattacgtgagctggtacaggcgcttgcccgggaccgcgcccaagctcttaatctatgaaaataacaggcgcccgagcgggatcccggacaggttctcgggctcaaaatcgggcacgagcgcgaccttggccataagcgggctccagaccggggacgaggccgattactgttgcgcggtctggggcgtgcgcaggggcgcgggcgcggtctttggcgcgggcacgaaagtgaccgtgctc

SEQ ID NO: 55898 - RNA, 324 nt, synthetic construct
  misc_feature 1..324: note = derived and/or modified sequence opt11 from anti-HIV_119-074500_VR-Chain
  source 1..324: mol_type = other RNA
caatccgtcctcacccaacccccctccgtctccgccgcccccggccaaaaagtcaccatgtcctgctccggctcctcctccaacatcggcaacaactacgtctcctggtaccaatacctccccggcaccgcccccaaactcctaatctacgaaaacgaccgccgcccctccggcatccccgaccgcttctccgcctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55899 - RNA, 333 nt, synthetic construct
  misc_feature 1..333: note = derived and/or modified sequence opt11 from anti-HIV_119-073911_VR-Chain
  source 1..333: mol_type = other RNA
caatccgtcctcacccaacccccctccgtctccgccgcccccggccaacgcgtcaccatctcctgctccggctcctcctccaacatcgaaaacaactacgtctcatggtaccaacacctccccggcaccgcccccaaactcctcgtctacgacgacaacaaacgcccctccggcatcccccaccgcttctccgcctccaaatccggcacctccgccaccctcgccatcaccggcctacaaaccggcgacgaagccgactactactgcaccctctggggcgtccgcaaaggcgtcggcgccgtcttcggcaccggcaccaaagtcaccgtcctc

SEQ ID NO: 55900 - RNA, 324 nt, synthetic construct
  misc_feature 1..324: note = derived and/or modified sequence opt11 from anti-HIV_119-072765_VR-Chain
  source 1..324: mol_type = other RNA
caatccgtcctcacccaacccccctccgtatccgccgcccccggccaaaaagtaaccatctcctgctccggcaactcctccaacatcggcaacaacttcgtctcctggtaccaacaagtccccggcaccgcccccaaactcctcgtctacgaaacctaccgccgcccctccggcacccccgaccgcttctccggctccaaatccggcacctccgccaccctcgccatctcaggcctccaaaccggcgacgaagccgactactactgcggcacctgggacggctccggcggcgtcttcggcaccggcaccaaagtcaccgtcctc

SEQ ID NO: 55901 - RNA, 333 nt, synthetic construct
  misc_feature 1..333: note = derived and/or modified sequence opt11 from anti-HIV_119-072313_VR-Chain
  source 1..333: mol_type = other RNA
caattcgtcctcacccaaccaccctccgtctccgccgcccccggccaaaaagtcaccatctcctgctccgcctcctcatccatcatcggcaaaaactacgtctcctggtaccaacaattccccggcaccgcccccaaactcctcatctacgaagacaacaaacgcccctccggcatccccgaccgcttctccggctcaaaatccggcacctcagccaccctagccatcaccggcctccaaaccggcgacgaagccgactactactgcaccgtctggggcgtccgcaaaggcgtcggcgccgtcttcggcaccggcaccaaagtcaccgtcctc

SEQ ID NO: 55902 - RNA, 333 nt, synthetic construct
  misc_feature 1..333: note = derived and/or modified sequence opt11 from anti-HIV_119-072280_VR-Chain
  source 1..333: mol_type = other RNA
caatccgtcctcacccaacccccctccgtctccgccgcccccggccaaaaagtctccatctcctgctccggctccgactccaacctcggcgacaactacgtctcctggtaccaacaattccccggcaccgcccccaaactcctcatccacgacaacaacaaacgcccctccggcacccccgaccgcttctccggctccaaatccggcacctccgccaccctcgccatcaccggcctacaaaccggcgacgaagccgactactactgcgccacctgggccccccgcctcaactccgcccgcgtcttcggcaacggcaccatggtcaccgtcctc

SEQ ID NO: 55903 - RNA, 333 nt, synthetic construct
  misc_feature 1..333: note = derived and/or modified sequence opt11 from anti-HIV_119-071693_VR-Chain
  source 1..333: mol_type = other RNA
caatccgtcctcacccaacccccctccgtctccgccgccccaggccaaaaagtcgtcatctcctgctccggctcatcctccatcatcgaaaaaaactccatctcctggtaccaacaaggccccggcgccgcccccaaactcctcatctacgaaaacgacaaacgcccctccggcatccccgaccgcttctcaggctcaaaatccggcacctccgccaccctcgccatcaccggcctccaaaccggcgacgaagccgactactactgcaccatctggggcgtccgcaaaggcgtcggcgccgtcttcggcaccggcaccaaagtcaccgtcctc

SEQ ID NO: 55904 - RNA, 321 nt, synthetic construct
  misc_feature 1..321: note = derived and/or modified sequence opt11 from anti-HIV_119-071353_VR-Chain
  source 1..321: mol_type = other RNA
caatccgtcctcacccaacccccctccgcctccgccgcccccggccaaaaagtcaccatctcctgctccggctccaactccaacatcggcaacaacttcgtctcctggtaccaactcttccccggcaccgcccccaaactcctcatcttcgaaaacaacaaacgcccctccggcatccccgaccgcttctccggcgccaaatccggcacctccgccaccctcgccatcaccggcctccaaaccggcgacgaagccgactacttctgctccacctggtccggctccctcaacttcggcaccggcacccgcgtcaccgtcctc

SEQ ID NO: 55905 - RNA, 324 nt, synthetic construct
  misc_feature 1..324: note = derived and/or modified sequence opt11 from anti-HIV_119-069711_VR-Chain
  source 1..324: mol_type = other RNA
caatccgtcctcacccaaccaccctccgtctccgccgcccccggccaaaaagtcaccatctcctgctccggctcctcctccaacatcggcaacaactacgtctcctggtaccaacaactccccggcaccgcccccaaactcctcatctacgacaacaacaaccgcccctccggcgtccccgaccgcttctccggctccaaatccggcacctccgccaccctcgccatcaccggcctccaaaccggcgacgaagccgactactactgcgaaacctgggacgactccggcggcgtcttcggcaccggcaccaaagtcaccgtcctc

SEQ ID NO: 55906 - RNA, 333 nt, synthetic construct
  misc_feature 1..333: note = derived and/or modified sequence opt11 from anti-HIV_119-069061_VR-Chain
  source 1..333: mol_type = other RNA
caatccgtcctcacccaacccccctccgtctccgccgcccccggccaaaaagtcaccatctcctgctccggctcctcctccaacatcggctccaactacgtctcctggtaccaacaactccccggcaccgcccccaaactcctcgtctacgacaacaacgaacgcccctccggcatccccgaccgcttctccggctccaaatccggcacctccgccaccctcgccatcaccggcctccaaaccggcgacgaagccgactactactgcgccacctgggccccccgcctcaactccgcccgagtcttcggcaacggcaccatggtcaccgtcctc

SEQ ID NO: 55907 - RNA, 324 nt, synthetic construct
  misc_feature 1..324: note = derived and/or modified sequence opt11 from anti-HIV_119-068202_VR-Chain
  source 1..324: mol_type = other RNA
caatccgtcctcacccaagaaccctccgtctcaggcgcccccggccaacgcgtcaccatctcctgcaccggctccaactccaacatcggcggccacgacgtccactggtaccaacaactccccggcaccgcccccaaactcctcatctacgacaacgacaaacgcccctccggcatccccgaccgcttctccggctccaaatccgacacctccgcctccctcggcatcaccggcctccaaaccggcgacgaagccgactactactgcgaaacctgggacggctccggcggcgtcttcggcaccggcaccaaagtcaccgtcctc

SEQ ID NO: 55908 - RNA, 324 nt, synthetic construct
  misc_feature 1..324: note = derived and/or modified sequence opt11 from anti-HIV_119-068063_VR-Chain
  source 1..324: mol_type = other RNA
caatccgccctcacccaacccccctccgcctccggctccctcggccaatccgtcaccatctcctgcaccggcacccgctccgacgtcggcaactactacgtctcctggtaccaacaactccccggcaccgcccccaaactcctcatctccgaaaacaaccgccgcccctccggcacccccgaccgcttctccggctccaaatccggcacctccgccaccctcgccatctccggcctccaaaccggcgacgaagccgactactactgcggcacctgggacggctccggcggcgtcttcggcaccggcaccaaagtcaccgtcctc

SEQ ID NO: 55909 - RNA, 333 nt, synthetic construct
  misc_feature 1..333: note = derived and/or modified sequence opt11 from anti-HIV_119-067980_VR-Chain
  source 1..333: mol_type = other RNA
caatcggtcttgacccagcccccgagcgtgagcgcggccccgggccagaaagtgaccataagctgtagcgggaactcgagcaatatcgggaacaatttcgtgagctggtaccagcaagtgcccgggaccgcgcccaagctcttggtctatgaaacgtacagacgcccgagcgggatcccggacaggttctcgggctcgaaatcgggcacgagcgcgaccttggccataaccgggctccagaccggggacgaggccgattaccattgcgcgatctggggcgtgcgcaagggcgtgggcgcggtctttggcacgggcacgaaagtgaccgtggtc

SEQ ID NO: 55910 - RNA, 324 nt, synthetic construct
  misc_feature 1..324: note = derived and/or modified sequence opt11 from anti-HIV_119-067866_VR-Chain
  source 1..324: mol_type = other RNA
caatccgtcctcacccaacccccctccgtctccgccgcccccggccaaaaagtcaccatctcctgctcaggctccacctccaccatcggcaacaactacgtctcctggtaccaacacctccccggcaccgcccccaaactcctcatctacgacaacaacaaacgccccgccggcatccccgaccgcttcacagcctccaaatccggcacctccgccaccctcgccatcaccggcctccacaccggcgacgaagcagactactactgcgaaacatgggacggctccggcggcgtcttcggcaccggcaccaaagtcaccgtcctc

SEQ ID NO: 55911 - RNA, 321 nt, synthetic construct
  misc_feature 1..321: note = derived and/or modified sequence opt11 from anti-HIV_119-067756_VR-Chain
  source 1..321: mol_type = other RNA
caatccgtcctcacccaacccccctccgtctccgccgcccccggccaaaaagtcgtcatctcctgctccggctccacctccaacatcggcaaaaacttcgtctcctggtaccaacaactccccggcaccgcccccaaactcctaatctacgaaaactcccgccgcccctccggcatccccgaccgcttctccggcgccaaatccggcacctccgccaccctcgccatcaccggcctccaaaccggcgacgaagccgactacttctgctccacctggtccggctccctcaacttcggcaccggcacccgcgtcaccgtcctc

SEQ ID NO: 55912 - RNA, 321 nt, synthetic construct
  misc_feature 1..321: note = derived and/or modified sequence opt11 from anti-HIV_119-066859_VR-Chain
  source 1..321: mol_type = other RNA
caatccgtcctcacccaacccccctccgtctccgccgcccccggccaaaaagtcaccatcacctgctccggctccgcctccaacatcgaaaacaactacgtctcctggtaccaacaattccccggccccgcccccaaactcctcatctacgaaaacgacaaacgcccctccggcatccccgaccgcttctccggctccgcctccggcacctccgccaccctcgccatcaccggcctccaaaccggcgacgaagccgactacttctgctccacctggtccggctcactcaacttcggcaccggcacccgcgtcaccgtcctc

SEQ ID NO: 55913 - RNA, 333 nt, synthetic construct
  misc_feature 1..333: note = derived and/or modified sequence opt11 from anti-HIV_119-065821_VR-Chain
  source 1..333: mol_type = other RNA
caatccgtcctcacccaacccccctccgtctccgccacccccggccaacgcgtcaccgtctcctgctccggctcctcatccaacatcggcaaccactacgtctcctggtaccaacaagtccccggcaccgcccccaaactcctcatctacgacaactccaaccgcccctccggcatccccgaccgcttctccggctccaaatccggcacctccgccaccctcggcatcaccggcctccaaaccggcgacgaagccgactactactgcaccgtctggggcgtccgcaaaggcgtcggcgcagtcttcggcaccggcaccaaagtcaccgtcctc

SEQ ID NO: 55914 - RNA, 333 nt, synthetic construct
  misc_feature 1..333: note = derived and/or modified sequence opt11 from anti-HIV_119-065191_VR-Chain
  source 1..333: mol_type = other RNA
caatccgtcctcacccaacccccctccgtctccgccgcccccggccaaaaagtcaccatatcctgctccggcaacaactccaacatcggcaacaactacgtctcctggtaccaacaactccccggcaccgcccccaaactcctcatcttcgaaaaccacaaacgcccctccggcatccccgaccgcttctccggctccaaatccggcacctcagccaccctcggcatcaccggcctccaatccggcgacgaagccgactactactgcgccacctgggccccccgcctcaactccgcccgcgtcttcggcaccggcaccaaagtcaccgtcctc

SEQ ID NO: 55915 - RNA, 333 nt, synthetic construct
  misc_feature 1..333: note = derived and/or modified sequence opt11 from anti-HIV_119-064667_VR-Chain
  source 1..333: mol_type = other RNA
caatcggtcttgacccagcccccgagcgtgagcgcggccccgggccagaaagtgaccataagctgtagcgggagcaatagctatatcgggaacaagtacgtgagctggtaccagcaagtgcccgggaccgcgcccaagctcttgatctatgaaaataacaagcgcccgagcgggatcccggacaggttctcgggctcaaaatcgggcacgagcgcgaccttggtcataaccgggctccagaccggggacgaggccgatttctattgcgggacctgggacgggagcttgcgcacgggcggggtcataggcacgggcacgcgcgtgaccgtgctc

SEQ ID NO: 55916 - RNA, 324 nt, synthetic construct
  misc_feature 1..324: note = derived and/or modified sequence opt11 from anti-HIV_119-063791_VR-Chain
  source 1..324: mol_type = other RNA
caatccgtcctcacccaacccccctccgtctccgcagcccccggccaaaaagtccccatctcctgctccggcaactcctccaacatcggaaacaactacgtctcctggtaccaacaactccccggcaccgcccccaaactcctcatctacgaaaacaacaaacgcccctccggcatccccgaccgcttctccggctccaaatccggcacctccgccacactcgccatcaccggcctccacaccggcgacgaagccgactactactgcgaaacctgggacggctccggcggcgtcttcggcaccggcaccaaagtcaccgtcctc

SEQ ID NO: 55917 - RNA, 333 nt, synthetic construct
  misc_feature 1..333: note = derived and/or modified sequence opt11 from anti-HIV_119-062989_VR-Chain
  source 1..333: mol_type = other RNA
caatccgtcctcacccaacccccctcagtctccgccgcccccggccaacgcgtcaccatctcctgctccggctcctcctccaacatcggcaacaacttcgtctcctggtaccaacaattccccggcaccgtccccaaactcctcatctacgaaaacaaccgccgcccctcaggcatccccgaccgcttctccggctccaaatccggcacctccgccaccctcgccatcaccggcctccaaaccggcgacgaagccgactactactgcgccgtctggggcgtccgccgcggcgtaggcgccgtcttcggcgccggcaccaaagtcatcgtcctc

SEQ ID NO: 55918 - RNA, 321 nt, synthetic construct
  misc_feature 1..321: note = derived and/or modified sequence opt11 from anti-HIV_119-062286_VR-Chain
  source 1..321: mol_type = other RNA
caatcggtcttgacccagcccccgagcgtgagcgcggccccgggccagaaagtgaccataagctgtagcgggagcgcgagcaatatcgggaaaaatttcgtgagctggtaccagcaattgcccgggaccgcgccaaagctcttgatctcggaaaataacaggcgcccgagcgggaccccggacaggttctcgggctcgaaatcgggcgcgagcgcgaccttagtcataagcgggctccagaccggggacgaggccgattactattgcgcgacctggagcgggagcttgagcataggcacgggcacgaaagtaaccgtgctc

SEQ ID NO: 55919 - RNA, 321 nt, synthetic construct
  misc_feature 1..321: note = derived and/or modified sequence opt11 from anti-HIV_119-061416_VR-Chain
  source 1..321: mol_type = other RNA
caatccgtcctaacccaacccccctccgtctccgccgcccccggccaaaaagtcgtcatctcctgctccggctcctcctccatcttcgaaaaaaactccatctcctggtaccaacaaggccccggcgccgcccccaaactcctcatctacgaaaacgacaaacgccgctcaggcatccccgaccgcttctccggctccaaatccgccacctccaccaccctcgccatcgtcggcctccaaaccggcgacgaagccgactacttctgctccacctggtccggctccctcaacttcggcaccggcacccgcgtcaccgtcctc

SEQ ID NO: 55920 - RNA, 321 nt, synthetic construct
  misc_feature 1..321: note = derived and/or modified sequence opt11 from anti-HIV_119-061344_VR-Chain
  source 1..321: mol_type = other RNA
caatccgtcctcacccaacccccctccgtctccgccgcccccggccaaaaagtcaccatctcctgctccggctcctcctccgtcttcggcaaaaactacgtctcctggtaccaacacctccccggcaccgcccccaaactcctcatctacgaaaacaacaaacgcccctccggcatccccgaccgcttctccggcgccaaatccggcaccgccgccaccctcgccatcaccggcctccaaaccggcgacgaagccgactactactgcgccacctggtccggctccctcaacttcggcaccggcaccaaagtcaccgtcctc

SEQ ID NO: 55921 - RNA, 324 nt, synthetic construct
  misc_feature 1..324: note = derived and/or modified sequence opt11 from anti-HIV_119-060240_VR-Chain
  source 1..324: mol_type = other RNA
caatcagtcctcacacaacccccctccgaatacggcgcccccggccacaacgtcaccgtctcctgctccggcaccacctccaacatcgaaaacaacttcgtctcctggtacctaatcgtccccggcaccgcccccaaactcctcatcttcgacaacgacaaacgcccctccggcatccccgaccgcttctccggctccaaatccggcacctccgccaccctcgccatcaccggcctccaaaccggcgacgaagccgactactactgcgccacctgggacggccgcgtctccgtcatcggcaccggcaccaaagtcaccgtcctc

SEQ ID NO: 55922 - RNA, 333 nt, synthetic construct
  misc_feature 1..333: note = derived and/or modified sequence opt11 from anti-HIV_119-060184_VR-Chain
  source 1..333: mol_type = other RNA
caatccgtcctcacccaacccccctccgtctccggcgcccccggccaacgcgtcaccatctcctgctccggctcctcctcaaacatcggctccaacaccgtcaactggtaccaacaactccccggcaccgcccccaaactcctcatctacgacaacaacaaacgcccctccggcatccccgaccgcttctccggctccaaatccggcacctccgccaccctcgtcatcaccggcctccaaaccggcgacgaagccgacttctactgcggcacatgggacggctccctccgcaccggaggcgtcatcggcaccggcacccgcgtcaccgtcctc

SEQ ID NO: 55923 - RNA, 321 nt, synthetic construct
  misc_feature 1..321: note = derived and/or modified sequence opt11 from anti-HIV_119-058035_VR-Chain
  source 1..321: mol_type = other RNA
caatccgtcctcacccaacccccctccgtctccgccgcccccggccaaaaagtcaccatctcctgctccggctccgcctccaacatcggcaaaaacttcgtctcctggtaccaacaactccccggcaccgcccccaaactcctcatctacgaaaacaaccgccgcccctccggcacccccgaccgcttctccggcgccaaatccggcacctcagccaccctcgccatcaccggcctccaaaccggcgacgaagccgactacttctgctccacctggtccggctccctcaacttcggcaccggcacccgcgtcaccgtcctc

SEQ ID NO: 55924 - RNA, 321 nt, synthetic construct
  misc_feature 1..321: note = derived and/or modified sequence opt11 from anti-HIV_119-057858_VR-Chain
  source 1..321: mol_type = other RNA
caatccgtcctcacccaacccccctccgtctccgccgcccccggccaaaacgtcaacatctcatgctccggcggctcctccaacatcggctccaactacgtctcctggtaccaacaattccccggcaccgcccccaaactcctcatctacgaaaacaacaaacgcccctccggcatccccgaccgcttctccggcgccaaatccggcacctccgccaccctcgccatcaccggcctccaaaccggcgacgaagccgactacttctgctccacctggtccggctccctcaacttcggcaccggcacccgcgtcacagtcctc

SEQ ID NO: 55925 - RNA, 324 nt, synthetic construct
  misc_feature 1..324: note = derived and/or modified sequence opt11 from anti-HIV_119-057473_VR-Chain
  source 1..324: mol_type = other RNA
caatccgtcctcacccaacccccctccgtctccgccgcccccggccaaaaagtcaccatctcctgctccggctcctcctccaacatcggcaacaactacgtctcctggtaccaacacctccccggcaccgcccccaaactcctcatctacgacacctactcccgcccctccggcatccccgaccgcttctccggctccaaatccggcacctccgccaccctcgccatcaccggcctccaaaccggcgacgaagccgactactactgcggcacctgggacggctccggcggcgtcttcggcaccggcaccaaagtcaccgtcctc

SEQ ID NO: 55926 - RNA, 321 nt, synthetic construct
  misc_feature 1..321: note = derived and/or modified sequence opt11 from anti-HIV_119-057090_VR-Chain
  source 1..321: mol_type = other RNA
caatccgtcctcacccaacccccctccgtctccgccgcccccggccaaaccgtcaccatctcctgctccggctccacctccaacatcggcaaaaacgacgtctcctggtaccaacaactccccggcaccgcccccaaactcctcatctccgaaaacaaccgccgcccctccggcacccccgaccgcttctccgcctccaaatccggcacctccgccaccctcgccatcaccggcctccaaaccggcgacgaagccgactacttctgctccacctggtccggctccctcaacttcggcaccggcacccgcgtcaccgtcctc

SEQ ID NO: 55927 - RNA, 333 nt, synthetic construct
  misc_feature 1..333: note = derived and/or modified sequence opt11 from anti-HIV_119-055754_VR-Chain
  source 1..333: mol_type = other RNA
caatcggtcttgacccagcccccgagcgtgagcgcggccccgggccagaaagtgaccataagctgtagcgggaactcaagctcgatcgggaacaatttcgtgagctggtaccagcaattgcccgggaccgcgcccaagctcttggtctatgaaaattacaggcgcccgagcgggatcccggacaggttctcgggctcgaaatcgggcacgagcgcgaccttggccatagacgggctccagacctgggacgaggccgattaccattgcgcgatctggggcgtgcgcaagggcgtgggcgcggtctttggcacgggcacgaaagtgaccgtggtc

SEQ ID NO: 55928 - RNA, 324 nt, synthetic construct
  misc_feature 1..324: note = derived and/or modified sequence opt11 from anti-HIV_119-054899_VR-Chain
  source 1..324: mol_type = other RNA
caatccgtcctcacccaacccccctccgtctccgccgcccccggccaaaaagtcaccatctcctgctccggctccaactcctacatcggcaacaaatacgtctcctggtaccaacaattccccggcaccgcccccaaactcctcatccacgaaaacaaccgccgcccctccggcacccccgaccgattctccggctccaaatccggcacctccgccaccctcgccatctccggcctccaaaccggcgacgaagccgactactactgcgaaacctgggacggctccggcggcgtcttcggcaccggcaccaaagtcaccgtcctc

SEQ ID NO: 55929 - RNA, 324 nt, synthetic construct
  misc_feature 1..324: note = derived and/or modified sequence opt11 from anti-HIV_119-054501_VR-Chain
  source 1..324: mol_type = other RNA
caatccgtcctcacccaacccccctccgtctccgccgcccccggccaaaaagtcaccatctcctgctccggcacctcctccaacatcggcaacaactacgtctcctggtaccaacacctacccggcaccgcccccaaactactcatcttcgaaaccaacaaacgcccctccggcatccccgaccgcttctcagcctccaaatccggcacctccgccaccctagccatcaccggcctccaaaccggcgacgaagccgactactactgcgaaacctgggacggctccggcggcgtcttcggccccggcacccgcgtcaccgtcctc

SEQ ID NO: 55930 - RNA, 324 nt, synthetic construct
  misc_feature 1..324: note = derived and/or modified sequence opt11 from anti-HIV_119-051867_VR-Chain
  source 1..324: mol_type = other RNA
caatccgtcctcacccaacccccctccgtctccgccgcccccggccaaaaagtcaccatctcctgctcaggcaactcctccaacatcggcaacaacttcatctcctggtaccaacaactccccggcaccgcccccaaactactcatctacgaaaacgaccgccgcccctccggcacacccgaccgcttctccggctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55931 - RNA, 324 nt, synthetic construct
  misc_feature 1..324: note = derived and/or modified sequence opt11 from anti-HIV_119-051814_VR-Chain
  source 1..324: mol_type = other RNA
caatccgtcctcacccaacccccctccgtctccgccgcccccggccaaaaagtcaccatctcctgctccggctccaactccaacatcggcaacaaagacgtctcctggtaccaacaaatccccgccaccgcccccaaactcctcatctacgaaaacaacaaacgcccctccggcatccccgaccgcttctccggctccaaatccggcacctccgccaccctcgccatcaccggcctccaaaccggcgacgaagccgactactactgcgccacctgggacggccgcgtctccgtcatcggcaccggcaccaacgtcatcgtcctc

SEQ ID NO: 55932 - RNA, 321 nt, synthetic construct
  misc_feature 1..321: note = derived and/or modified sequence opt11 from anti-HIV_119-051567_VR-Chain
  source 1..321: mol_type = other RNA
caatccgtcctcacccaacccccctccgtctccgccgcccccggccaaaaagtcaccatctactgctccggctcccgctccaacatcggccgcaactacgcctcctggtaccaacaactccccggcaccgcccccaaactcctcatcttcgacaacaaccgacgcccctccggcatccccgaccgcttctccggcgccaaatccggcacctccgccaccctcgccatcaccggcctccaaaccggcgacgaagccgactacttctgctccacctggtccggctccctcaacttcggcaccggcacccgcgtcaccgtcctc

SEQ ID NO: 55933 - RNA, 324 nt, synthetic construct
  misc_feature 1..324: note = derived and/or modified sequence opt11 from anti-HIV_119-051483_VR-Chain
  source 1..324: mol_type = other RNA
caatccgtcctcacacaaccaccctccgtctccgccgcccccggccaaaaactcaccatctcctgctccggcacctcctccaacatcggcaacaactacgtctcctggtaccaacacctccccggcaccgcccccaaactcctcatctacgaaaacaaccgccgaccctccggcatccccgaacgcttctccgcctccaaatccggcacctccgccaccctcggcataaccggcctccaaaccggcgacgaagccgactactactgcgaaacctgggacgactccggcggcgtcttcggcaccggcaccaaagtcaccgtcctc

SEQ ID NO: 55934 - RNA, 333 nt, synthetic construct
  misc_feature 1..333: note = derived and/or modified sequence opt11 from anti-HIV_119-050913_VR-Chain
  source 1..333: mol_type = other RNA
caatcagtactcacccaacccccctccgtctccgccgcccccggccaaaaagtcaccatctcctgctccggcggcacctccaacatcggcaacaactacgtctcctggtaccaacaactccccggcaccgccccccgcctcctcatctacgaaaccaacaaacgcccctccggcatccccgaccgcttcttcggctccaaatccggcacctccgccaccctcgccatctccggcctccaaaccggcgacgaagccgactactactgcaccgtctggggcgtccgcaaaggcgtcggcgccgtcttcggcaccggcaccaaagtcaccgtcctc

SEQ ID NO: 55935 - RNA, 333 nt, synthetic construct
  misc_feature 1..333: note = derived and/or modified sequence opt11 from anti-HIV_119-050187_VR-Chain
  source 1..333: mol_type = other RNA
caatccgtcctcacccaacccccctcagtctccgccgcccccggccaaaaagtcaccatctcctgctccggctcctcctccaacatcggcaaaaactccgtctcctggtaccaacaattccccggcaccgcccccaaactcctcatctacgaaaacaacaaacgcccctccggcatccccgaccgcttctccgactcccaatccggcacctccgccaccctcgccatcaccggcctacaaaccggcgacgaagcagactactcctgcgccacctgggccgcctccctcaactccgcccgcgtcttcggcaccggcacccgcgtcaccgtcctc

SEQ ID NO: 55936 - RNA, 324 nt, synthetic construct
  misc_feature 1..324: note = derived and/or modified sequence opt11 from anti-HIV_119-049069_VR-Chain
  source 1..324: mol_type = other RNA
cagagcgtgctcacgcaaccgccctcggtctcggccgcgcccgggcaaaaggtcacgatctcgtgctcgggctcgacctcgaacataggcaagagcgatgtcttttggtatcaacagctcccgggcacggccccgaaattgctcataagcgagacctcgcgcaggccctcgggcacgcccgatcgctttagcgggagcaagagcgggacctcggccacgctcacgatcacgggcttgcaaacgggcgatgaagcggactattactgtgaagcgtgggatggctcgggcggggtctttggcacaggcacgaaagtgaccgtgctc

SEQ ID NO: 55937 - RNA, 333 nt, synthetic construct
  misc_feature 1..333: note = derived and/or modified sequence opt11 from anti-HIV_119-048517_VR-Chain
  source 1..333: mol_type = other RNA
caatcggtcttgacccagcccccgagcgtgagcgcggccccgggccagaaagtgaccataagctgtagcgggagcaagttcaatatcgggaacaaggacgtgagctggtaccagcactcgcccgggaccgcgcccaagctcttgatctatgaaaataacaagcgcccgagcgggatcccggacaggttctcgggctcgaaatcgggcacgagcgcgaccttgggcataagcgggctccagaccggggacgaggccgattactgttgcgcggtctggggcgtgcgcaggggcgcgggcgcggtctttggcgcgggcacgaaagtgaccgtgctc

SEQ ID NO: 55938 - RNA, 333 nt, synthetic construct
  misc_feature 1..333: note = derived and/or modified sequence opt11 from anti-HIV_119-048470_VR-Chain
  source 1..333: mol_type = other RNA
caatcggtcttgacccagcccccgagcgtgagcgcggccccgggccagaaagtgaccataagctgtagcgggagcacgagcaatatcgggaaaaatctcgtgagctggtaccagcaatttcccgggaccgcgcccaagctcttgatctatgaaaataacaggcgcccgagcgggatcccggacaggttctcgggctcgaaatcgggcacgagcgcgaccttggtcataaccgggctccagaccggggacgaggcagatttctattgcgggacctggggcgggagcttgcgcgcgggcggagtcataggcacgggcacgcgcgtgaccgtgctc

SEQ ID NO: 55939 - RNA, 282 nt, synthetic construct
  misc_feature 1..282: note = derived and/or modified sequence opt11 from anti-HIV_119-048303_VR-Chain
  source 1..282: mol_type = other RNA
tccgtcctcacccaacccccctccgtctccgccgcccccggccaaaacatcaccatctcctgctccggctccatctccaacatcgcctccaacttcatctcctggtaccaacaactccccggcaccgcccccaaaatcatcatctacgacaacgaccaacgccccctcggcatccccgcccgcttctccggctccaaatccggcgcctccgccaccctcgtcatcaccggcctccaaaccggcgacgaagccgactactactgcggcacctgggacggctcc

SEQ ID NO: 55940 - RNA, 333 nt, synthetic construct
  misc_feature 1..333: note = derived and/or modified sequence opt11 from anti-HIV_119-048021_VR-Chain
  source 1..333: mol_type = other RNA
caatccgtcctaacccaacccccctcagtctccgccgcccccggccaaaaagtcaccatctcctgctccggctcctcctccaacatcggcaacaactacgtctcctggtaccaacaactccccggcaccgcccccaaactcctcatctacgacaacaacaaacgcccctccggcatccccgaccgcttctccggctccaaatccggcacctccgccaccctcgtcatcaccggcctccaaaccggcgacgaagccgacttctactgcggcacctgggacggctccctatccggcggcggcgtcatcggcaccggcacccgcgtcaccgtcctc

SEQ ID NO: 55941 - RNA, 324 nt, synthetic construct
  misc_feature 1..324: note = derived and/or modified sequence opt11 from anti-HIV_119-047928_VR-Chain
  source 1..324: mol_type = other RNA
caatccgtcctcacccaacccccctccgtctccgccgcccccggccaaaaagtcaccatctcctgctccggctccaactccaacatcggcaacaactgcgtctcctggtaccaacaagtccccggcaccgcccccaaactcctcatctacgaaaacaaccgccgcccctccggcatccccgaccgcttctccggctccaaatccggcacctccgccaccctcgccatctccggcctccaaaccggcgacgaagccgactactactgcggcacctgggacggctccggcggcgtcttcggcaccgccaccaaagtcaccgtccta

SEQ ID NO: 55942 - RNA, 324 nt, synthetic construct
  misc_feature 1..324: note = derived and/or modified sequence opt11 from anti-HIV_119-047384_VR-Chain
  source 1..324: mol_type = other RNA
caatccgtcctcacccaacccccctccgtctccgccgcccccggccaaaaagtcaccatctcctgctccggctccaactccaacatcggcaacaaagacgtctcctggtaccgccaagtcccccccaccgcccccaaactcctcatctacgaaaacaacaaacgcccctccggcatccccgaccgcttctcaggctccaaatccggcacctccgccaccctcgccatcaccggcctccaaaccggcgacgaagccgactactactgcgccacctgggacggccgcgtctccgtcttcggcaccggcaccaaagtcgccgtcctc

SEQ ID NO: 55943 - RNA, 333 nt, synthetic construct
  misc_feature 1..333: note = derived and/or modified sequence opt11 from anti-HIV_119-047145_VR-Chain
  source 1..333: mol_type = other RNA
caatccgtcctcacccaacccccctccgtctccgccgcccccggccaaaccgtcaacatctcctgctccggctccaactccaacatcggctccaaatacgtctcctggtaccaacacttccccggcaccgcccccaaactcctcatctacgaaaacaacaaacgctcctccggcatccccgaccgcttctccggctccaaatccgccacctccgccaccctcgccatcaccggcctccaaaccggcgacgaagccgactactactgcgccacctgggccccctccctcaactccgcccgcgtcttcggcaccggcaccaaagtcaccgtcctc

SEQ ID NO: 55944 - RNA, 333 nt, synthetic construct
  misc_feature 1..333: note = derived and/or modified sequence opt11 from anti-HIV_119-046752_VR-Chain
  source 1..333: mol_type = other RNA
caatccgtcctcacccaacccccctccgtctccgccgcccccggccaaaaagtcaccatctcctgctccggcaactcctcctcaatcggcaacaacttcgtctcctggtaccaacaactccccggcaccgcccccaaactcctcgtctacgaaaactaccgccgcccctccggcatctccgaccgcttctccggctccaaatcaggcacctccgccaccctcgccatcaccggcctccaaaccggcgacgaagccgactactactgcaccgtctggggcgtccgcaaaggcgtcggcgcagtcttcggcaccggcaccaaagtcaccgtcctc

SEQ ID NO: 55945 - RNA, 324 nt, synthetic construct
  misc_feature 1..324: note = derived and/or modified sequence opt11 from anti-HIV_119-046660_VR-Chain
  source 1..324: mol_type = other RNA
caatcagtcctcacccaacccccctccgtctccgccgcccccggccaaaaagtcaccatctcctgctccggatcctcctccaacatcggcaaccactacgtctcctggtaccaacaactccccggcaccgcccccaaactcctcatctacgacaacaacaaacgcccctccggcatccccgaccgcttctcagcctccaaatccggcacctccgccaccctcggcatcaccggcctccaaaccggcgacgaagccgactactactgcgccacctgggacggccgcgtctccgtcatcggcaccggaaccaaagtcaccgtcgtc

SEQ ID NO: 55946 - RNA, 333 nt, synthetic construct
  misc_feature 1..333: note = derived and/or modified sequence opt11 from anti-HIV_119-046202_VR-Chain
  source 1..333: mol_type = other RNA
caatccgtcctcacccaacccccctcagtctccgccgcccccggccaaaaagtcaccatctcctgctccggctcctcctccaacatcggcaacaactacgtctcctggtaccaacaactccccggcaccgcccccaaactcctcgtctacgaaaactaccgccgcccctccggcatccccgaccgcttctccggctccaaatccggcacctccgccaccctcgccatcaccggcctccaaaccggcgacgaagccgactaccactgcgccatctggggcgtccgcaaaggcgtcggcgccgtcttcggcaccggcaccaaagtcaccgtcgtc

SEQ ID NO: 55947 - RNA, 333 nt, synthetic construct
  misc_feature 1..333: note = derived and/or modified sequence opt11 from anti-HIV_119-045790_VR-Chain
  source 1..333: mol_type = other RNA
caatccgtcctcacccaacccccctccgtctccgcagcccccggccaaaaagtcaccatctcctgctccggctcctcctccaacatcggcaacaactacgtctcctggtaccaatacctccccggcaccgcccccaaactcctcttctacgaagacaaccgacgcccctccggcacccccgaccgcttctccggctccaaatccggaacatccgccaccctcgccatatccggcctccaaaccggcgacgaagccgactactactgcaccatctggggcgtccgcaaaggcgtcggcgccgtcttcggcaccggcaccaaagtcaccgtccta

SEQ ID NO: 55948 - RNA, 333 nt, synthetic construct
  misc_feature 1..333: note = derived and/or modified sequence opt11 from anti-HIV_119-044670_VR-Chain
  source 1..333: mol_type = other RNA
caatccgtcctcacccaacccccctccgtctccggcgcccccggcgaacgcgtcaccatctcctgcaccggcaacacctccaacatcggcacctacgacgtccaatggtaccaacacctccccggcaccgccccccgactcctcatctaccacaacgtcaacctcccctccggcgtccccgaccgcttctccgcctccaaatccggcacctccgccaccctcgccatcaccggcctccaaaccggcgacgaagccgactactactgcaccatctggggcgtacgcaaaggcgtcggcgccgtcttcggcaccggcaccaaagtcaccgtcctc

SEQ ID NO: 55949 - RNA, 321 nt, synthetic construct
  misc_feature 1..321: note = derived and/or modified sequence opt11 from anti-HIV_119-044140_VR-Chain
  source 1..321: mol_type = other RNA
caatccgtcctcacccaacccccctccgtctccgccgcccccggccaaaaagtcaccatctcctgctccggcggcacctccaacatcggcaaccacttcgtctcctggtaccgccacctccccggcaccgcccccaaactcctcatctacgaaaacaacaaccgcccctccggcatccccgaccgcttctccggcgccaaatccggcacctccgccaccctcgccatcaccggcctccaaacaggcgacgaaggcgactactactgcgccacctggtccggctccctcaacatcggcaccggcaccaaagtcaccgtcctc

SEQ ID NO: 55950 - RNA, 333 nt, synthetic construct
  misc_feature 1..333: note = derived and/or modified sequence opt11 from anti-HIV_119-042776_VR-Chain
  source 1..333: mol_type = other RNA
caatccgtcctcacccaacccccctccgtctccgccgcccccggccaaaaagtcacaatctcctgctccggctcctcatccaacatcggcaacaactacgtctcctggtaccaacacctccccggcaccgcccccaaactcctcatctacgaatccgcccgccgcccctccggcacccccgaccgcttctccggctccaaatccggcacctccgccaccctcgcaatcaccggcctccaaaccggcgacgaagccgactactactgcaccctctggggcgtccgcaaaggagtcggcgccgtcttcggcaccggcacccgcgtcaccgtcctc

SEQ ID NO: 55951 - RNA, 333 nt, synthetic construct
  misc_feature 1..333: note = derived and/or modified sequence opt11 from anti-HIV_119-042581_VR-Chain
  source 1..333: mol_type = other RNA
caatccgtcctcacccaacccccctccgtctccgccgcccccggccaaaaagtcaccatctcctgctccggctcctcctccaacatcggcaacaacttcgtctcctggtaccaacaactacccggaaccgcccccaaactcctcatcttcgaaacccaccgccgcccctccggcatccccgaccgcttctccggctccaaatccggcacctccgccaccctcgccatcaccggcctccaatccggcgacgaagccgactactactgcgccgtctggggcgtccgccaaggcgccggcgccgtcttcggcaccggcaccaaagtcaccgtcctc

SEQ ID NO: 55952 - RNA, 333 nt, synthetic construct
  misc_feature 1..333: note = derived and/or modified sequence opt11 from anti-HIV_119-040905_VR-Chain
  source 1..333: mol_type = other RNA
caatccgtcctcacccaacccccctccgtctccgccgcccccggccaaaaagtcaccatctcctgctccggcaactcctccaacatcggcgacaacttcgtctcctggtaccaacaactccccggaatcgcccccaaactcctcgtctacgaaaccaacaaacgcccctccggcatccccgaccgcttcgccggctccaaatccggcacctcagccaccctcgtcatcaccggcctccaaaccggcgacgaagccgacttctactgcggcacctgggacggatccctccgcaccggcggcgtcatcggcaccggcacccgcgtcaccgtcctc

SEQ ID NO: 55953 - RNA, 321 nt, synthetic construct
  misc_feature 1..321: note = derived and/or modified sequence opt11 from anti-HIV_119-040322_VR-Chain
  source 1..321: mol_type = other RNA
caatccgtcctcacccaacccccctccgtctccgccgcccccggccaaaaagtcgtcatctcctgctccggctcctcctccatcatcgaaaaaaactccatctcctggtaccaacaaggccccggcgccgcccccaaactactcatctacgaaaacgacaaacgcccctccggcatccccgaccgcttctcaggctccaaatccggcaccaccggcaccctcgccatcaccggcctccaaaccggcgacgaagccgactacttctgcgccacctggtccggccgcctcaacatcggcaccggcaccaaagtcaccgtcctc

SEQ ID NO: 55954 - RNA, 324 nt, synthetic construct
  misc_feature 1..324: note = derived and/or modified sequence opt11 from anti-HIV_119-039892_VR-Chain
  source 1..324: mol_type = other RNA
caatccgtcctcacccaacccccctccgtctccgccgcccccggccaaaaagtcaccatctcatgctccggctccaacgccaacatcggcaacaaagacgtctcctggtaccaacaactccccgccaccgcccccaaactcctcatctacgaatccaacaaacgcccctccggcatccccgaccgcttctccggctccaaatccggcacctccgccaccctcgccatcaccggcctccaaaccggcgacgaagccgactactactgcgccacctgggacggccgcgtctccggaatcggcaccggcaccaaagtcaccgtcctc

SEQ ID NO: 55955 - RNA, 324 nt, synthetic construct
  misc_feature 1..324: note = derived and/or modified sequence opt11 from anti-HIV_119-039764_VR-Chain
  source 1..324: mol_type = other RNA
caatccgtcctcacccaacccccctccgtctccgccgcccccggccaaaaagtcaccatctcctgctccggctccgcctccaacatcggcaaaaacttcgtctcctggtaccaacaagtccccggcaccgcccccaaactcctcatctacgaaaacaaccgccgcccctccggcacccccgacagattctccggctccaaatccggcacctccggcaccctcgccatctccggcctccaaaccggcgacgaagccgactactactgcgaaacctgggacggctcaggcggcgtcttcggcaccggcaccaaagtcaccgtcctc

SEQ ID NO: 55956 - RNA, 333 nt, synthetic construct
  misc_feature 1..333: note = derived and/or modified sequence opt11 from anti-HIV_119-039188_VR-Chain
  source 1..333: mol_type = other RNA
caatcggtcttgacccagcccccgagcttaagcggggccccgggccagaccgtgaccataagctgtagcgggagctcgagcaatatcgggaacaattacgtgagctggtaccagcaattacccgggaccgcgcccaagctcctgatctatgactcgaacaggcgcccgagcgggatcccggacagattctcaggctcgaaatcgggcacgagcgcgaccttggccataagcgggctccagaccggggacgaggccgattactgttgcgcggtctggggcgtgcgcaggggcgcgggcgcggtctttggcgcgggcacgaaagtgaccgtgctc

SEQ ID NO: 55957 - RNA, 321 nt, synthetic construct
  misc_feature 1..321: note = derived and/or modified sequence opt11 from anti-HIV_119-039058_VR-Chain
  source 1..321: mol_type = other RNA
caatccgtcctcacccaacccccctccgtctccggcgcccccggccaacgcgtcaccatctcctgcaccggctcctcctccaacatcggcaacaactacgtctcctggtaccgccgcctccccggcaccgcccccaaactcctcatctacgaaaacaacaaacgcccctccggcatccccgaccgcttctccggcgccaaatcaggcacctccgccaccctcgccatcaccggcctccaaaccggcgacgaagccgactacttctgctccacctggtccggctccctcaacttcggcaccggcacccgcgtcaccgtcctc

SEQ ID NO: 55958 - RNA, 321 nt, synthetic construct
  misc_feature 1..321: note = derived and/or modified sequence opt11 from anti-HIV_119-038837_VR-Chain
  source 1..321: mol_type = other RNA
caatccgtcctcacccaacccccctccgtctccgccgcccccggccaaaaagtcaccatctcctgctccggcggcacctccaacatcggcaacaacttcgtctcctggtaccaacacctccccggcaccgcccccaaactcctcatcttcgaaaacaacaaacgcccctccggcgtccccgaccgcttctccggcgccaaatccggcacctccgccaccctcgccatcaccggcctccaaaccggcgacgaaggcgactactactgcgccacctggtccggctccctcaacatcggaaccggcaccaaagtcaccgtcctc

SEQ ID NO: 55959 - RNA, 321 nt, synthetic construct
  misc_feature 1..321: note = derived and/or modified sequence opt11 from anti-HIV_119-038396_VR-Chain
  source 1..321: mol_type = other RNA
caatccgtcctcacccaacccccctccgtctccgccacccccggccaaaaagtcaccatctcctgctccggctccaactccaacatcggcaacaaatacgtctcctggtaccaactcttccccggaaccgcccccaaactcctcatctccgaaaacaaccgccgcccctccggcacccccgaccgcttctccggctccaaatccggcacctccgccaccctcgccatcaccggcctccaaaccggcgacgaagccgactactactgcgccacctggtccggctccctcaacatcggcaccggcaccaaagtcaccgtcctc

SEQ ID NO: 55960 - RNA, 321 nt, synthetic construct
  misc_feature 1..321: note = derived and/or modified sequence opt11 from anti-HIV_119-036918_VR-Chain
  source 1..321: mol_type = other RNA
caatccgtcctcacccaacccccctccgtctccgccgcccccggccaaaaagtcaccatctcctgctccggcgccacctccaacatctgggaccactacgtctcctggtacctccaagtccccggcaccgccccccgcctcctcatctacgacaacgacaaacgcccctccggcatccccgaccgcttctccggctccaaatccggcacctccgccaccctcgccatcaccggcctccaaaccggcgacgaaggcgactactactgcgccacctggtccggctcactcaacatcggcaccggcaccaaagtcaccgtcctc

SEQ ID NO: 55961 - RNA, 324 nt, synthetic construct
  misc_feature 1..324: note = derived and/or modified sequence opt11 from anti-HIV_119-036592_VR-Chain
  source 1..324: mol_type = other RNA
caatccgtcctcacccaacccccctccgtctccgccgcccccggccaaaaagtcaccatctcatgctccggctccaactccaacaccggcaacaaagacgtctcctggtaccaacaagtccccgccaccgcccccaaactcctcatctacgaatccaacaaacgcccctccggcatccccgacagattctccggctccaaatccggcacctccgccaccctagccatcaccggcctccaaaccggcgacgaagccgactactactgcgccatctgggacggccgcgtctccgtcatcggcaccggcaccaaagtcaccgtcctc

SEQ ID NO: 55962 - RNA, 324 nt, synthetic construct
  misc_feature 1..324: note = derived and/or modified sequence opt11 from anti-HIV_119-036310_VR-Chain
  source 1..324: mol_type = other RNA
caatccgtcctcacccaacccccctcagtctccgccgcccccggccaaaaagtcaccatctcctgctccggctccacctccaacatcggccaaaactacgtctcctggtaccaacaactccccggcaccgcccccaaactcctcatctacgaaaacaaccgccgaccctccggctcccccgaccgcttctccggctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55963 - RNA, 333 nt, synthetic construct
  misc_feature 1..333: note = derived and/or modified sequence opt11 from anti-HIV_119-035618_VR-Chain
  source 1..333: mol_type = other RNA
caatccgtcctcacccaacccccctccgtctccgccgcccccggccaaaaagtcaccatctcctgctccggctcctccttcaccatcggcaacaaccacgtctcctggtaccaacaactccccggcaccgcccccaaactcctcatcttcgaatcccacaaacgcccctccggagtccccgaccgcttctccggctccaaatcaggcacctccgccaccctcgccatcaccggcctccaaaccggcgacgaagccgactactactgcaccgtctggggcgtccgcaaaggcgtcggcgccgtcttcggcaccggcaccaaagtcaccgtcctc

SEQ ID NO: 55964 - RNA, 321 nt, synthetic construct
  misc_feature 1..321: note = derived and/or modified sequence opt11 from anti-HIV_119-035569_VR-Chain
  source 1..321: mol_type = other RNA
caatcagtcctcacccaacccccctccgtctccggcgcccccggccaaaccgtcaccatctcctgcaccggctcctcctccaacatcggcggctacgacgtccactggtaccaacaactccccggcaccgcccccaaactcctcatctacgaaaacaaccgccgcccctccggcacccccgaccgcttctccggcgccaaatccggcacctccgccaccctcgccatcaccggcctccaaaccggcgacgaaggcgactactactgcgccacctggtccggctccctcaacatcggcaccggcaccaaagtcaccgtcctc

SEQ ID NO: 55965 - RNA, 324 nt, synthetic construct
  misc_feature 1..324: note = derived and/or modified sequence opt11 from anti-HIV_119-035466_VR-Chain
  source 1..324: mol_type = other RNA
caatccgtcctcacccaacccccctccgtctccgccgccgccggccaaaacgtcaacatctcctgctccggcaaaaaatccaacatcggcaacaactacgtctcctggtaccaacaattccccggcaccgcccccaaactcctcatatacggcaacaccaaccgcccctccggcatccccgaccgcttctccggctccaaatcaggcacctccgccaccctcgccatcaccggcctccaaaccggcgacgacgccgactactactgcgaaacctgggacggctccggcggcgtcttcggcaccggcaccaaagtcaccgtcctc

SEQ ID NO: 55966 - RNA, 333 nt, synthetic construct
  misc_feature 1..333: note = derived and/or modified sequence opt11 from anti-HIV_119-035157_VR-Chain
  source 1..333: mol_type = other RNA
caatccgtcctcacccaacccccctccgtctccgccgcccccggccaaaaagtcaccatctcctgctccggctcctcctccaacatcggcaacaacttcgtctcctggtaccaacaacgccccggcaccgcccccaaactactcatctacgaaaccaacaaacgcccctcaggcatccccgaccgcttctccggctccaaatccggcacatccgccaccctcgccatcaccggcctccaaaccggcgacgaagccgactactactgcgccacctgggccccccgcctcaactccgcccgcgtcttcggcaacggcaccatggtcaccgtcctc

SEQ ID NO: 55967 - RNA, 333 nt, synthetic construct
  misc_feature 1..333: note = derived and/or modified sequence opt11 from anti-HIV_119-035121_VR-Chain
  source 1..333: mol_type = other RNA
caatccgtcctcacccaacccccctccgtctccgccgcccccggccaaaaagtcaccatctcctgctccggctccacctcctacatcggcaacaaatacgtctcctggtaccaacaattccccggcgccgcccccaaactcctcatctacgaaaacaacaaacgcccctccggcatccccgaccgcttctccgcctccaaatccgccacctccgccaccctagccatcaccggcctccaaaccggcgacgaagccgactactgctgcgccgtctggggcgtccgccgcggcgccggcgccgtcttcggcgccggcaccaaagtcaccgtcctc

SEQ ID NO: 55968 - RNA, 324 nt, synthetic construct
  misc_feature 1..324: note = derived and/or modified sequence opt11 from anti-HIV_119-035046_VR-Chain
  source 1..324: mol_type = other RNA
caatccgccctcacccaacccgcctccgtctccggctcccccggccaatccatcaccatctcctgcaccggcacctcctccgacgtcggctacgactacgtctcctggtaccgccaagtccccgccaccacccccaaactcctcatctacgaaaacaacaaacgcccctccggcatccccgaccgcttctccggctccaaatccggcacctccgccaccctcgccatcaccggcctccaaaccggcgacgaagccgactactactgcgccacctgggacggccgcgtctccgtcatcggcaccggcaccaaagtcaccgtcgtc

SEQ ID NO: 55969 - RNA, 324 nt, synthetic construct
  misc_feature 1..324: note = derived and/or modified sequence opt11 from anti-HIV_119-034754_VR-Chain
  source 1..324: mol_type = other RNA
caatccgtcctcacccaacccccctccgtctccgccgcccccggcgaaaaagtcaccatctcctgctccggctcctcctccaacatcggcaacaactacgtctcctggtaccaacaactccccggcaccgtccccaaactcctcatctacgacaacaacaaacgcccctccggcacccccgaccgcttctcaggctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55970 - RNA, 324 nt, synthetic construct
  misc_feature 1..324: note = derived and/or modified sequence opt11 from anti-HIV_119-034318_VR-Chain
  source 1..324: mol_type = other RNA
cagagcgtgctcacgcaaccgccctcggtctcggccgcgcccgggcaaaagatcacgatctcgtgctcgggctcgagctcgaacataggcaataacgatgtctcgtggtatcaacagctcccgggcacggccccgaaactgctcatatacgagaacgatcgcaggccctcgggcacgcccgatcgctttagcgggagcaagagcgggacctcggccacgctcgcgatcacgggcttgcaaacgggcgatgaagcggactattactgtgaaacgtgggatggctcgggcggggtctttggcacaggcacgaaagtgaccgtgctc

SEQ ID NO: 55971 - RNA, 333 nt, synthetic construct
  misc_feature 1..333: note = derived and/or modified sequence opt11 from anti-HIV_119-033780_VR-Chain
  source 1..333: mol_type = other RNA
caatccgtcctcacccaacccccctccgtctccgcagcccccggccaacgcgtcaccatctcctgctccggcacctcctccaacatcggcgaaaactacgtctcctggtaccaacaaatccccggcaccgcccccaaactcctcatctacgaaaacaacaaacgaccctccggcatccccgaccgattctccggctcaaaatccggcacctccgccaccctagtcatcaccggcctccaaaccggcgacgaagccgacttctactgcggcacctggggcggctccctccgcacaggcggagtcctcggcaccggcacccgcgtcaccgtcctc

SEQ ID NO: 55972 - RNA, 333 nt, synthetic construct
  misc_feature 1..333: note = derived and/or modified sequence opt11 from anti-HIV_119-033632_VR-Chain
  source 1..333: mol_type = other RNA
caatcggtcttaacccagcccccgagcgtgagcgcggccccgggccagcgcgtgaccataagctgtagcgggggctcgagcaatatcgggagcaattacgtgagctggtaccagcaattgcccgggaccgcgcccaagctcttgatctatcaaaataacaagcgcccgagcgggatcccggacagattctcgggctcgaaatcgggcacgagcgcgaccttgggcataaccgggctccagaccggggacgaggccgattactattgcacggtctggggcgtgcgcaagggcgtgggcgcggtctttggcacgggcacgaaagtgaccgtgctc

SEQ ID NO: 55973 - RNA, 333 nt, synthetic construct
  misc_feature 1..333: note = derived and/or modified sequence opt11 from anti-HIV_119-033183_VR-Chain
  source 1..333: mol_type = other RNA
caatcagtcctgacccagcccccgagcgtaagcgcggccccgggccagatggtgaccataagctgcagcggaggcgcaagcaacctcgggaaaaacagcgtaagctggtaccaacaactgcccggaaccgcgcccaaactcctgatctacgaagacaacagacgcccgagcgggaccccggacaggttctcaggctcacgctcgggcacaagcgcaaccctggccataaccggactccagaccggagacgaggccgactactactgcacaatctggggcgtacgcaaaggcgtaggcgcagtcttcggcacaggcacaaaagtaaccgtgctc

SEQ ID NO: 55974 - RNA, 333 nt, synthetic construct
  misc_feature 1..333: note = derived and/or modified sequence opt11 from anti-HIV_119-030696_VR-Chain
  source 1..333: mol_type = other RNA
caatccgtcctaacccaaccaccctccgtctccggcgcccccggccaaatcgtcaccctctcctgcaccggcgccatgaccaacatcggcaacaacgacgtccactggtaccaacacctccccggcaccggccccaaactcctcatctacgaaaacaacaaacgcccctccggcatccccgaccgattctccggctcaaaatccggcacatccgccaccctcgtcatcacaggcctccaaaccggcgacgaagccgacttctactgcggcacctgggacggctccctccgcaccggcggcgtcatcggcaccggcacccgcgtcaccgtcctc

SEQ ID NO: 55975 - RNA, 324 nt, synthetic construct
  misc_feature 1..324: note = derived and/or modified sequence opt11 from anti-HIV_119-030059_VR-Chain
  source 1..324: mol_type = other RNA
caatccgtcctcacccaacccccctccgtctccgccgcccccggccaaaaagtcgtcatctcctgctccggctcctcctccatcatcgaaaaaaactccatctcctggtaccaacaaggccccggcgccgcccccaaactcctcatctacgaaaacgacaaacgcccctccggcatctcagaccgcttctccggctccaaatccgccacctccgccaccctcgccatcaccggcctccacaccggcgacgaagccgactactactgcgaaacctgggacggctcaggcggcgtcttcggcaccggcaccaaagtcaccgtcctc

SEQ ID NO: 55976 - RNA, 333 nt, synthetic construct
  misc_feature 1..333: note = derived and/or modified sequence opt11 from anti-HIV_119-029589_VR-Chain
  source 1..333: mol_type = other RNA
caatccgtcctcacccaacccccctccgtctccgccgcccccggccaaaaagtcaccatctcctgctccggcacctcctcaaacatcggcaacaacttcgtctcctggtaccaactcctccccggcaccgccccccgcctcctcatctacgacaacaacaaacgcccctccggcacccccgaccgcttctccggctccaaatccggcacctccgccaccctcggcatcaccggcctccaaaccggcgacgaagccgacttctactgcggcacctgggacggctccctccgcaccggcggcgtcatcggcaccggcacccgcgtcaccgtcctc

SEQ ID NO: 55977 - RNA, 324 nt, synthetic construct
  misc_feature 1..324: note = derived and/or modified sequence opt11 from anti-HIV_119-029448_VR-Chain
  source 1..324: mol_type = other RNA
caatccgtcctcacccaacccccctccgtctccgccgcccccggccaaaaagtcaccatctcctgctccggcaactcctccaacatcggcaaaaactccgtctcctggtaccaccaactccccggcaccgcccccaaactcctcatctacgaaaacgaccgccgcccctccggcacccccgaccgcttctccggctcaaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 55978 - RNA, 333 nt, synthetic construct
  misc_feature 1..333: note = derived and/or modified sequence opt11 from anti-HIV_119-029220_VR-Chain
  source 1..333: mol_type = other RNA
caatccgtcctcacccaacccccctccgtctccgccgcccccggccaaaaagtcaccatctcctgctccggctccacctccaacatcggccaaaactacgtctcctggtaccaacaactccccggcaccgcccccaaactcctcatctacgaaaacgaccgccgcccctccggcatccccgaccgcttctccggctccaaatcaggcacctccgccaccctcgccatctccggcctccaaaccggcgacgaagccgactactgctgcgccgtctggggcgtccgccgcggcgccggagccgtcttcggccccggcaccaaagtcaccgtcctc

SEQ ID NO: 55979 - RNA, 333 nt, synthetic construct
  misc_feature 1..333: note = derived and/or modified sequence opt11 from anti-HIV_119-028317_VR-Chain
  source 1..333: mol_type = other RNA
caatccgtcctcacccaacccccctccgtctccgccgcccccggccaaaaagtcaccatctcctgctccggctcctcctccaacatcggcaacgactacgtctcctggtaccaacaactccccggcaccgcccccaaactcctcatctacgaaaacaacaaacgcccctccggcatccccgaccgattctccggctccaaatccggcacctccgccaccctcgccatcaccggcctccaaaccggcgacgaagccgactactactgcaccatctggggcgtccgcaaaggcgtcggcgccgtcttcggcaccggcaccaaagtcaccgtcctc

SEQ ID NO: 55980 - RNA, 324 nt, synthetic construct
  misc_feature 1..324: note = derived and/or modified sequence opt11 from anti-HIV_119-028165_VR-Chain
  source 1..324: mol_type = other RNA
caatccgtcctcacccaacccccctccgtctccgccgcccccggccaaaccgtcaccatctcctgctccggcatcacctccaacatcggcaaaaacgacgtctcctggtaccaacaactccccggcaccgcccccaaactcctcatctccgaaaacaaccgccgcccctccggcatccccgaccgcttctccggctccaaatccggcacctccgccaccctcgccatcaccggcctccaaaccggcgacgaagccgactactactgcgccatctgggacggccgcgtctccgtcatcggcaccggcaccaaagtcaccgtcctc

SEQ ID NO: 55981 - RNA, 324 nt, synthetic construct
  misc_feature 1..324: note = derived and/or modified sequence opt11 from anti-HIV_119-027147_VR-Chain
  source 1..324: mol_type = other RNA
caatccgtcctcacccaacccccctccgtctccgccgcccccggccaaaccgtcaccatctcctgctccggctccacctccgacatcggcaaaaacgacgtctcctggtaccaacaactccccggcatcgcccccaaactcctcatctccgaaaacaaccgccgaccctccggcacccccgaccgcttctccggctccaaatccggcacctccgccaccctcgccatcaccggcctccaaaccggcgacgaagccgactactactgcgaaacctgggacggctccggcgccgtcttcggcaccggcaccaaagtcaccgtcctc

SEQ ID NO: 55982 - RNA, 333 nt, synthetic construct
  misc_feature 1..333: note = derived and/or modified sequence opt11 from anti-HIV_119-026743_VR-Chain
  source 1..333: mol_type = other RNA
caatccgtcctcacccaacccccctccgtctccgccgcccccggccaaaacgtcaccatctcctgctccggctcctcctccaacatcggcaacaacttcgtctcctggtaccaacaacgccccggcaccggccccaaactcctcatctacgaaaccaaccgccgcccctccggcatccccgaccgcttctccggctccaaatccggcacctccgccaccctcgccatcaccggcctccaaaccggcgacgaagccgactactactgcgccacctgggccccctccctcaactccgcccgcgtcttcggcaccggcaccaaagtcaccgtcctc

SEQ ID NO: 55983 - RNA, 333 nt, synthetic construct
  misc_feature 1..333: note = derived and/or modified sequence opt11 from anti-HIV_119-026508_VR-Chain
  source 1..333: mol_type = other RNA
caatccgtcctcacccaaccaccctccgtctccgccgcccccggccaaaaagtcaccatctcctgctccggctcctcctccaccatcggcaacaactacatctcctggtaccaagtcctccccggcaccgcccccaaactcgtcatcttcaaaaacaacgaacgcccctcccgcgtccccgaccgcttctccggctccaaatccggcacctccgccaccctcggcatcaccggcctccaactcggcgacgaaggcgactactactgcggcacctgggaaacctccctctccggcggcggagtcttcggcaccggcaccaaagtcaccgtcctc

SEQ ID NO: 55984 - RNA, 324 nt, synthetic construct
  misc_feature 1..324: note = derived and/or modified sequence opt11 from anti-HIV_119-025683_VR-Chain
  source 1..324: mol_type = other RNA
caatccgtcctcacccaacccccctccgtctccgccgcccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccgactcccaatccggcacctccgccaccctcgccatcaccggcctccaaaccggagacgaagccgactactactgcgaaacctgggacggctccggcggcgtcttcggcaccggcaccaaagtcaccgtcctc

SEQ ID NO: 55985 - RNA, 333 nt, synthetic construct
  misc_feature 1..333: note = derived and/or modified sequence opt11 from anti-HIV_119-025614_VR-Chain
  source 1..333: mol_type = other RNA
caatcgctcttgacccagcccccgagcgtgagcgcggccccgggccagaacgtgatcataagctgtagcgggagctcgagcaatatcgggaaaaattacgtggcctggtaccagcaagtgcccgggaccgcgcccaagatcgtggtctttgaaacgaccaatcgcccgagcgggatcccggacaggttctcgggctcgaaatcgggcacgagcgcaaccttggccataaccgggctccagaccggggacgaggccgattactattgcacggtctggggcgtgcgaaagggcgtgggcgcagtctttggcacgggcacgaaagtgaccgtgctc

SEQ ID NO: 55986 - RNA, 324 nt, synthetic construct
  misc_feature 1..324: note = derived and/or modified sequence opt11 from anti-HIV_119-025548_VR-Chain
  source 1..324: mol_type = other RNA
caatccatcctcacccaacccccctccgtctccgccgcccccggccaaaaagtcaccatctcctgctccggctcctcctccaacatcggcaacaactacgtctcctggtaccaacacgtccccggcaccgcccccaaactcctcatctacgaaaacaaccgccgcccctccggcacccccgaccgcttctccggctccaaatccggcacctccgccaccctcgccatcaccggcctccaatccggcgacgaagccgactactactgcggcacctgggacggctccggcggcgtcttcggcaccggcaccaaagtcaccgtcctc

SEQ ID NO: 55987 - RNA, 333 nt, synthetic construct
  misc_feature 1..333: note = derived and/or modified sequence opt11 from anti-HIV_119-025526_VR-Chain
  source 1..333: mol_type = other RNA
caatcggtcttgacccagcccccgagcgtgagcgcggccccgggccagaaagtgaccataagctgtagcgggagcgcgagcaatatcgggaaaaatttcgtaagctggtaccagcaattgcccgggaccgcgcccaagctcctaatctatgaaaataacagacgcccgagcgggaccccggacaggttctcgggctcgaaatcgggcacgagcgcgaccttggccataaccgggctccagaccggggacgaggccgattactattgcacggtctggggcgtgcgcaagggcgtgggcgcagtctttggcacaggcacgaaagtgaccgtactc

SEQ ID NO: 55988 - RNA, 324 nt, synthetic construct
  misc_feature 1..324: note = derived and/or modified sequence opt11 from anti-HIV_119-023552_VR-Chain
  source 1..324: mol_type = other RNA
caatccgtcctcacccaaccaccctccgtctccgccgcccccggccaaaccgtcaccatctcctgctccggctccacctcaaacatcggcaaaaacgacgtctcctggtaccaacaactacccggcaccgcccccaaactcctcatctccgaaaacaaccgccgcccctccggcacccccgaccgcttctccgcctccaaatccggcacctccgccaccctcgccatcaccggcctccaaaccggcgacgaagccgactactactgcgaaacctggcacggctccggcggcgtcttcggcaccggcaccaaagtcaccgtcctc

SEQ ID NO: 55989 - RNA, 321 nt, synthetic construct
  misc_feature 1..321: note = derived and/or modified sequence opt11 from anti-HIV_119-023092_VR-Chain
  source 1..321: mol_type = other RNA
caatccgtcctcacccaacccccctccgtctccgccgcccccggccaaaaagtcaccatctcctgctccggctccacctccgacctcggccaaacccgcgtctcatggtaccaacaactcccccgctccgcccccgaactcctcatcttcgaaaacaaccgccgcccctcaggcatccccgaccgcttctccggcgccaaatcaggcacctccgccaccctagccatcaccggcctccaaaccggcgacgaagccgactacttctgctccacctggtccggctccctcaacttcggcaccggcacccgcgtcaccgtcctc

SEQ ID NO: 55990 - RNA, 324 nt, synthetic construct
  misc_feature 1..324: note = derived and/or modified sequence opt11 from anti-HIV_119-022793_VR-Chain
  source 1..324: mol_type = other RNA
caatcagtcctgacccagcccccaagcgtaagcgcagccccaggccaaaaagtaaccataagctgcagcggaggcacaagcaacatcggaaacaactacgtaagctggtacagacgcctgcccggaaccgcgcccaaactcctgatctacgaaaacaacaaacgcccgagcggaatcccggacagattctcaggcgcaaaatcaggcacaagcgcaaccctaggcataaccggactccagaccggagacgaagccgactactactgcgaaacctgggacgacagcggaggcgtattcggaaccggaaccaaagtcacagtccta

SEQ ID NO: 55991 - RNA, 324 nt, synthetic construct
  misc_feature 1..324: note = derived and/or modified sequence opt11 from anti-HIV_119-022395_VR-Chain
  source 1..324: mol_type = other RNA
caatccgtcctcacccaacccccctccgtctccgccgcccccggccaaaccgtcaccatctcctgctccggctcaacctccaacatcggcaaaaacgacgtctcctggtaccaacaactccccggcaccgcccccaaactcctcatctccgacaacaaccgccgcccctcctggacccccgaccgcttctccggctccaaatccggcacctccgccaccctcgccatcaccggcctccaaaccggcgacgaagccgactactactgcgaaacctgggacggctccggcggcgtcttcggccccggcacccgcgtcaccgtcctc

SEQ ID NO: 55992 - RNA, 333 nt, synthetic construct
  misc_feature 1..333: note = derived and/or modified sequence opt11 from anti-HIV_119-022334_VR-Chain
  source 1..333: mol_type = other RNA
caatccgtcctcacccaacccccctccgtctccgccgcccccggccaaaacgtcaacatctcctgctccggcggctcatccaacatcggctccaactacgtctcctggtaccaacaattccccggcaccgcccccaaacacctcatctacgaaaacaacaaacgcccctccggcatccccgaccgcttctccgactcccaatccggcacctccgccaccctcggcatcaccggcctccaaaccggcgacgaagccgactactactgcggcacctgggacggctccctccgcaccggcggcgtcatcggcaccggcacacgcgtcaccgtcctc

SEQ ID NO: 55993 - RNA, 321 nt, synthetic construct
  misc_feature 1..321: note = derived and/or modified sequence opt11 from anti-HIV_119-021866_VR-Chain
  source 1..321: mol_type = other RNA
caatccgtcctcacccaacccccctccgtctccgccgcccccggccaacgcgtcaccatctcctgctccggctccgcctccaacatcggcaaaaacttcgtctcctggtaccaacaactccccggcaaagcccccaaactcatcatctacgaagtcaccaaacgcccctccggcgtccccgcccgcttctccggctccaaatccggcacctccgccaccctcgccatcaccggcctccaaaccggcgacgaagccgactacttctgctccacctggtccggctccctcaacttcggcaccggcacccgcgtcaccgtcctc

SEQ ID NO: 55994 - RNA, 324 nt, synthetic construct
  misc_feature 1..324: note = derived and/or modified sequence opt11 from anti-HIV_119-021278_VR-Chain
  source 1..324: mol_type = other RNA
caatccgtcctcacccaacccccctccgtctccgccgcccccggccaaaaagtcaccatctcctgctccggctccgcctccaacatcggcaaaaacttcgtctcctggtaccaacaactccccggcaccgcccccaaactcctcatctacgaaaacaaccgccgaccctccggcacccccgaccgcttctccggctcccgatccggcacctccgccaccctcggcatcaccggcctacaaaccggcgacgaagcccactactactgcgaaacctgggacgactccggcggcgtcttcggcaccggcaccaaagtcaccgtactc

SEQ ID NO: 55995 - RNA, 333 nt, synthetic construct
  misc_feature 1..333: note = derived and/or modified sequence opt11 from anti-HIV_119-021183_VR-Chain
  source 1..333: mol_type = other RNA
caatccgtcctcacccaacccccctccgtctccgccgcacccggccaaaaagtcaccatctcctgctccggcaactcctccaacatcggcaacaacttcgtctcctggtaccaacaattccccggcaccgcccccaaactcctcgtcttcgaaacccaccgccgcccctccggcatccccgaccgcttctccggctccaaatccggcacctccgccaccctcgccatcaccggcctccaaaccggcgacgaagccgactactactgcgccgtctggggcgtccgccgcggcgtcggcgccgtcttcggcgccggcaccaaagtcaccgtcctc

SEQ ID NO: 55996 - RNA, 333 nt, synthetic construct
  misc_feature 1..333: note = derived and/or modified sequence opt11 from anti-HIV_119-019376_VR-Chain
  source 1..333: mol_type = other RNA
caatcggtcttgacccagcccccgagcgtgagcgcggccccgggccagaaagtgaccataagctgtagcgggagctcgagcaatatcgggaacaattacgtgagctggtaccagcaagtgcccgggaccgcgcccaagctcttggtctatgaaacgtacaggcgcccgagcgggatcccggacaggttctcgggctcgaaatcgggcacgagcgcgaccttggccataaccgggctccagaccggggacgaggccgattactattgcacgatctggggcgtgcgcaagggcgtgggcgcggtctttggcacgggcacgaaagtgaccgtgctc

SEQ ID NO: 55997 - RNA, 321 nt, synthetic construct
  misc_feature 1..321: note = derived and/or modified sequence opt11 from anti-HIV_119-019238_VR-Chain
  source 1..321: mol_type = other RNA
caatccgtcctcacccaacccccctccgtctccgccgcccccggccaaaaagtcaccatctcctgctccggcacctcatccaacatcggcaacaaccacgtctcctggtaccaacaagtccccggcaccgcccccaaactcctcatctacgaaaacaacaaacgcccctccggcatccccgcccgcttctccgccgccaaatccggcacctccgccaccctcgccatcaccggactccaaaccggcgacgaagccgactacttctgcgccacctggtccggccgcctcaacatcggcaccggcaccaaagtcaccgtcctc

SEQ ID NO: 55998 - RNA, 333 nt, synthetic construct
  misc_feature 1..333: note = derived and/or modified sequence opt11 from anti-HIV_119-018500_VR-Chain
  source 1..333: mol_type = other RNA
caatccgtcctcacccaacccccctccgtctccgccgcccccggccaaaaagtcaacatctcctgctccggctcctcctccaacatcggcaacaacttcgtctcctggtaccaacaaagacccggcaccgcccccaaactactcatctacgaaaccaaccgccgcccctccggcatccccgaccgcttctcaggctccaaatccggcacctccgccaccctcgccatcaccggcctccaaaccggcgacgaagccgactactactgcgccacctgggccgcctccctaacctccgcccgcgtcttcggcatcggcaccaaagtcaccgtcctc

SEQ ID NO: 55999 - RNA, 324 nt, synthetic construct
  misc_feature 1..324: note = derived and/or modified sequence opt11 from anti-HIV_119-018318_VR-Chain
  source 1..324: mol_type = other RNA
caatccgtcctaacccaacccccctcagtctcagccgcccccggccaaaccgtcatcatctcctgctccggctcaacctccaacatcggcaaaaacgacgtctcctggtaccaacaactccccggcaccgcccccaaactcctcatctccgaaaacaaccgccgcccctccggcacccccgaccgcttctccggctccaaatccggcacctccgccaccctcgccatcaccggcctccaaaccggcgacgacgccgactactactgcgaaacctgggacggctccggcggcgtcttcggcaccggcaccaaagtcaccctcgtc

SEQ ID NO: 56000 - RNA, 333 nt, synthetic construct
  misc_feature 1..333: note = derived and/or modified sequence opt11 from anti-HIV_119-018218_VR-Chain
  source 1..333: mol_type = other RNA
caatcagtcctcacccaacccccctccgtctccgccgcccccggccaaaaagtcaccatctcctgctccggcaactcatccaacatcggcaacaacttcgtctcctggtaccaacaactccccggcaccgcccccaaactcctcatctacgaaaacaaccgccgcccctccggcatccccgaccgcttctccggctccaaatccggcacctccgccaccctcgccatctccggcctccaaaccggcgacgaagccgactactggtgcgccgtctggggcgtccgccgcggcgccggcgccgtcttcggcgccggcaccaaagtcaccgtcctc

SEQ ID NO: 56001 - RNA, 324 nt, synthetic construct
  misc_feature 1..324: note = derived and/or modified sequence opt11 from anti-HIV_119-017876_VR-Chain
  source 1..324: mol_type = other RNA
caatccgtcctcacccaacccccctccgtctcagccgcccccggccaaaaagtcaccatctcctgctccggctccacctccaaaatcggccaaaactccgtctcctggtaccaacaactccccggcaccgcccccaaactcctcatctacgaaaacgaccgccgcccctccggcacccccgaccgcttctccgcctccaaatccggcacctccgccaccctcgccatcaccggcctccaaaccggcgacgaagccgactactactgcgaaacctgggacgactccggcggcgtcttcggcaccggcaccaaagtcaccgtcctc

SEQ ID NO: 56002 - RNA, 324 nt, synthetic construct
  misc_feature 1..324: note = derived and/or modified sequence opt11 from anti-HIV_119-017740_VR-Chain
  source 1..324: mol_type = other RNA
caatccgtcctcacccaacccccctccgtctccgccgcacccggccaaaaagtcaccatctcctgctccggctccaactccaacatcggcaacaaagacgtctcctggtaccgccaagtccccgccaccgcccccaaactccccatctacgaaaacaaaaacgaaccctccggcgtccccgaccgcttctccggctccaaatccggcacctccgccaccctcgccataaccggcctccaaaccggcgacgaagccgactactactgcgccacctgggacggccgcgtctcagtcatcggcaccggcaccaaagtcacagtcgtc

SEQ ID NO: 56003 - RNA, 321 nt, synthetic construct
  misc_feature 1..321: note = derived and/or modified sequence opt11 from anti-HIV_119-017128_VR-Chain
  source 1..321: mol_type = other RNA
caatccgtcctcacccaaccaccctccgtctccgccgcccccggccaaaaagtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggcgccaaatccggcacctcagccaccctcgccatcaccggcctccaaaccggcgacgaagccgactacttctgctccacctggtccggctccctcaacttcggcaccggcacccgcgtcaccgtcctc

SEQ ID NO: 56004 - RNA, 324 nt, synthetic construct
  misc_feature 1..324: note = derived and/or modified sequence opt11 from anti-HIV_119-017044_VR-Chain
  source 1..324: mol_type = other RNA
caatcagtcctcacccaacccccctccgtctccgccgcccccggccaaaaagtcaccatctcctgctccggctccaactccaacatcggcaacaactacgtctcctggtaccaccacctccccggcaccgccccccgactcctcatctacgacaacaacaaacgcccctccggcatccccgaccgcttctccggctccaaatccggcacctccgccaccctcgccatcaccggcctccaaaccggcgacgaagccgactactactgcgccacctgggacggccgcgtctccgtcatcggcaccggcacccaagtcaccgtcctc

SEQ ID NO: 56005 - RNA, 321 nt, synthetic construct
  misc_feature 1..321: note = derived and/or modified sequence opt11 from anti-HIV_119-016644_VR-Chain
  source 1..321: mol_type = other RNA
caatccgtcctcacccaaccaccctccgtctccgccgcccccggccaaaaagtcaccatctcctgctccggcggcacctccaacatcggcaacaactacgtctcctggtaccaacaactccccggcaccgcccccaaactcctcatctacgaaaacaacaaacgcccctccggcatccccgcccgcttctccgccgccaaatccggcacctccgccaccctcgccatcaccggcctacaaaccgaagacgaagccgactactactgcgccacctggtccggctccctcaacatcggcaccggcaccaaagtcaccgtcctc

SEQ ID NO: 56006 - RNA, 333 nt, synthetic construct
  misc_feature 1..333: note = derived and/or modified sequence opt11 from anti-HIV_119-015878_VR-Chain
  source 1..333: mol_type = other RNA
caatccgccctcacccaacccccctccgcctccggctcccccggccaatccgtcaccatctcctgctccggctcctcctccaacatcggcaacaacttcgtctcctggtaccaacaacgccccggcaccgcccccaaactcctcatctacgaaaccaacaaacgcccctccggcatccccgaccgcttctccggctccaaatccggcacctccgccaccctcgccatcaccggactccaaaccggcgacgaagccgactactactgcgccacctgggccccccgcctcaactccgcccgcgtcttcggcaacggcaccatggtcaccgtcctc

SEQ ID NO: 56007 - RNA, 321 nt, synthetic construct
  misc_feature 1..321: note = derived and/or modified sequence opt11 from anti-HIV_119-015538_VR-Chain
  source 1..321: mol_type = other RNA
caatcagtcctcacccaacccccctccgtctccgccacccccggccaaaaagtcaccatctcctgctccggctcctcctccaacatcggcaacaactacgtctcctggtaccgccgcctccccggcaccgcccccaaacacctcatctacgaaaccaacaaccgcccctccggcgtccccgcccgcctctccgccgccaaatccggcacctccgccaccctcgccatcaccggcctccaaaccgaagacgaagccgactactactgcgccacctggtccggctccctcaacatcggcaccggcaccaaagtcaccgtcctc

SEQ ID NO: 56008 - RNA, 321 nt, synthetic construct
  misc_feature 1..321: note = derived and/or modified sequence opt11 from anti-HIV_119-015455_VR-Chain
  source 1..321: mol_type = other RNA
caatccgtcctaacccaacccccctccgtctccgccacccccggccaaaaagtcaccatctcctgctccggctccaactccaacatcggcaacaaagacgtctcctggtaccaacacttccccggcaccgcccccaaactcctcatctacgaaaacaacaaacgcccctccggcatccccgaccgcttctccggctccaaatccgccacctccgccaccctcaccatcaccggcctccaaaccgaagacgaagccgactactactgcgccacctggtccggctcactcaacatcggcaccggcaccaaagtcaccgtcctc

SEQ ID NO: 56009 - RNA, 321 nt, synthetic construct
  misc_feature 1..321: note = derived and/or modified sequence opt11 from anti-HIV_119-014425_VR-Chain
  source 1..321: mol_type = other RNA
caatccgtcctcacccaacccccctccgtctccgccgcccccggccaaaaagtcaccatctcctgctccggcggcacatccaacatcggcaacaactacgtctcctggtaccaacacctccccggcaccgcccccaaactcctcatctacgaaaacaacaaacgcccctccggcatccccgaccgcttctccggcgccaaatccggcacctccgccaccctcgccatcaccggcctccaaaccggcgacgaaggcgactactactgcgccacctggtccggctccctcaacatcggcaccggcaccaaagtcaccgtcctc

SEQ ID NO: 56010 - RNA, 324 nt, synthetic construct
  misc_feature 1..324: note = derived and/or modified sequence opt11 from anti-HIV_119-013582_VR-Chain
  source 1..324: mol_type = other RNA
caatccatggtcacccaatccccctcagtctcagccgcccccggccaaaaagtcaccatctcctgctccggcacctcctccaacatcggccaaaactacgtctcctggtaccaacaactacccggcaccgcccccaaactcctcatctccgaaaacaaccgacgcccctccggcacccccgaccgcttctccggctccaaatccggcacctccgccaccctcgccatcaccggcctccaaaccggcgacgaagccgactactactgcgaaacctgggacggctccggcggcgtcttcggcaccggcaccaaagtcaccgtcctc

SEQ ID NO: 56011 - RNA, 333 nt, synthetic construct
  misc_feature 1..333: note = derived and/or modified sequence opt11 from anti-HIV_119-013364_VR-Chain
  source 1..333: mol_type = other RNA
caatcagtcctaacccagcccccaagcgtaagcgcagccccgggccaaaaagtaaccataagctgcagcggaagctcaagcaacatcggaaacaactacgtaagctggtaccaacaactgcccggaaccgcacccaaactcctaatctacgacaacaacaaacgcccaagcggaatcccagacagattctcaggctcaaaatcaggcacaagcgcaaccctggccataaccggactccacaccggagacgaagccgactactactgcacagtctggggcgtacgcaaaggcgtaggcgcagtcttcggcacaggcacaaaagtaaccgtactc

SEQ ID NO: 56012 - RNA, 333 nt, synthetic construct
  misc_feature 1..333: note = derived and/or modified sequence opt11 from anti-HIV_119-012886_VR-Chain
  source 1..333: mol_type = other RNA
caatcgatcttgacccagcccccgagcgtgagcgcagccccgggccagaaagtgaccataagctgtagcgggagctcgagcacaatcgggaccaattacgtgagctggtaccagcaatttcccgggaccgcgcccaagctcttggtctttgaaacgcacaggcgcccgagcgggatcccggacaggttctcgggatcgaaatcgggcacgagcgcgaccttggccataaccggactccagaccggagacgaggccgattactattgcgcggtctggggcgtgcgcaggggcgtgggcgcggtctttggcgcgggcacgaaagtgaccgtgctc

SEQ ID NO: 56013 - RNA, 333 nt, synthetic construct
  misc_feature 1..333: note = derived and/or modified sequence opt11 from anti-HIV_119-012249_VR-Chain
  source 1..333: mol_type = other RNA
caatccgtcctcacccaacccccctcagtctccggcgcccccggccaaaaagtcaccatctcctgctccggctcctcctccaacatcggccgcaactacgtctcctggtaccaacaactccccggcaccgcccccaaactcctcatctacgaaaacaacaaacgcccctccggcatccccgaccgcttctccggctccaaatccggcacctccgccaccctcgtcatcaccggcctacaaaccggcgacgaagccgacttctactgcggcacctgggacggctccctctccggcggcggcgtcatcggcaccggcacccgcgtcaccgtcctc

SEQ ID NO: 56014 - RNA, 324 nt, synthetic construct
  misc_feature 1..324: note = derived and/or modified sequence opt11 from anti-HIV_119-012161_VR-Chain
  source 1..324: mol_type = other RNA
caatccttcctaacccaacccccctccgtctccgccgcccccggccaaaaagtcaccatctcctgctccggctccaactccaacatcggcaaaaactacgtatcctggtaccaatacctccccggcaccgtccccaaactcctcatctacgaaaacgacaaacgcccctccggcatccccggccgcttctccgcctccaaatccggcacctccgccaccctcgccatcaccggcctccaaaccggcgacgaagccgactactactgcggcacatgggacggctccggcggcgtcttcggcaccggcaccaaagtcaccgtcctc

SEQ ID NO: 56015 - RNA, 324 nt, synthetic construct
  misc_feature 1..324: note = derived and/or modified sequence opt11 from anti-HIV_119-012110_VR-Chain
  source 1..324: mol_type = other RNA
caatccgtcctcacccaacccccctccgtctccgccgcccccggacaaaccgtcaccatctcctgctccggctccacctccaacatcggcaaaaacgacgtctcctggtaccaacaactccccggcaccgcccccaaactcctcatctccgaaaacaaccgccgcccctccggcacccccgaccgcttctccggctccaaatccggcacctccgccaccctcgccatctccggcctccaaaccggcgacgaagccgactactactgcggcacctgggacggctccggcggcgtcttcggcaccggcaccaaagtcaccgtcctc

SEQ ID NO: 56016 - RNA, 333 nt, synthetic construct
  misc_feature 1..333: note = derived and/or modified sequence opt11 from anti-HIV_119-012100_VR-Chain
  source 1..333: mol_type = other RNA
caagccgtcctcacccaacccccctccgtctccgccgcccccggccaaaaagtcgccatctcctgctcaggctcctcctccaacatcggcaacaactacgtctcctggtaccaacaactccccggcaccgtccccaaactcctcatctacgacacagacaaacgcccctccggcatccccgaccgcttctccggctccaaatccggcacctccgccaccctcggcatcacccgcctccaaaccggcgacgaagccgactactactgcgccacctgggccccccgcctcaactccgcccgcgtcttcggcaacggcaccatggtcaccgtcctc

SEQ ID NO: 56017 - RNA, 324 nt, synthetic construct
  misc_feature 1..324: note = derived and/or modified sequence opt11 from anti-HIV_119-011651_VR-Chain
  source 1..324: mol_type = other RNA
caatccgtcctcacccaacccccctccgtctccgccgcccccggccaaaaagtcaccatctcctgctccggcaactcctccaacatcggcaacaactacgtctcctggtaccaacaactccccggcaccgcccccaaactcctcatctacgaaaacaacaaacgcccctccggcatccccgaccgattctccggctccaaatccggcacctccgccaccctagccatcaccggactccaaaccggcgacgaagccgactactactgcgccacctgggacggccgcgtctccgtcttcggcaccggcaccaaagtcgccgtcctc

SEQ ID NO: 56018 - RNA, 333 nt, synthetic construct
  misc_feature 1..333: note = derived and/or modified sequence opt11 from anti-HIV_119-011479_VR-Chain
  source 1..333: mol_type = other RNA
caatccgtcctcacccaacccccctccgtctcagccacccccggccaaaaagtcaccatctcctgctccggctccaactccaacatcggcaacaaatacgtctcctggtaccaacacttccccggcaccgcccccaaactcctcatctacgaaaacaaccgccgcccctccggcatccccgaccgcttctccggctccaaatccggcacctccgccaccctcgccatcaccggcctccaaaccggcgacgaagccgactactactgcaccatctggggcgtccgcaaaggagtcggcgccgtcttcggcaccggcaccaaagtcaccgtcctc

SEQ ID NO: 56019 - RNA, 333 nt, synthetic construct
  misc_feature 1..333: note = derived and/or modified sequence opt11 from anti-HIV_119-011232_VR-Chain
  source 1..333: mol_type = other RNA
caatccgtcctcacccaaccaccctccgtctccgccgcccccggccaaaacgtcaacatctcctgctccggcggctcctccaacatcggatccaactacgtctcctggtaccaacaattccccggcaccgcccccaaactcctcatctacgacgacgacaaacgcccctccggcatcccccaccgcttctccgcctcaaaatccggcacctccgccaccctcgccatctccggcctccaaaccggcgacgaagccgactactgctgcgccgtctggggcgtccgccgcggcgccggcgccgtcttcggcgccggcaccaaagtcaccgtcctc

SEQ ID NO: 56020 - RNA, 333 nt, synthetic construct
  misc_feature 1..333: note = derived and/or modified sequence opt11 from anti-HIV_119-011175_VR-Chain
  source 1..333: mol_type = other RNA
caatccgtcctcacccaaccaccctccgtctccgccgcccccggccaaaaagtcaccatctcctgctccggctccaactcctacatcggcaacaaatacgtctcctggtaccaacaattccccggaaccgcccccaaactcctcatctacgaaaacaaccgacgcccctccggcatccccgaccgcttctccggctccaaatccggcacctccgccaccctcgccatctccggcctccaaaccggcgacgaagccgactactgctgcgccgtctggggcgtccgccgcggcgccggcgccgtcttcggccccggcaccaaagtcaccgtcctc

SEQ ID NO: 56021 - RNA, 321 nt, synthetic construct
  misc_feature 1..321: note = derived and/or modified sequence opt11 from anti-HIV_119-008396_VR-Chain
  source 1..321: mol_type = other RNA
caatccgtcctcacccaacccccctccgtctccgccgcccccggccaaaaagtcaccatctcctgctccggctcctcctccaacatcggcaacaactacgtctcctggtaccaacaagtccccggcaccgcccccaaactactcgtctacgaaaacacccgccgcccctccggcgtccccgaccgcttctcaggcgccaaatccggcacctccgccaccctcgccatcaccggcctccaaaccggcgacgaaggcgactactactgcgccacctggtccggctccctcaacatcggcaccggcaccaaagtcaccgtcctc

SEQ ID NO: 56022 - RNA, 324 nt, synthetic construct
  misc_feature 1..324: note = derived and/or modified sequence opt11 from anti-HIV_119-007148_VR-Chain
  source 1..324: mol_type = other RNA
caatccgtcctcacccaacccccctccgtctccgccgcccccggccaaaaagtcaccatctcctgctccggctccacctccaacatcggcaaaaactacgtctcctggtaccaacacctacccggcaccgcccccaaactactcctctacgaaaacgaccgccgcccctcaggcacacccgaccgcttctccggctccaaatccggcacctccgccaccctcgccatcaccggcctccacaccggcgacgaagccgactactactgcgaaacctgggacggctccggcggcgtcttcggcaccggcaccaaagtcaccgtcctc

SEQ ID NO: 56023 - RNA, 333 nt, synthetic construct
  misc_feature 1..333: note = derived and/or modified sequence opt11 from anti-HIV_119-007029_VR-Chain
  source 1..333: mol_type = other RNA
caatccgtcctcacccaacccccctccgtatcagccgcccccggacaaaaagtcaccatctcctgctccggcaactcatccaacatcggcaacaacttcgtctcctggtaccaacaagtacccggcaccgcccccaaactcctcctctacgaaacctaccgccgcccctccggaatctccgaccgcttctccggctccaaatccggcacctccgccaccctcgccatcaccggcctccaaaccggcgacgaagccgactactactgcaccgtctggggcgtccgcaaaggcgtcggcgccgtcttcggcaccggcaccaaagtcaccgtcctc

SEQ ID NO: 56024 - RNA, 324 nt, synthetic construct
  misc_feature 1..324: note = derived and/or modified sequence opt11 from anti-HIV_119-004707_VR-Chain
  source 1..324: mol_type = other RNA
cagagcgtgctcacgcaaccgccctcggtctcggccgcgcccgggcaaaaggtcacgatctcgtgctcgggctcgacctcgaacataggcaagaacgatgtctcgtggtatcaacagctcccgggcacggccccgaaattgctcataagcgagaacaatcgcaggccctcgggcacgcccgatcgctttagcgggagcaagagcgggacctcggccacactcgcgatcacgggcttgcaaacgggcgatgaagcagactattactgtgaaacgtgggatggctcgggcggggtctttggcacgggcacgaaagtgaccgtgcta

SEQ ID NO: 56025 - RNA, 333 nt, synthetic construct
  misc_feature 1..333: note = derived and/or modified sequence opt11 from anti-HIV_119-003910_VR-Chain
  source 1..333: mol_type = other RNA
caatccgtcctcacccaaccaccctccgtctccgccgcccccggccaaaaagtcgccatctcctgctccggcaacacctcctccatcggcaacaacttcgtctcctggtaccaacaagtccccggcaccgcccccaaactcctcgtctacgaaacctaccgccgcccctccggcatccccgaccgcttctccggctccaaatccggcacctccgccaccctcgccatcaccggcctccaaaccggcgacgaagccgactactactgcaccgtctggggcgtccgcaaaggcgtcggcgccgtcttcggcaccggcaccaaagtcaccgtcctc

SEQ ID NO: 56026 - RNA, 321 nt, synthetic construct
  misc_feature 1..321: note = derived and/or modified sequence opt11 from anti-HIV_119-002450_VR-Chain
  source 1..321: mol_type = other RNA
caatccgtcctcacccaacccccctccgtctccggcgcccccggccaacgcgtcaccatctcctgcaccggctcctcctccaacatcggcaacaactacgtctcctggtaccaaggcctccccggcaccgcccccaaactcctcatctacgaaaacaacaaacgcccctccggcatccccgaccgcttctccggcgccaaatccggcaccgccgccaccctcgccatcaccggcctccaaaccggcgacgaagccgactactactgcgccacctggtccggctccctcaacttcggcaccggaaccaaagtcaccgtcctc

SEQ ID NO: 56027 - RNA, 321 nt, synthetic construct
  misc_feature 1..321: note = derived and/or modified sequence opt11 from anti-HIV_119-001552_VR-Chain
  source 1..321: mol_type = other RNA
caatccgtcctcacccaacccccctccgtctccgccgcccccggccaaaaagtcaccatctcctgctccggctccaactcctacctcggcaacaaatacgtctcctggtaccaacaattccccggcaccgcccccaaactactcatctacgaaaacaacaaacgcccctccggcatccccgaccgcttctccgcctccaaatccgccgcctccgccaccctcgccatcaccggcctccaaaccggcgacgaaggcgactactactgcgccacctggaccggctccctcaacatcggcaccggcaccaaagtcaccgtccta

SEQ ID NO: 56028 - RNA, 333 nt, synthetic construct
  misc_feature 1..333: note = derived and/or modified sequence opt11 from anti-HIV_059-188169_VR-Chain
  source 1..333: mol_type = other RNA
caatccgtcctcacccaacccccctccgtctccgccgcccccggccaaaaagtcaccatctcctgctccggctccacctccaacatcggcgacaactacgtctcctggtaccaacaagtccccggcaccgcccccaaactcctcatctacgaaaacaaccgccgcccctccggcacccccgaccgcttctccggctccaaatccggcacctccgccaccctcgccatcaccggcctccaaaccggcgacgaagccgactactactgcggcacctgggacacctccctctccaccggcggcgtcttcggcaccggcaccaaagtcaccgtcctc

SEQ ID NO: 56029 - RNA, 333 nt, synthetic construct
  misc_feature 1..333: note = derived and/or modified sequence opt11 from anti-HIV_059-183739_VR-Chain
  source 1..333: mol_type = other RNA
caatccgtcctcacccaacccccctccgtctccgccgcccccggccaaaaagtcaccatctcctgctccggatccacctccaacatcggcaaaaactacgtctcctggtaccaacaactccccggcaccgcccccaaactcctcatctacgaaaacaaccgccgcccctccggcacccccgaccgcttctccggctccaaatccggcacctccgccaccctcggcatctccggcctccaaaccggcgacgaagccgactactactgcggcacctgggacacctccctctccggcggcggcgtcttcggcaccggcaccaaagtcaccgtcctc

SEQ ID NO: 56030 - RNA, 333 nt, synthetic construct
  misc_feature 1..333: note = derived and/or modified sequence opt11 from anti-HIV_059-182376_VR-Chain
  source 1..333: mol_type = other RNA
caatccgtcctctcccaacccccctccgtctccgccgcccccggccaaaaagtcaccatctcctgctccggctcctcctccaacatcggcaactactacgtctcctggtaccaacaattccccggcaccgcccccaaactcctcatctacaaaaacgacaaccgcccctccggcatccccgaccgcttctcaggctccaaatccggcacctccgccaccctcggcatctccggcctccaaaccggcgacgaagccgactactactgcggcacctggggcacctccctctccggcggcggcgtcttcggcaccggcaccaaagtcaccgtcctc

SEQ ID NO: 56031 - RNA, 333 nt, synthetic construct
  misc_feature 1..333: note = derived and/or modified sequence opt11 from anti-HIV_059-182199_VR-Chain
  source 1..333: mol_type = other RNA
caatcagtcctaacccaacccccaagcgtaagcgccgccccaggccaaaacataaccatcagctgcagcggcagctcaagcaacatcggaagccacagcataagctggtaccaacacctacccggaaccgcccccaaaatcgtaatctacgacaacgacaaacgcccactcggaatcccagacagattctcaggctcaaaatcaggcacaagcgcaaccctaggcataaccggactccaaaccggagacgaagccgactactactgcggcacctgggacacaagcctaagcggcggcggagtcttcggcccaggcacaaaagtaaccgtactc

SEQ ID NO: 56032 - RNA, 324 nt, synthetic construct
  misc_feature 1..324: note = derived and/or modified sequence opt11 from anti-HIV_059-169202_VR-Chain
  source 1..324: mol_type = other RNA
cactccgtcctaacccaacccccctccgtatccgccgcccccggccaaaaagtcaccatctcctgctccggctcctcctccaaaatcggcaacaacttcgtctcctggtaccaacaactccccggcaccgcccccaaactcctcatctacgaaaacaacaaacgcccctccggcatccccgaccgattctccggctccaaatccggcacctccgccaccctcgccatcaccggcctccaaaccggcgacgaagccgactactactgcggcacctgggacggccgcgtctccgtcatcggctccggcaccaaactcaccgtcctc

SEQ ID NO: 56033 - RNA, 324 nt, synthetic construct
  misc_feature 1..324: note = derived and/or modified sequence opt11 from anti-HIV_059-155645_VR-Chain
  source 1..324: mol_type = other RNA
caatccgccctcacccaacccgcctccgtctccggctcacccggccaatccatcaccatctcctgcaccggcacctcctccgacgtcggctacaactacgtctcctggtaccaacaactccccggcaccgcccccaaactcctcatctacgaaaacaacaaacgcccctccggcatccccgaccgcttctccggctccaaatccggcacctccgccaccctcgccatcaccggcctccaaaccggcgacgaagccgactactactgcggcacctgggacggccgcctctcagtcatcggcaccggcaccaaagtcaccgtcctc

SEQ ID NO: 56034 - RNA, 333 nt, synthetic construct
  misc_feature 1..333: note = derived and/or modified sequence opt11 from anti-HIV_059-151619_VR-Chain
  source 1..333: mol_type = other RNA
caatcagtcctgacccagcccccaagcgtaagcgcagccccaggccaaaaagtaaccataagctgcagcggaagctcaagcaacatcggaaacaacttcgtaagctggtaccaactcctgcccggaaccccgcccaaactcctgatcttcaaaaacaacgaacgcccaagcggaatcccagacagattctcaggctcaaaatcaggcacaagcgcaaccctaggcataaccggactccagaccggggacgaaggcgactactactgcggaacctgggacacaagcctaagcggaggcggagtcttcggcacaggcacacgcgtaaccgtactc

SEQ ID NO: 56035 - RNA, 333 nt, synthetic construct
  misc_feature 1..333: note = derived and/or modified sequence opt11 from anti-HIV_059-146503_VR-Chain
  source 1..333: mol_type = other RNA
caatccgtcctcacccaacccccctccgtctccgccacccccggccaaaaagtcaccatctcctgctccggctccgcctccaacatcggcaacaactacgtctcctggtaccaacaatttcccggcaccgcccccaaactcctcatctacgacaccaacaaacgcccctccggcatccccgaccgcttctccggctccaaatccggcacctccgccatcctcggcatcaccggcctccaaatcggcgacgaagccgactactactgcggcacctgggacacctccctctccggcggcggagtcttcggcaccggcaccaaagtcaccgtcctc

SEQ ID NO: 56036 - RNA, 324 nt, synthetic construct
  misc_feature 1..324: note = derived and/or modified sequence opt11 from anti-HIV_059-136098_VR-Chain
  source 1..324: mol_type = other RNA
caatccgtcctcacccaaccaccctccgtctccgccgcccccggccaacgagtcaccatctcctgctccggctcctcctccaacatcggcaacaactacgtctcctggtaccaacaactccccggcaccgcccccaaactcctcatctacgaaaacaaccgccgcccctccggcatccccgaccgattctccggctccaaatccggcacctccgccaccctcgccatcaccggcctccaaaccggcgacgaaggcgactactactgcgcccgctgggacggccgcctctccgtcatcggctccggcaccaaagtcaccgtcctc

SEQ ID NO: 56037 - RNA, 333 nt, synthetic construct
  misc_feature 1..333: note = derived and/or modified sequence opt11 from anti-HIV_059-105516_VR-Chain
  source 1..333: mol_type = other RNA
caatccgccctcacccaacccccctccgtctccgcagcccccggccaaaaagtcaccatctcctgctccggctcctcctccaacatcggcaacaactacgtctcctggtaccaacaactccccggcaccgcccccaaactcctcatctacgacaacaacaaacgcccctccggcatccccgaccgattctccggctccaaatccggcacctccgccaccctcgccatcgccggcctccaaaccggcgacgaagccaactactactgcggcacctgggacggctccctccgcaccggcggcgtcttcggcaccggcaccaaagtcaccgtcctc

SEQ ID NO: 56038 - RNA, 333 nt, synthetic construct
  misc_feature 1..333: note = derived and/or modified sequence opt11 from anti-HIV_059-095709_VR-Chain
  source 1..333: mol_type = other RNA
caatccgtcctcacccaacccccatccgtctccgccgcccccggccaaaaagtcaccatctcctgctccggccgctcctccaacatcggcaacaacttcgtctcctggtaccaactcctccccggcaccgcccccaaactcctcatctacaaaaacaacgaacgcccctccggcatccccgaccgcttctcagcctccaaatccggcacctccgccaccctaggcatcaccggcctccaaaccggcgacgaagccgactactactgcggcacctgggacacctccctctccggcggcggcgtcttcggcaccggcaccaaagtcaccgtcctc

SEQ ID NO: 56039 - RNA, 333 nt, synthetic construct
  misc_feature 1..333: note = derived and/or modified sequence opt11 from anti-HIV_059-069468_VR-Chain
  source 1..333: mol_type = other RNA
caatccgtcctcacccaacccccctccgtctccggcgccccccgccaatccgtcatcatctcctgcaccggctcatcctccaacatcggcggcttcgacgtccactggtaccaacaactccccggcaccgcccccaaactcctcatctacgaaaacaaccgccgcccctccggcacccccgaccgcttctcaggctccaaatccggcacctccgccaccctcgccatcaccggcctccaaaccggcgacgaagccgactactactgcggcacctgggacggctccctctccaccggcggcgtcatcggcaccggcaccaaagtcaccgtcctc

SEQ ID NO: 56040 - RNA, 333 nt, synthetic construct
  misc_feature 1..333: note = derived and/or modified sequence opt11 from anti-HIV_059-060026_VR-Chain
  source 1..333: mol_type = other RNA
caatccgtcctcacccaacccccctccgtctccgccgcccccggccaaaaagtcaccatctcctgctccggctcctcatccaacatcggcaacaactacgtctcctggtaccaacaactccccggcaccgtccccaaactcctcatctacaaaaacgacaaacgcccctccggcatccccgaccgcttctcaggctccaaatccgccacctccgccaccctcggcatcaccggcctccaaaccggcgacgaagccgactactactgcggcatctgggacacctccctctccgccggcggcgtcttcggcaccggcacccgcgtcaccgtcctc

SEQ ID NO: 56041 - RNA, 333 nt, synthetic construct
  misc_feature 1..333: note = derived and/or modified sequence opt11 from anti-HIV_059-053668_VR-Chain
  source 1..333: mol_type = other RNA
caatccgtcctaacccaacccccctccgtctccgccgcccccggccaaaaagtcaccatctcctgctccggctcctcctccaacatcggcaacaactacgtctcctggtaccaacaactccccggcaccgcccccaaactcctcatctacgaaaacaacaaacgctcctccggcatccccgaccgcttctccggctccaaatccggcacctccgccaccctcgccatcaccggcctccaaaccggcgacgaagccgactactactgcggcacccgcgactcctccctctccggcggcggcgtcatcggcaccggcacaaaagtcaccgtcctc

SEQ ID NO: 56042 - RNA, 333 nt, synthetic construct
  misc_feature 1..333: note = derived and/or modified sequence opt11 from anti-HIV_059-052864_VR-Chain
  source 1..333: mol_type = other RNA
caatccgtcctcacccaacccccctccctctccgccgcccccggccaacgcgtcaccatatcctgctcaggctcctcctccaacatcggcaacaactacgtctcctggtaccaacaactccccggcaccgcacccaaactcctcatctacgaatccaacaaacgcccctccggcacacccgaccgcttctccggctcaaaatccggcacctccgccaccctcgccatcaccggcctccaaaccggcgacgaagccgactactactgcggcacctgggacgcctccctatcctccggcggcgtcatgggcaccggcaccaaagtcaccgtcctc

SEQ ID NO: 56043 - RNA, 333 nt, synthetic construct
  misc_feature 1..333: note = derived and/or modified sequence opt11 from anti-HIV_059-050968_VR-Chain
  source 1..333: mol_type = other RNA
caatccgtcctcacccaagccccatccgtctccgccgcccccggcgaaaaagtcaccatctcctgctccggcacctcctccaacatcggctactactacgtctcctggtaccaacaattccccggcaccgcccccaaagtcgtaatctacgaaaacaaccgccgcccctccggaacccccgaccgcttctccggctccaaatccggcacctccgccaccctcgccatcaccggcctccaaaccggcgacgaagccgactactactgcggcacctggggcggctccctctccaccggcggcgtcataggcaccggcaccaaagtcaccgtcctc

SEQ ID NO: 56044 - RNA, 333 nt, synthetic construct
  misc_feature 1..333: note = derived and/or modified sequence opt11 from anti-HIV_059-046422_VR-Chain
  source 1..333: mol_type = other RNA
caatccgtcctcacccaacccccctccgtctccgccgcccccggccaaaaagtcaccatctcctgctccggctcctcctccaccatcggcaacaactacatctcctggtaccaactcctccccggcaccccccccaactacctcatcttcaaaatctccgaacgcccctccggcgtccccgaccgcttctccggctccaaatccggcacctccgccaccctccacatcaccggcctacaaaccggcgacgaaggcgactactactgcggcacctgggacacctccctctccggcggcggcgtcttcggcaccggcaccaaagtcaccgtcctc

SEQ ID NO: 56045 - RNA, 333 nt, synthetic construct
  misc_feature 1..333: note = derived and/or modified sequence opt11 from anti-HIV_059-045120_VR-Chain
  source 1..333: mol_type = other RNA
caatccgtcctcacccaacccccctccgtctccgccgcccccggccaaaaagtcgccatctcctgctccggctcctcctccaccatcggcaacaactacgtctcctggtaccaactcctccccggcaccccccccaaactcctcatcttcaaatcccacgaacgcccctccggcatccccgaccgcttctccggctccaaatccggcacctccgccaccctcggcatcaccggcctccaaaccggcgacgaaggcgactactactgcggcacctgggactcctccctctccgtcggcggcgtcttcggcaccggcaccaaagtcaccgtcctc

SEQ ID NO: 56046 - RNA, 333 nt, synthetic construct
  misc_feature 1..333: note = derived and/or modified sequence opt11 from anti-HIV_059-039932_VR-Chain
  source 1..333: mol_type = other RNA
caatccgtcctcacccaacccccctcagtctcagccgcccccggccaaaaagtcaccatctcctgctccggctcctcatccatcatcggcaaaaactacgtctcctggtaccaacacctccccggcaccgcccccaaactcctcatctacgaaaacaacaaacgcccctcaggcatccccgaccgcttctccggctccaaatccggcacctccgccaccctagccatcgccggcctccaaaccggcgacgaagccaactactactgcggcacctggggcggctccctatccaccggcggcgtcttcggcaccggcaccaaagtcaccgtcctc

SEQ ID NO: 56047 - RNA, 333 nt, synthetic construct
  misc_feature 1..333: note = derived and/or modified sequence opt11 from anti-HIV_059-038595_VR-Chain
  source 1..333: mol_type = other RNA
caatccgtcctcacccaacccccctcagtctccgccgcccccggccaaaaagtcaccatctcctgctccggccgctcctccaacatcggcaacaacttcgtctcctggtaccaacaactccccggcaccgcccccaaactcctcatctacgaaaacaacaaacgcccctccggaatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcatcgtcctc

SEQ ID NO: 56048 - RNA, 333 nt, synthetic construct
  misc_feature 1..333: note = derived and/or modified sequence opt11 from anti-HIV_059-035082_VR-Chain
  source 1..333: mol_type = other RNA
caatccgtcctcacccaacccccctccgtctccgcagcccccggccaaaaagtcaccatctcctgctccggctccacctccaacatcggcaaatccttcgtctcatggtaccaacaactccccggcaccgcccccaaactcctcatctacgacaacaaccgccgcccctccggcacccccgaccgattctccggctccaaatccggcacatccgccaccctcgccatcaccggcctccaaaccggcgacgaagccgactactactgcggcacctggggcggctccctctccaccggcggcgtcatcggcaccggcaccaaagtcaccgtcctc

SEQ ID NO: 56049 - RNA, 333 nt, synthetic construct
  misc_feature 1..333: note = derived and/or modified sequence opt11 from anti-HIV_059-029204_VR-Chain
  source 1..333: mol_type = other RNA
caatccgtcctcacccaacccccctcagtctccgccgcccccggacaaaaagtcaccatctcctgctccggctcaacctccaacatcggcaaaatcctcgtctcctggtaccaacaactccccggcaccgcccccaaaccctccatctacgacaacaaccgccgcccctccggcacccccgaccgcttctccggctccaaatccggcacctccgccaccctcgccatcaccggcctccaaaccggcgacgaagccgactactactgcggcacctgggacggctccctctccaccggcggcgtcatcggcaccggcaccaaagtcaccgtcccc

SEQ ID NO: 56050 - RNA, 324 nt, synthetic construct
  misc_feature 1..324: note = derived and/or modified sequence opt11 from anti-HIV_059-025235_VR-Chain
  source 1..324: mol_type = other RNA
caatccgtcctcacccaacccccctccgtctccggcgcccccggccaaaaaatcaccatctcctgctccggctccacctccaacatcggcaaatcctacgtctcctggtaccaacaactccccggcaccgcccccaaactcctcatctacgaaaacaaccgccgcccctcaggcacccccgaccgcttctccggctccaaatccggcacctcagccaccctcgccatcaccggcctacaaaccggcgacgaagccgactactactgcggcacctgggacggctccggcggcgtcatcggcaccggcaccaaagtcaccgtcctc

SEQ ID NO: 56051 - RNA, 333 nt, synthetic construct
  misc_feature 1..333: note = derived and/or modified sequence opt11 from anti-HIV_059-015192_VR-Chain
  source 1..333: mol_type = other RNA
caatccgtcctcacccaacccccctccgtctccgccgcccccggccaaaaagtcaccatctcctgctccggctcctcctccaccatcggcgacaaatacgtctcatggtaccaactcctccccggcaccgcccccaaactcctcatctacaaaaacaacaaacgcccctccggcatccccgaccgcttctccggctccaaatccggcacctccgccaccctcggcatcaccggcctccaaaccggcgacgaagccgactactactgcggcacctgggacacctccctctccgtcggcggagtcttcggcaccggcaccaaagtcaccgtcctc

SEQ ID NO: 56052 - RNA, 333 nt, synthetic construct
  misc_feature 1..333: note = derived and/or modified sequence opt11 from anti-HIV_059-007060_VR-Chain
  source 1..333: mol_type = other RNA
caatccgtcctcacccaacccccctccgtctccgccgcccccggccaaaaagtcaccatctcctgctccggctcctcctccaacatcggcaacaaatacgtctcctggtaccaacaactccccggcaccgcccccaaactcctcatctacgaaaacaaaaaacgcccctccggcatccccgaccgcttctccggctccaaatccggcacctccgccaccctcggcatcaccggactccaaaccggcgacgaagccgactacttctgcggcacctgggacacctccctctcaggcggcggcgtattcggctccggcaccaaagtcaccgtcctc

SEQ ID NO: 56053 - RNA, 324 nt, synthetic construct
  misc_feature 1..324: note = derived and/or modified sequence opt11 from anti-HIV_059-006953_VR-Chain
  source 1..324: mol_type = other RNA
cagagcgtgctcacgcaaccgccctcggtctcggccgcgcccgggcaaaaggtcacgatatcgtgctcgggctcgagctcgaacataggcgtgagctggtaccagcaagtgcccgggaccgcgcccaagctcttgatctatgacaatgacaagcgcccgaccgggatcccggacaggttctcgggctcgaaatcgggcacgagcgcgatcttggccataaccgggctccagaccggggacgagggcgattactattgcgggacctgggaaacgagcctgagcgggggcggggtctttggcacgggcacgaaagtgaccgtgctc

SEQ ID NO: 56054 - RNA, 333 nt, synthetic construct
  misc_feature 1..333: note = derived and/or modified sequence opt11 from anti-HIV_059-005953_VR-Chain
  source 1..333: mol_type = other RNA
cactccgtcctcacccaacccccctccgtctccgccgcccccggccaaaaagtcaccatctcctgctccggcacctcctcaaacatcggcaaaaactacgtctcctggtaccaacaactccccggcaccgcccccaaactcctcatctacgaaaacaaccgccgcccctccggcacccccgaccgcttctccggctccaaatccggcacctccgccaccctcgccatcaccggcctccaaaccggcgacgaagccgactactactgcggcacctgggacacctccctctccaccggcggcgtcttcggcaccggcaccaaagtcaccgtcctc

SEQ ID NO: 56055 - RNA, 324 nt, synthetic construct
  misc_feature 1..324: note = derived and/or modified sequence opt11 from anti-HIV_059-003725_VR-Chain
  source 1..324: mol_type = other RNA
caatccgtcctcacccaacccccatccgtctccgccgcccccggccaaaaactcaccatctcctgctccggctccacctccaaaatcggcaacaactacgtctcctggtaccaacacctccccggcaccgcccccaaactcctcgtctacgaaaacaacaaacgcccctccggcatccccgaccgcttctccggctccaaatccggcacctccgccaccctcgccatcaccggcctccaaaccggcgacgaagccgactactactgcggcacctgggacggccgcctctccgtcatcggcaccggcaccaaagtcaccgtccta

SEQ ID NO: 56056 - RNA, 333 nt, synthetic construct
  misc_feature 1..333: note = derived and/or modified sequence opt11 from anti-HIV_059-002618_VR-Chain
  source 1..333: mol_type = other RNA
caactagtcctcacccaacccccctccgtctccgccgcccccggccaaaaagtcaccatctcctgctccggctcctcctccaacatcggcaacaacttcgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacacccgcctctccgccggcggcgtcttcggcaccggcaccaaagtcaccgtcctc

SEQ ID NO: 56057 - RNA, 324 nt, synthetic construct
  misc_feature 1..324: note = derived and/or modified sequence opt11 from anti-HIV_059-001522_VR-Chain
  source 1..324: mol_type = other RNA
caatccgtcctcacccaacccccctccgtctccgccgcccccggccaaaaagtcaccatctcctgctccggctccaactccaacatcggcaacaactacgtctcatggtaccaacaactccccggcacagcccccaaactcctcatctacgaaaacaacaaacgcccctccggcatccccgaccgcttctccggctccaaatccggcacctccgccaccctcgccatcaccggcctccaaaccggcgacgaagccgactactactgcggcacctgggacggccgcctctccgtcatcggcgccggcaccaaagtcatcgtcgtc

SEQ ID NO: 56058 - RNA, 333 nt, synthetic construct
  misc_feature 1..333: note = derived and/or modified sequence opt11 from anti-HIV_059-000731_VR-Chain
  source 1..333: mol_type = other RNA
caatccgtcctcacccaacccccctccgtctccgccgcccccggccaaaaagtcaccatctcctgctccggctccacctccaacatcggcaacaaatacgtctcctggtaccaacaagtccccggcaccgcccccaaactcctcatctacgaaaacaaccgccgcccctccggcatccccgaccgcttctccggctccaaatccggcacctccgccaccctcgccatcaccggcctccaaaccggcgacgaagccgactactactgcggcacctgggacgcctccctccgcaccggcggcgtcatcggcaccggcaccaaagtcaccgtcctc

SEQ ID NO: 56059 - RNA, 333 nt, synthetic construct
  misc_feature 1..333: note = derived and/or modified sequence opt11 from anti-HIV_059-000634_VR-Chain
  source 1..333: mol_type = other RNA
caatccgtcctcacccaacccccctccgtctccgccgcccccggccaaaaagtcaccatctcctgctccggctcctcctcaaccatcggcaacaactacgtctcctggtaccaagtcgtccccggcaccgcccccaaactcctcatctacaaaatcaacgaacgcccctccggcatccccgaccgcttctccggctcaaaatccggcacctccgccaccctcggcatcaccggcctccaaaccggcgacgaagccgactactactgcggcacctgggacacctccctatccggcggcggcgtcttcggacccggcaccaaagtcaccgtcctc

SEQ ID NO: 56060 - RNA, 333 nt, synthetic construct
  misc_feature 1..333: note = derived and/or modified sequence opt11 from anti-HIV_048-250757_VR-Chain
  source 1..333: mol_type = other RNA
caatccgtcctcacccaacccccctccgtctccggcgcccccggccaacgcgtcaccatctcctgcaccggcaccacctccaacatcggctccaactacgtcgcctggtaccaacaactccccggcaccgcccccaaactcctcatctacgacaacgacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56061 - RNA, 333 nt, synthetic construct
  misc_feature 1..333: note = derived and/or modified sequence opt11 from anti-HIV_048-250716_VR-Chain
  source 1..333: mol_type = other RNA
caatccgtcctcacccaacccccctccgtctccgccgcccccggccaaaaagtcaccatctcctgctccggctcctcctccaacatcggcaacaaatacgtctcctggtaccaacaactccccggcaccgcccccaaactcctcatctacgaaaactccaaacgcccctccggcatccccgaccgcttctccggctccaaatccggcacatccgccaccctcggcatcaccggcctccaaaccggcggccaagccgactactactgcggcacctgggacacctccctctccgccggcggcgtcttcggctccggcaccaaagtcaccgtcctc

SEQ ID NO: 56062 - RNA, 333 nt, synthetic construct
  misc_feature 1..333: note = derived and/or modified sequence opt11 from anti-HIV_048-250463_VR-Chain
  source 1..333: mol_type = other RNA
caatccgtcctcacccaacccccctccgtctccgccgcccccggccaaaaagtcaccatctcctgctccggctcccgctccaacaacggcaacaactacgtctcctggtaccaacaactccccggcaccgcccccaaactcctcatctacgaaaacaacaaacgcccctccggcatccccgaccgcttctccggctccaaatccggcacctccgccaccctcgccatcaccggcctccaaaccggcgacgaagccgactactactgcggcacctgggactcctccctctccggcggcggcgtcatcggcaccggcaccaaactcaccgtcctc

SEQ ID NO: 56063 - RNA, 333 nt, synthetic construct
  misc_feature 1..333: note = derived and/or modified sequence opt11 from anti-HIV_048-248153_VR-Chain
  source 1..333: mol_type = other RNA
caatcagccctaacccaacccgcaagcgtaagcgccagcttcggccaaagcataaccataagctgcaccggagcagcaagcgacgtcggatacaactacgtaagctggtaccaacaactacccggaaccacacccaaactcctaatctaccgcaacaaccaacgcccaagcggaatcccagacagattctcaggctcaaaatcgggcacaagcgcaaccctaggcataaccggactccaaaccggagacgaagccgactactactgcggaacctgggacacaagcctaagcgcaggcggagtcttcggcacaggcacaaaagtaaccgtactc

SEQ ID NO: 56064 - RNA, 333 nt, synthetic construct
  misc_feature 1..333: note = derived and/or modified sequence opt11 from anti-HIV_048-247532_VR-Chain
  source 1..333: mol_type = other RNA
caatccgtcctcacccaacccccctccgtctccgccgcccccggccaacaagtcaccatctcatgctccggcaccacctccaacatcggcaccaactacgtctcctggtaccaacaaatgccccccgccgcccccaaactcctcatctacgacaacaaaaaacgcccctccgacatccccgaccgcttctccggctccaaatccggcacctccgccaccctcggcatcaccggcctccaaaccggcgacgaagccgactactactgcggcacctgggacacctccctctcagccggcggcgtcttcggcaccggcaccaaagtcaccgtcctc

SEQ ID NO: 56065 - RNA, 333 nt, synthetic construct
  misc_feature 1..333: note = derived and/or modified sequence opt11 from anti-HIV_048-245846_VR-Chain
  source 1..333: mol_type = other RNA
caatccgtcctcacccaacccccctcagtctccgccacccccggccaacgcgtcaccatctcctgcaccggctcatcctccaacatcggcggctacgacgtctcctggtaccaagtcctccccggcaccgcccccaaactcctcatctacgactccgacaaacgcccctccggcatccccgaccgcttctcaggctcccaatccggcacctccgccacactcggcatcaccggcctccaaaccggcgacgaagccgactactactgcggcacctgggacacctccctctccggcggcggcgtcttcggcaccggcaccaaagtcaccgtcctc

SEQ ID NO: 56066 - RNA, 333 nt, synthetic construct
  misc_feature 1..333: note = derived and/or modified sequence opt11 from anti-HIV_048-244016_VR-Chain
  source 1..333: mol_type = other RNA
caatccgtcctcacccaacccccctccgtctccggcgcccccggccaacgcgtcaccatctcctgcaccggctcctcctccaacatcggcggctacgacgtccactggtaccaacaactccccggcaccgcccccaaactcctcatctacaaaaacgacaaacgcccctccggcatccccgaccgcttctccggctccaaatccggaacctccgccatcctcggcatcaccggcctccaaaccggcgacgaagccgactactactgcggcgcctgggacacctccctctcagccggcggcgtcttcggcaccggcaccaaagtcaccgtcctc

SEQ ID NO: 56067 - RNA, 333 nt, synthetic construct
  misc_feature 1..333: note = derived and/or modified sequence opt11 from anti-HIV_048-243682_VR-Chain
  source 1..333: mol_type = other RNA
caatccctcctcacccaaccaccctccgtctccgccgcccccggccaaaaagtcaccatctcctgcaccggctcctcctccaacatcggcggctacgacgtccactggtaccaacaactccccggcaccgcccccaaactcctcatctacgaaaacaacaaacgcccctccggcatccccgaccgcttctccggctccaaatccggcacctccgccaccctcggcataaccggcctccaaaccggcgacgaagccgactactactgcggcacctgggactcctccctatccgccggcggcgtcttcggcaccggcaccaaagtcaccgtcctc

SEQ ID NO: 56068 - RNA, 333 nt, synthetic construct
  misc_feature 1..333: note = derived and/or modified sequence opt11 from anti-HIV_048-243588_VR-Chain
  source 1..333: mol_type = other RNA
caatccctcctcacccaacccccctccgtctccgccccccccggccaaatggtctccatctcctgctccggctcctcccacaacatcggcgacaactacgtctcctggtaccaacacctccccggcaccgcccccaaactcctcatctacgacaacaactcccgcccctccggcatccccgaccgcttctcaggctccaaatccggcacctccgccaccctcggcatcaccggcctccaaaccggcgacgaagccgactactactgcggcacctgggacacctccctctccggcggcggcgtcttcggcaccggcaccaaagtcaccgtcctc

SEQ ID NO: 56069 - RNA, 333 nt, synthetic construct
  misc_feature 1..333: note = derived and/or modified sequence opt11 from anti-HIV_048-241775_VR-Chain
  source 1..333: mol_type = other RNA
caatccgtcctcgcccaaccaccctccgtctccggcgcccccggccaacgcgtcacaatctcctgcaccggctcctcctccaacatcggcgaatacgacgtccactggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcacagtcctc

SEQ ID NO: 56070 - RNA, 333 nt, synthetic construct
  misc_feature 1..333: note = derived and/or modified sequence opt11 from anti-HIV_048-237996_VR-Chain
  source 1..333: mol_type = other RNA
caatccgtcctcacccaacccccctcagtctccggcgcccccggccaacgcgtcaccatctcctgcaccggctcctcatccaacatcggcggctacgacgtccactggtaccgccaactccccggcaccgcccccaaactcctaatctacgacaccgtcaaacgcccctccggcatccccgaccgcttctccggctcaaaatccggcacctccgccaccctcggcatcaccggcctccaaaccggcgacgaagccgactactactgcggcacctgggacacatccctctccgccggcggagtcttcggcaccggcaccaaagtcaccgtcctc

SEQ ID NO: 56071 - RNA, 330 nt, synthetic construct
  misc_feature 1..330: note = derived and/or modified sequence opt11 from anti-HIV_048-237730_VR-Chain
  source 1..330: mol_type = other RNA
tccgtcctcacccaacccccctccgtctccggcgcccccggccaacgcgtcaccatctcctgcaccggcaccaactccaacttcggctccaactacgcccactggtaccaacaagtccccggcaccgcccccaaactcctcatctactccaacaacgcccgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56072 - RNA, 333 nt, synthetic construct
  misc_feature 1..333: note = derived and/or modified sequence opt11 from anti-HIV_048-237253_VR-Chain
  source 1..333: mol_type = other RNA
caatccgtcctcacccaacccccctccgtctccgccgcccccggccaaaaagtcaccgtctcctgctccggctcctcctccaacatcggctccaacgacgtctcctggtaccaacaattccccggcgccgcccccaaactcctcatctacaaaaacaacgaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56073 - RNA, 333 nt, synthetic construct
  misc_feature 1..333: note = derived and/or modified sequence opt11 from anti-HIV_048-234100_VR-Chain
  source 1..333: mol_type = other RNA
caatccatgctcacccaacccccctccgtctccgccgcccccggcgaaaaagtcaccatctcctgctccggctcctcctccaacatcggcaaaaccttcgtctcctggtaccaacaagtccccggcaccgcccccaaactcctcatctacaaaaacgacaaccgcccctccggcatccccgaccgcttctccggctccaaatccggcacctccgcaaccctcggcatctccggcctccaaaccggcgacgaagccgactactactgcggcacctgggacacctccctctccggcggcggcgtcttcggcaccggcaccaaagtcaccgtcctc

SEQ ID NO: 56074 - RNA, 333 nt, synthetic construct
  misc_feature 1..333: note = derived and/or modified sequence opt11 from anti-HIV_048-230882_VR-Chain
  source 1..333: mol_type = other RNA
caatccgtcctcacccaacccccctccgtctccgccgcccccggccaaaaagtcaccatctcctgctccggcaactcctccaacatcggctccaacttcgtatcctggtaccaacaactccccggcaccgcccccaaactcctcatctacgaaaacaacaaacgcccctccggcatccccgaccgcttctcaggctccaaatccggcacctccgccaccctcggcatcaccggcctccaaaccggcgacgaagccgactactactgcggcacctgggacacctccctctcccccggcggcgtcttcggcaccggcaccaaagtcaccgtcctc

SEQ ID NO: 56075 - RNA, 333 nt, synthetic construct
  misc_feature 1..333: note = derived and/or modified sequence opt11 from anti-HIV_048-229473_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaattccccggcaccgcccccaaactcctcatctacgaaaacaacaaacgcccctcaggcatccccgaccgcttctcaggctccaaatcaggcaccaccgccaccctcgccatcacccgcctccaaaccggcgacgaagccgactactactgcggcacctggggcggctccctctccgccggcggcgtcttcggcaccggcaccaaagtcaccgtcctc

SEQ ID NO: 56076 - RNA, 333 nt, synthetic construct
  misc_feature 1..333: note = derived and/or modified sequence opt11 from anti-HIV_048-228238_VR-Chain
  source 1..333: mol_type = other RNA
caatccgtcctcacccaaccaccctccgtctccgccgcccccggccaaaaagtcaccatctcctgctccggctcctcctccaacatcggcatcaactacgtctcctggtaccaacaactccccggcaccgcccccaaactcctcatctacgacaacaccaaacgcccccaaggcatccccgaccgcttctccggctccaaatccggcacctccgccaccctcgccatcaccggcctacaaaccggcgacgaagccgactactactgcggcacctgggacggctccctctccaccggcggcgtcatcggcaccggcaccaaagtcaccgtccta

SEQ ID NO: 56077 - RNA, 333 nt, synthetic construct
  misc_feature 1..333: note = derived and/or modified sequence opt11 from anti-HIV_048-228027_VR-Chain
  source 1..333: mol_type = other RNA
caatccctcctaacccaatcaccctccgcctccggcccccccggccaacgcgtcaccatctcctgctcaggctccaactccaacatcggctccaacaccgtcaactggtaccaccacctccccggcgccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56078 - RNA, 333 nt, synthetic construct
  misc_feature 1..333: note = derived and/or modified sequence opt11 from anti-HIV_048-227795_VR-Chain
  source 1..333: mol_type = other RNA
caatcggtcctgacccagcccccgagcgtgagcgcggccccgggccagaaagtgaccataagctgtagcgggagctcaagcaatatcgagagcaggagcgtgcactggtaccagcaaaagcccgggcaagcgcccgtgctcgtgatctattacgatagcgatcgcccgagcgggatcccggacaggttctcgggctcaaaatcgggcacggccgcgaccttgggcataaccgggctccagaccggggacgaggccgattactattgcgggacctgggacacgagcttgagcgcgggcggggtctttggcacgggcacgaaagtgaccgtgctc

SEQ ID NO: 56079 - RNA, 333 nt, synthetic construct
  misc_feature 1..333: note = derived and/or modified sequence opt11 from anti-HIV_048-227770_VR-Chain
  source 1..333: mol_type = other RNA
caatccgtcctcacccaacccccctccgtctccggcgcccccggccaacgcgtcaccatctcctgcaccggctcctcctccaacatcggcccccgcgacgtccactggtaccaacaactccccggcaccgtccccaaactcctcatctacgacacctacacccgcccctcaggcatccccgaccgcttctccggctccaaatccggcgcctccgccaccctcgacatcacaggcctccaaaccggcgacgaagccgactactactgcggcatctgggacacctccctctccgccggcggcgtcttcggcaccggcaccaaagtcaccgtcctc

SEQ ID NO: 56080 - RNA, 333 nt, synthetic construct
  misc_feature 1..333: note = derived and/or modified sequence opt11 from anti-HIV_048-225298_VR-Chain
  source 1..333: mol_type = other RNA
caatccgccctcacccaaccccgctccgtctccggctcccccggccaatccgtcaccatctcatgcaccggcacctccaacgacgtcggatacgactacgtctcctggtaccaacaactacccggcaccgcccccaaactcctcatctacgacatcaacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56081 - RNA, 327 nt, synthetic construct
  misc_feature 1..327: note = derived and/or modified sequence opt11 from anti-HIV_048-225090_VR-Chain
  source 1..327: mol_type = other RNA
gaactcacccaacccccctccgtctccggcgcccccggccaacgcgtaaccatctcctgcaccggctcctcctccaacatcggcggctacgacgtccactggtaccaacaactccccggcaccgcccccaaactcctcatctacgacaacaacaaacgcccctccggcatccccgaccgcttctccggctccaaatccggcacctccgccaccctcggcatcaccggcctccaaaccggcgacgaagccgactactactgcggcacctgggacacatccctctccaccggcggcgtcttcggcaccggcaccaaagtcaccgtcctc

SEQ ID NO: 56082 - RNA, 333 nt, synthetic construct
  misc_feature 1..333: note = derived and/or modified sequence opt11 from anti-HIV_048-224187_VR-Chain
  source 1..333: mol_type = other RNA
caatccgtcctcacccaacccccctccgcctccggcacccccggccaacgcgtcaccatctcctgctccggctcctccgccaacatcggcaccaactacgtcttctggtaccaacacctccccggcaccaccccccgcctcctcatcttccgcaacaacgaacgcccctccggcatccccgaccgattctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56083 - RNA, 333 nt, synthetic construct
  misc_feature 1..333: note = derived and/or modified sequence opt11 from anti-HIV_048-223055_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaattccccggcaccgcccccaaagtcctcatctacggcaactccaaacgcccctccggcatccccgaccgcttctccggctccaaatcaggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56084 - RNA, 333 nt, synthetic construct
  misc_feature 1..333: note = derived and/or modified sequence opt11 from anti-HIV_048-222711_VR-Chain
  source 1..333: mol_type = other RNA
caacccgtcctcacccaacccccctccgtctccggcgcccccggccaacgcgtcaccatctcctgcaccggctcctcatccaacatcggcggctacgacgtccactggtaccaacaagtccccggcaccgcccccaaactcctcatcttcgaaaacaaccgccgcccctccggcatccccgaccgcttctccggctccaaatcaggcacctccgccaccctcgccatcaccggcctccaaaccggcgacgaagccgactactactgcggcacctgggacggctccctctccaccggcggcgtcatcggcaccggcaccaaagtcaccgtcctc

SEQ ID NO: 56085 - RNA, 333 nt, synthetic construct
  misc_feature 1..333: note = derived and/or modified sequence opt11 from anti-HIV_048-221209_VR-Chain
  source 1..333: mol_type = other RNA
caatcagtcctaacccaacccccatccgtctccggcgcccccggccaacgcgtcaccatctcctgcaccggcaactcctccaacatcggcgactacgacgtccactggtaccaacaagtcgccggcaccgcccccaaactcctcatcttcaaaaacaacgaacgcccctccggcatccccgaccgcttctccggctccaaatccggcacctccgccacactcggcatcaccggcctccaaaccggcgacgaagccgactactactgcggcacctgggacacctccctctccgccggcggcgtcttcggctccggcaccaaagtcaccgtcctc

SEQ ID NO: 56086 - RNA, 333 nt, synthetic construct
  misc_feature 1..333: note = derived and/or modified sequence opt11 from anti-HIV_048-220629_VR-Chain
  source 1..333: mol_type = other RNA
caatcagccctcacccaacccgcctccgtctccggctccctcggccaatccatcaccatctcctgcaccggcacctcccgcgacgtcggctactcctacgtctcctggtaccaacacctccccggcaccgcccccaaactcctcatctacgaaaacaacaaacgcccctccggcatccccgaccgattctccggctcaaaatcaggcacctccgccaccctcggcatcaccggactccaaaccggcgacgaagccgactactactgcggcacctgggactcctccctctccgccggcggcgtcttcggcaccggcaccaaagtcaccgtccta

SEQ ID NO: 56087 - RNA, 333 nt, synthetic construct
  misc_feature 1..333: note = derived and/or modified sequence opt11 from anti-HIV_048-219430_VR-Chain
  source 1..333: mol_type = other RNA
caatccgtcctcacccaacccccctccgtctccgccgcccccggccaaatggtcaccatctcctgctccggctccacatccaacatcggcatcaactacgtatcctggtaccaacacgtccccggcaccgcccccaaactcctcatctacgacaacaacaaacgcccctccggcatccccgaccgcttctccggctccaaatccggcacctccgccaccctcggcatcaccggcctccacaccggcgacgaagccgactactactgcggcacctgggacacctccctatccgccggcggcgtcttcggcacaggcaccaaagtcaccgtcctc

SEQ ID NO: 56088 - RNA, 333 nt, synthetic construct
  misc_feature 1..333: note = derived and/or modified sequence opt11 from anti-HIV_048-216250_VR-Chain
  source 1..333: mol_type = other RNA
caatcagtcctaacccagcccccaagcgtaagcgcagccccaggccaaaaagtgaccataagctgcaccgggacaacaagcgacttcgggtacaactgcgtaagctggtaccagcaacaccccggacgcgcacccaaggtcataatctcaggcgtaaacaagcgaccaagcggaatcccggacaggttctcgggctcgaaatcaggcacaagcgcgaccctgggcataaccggactccagaccggggacgaggccgactactactgcggaacctgggactcaagcctaagcgcaggcggggtcttcggcacaggcacaaaagtgaccgtactc

SEQ ID NO: 56089 - RNA, 321 nt, synthetic construct
  misc_feature 1..321: note = derived and/or modified sequence opt11 from anti-HIV_048-216133_VR-Chain
  source 1..321: mol_type = other RNA
acccaacccccctccctctccgccacccccggccaacgcgtctccatctcctgctccggcggcggctccaacatcggcaacaacgacgtcttctggttccaacaattccccggcgccggcccccgcctcctcatctacgacaaccacaaacgccactacggcacccccgaccgcttctccggctccaaatccggcacctccgccaccctcgccatcaccggcctccaaaccggcgacgaagccgcctactactgcggcacctgggacggctccctatcaaccggcggcgtcatcggcaccggcaccaaagtcaccgtcctc

SEQ ID NO: 56090 - RNA, 333 nt, synthetic construct
  misc_feature 1..333: note = derived and/or modified sequence opt11 from anti-HIV_048-214886_VR-Chain
  source 1..333: mol_type = other RNA
caatccgccctcacccaaccacgctcagtctccggctcccccggccaatccgtcaccatctcctgcaccggcacctcctccgacgtcggctacaactacgtctcctggtaccaacaccaccccggcaccgcccccaaactcctcatctacaaaaacaacaaccgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56091 - RNA, 333 nt, synthetic construct
  misc_feature 1..333: note = derived and/or modified sequence opt11 from anti-HIV_048-214709_VR-Chain
  source 1..333: mol_type = other RNA
caatccgtcctcacccaaccaccctccgtctccgccgcccccggccaaaaagtcaccatctcctgctccggctcctcctccaacatcggcaacaactacgtctcctggtaccaacaactccccggcaccgcccccaaactcctcatctacgaaaacgaccgccgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56092 - RNA, 333 nt, synthetic construct
  misc_feature 1..333: note = derived and/or modified sequence opt11 from anti-HIV_048-214001_VR-Chain
  source 1..333: mol_type = other RNA
caatcagtcctaacccaacccccaagcgtaagcggagccccaggccaaaccgtaaccataagctgcagcggaagcaacagcaacatcggaaaccacgacgtacactggtaccaacacgtacccggaaccgcacccaaactcctaatctacgacaacaacaaacgcccaagcggaatcccagacagattctcaggctcaaaatcaggcacaagcgcaaccctaggcataaccggactccaaaccggagacgaagccgaatactactgcgcaacctgggacgcaagcctgagcggaggcggagtcttccgcacaggcacaaaagtaaccgtactc

SEQ ID NO: 56093 - RNA, 333 nt, synthetic construct
  misc_feature 1..333: note = derived and/or modified sequence opt11 from anti-HIV_048-213230_VR-Chain
  source 1..333: mol_type = other RNA
caatccgtcctcacccaacccccctccatgtccgccgcccccggccaaaaagtcaccatctcctgctccggctcctccaacaacatcggcaaaaacgtcgtctcctggtaccaacaactccccggcaccgcccccaaagtcctcatctacgaaaacaacaaacgcctctccggcatccccgaccgcttctccggctccaaatccggcacctccgccaccctcgtcatcaccggcctccaaaccggcgacgaagccgactactactgcggcacctgggactcctccctctccgccggcggcgtcttcggcaccggcaccaaagtcaccgtcctc

SEQ ID NO: 56094 - RNA, 333 nt, synthetic construct
  misc_feature 1..333: note = derived and/or modified sequence opt11 from anti-HIV_048-212574_VR-Chain
  source 1..333: mol_type = other RNA
caatccgtcctcacccaacccccctccgtctccgccgcccccggccaacgcgtaaccgtctcctgctccggctccacctccaacatcgaatccaactacgtctcctggtaccaacaagtccccggaaccgcccccaaactcctcatctacgaaaacaacaaacgcccctccggcatccccgaccgcttctccggctccaaatccggcacctccgccaccctcgccatcaccggcctccaaaccggcgacgaagccgcctactactgcggcacctgggacggctcactctccaccggcggcgtcatcggcaccggcaccaaagtcaccgtcctc

SEQ ID NO: 56095 - RNA, 333 nt, synthetic construct
  misc_feature 1..333: note = derived and/or modified sequence opt11 from anti-HIV_048-212207_VR-Chain
  source 1..333: mol_type = other RNA
caatccgtcctcacccaacccccctccctctccgccgcccccggccaaaaagtcaccatctcctgctccggcggctcctccaacatcggcaacaactacgtctcctggtaccaacacctccccggcaccgcccccaaactcctcatctacgacaactacaaacgcccctccggcatccccgaccgattctccggctccaaatccggcacctccgccaccctcgacatcaccggcctccaaaccggcgacgaagccgactactactgcggcacctgggacacctcactctccgccggcggcgtcttcggcaccggcaccaaagtcaccgtcctc

SEQ ID NO: 56096 - RNA, 333 nt, synthetic construct
  misc_feature 1..333: note = derived and/or modified sequence opt11 from anti-HIV_048-209146_VR-Chain
  source 1..333: mol_type = other RNA
caatccgtcctcacccaacccccctccgtctccggcgcccccggccaaaaaatcaccgtctcctgcaccggcaccacctccaacatcggcccccacgacgtccactggtaccaactcgtccccggacgcccccccaaactcctcatcttccacaacaacatccgcccatccggcatccccgaccgcttctccggctccaaatccggcatgtccgccaccctaggcatcaccggcctccaaaccggcgacgaagccgactactactgcggcacctgggactcctccctctccgccggcggcgtcttcggcaccggcaccaaagtcaccgtcctc

SEQ ID NO: 56097 - RNA, 333 nt, synthetic construct
  misc_feature 1..333: note = derived and/or modified sequence opt11 from anti-HIV_048-208206_VR-Chain
  source 1..333: mol_type = other RNA
caatccgtcctcacccaacccccctccgtctccgccgcccccggccaaaaagtcaccatctcctgctccggctcctcctccaacatcggctccaactacgtctcctggtaccaacaattccccggcaccgccccccgcctcctcatctacgaaaacgacaaacgcccctccgccatccccgaccgcttctccggctccaaatccggcacctccgccaccctcggcatcaccggcctccacaccggcgacgaagccgactactactgcggcacctgggacggctcactctccaccggcggcgtcatcggcaccggcaccaaagtcaccgtcctc

SEQ ID NO: 56098 - RNA, 333 nt, synthetic construct
  misc_feature 1..333: note = derived and/or modified sequence opt11 from anti-HIV_048-208194_VR-Chain
  source 1..333: mol_type = other RNA
caatccgccctcacccaacccccctccgcctccggctcacccggccaatccgtcaccatctcctgcaccggcacctcctccgacatcggctacaaatacgtctcctggtaccaactcctccccggcaccccccccaaactcctcatcttcaaaaacaacgaacgcccctccggcatccccgaccgcttctccggctccaaatccggcacctccgccaccctcggcatcaccggcctccaaaccggcgacgaagccgactactactgcggcgcctgggacacctccctctccgccggcggcgtcttcggcaccggcaccaaagtcaccgtcctc

SEQ ID NO: 56099 - RNA, 333 nt, synthetic construct
  misc_feature 1..333: note = derived and/or modified sequence opt11 from anti-HIV_048-207744_VR-Chain
  source 1..333: mol_type = other RNA
caatccgccctcacccaacccgcctccgtctccgcctccttcggccaatccatcaccatctcctgcaccggcgccgcctccacaatcggcaacaacctcgtctcctggtaccgcctcctccccggcacagcccccaaactcctcatctacaaaaacgacaaccgcccctccggcatccccgaccgcttctccggctccaaatccggcacctccgccaccctcggcatctccggcctccaaaccggcgacgaagccgactactactgcggcacctgggacacctccctctccggcggcggcgtcttcggcaccggcaccaaagtcaccgtcctc

SEQ ID NO: 56100 - RNA, 333 nt, synthetic construct
  misc_feature 1..333: note = derived and/or modified sequence opt11 from anti-HIV_048-206501_VR-Chain
  source 1..333: mol_type = other RNA
caatccgtcctcacccaacccccctccgtttccggcgcccccggccaacgcgtcaccatctcctgctccggctcctcctccaacatcggcaacaacgccgtcaactggtaccaacaactccccggcaaagcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56101 - RNA, 333 nt, synthetic construct
  misc_feature 1..333: note = derived and/or modified sequence opt11 from anti-HIV_048-204221_VR-Chain
  source 1..333: mol_type = other RNA
caatccgtcctcacccaaccaccctccgcctccggcacccccggccaacgcgtcaccatctcctgcttcggctcctcctccaacatcgcctcctccgccgtcaactggtaccaacaactccccggcaccgcccccaaactcctcatctacaaaaacgacaaacgcccctccggcatccccgaccgcttctccggctccaaatccggcacctccgccaccctcggcatcaccggcctccaaaccggagacgaagccgactactactgcggcacctgggacacctccctctccgccggcggcgtcttcggcaccggcaccaaagtcaccgtcctc

SEQ ID NO: 56102 - RNA, 333 nt, synthetic construct
  misc_feature 1..333: note = derived and/or modified sequence opt11 from anti-HIV_048-204015_VR-Chain
  source 1..333: mol_type = other RNA
caatccgtcctcacccaacccccctccgcctccggcacccccggccaacgcgtcaccatctcctgctccggctcctcctccaacatcggctccaaatacgtctactggtaccaacaactccccggcaccgcccccaaactcctcatctacaaaaacgacaaccgcccctccggcatccccgaccgattctcaggctccaaatccggcacctccgccaccctcggcatctccggcctccaaaccggcgacgaagccgactactactgcggcacctgggacacctccctctccggcggcggcgtcttcggcaccggcaccaaagtcaccgtcctc

SEQ ID NO: 56103 - RNA, 333 nt, synthetic construct
  misc_feature 1..333: note = derived and/or modified sequence opt11 from anti-HIV_048-201240_VR-Chain
  source 1..333: mol_type = other RNA
caatccgtcctcacccaacccccctccgtctccgccgcccccggccaaaaagtcaccatctcctgctccggctcctcctccaacatcggcaacaactacgtcgcctggtaccaacaactccccggcaccgcccccaaactcctcatcaaagaaaactcccaacgcccctcaggcatccccgaccgcttctccggctccaaatccggcacctccgccaccctcgccatcaccggcctccaaaccggcgacgaagccgactactactgcggcacctgggacacctccctctccaccggcggcgtcttcggcaccggcaccaaagtcaccgtcctc

SEQ ID NO: 56104 - RNA, 333 nt, synthetic construct
  misc_feature 1..333: note = derived and/or modified sequence opt11 from anti-HIV_048-200455_VR-Chain
  source 1..333: mol_type = other RNA
caatccgccctcacccaacccgcctccgtctccggctcccccggccaatccatcaccatctcctgcaccggcacctcctccgacgtcggctacaactacgtctcctggtaccaagtcctccccggcaccgcccccaaactcctcatctacaaaaacaccgaacgcccctccggcatccccgaccgcttctccggctccaaatccggcacctcagccaccctcgacatcaccggcctccaaaccggcgacgaagccgactactactgcggcacctgggacacctccctctccgccggcggcgtcttcggcaccggcaccaaagtcacagtcctc

SEQ ID NO: 56105 - RNA, 333 nt, synthetic construct
  misc_feature 1..333: note = derived and/or modified sequence opt11 from anti-HIV_048-200319_VR-Chain
  source 1..333: mol_type = other RNA
caatccgtcgtcacccaacccccctccgcctccggcacccccggccaacgagtcaccatctcctgctccggctcctcctccaacatcggctccaaatacgtctactggtaccaccaacaccccggcaccgcccccaaactcctcatctacgacaacaacaaccgcccctccggcatccccgaccgcttctccggctccaaatccggcacctccgccaccctcggcatcaccggcctccaaaccggcgacgaagccgactactactgcggcacctgggacacctccctctcccgcggcggcgtcttcggcaccggcaccaaagtcaccgtcctc

SEQ ID NO: 56106 - RNA, 333 nt, synthetic construct
  misc_feature 1..333: note = derived and/or modified sequence opt11 from anti-HIV_048-197896_VR-Chain
  source 1..333: mol_type = other RNA
caatccgtcctcacccaacccccctccgtctccgcagcccccggccaaaaagtcaccatctcctgctccggcgcctcctacaacatcggcaaaaactccgtctcctggtaccaacaactacccggcaccccccccaaactcctcatcttcaaaaacaacgaacgcccctcaggcatccccgaccgcttctccggctccaaatccggcacctccgccaccctcggcatcaccggcctccaaaccggcgacgaagccgactactactgcgccacctgggacacctccctctccgccggcggcgtcttcggcaccggcaccaaagtcaccgtcctc

SEQ ID NO: 56107 - RNA, 333 nt, synthetic construct
  misc_feature 1..333: note = derived and/or modified sequence opt11 from anti-HIV_048-193813_VR-Chain
  source 1..333: mol_type = other RNA
caatccgtcctaacccaatccccctccgtctccgccgcccccggccaaaaagtcaccatctcctgctccggctccaactccaacgtcggcaactactacgtctcctggtaccaacacctccccggcaccgcccccaaagtcctcatctacgaaggcaacaaacgcccctccggcgtccccgaccgcttctccggctccaaatccggcacctccgcctcactcgccatcaccggcctccaaaccggcgacgaagccgactactactgcggcacctgggacacctccctctccgccggcggcgtcttcggctccggcaccaaagtcaccgtcctc

SEQ ID NO: 56108 - RNA, 333 nt, synthetic construct
  misc_feature 1..333: note = derived and/or modified sequence opt11 from anti-HIV_048-192098_VR-Chain
  source 1..333: mol_type = other RNA
caatccgtcctcacccaacccccctccgcctccggcacccccggccaacgcgtcaccatctcctgctccggctccacctccaacatcggctccaactacgtctactggtaccaacaactccccggcaccacccccaaactactcatctacgaaaacaacaaacgcccctcaggcatcaccgaccgcttcttcggctccaaatccggcccctccgccaccctcgacatcaccggcctccaaaccggcgacgaagccgactactactgcggcacctgggacgcctccctctccgccggcggcgtcttcggcaccggcaccaaagtcaccgtcctc

SEQ ID NO: 56109 - RNA, 333 nt, synthetic construct
  misc_feature 1..333: note = derived and/or modified sequence opt11 from anti-HIV_048-191786_VR-Chain
  source 1..333: mol_type = other RNA
caatccgtcctaacccaaccaccctccgtctccgccgcccccggccaaaacgtcaacatctcctgctccggctcctcctccaacatcgaaaacaacttcgtctcctggtaccaaaaactccccggcaccgcccccaaactcctaatctacgacaacaacaaacgcccctccggcatccgcgaccgcttctcaggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56110 - RNA, 333 nt, synthetic construct
  misc_feature 1..333: note = derived and/or modified sequence opt11 from anti-HIV_048-188746_VR-Chain
  source 1..333: mol_type = other RNA
caatccgtcctcacccaacccccctccgcctccggcacccccggccaaaaagtcaccatctcctgctccggctccaactccaacatcggctccaacttcgtctcctggtaccaactcctccccggcaccacccccaaactcctcatctaccgcaacaaccaacgcccctccggcgtccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtaaccgtcctc

SEQ ID NO: 56111 - RNA, 333 nt, synthetic construct
  misc_feature 1..333: note = derived and/or modified sequence opt11 from anti-HIV_048-185937_VR-Chain
  source 1..333: mol_type = other RNA
caatccgtcctcacccaacccccctccgtctccgccgcccccggccaaaaagtcaccatctcctgctccggctcctcctccaacatcggaaacaactacgtctcctggtaccaacaactccccggcaccgcccccaaactcctcatctacgaaaacaacaaacgcccctccggcatcccctaccccatctccggctcaaaatcaggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56112 - RNA, 333 nt, synthetic construct
  misc_feature 1..333: note = derived and/or modified sequence opt11 from anti-HIV_048-184849_VR-Chain
  source 1..333: mol_type = other RNA
caatccgtcctcacccaagccccctccgcctccggcacccccggccaaaccgtcacaatctcctgctccggctcctcctccaacatcggcaccaaatacgtctactggtaccaacaactccccggcaccgcccccaaactcctcatctacaaaaacaacgaacgcccctccggcatccccgaccgcttctccggctccaaatccggcacctcagccaccctcggcatcaccggcctccaaaccggcgacgaagccgactactactgcggcacctgggacacctccctctcccccggcggcgtcttcggcaccggcaccaaagtcaccgtcctc

SEQ ID NO: 56113 - RNA, 333 nt, synthetic construct
  misc_feature 1..333: note = derived and/or modified sequence opt11 from anti-HIV_048-183089_VR-Chain
  source 1..333: mol_type = other RNA
caatccgtcctcacccaacccccctccgcctccggcaccccaggccaacgcgtcaccatctcctgctccggctcctcctccaacatcggctcctcctacgtctactggtaccaactcctccccggcaccccccccaaactcctcatcttcaaaaacaacgaacgaccctccggcatccccgaccgattctccggctccaaatccggcacctccgccaccctcggcatcaccggcctccaaaccggcgacgaagccgactactactgcggcacctgggacacctccctttccgccggcggcgtcttcggcaccggcaccaaagtcaccgtcctc

SEQ ID NO: 56114 - RNA, 333 nt, synthetic construct
  misc_feature 1..333: note = derived and/or modified sequence opt11 from anti-HIV_048-181509_VR-Chain
  source 1..333: mol_type = other RNA
caatccgtcctcacccaacccccctccgtctccggcgcccccggccaacgcgtcaccatctcctgcaccggctcctcctccaacatcggcggctacgacgtacactggtaccaccaactccccggcgccgcccccaaactcctcatctacaaaaacgacaaccgcccctccggcatccccgaccgattctccggctccaaatccggcacctccgccaccctcggcatctccggcctccaaaccggcgacgaagccgactactactgcggaacctgggacacctccctctccggcggcggcgtcttcggcaccggcaccaaagtcaccgtcctc

SEQ ID NO: 56115 - RNA, 333 nt, synthetic construct
  misc_feature 1..333: note = derived and/or modified sequence opt11 from anti-HIV_048-180990_VR-Chain
  source 1..333: mol_type = other RNA
caatccgtcctcacccaacccccctccgtctccgccgcccccggccaacgagtcaccatctcctgctccggctccacctccaacatcggcaacaactacgtctcctggtaccaacacttccccggcaaagtccccaaagtcgtcatctcagaaaccaccaaacgcccctccggcatccccgaccgcttctccggctccaaatccggcacctccgccaccctaggcatcaccggcctccaaaccggcgacgaagccgactactactgcggcacctgggactcctccctctccgccggcggcgtcttcggcaccggcaccaaagtaaccgtcctc

SEQ ID NO: 56116 - RNA, 333 nt, synthetic construct
  misc_feature 1..333: note = derived and/or modified sequence opt11 from anti-HIV_048-177532_VR-Chain
  source 1..333: mol_type = other RNA
caatccgccctcacccaacccccctccgcctccggctccctcggccaatccgtcaccatctcctgcaccggcacctcctccgacgtcggcaacaacttcgtctcctggtaccaaaaaaaacccggcaaagcccccaaactcatcgtctacgaagtcaacaaacgcccctccggaatccccgaccgcttctccggctcaaaatcaggcacctccgccaccctcggcatcaccggcctccaaaccggcgacgaagccgactactactgcggcacctgggacacctccctctcaaccggcggcgtcttcggcaccggcaccaaagtcaccgtcctc

SEQ ID NO: 56117 - RNA, 324 nt, synthetic construct
  misc_feature 1..324: note = derived and/or modified sequence opt11 from anti-HIV_048-177426_VR-Chain
  source 1..324: mol_type = other RNA
ctcacccaaccccactccgtctccgaatcccccggcaaaaccgtcaccatctcctgcaccggcacctcctccgacgtcggctacaactacgtctcctggtaccaacaccaccccggcaaagcccccaaactcctcatctacgaagtcaccaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56118 - RNA, 333 nt, synthetic construct
  misc_feature 1..333: note = derived and/or modified sequence opt11 from anti-HIV_048-177389_VR-Chain
  source 1..333: mol_type = other RNA
caatccgtcctcacccaacccccctccatgtccgccgcccccggcgaacgcgtcaccatctcctgctccggctcctcctccaacatcggcaaccaccacgtctcctggtaccaacaacgccccggcaccgcccccaaactcctcatctacgaaaacaacgaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56119 - RNA, 333 nt, synthetic construct
  misc_feature 1..333: note = derived and/or modified sequence opt11 from anti-HIV_048-174266_VR-Chain
  source 1..333: mol_type = other RNA
caatccgtcctcacccaacccccctccgtctccggcgcccccggccaacgcgtcaccatctcctgctccggctcctcctccaacatcggctcccactacgtctcctggtaccaacaagtccccggcaccgccccccgactcgtcatctacgacaccatcaaacgccactccggcatccccgaccgcttctccggctccaaatccggcacctccgcaaccctcggcatcaccggcctccaaaccggcgacgaagccgactactactgcggcacctgggacacctccctctccgccggcggcgtcttcggcaccggcaccaaagtaaccgtcctc

SEQ ID NO: 56120 - RNA, 333 nt, synthetic construct
  misc_feature 1..333: note = derived and/or modified sequence opt11 from anti-HIV_048-172847_VR-Chain
  source 1..333: mol_type = other RNA
caatcggtcttgacccagcccccgagcgtaagcgcggccccgggccagcgagtgaccgtgagctgtagcgggagcacgagcaatatcgagagcaattacgtgagctggtaccagcaagtgcccgggaccgcgcccaagctcttgatctatgaaaataacaagcgcccgagcgggatcccggacaggttctcgggctcgaaatcgggcacgagcgcgaccttgggcataaccgggctccagaccggggacgaggccgattactattgcgggacctgggacacgagcttgagcgcgggcggggtctttggcacgggaacgaaagtgaccgtgctc

SEQ ID NO: 56121 - RNA, 333 nt, synthetic construct
  misc_feature 1..333: note = derived and/or modified sequence opt11 from anti-HIV_048-172845_VR-Chain
  source 1..333: mol_type = other RNA
caatccgccctcacccaacccccctccgcctccggctcccccggccaatccgtaaccatctcatgcaccggcacctcctccgacgtcggctacaactacgtctcatggtaccaacaactccccggcaccgcccccaaactcctcatctaccgcaacaaccaacgcccctccggcgtccccgaccgcttctccggctccaaatccggcacctccgccaccctcggcatcaccggcctccaaaccggcgacgaagccgactactactgcgccacctgggacacctccctatccgccggcggcgtcttcggcaccggcaccaaagtcaccgtcctc

SEQ ID NO: 56122 - RNA, 333 nt, synthetic construct
  misc_feature 1..333: note = derived and/or modified sequence opt11 from anti-HIV_048-172363_VR-Chain
  source 1..333: mol_type = other RNA
caatccgtcctcacccaacccccctccgtctccgccgcccccggccaaaaagtcaccatctcctgctccggctccggctccaacatcggcaacacctacgtctcctggtaccaacaactccccggcaccgcccccaaactcctcatcttcgaagacaacaaacgcccctccggcatccccgaccgcttctccggctccaaatcaggcacctccgccaccctcgccatcaccggcctccaaaccggcgacgaagccgactactactgcggcacctgggactcctccctctccggcggcggcgtcatcggcaccggcaccaaactcaccgtactc

SEQ ID NO: 56123 - RNA, 333 nt, synthetic construct
  misc_feature 1..333: note = derived and/or modified sequence opt11 from anti-HIV_048-171609_VR-Chain
  source 1..333: mol_type = other RNA
caatccgtcctaacccaacccccctccgtctccgccgcccccggccaagaagtcaccatctcctgctccgcatcctcctcctccatcggcaacgacttcgtctcctggtaccaacaactccccggcaccgcccccaaactcctcatctacggcaactccaaccgcccctccggcatccccgaccgcttctcaggctccaaatccggcacctccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56124 - RNA, 333 nt, synthetic construct
  misc_feature 1..333: note = derived and/or modified sequence opt11 from anti-HIV_048-170705_VR-Chain
  source 1..333: mol_type = other RNA
caatcagtcctcacccaacccccctccgtctccgccgcccccggccaaatggtcaccatctcctgctcaggctccacctccaacatcggcatcaactacgtctcctggtaccaacacgtccccggcaccgcccccaaactcctcatctacgaaaacgtcgaacgccgctccggcatccccgaccgcttctccgcctccaaatcagccacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56125 - RNA, 333 nt, synthetic construct
  misc_feature 1..333: note = derived and/or modified sequence opt11 from anti-HIV_048-168381_VR-Chain
  source 1..333: mol_type = other RNA
caatccgccctcacccaacccgcctccgtctccggatcccccggccaatccatcaccatctcctgcaccggcacctcctccaacatcggctccaactacgtctcctggtaccaacaactccccggcaccgcccccaaactcctcatctacgaaaacaaccaacgcccctccggcatccccgaccgcttctcaggctccaaatccggcacctccgccaccctcggcatcaccggcctccaaaccggagacgaagccgactactactgcggcacctgggacacctccctctccgccggcggcgtcttcggctccggcaccaaagtcaccgtcctc

SEQ ID NO: 56126 - RNA, 333 nt, synthetic construct
  misc_feature 1..333: note = derived and/or modified sequence opt11 from anti-HIV_048-166619_VR-Chain
  source 1..333: mol_type = other RNA
caatccgtcctaacccaacccccctccgtctccggcgcccccggccaacgcgtcaccatctcctgcaccggctcctcctccaacatcggcggctaccacacccactggtaccaacaactccccggcaccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56127 - RNA, 333 nt, synthetic construct
  misc_feature 1..333: note = derived and/or modified sequence opt11 from anti-HIV_048-162036_VR-Chain
  source 1..333: mol_type = other RNA
caatccgtcctcgcccaacccccctcagtctccggcgcccccggccaaaccgtcaccatctcctgcaccggatcatcctccaacatcggcggctacgacgtccactggtaccaacaactccccggcaccgcccccaaactactaatctacaaagacgacaaacgcccctccggcatccccgaccgcttctccggctccaaatccggcacctccgccaccctcggcatcaccggcctccaaaccggcgacgaagccgactactactgcggcacctgggacacctccctcaaccgcggcggcgtcttcggcaccggcaccaaagtcaccgtcctc

SEQ ID NO: 56128 - RNA, 333 nt, synthetic construct
  misc_feature 1..333: note = derived and/or modified sequence opt11 from anti-HIV_048-160042_VR-Chain
  source 1..333: mol_type = other RNA
caatccgtcctcacccaacccccatccgtctccgccgccccaggccaaaaagtcaccatctcctgctccggctcctcctccaacatcggcatcaactacatctcctggtaccaacaactccccggcaccgcccccaaaatcctcatctacgacaacgacaaacgccccctcggcatccccgaccgcttctccggctccaaatccggcacctccgccaccctcggcatcaccggcctccaaaccggcgacgaagccgactactactgcggcacctgggacgcctccctctccgccggcggcgtcttcggcaccggcaccaaagtcaccgtcctc

SEQ ID NO: 56129 - RNA, 333 nt, synthetic construct
  misc_feature 1..333: note = derived and/or modified sequence opt11 from anti-HIV_048-159676_VR-Chain
  source 1..333: mol_type = other RNA
caatcggtcctgacccagcccccgagcgtgagcgcgagcccgggccagaaagtgaccataagctgtagcgggagctcgagcgatatcgggagcaattacgtgagctggtacgtgcaattgcccgggaccgcgcccaagctcttgatctataaaaataacgagcgcccgagcgggatcccggacaggttctcgggctcaaaatcgggcacgagcgcgaccctgggcataaccgggctccagaccggagacgaggccgattactattgcgggacctgggacacgagcttgagcgcgggcggggtctttggcacgggcacgaaagtgaccgtgctc

SEQ ID NO: 56130 - RNA, 333 nt, synthetic construct
  misc_feature 1..333: note = derived and/or modified sequence opt11 from anti-HIV_048-159500_VR-Chain
  source 1..333: mol_type = other RNA
caatccgtcctcacccaacccccctccgtatccgccgcccccggccaaaacgtcaccatctcctgctccggctcctggtccaacatcggcgccaactacgtctcctggtaccaacaactccccggcaccgcccccaaactcctcatctacgaaaacaacaaacgaccctccggcatccccgaccgcttctccggctccaaatccggcacctccgccaccctcggcttcacaggcctccaaaccggcgacgaagccgactactactgcggcacctgggacacctccctctccgccggcggcgtcttcggcaccggcaccaaagtcaccgtcctc

SEQ ID NO: 56131 - RNA, 333 nt, synthetic construct
  misc_feature 1..333: note = derived and/or modified sequence opt11 from anti-HIV_048-159421_VR-Chain
  source 1..333: mol_type = other RNA
caatccctcctaacccaagccccctccgtctccgccgcccccggccaaaccgtcaccatctcctgctccggctccaacgccgacatcggcaaaaacttcgtctcctggtaccaacaatcccccggcgccgcccccaaactcctcatctacgaaaacgaccgccgcccctccggcatccccgaccgcttctccggctccaaatccggcacctccgccaccctcggcatcaccggcctccaaaccggcgacgaagccgaatactactgcgccacctgggacgcctccctctccggcggcggcgtcttcggcaccggcaccaaagtcaccgtcctc

SEQ ID NO: 56132 - RNA, 333 nt, synthetic construct
  misc_feature 1..333: note = derived and/or modified sequence opt11 from anti-HIV_048-159333_VR-Chain
  source 1..333: mol_type = other RNA
caatcggtcttaacccagcccccgagcgcgagcgggaccccgggccagcgcgtgaccataagctgtagcgggagcaatagcaatatcgggagcgatagcgtgtactggtaccagcaattgcccgggcgctcgcccaagctcttgatctatcgcaataacgagcgcccgagcgggatcccggacaggttctcgggctcgaaatcgggcacgagcgcgaccttgggcataaccgggctccagaccggggacgaggccgattactattgcgggacctgggacacgagcttgagcgcgggcggggtctttggcacgggcacaaaagtgaccgtactc

SEQ ID NO: 56133 - RNA, 333 nt, synthetic construct
  misc_feature 1..333: note = derived and/or modified sequence opt11 from anti-HIV_048-158932_VR-Chain
  source 1..333: mol_type = other RNA
caatccgtcctcacccaacccgcctccgtctccggctcccccggccaatccatcaccatctcctgctccggctcctcttccaacatcggcgacatcttcgtctcctggtaccaacaagtccccggcgccgcccccaaactcctcatctacgacaacgacaaacgcccctccggcatccccgaccgcttctccggctccaaatccggcacctccgccaccctcgacatcaccggcctccaaaccggcgacgaagccgactactactgcggcacctgggacacctccctctccgccggcggcgtcttcggcaccggcaccaaagtcaccgtccta

SEQ ID NO: 56134 - RNA, 333 nt, synthetic construct
  misc_feature 1..333: note = derived and/or modified sequence opt11 from anti-HIV_048-155811_VR-Chain
  source 1..333: mol_type = other RNA
caatccgccctcacccaacccgcctccgtctccggctcccccggccaatccatcaccatctcctgcaccggcacctcctccgacgtcggctacgactacgtctcctggtaccaactcctacccggcaccccccccaaactcctcatcttcaaaaacaacgaacgcccctccggcatccccgaccgcttctccggctccaaatccggcacctccgccaccctcggcatcaccggcctccaaaccggcgacgaagccgactactactgcgccacctgggacacctccctctccgccggcggcgtcttcggcaccggcaccaaagtcaccgtcctc

SEQ ID NO: 56135 - RNA, 333 nt, synthetic construct
  misc_feature 1..333: note = derived and/or modified sequence opt11 from anti-HIV_048-155464_VR-Chain
  source 1..333: mol_type = other RNA
caatccgccctcacccaacccgcctccgtctccggctcccccggccaatccatcaccatctcctgcaccggcgccaccggcgactcaggccacacctacgtctcctggtaccaacaactccccggcaccgcccccaaactcctcatctactccaacaacgaacgcccctccggcgtccccgaccgattctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56136 - RNA, 333 nt, synthetic construct
  misc_feature 1..333: note = derived and/or modified sequence opt11 from anti-HIV_048-155392_VR-Chain
  source 1..333: mol_type = other RNA
caatccgtcctcacccaacccccctccgtctccgccgcccccggccaaatggtcaccatctcctgctccggctcctcctccaacatcggcgacaactacgtctcctggtaccaacaactccccggccgcggccccaaactcctcgtctacgacacctacaaacgctacctcgaaacccccgaccgcttctccggctccaaatccggcacctccgccaccctcggcataaccggcctccaaaccggcgacgaagccgactactactgcggcacctgggacacctccctctccgccggcggcgtcttcggcaccggcaccaaagtcaccgtcctc

SEQ ID NO: 56137 - RNA, 333 nt, synthetic construct
  misc_feature 1..333: note = derived and/or modified sequence opt11 from anti-HIV_048-155389_VR-Chain
  source 1..333: mol_type = other RNA
caatccgtcctcacccaacccccctccgtctccgccgcccccggccaaaaagtcaccatctcctgctccggcatctcctccaacatcggcaacaaccccgtctcctggtaccaacaattccccggcaccgcccccaaactcctcatctacaaaaacgacaaacgcccctccggcatccccgaccgcttctccggctccaaatccggcacctccgccaccctcggcatcaccggcctccaaaccggcgacgaagccgactactactgcggcacctgggacacctccctctccaccggcggcgtcttcggcacaggcaccaaagtcaccgtcctc

SEQ ID NO: 56138 - RNA, 333 nt, synthetic construct
  misc_feature 1..333: note = derived and/or modified sequence opt11 from anti-HIV_048-154449_VR-Chain
  source 1..333: mol_type = other RNA
caatcagtcctaaaacaacccccctccgtctccggcgcccccggcctccgcgtcaccatctcctgcaccggcggctcctccaacatcggcggcttcgacgtccactggtaccaacacttccccggcaccgcccccaaactcctcatctacgacaacgaccaacgcccctccggcatccccgaccgattctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56139 - RNA, 333 nt, synthetic construct
  misc_feature 1..333: note = derived and/or modified sequence opt11 from anti-HIV_048-153379_VR-Chain
  source 1..333: mol_type = other RNA
caatccgtcctcacccaacccccctccgtctccgccacccccggccaaaaagtcaccatctcctgctccggctcccgctccaacataggctcccactacgtctcctggtaccaacaattccccgaatccgcccccaaactcctcatctacaaaaacgacaaccgcccctccggcatccccgaccgcttctccggctccaaatccggcacctccgccaccctaggcatctccggcctccaaaccggcgacgaagccgactactactgcggcacctgggacacctccctctccggcggcggcgtcttcggcaccggcaccaaagtcaccgtcctc

SEQ ID NO: 56140 - RNA, 333 nt, synthetic construct
  misc_feature 1..333: note = derived and/or modified sequence opt11 from anti-HIV_048-153171_VR-Chain
  source 1..333: mol_type = other RNA
caatccgtcctcacccaacccccctccgtctccgccgcccccggccaaaaagtcaccatctcctgctccggctccacctccaacatcgaagacatctacgtctcctggtaccaacacctccccggcaccgcccccaaactcctcatctacgacaacaacaaacgcccctccggcatccccgaccgcttctccggctccaaatccggcacctccgccaccctcgccatcaccggcctccaaaccggcgacgaagccgactactactgcggcacctgggacacctccctctccgccggcggcgtcttcggcaccggcaccaaagtcaccgtcctc

SEQ ID NO: 56141 - RNA, 333 nt, synthetic construct
  misc_feature 1..333: note = derived and/or modified sequence opt11 from anti-HIV_048-152324_VR-Chain
  source 1..333: mol_type = other RNA
caatccatggtcacccaatccccctccgtctccgccgcccccggccaaaaagtcaccatctcatgctccggcacctcctccaacatcggccaaaactacgtctcctggtaccaacaactccccggcaccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56142 - RNA, 333 nt, synthetic construct
  misc_feature 1..333: note = derived and/or modified sequence opt11 from anti-HIV_048-146102_VR-Chain
  source 1..333: mol_type = other RNA
caatccgtcctcacccaacccccctccgtctccgccgcccccggccaaaaagtcaccatctcctgctccggctcctcctccaccatcggcaacaactacatctcctggtaccaactcctccccggcaccccccccaaactcctcatctacaaaaacaacgaacgcccctccggcatccccgaccgcttctccggctccaaatccggcacctcagccaccctcggcatcaccggcctccaaaccggcgacgaagccgactactactgcggcacctgggacacctccctctccgccggcggcgtcttcggcaccggcaccaaagtcaccgtcctc

SEQ ID NO: 56143 - RNA, 333 nt, synthetic construct
  misc_feature 1..333: note = derived and/or modified sequence opt11 from anti-HIV_048-145984_VR-Chain
  source 1..333: mol_type = other RNA
caatccgtcctcacccaacccctctcagtctccggcgcccccggccaacgcgtcaccatctcctgcaccggctcctcctccaacatcggctccaacttcgtctcctggtaccaagtcctccccggcaccacccccaaactcctcatcttcaaaaacaacgaacgcccctccggcatccccgaccgcttctccggctccaaatccggcacctccgccaccctcggcatcaccggcctccaaaccggcgacgaagccgactactactgcggcgcctgggacacctccctctccgccggcggcgtcttcggcaccggcaccaaagtcaccgtcctc

SEQ ID NO: 56144 - RNA, 333 nt, synthetic construct
  misc_feature 1..333: note = derived and/or modified sequence opt11 from anti-HIV_048-145371_VR-Chain
  source 1..333: mol_type = other RNA
caatccgtcctcacccaaccaccctccgtctccgccgcctccggccaaaaagtctccatcccctgctccggcggcacctccaacatcggcgacaactacgtctcctggttccaacaattccccggctccgcccccaaaatcctcatctacgactccgacaaacgcccctcccgcatctccgaccgcttctcagcctccaaatccggcacctccgccaccctcgacatcacccgcctccaaaccggcgacgaagccgactactactgcggcacctgggacacctccctctccgccggcggcgtcttcggcaccggcaccaaagtcaccgtcctc

SEQ ID NO: 56145 - RNA, 333 nt, synthetic construct
  misc_feature 1..333: note = derived and/or modified sequence opt11 from anti-HIV_048-144907_VR-Chain
  source 1..333: mol_type = other RNA
caatccgccctcacccaacccgcctccgtctccggctcccccggccaatccatcaccatctcctgcaccggcacccgccgcgacgtcggcttcaactacgtctcctggtaccaacaacaccccggcaccgcccccaaactcctcatctacgaaaacaacaaacgcccctccggcatccccgacagattctccggctccaaatccggcacctcagccaccctcggcatcaccggcctccaaaccggcgacgaagccgactactactgcggcacctgggactcctccctctccgccggcggcgtcttcggcaccggcaccaaagtcaccgtcctc

SEQ ID NO: 56146 - RNA, 333 nt, synthetic construct
  misc_feature 1..333: note = derived and/or modified sequence opt11 from anti-HIV_048-142298_VR-Chain
  source 1..333: mol_type = other RNA
caatccgtcctcacccaacccccctccgcctccggcacccccggccaacgcgtcaccatctcctgctccggctcctcctccaccatcggcaacaactacatctcatggtaccaactcctccccggcaccccacccaaactcctcatcttcaaaaacaacgaacgcccctccggcatccccgaccgcttctccgcctccaaatccggcacctccgccaccctaggcatcaccggcctccaaaccggcgacgaagccgactactactgcggcacctgggacacctccctctccgccggcggcgtcttcggcaccggcaccaaagtcaccgtcctc

SEQ ID NO: 56147 - RNA, 333 nt, synthetic construct
  misc_feature 1..333: note = derived and/or modified sequence opt11 from anti-HIV_048-142277_VR-Chain
  source 1..333: mol_type = other RNA
caatccgtcctcacccaacccccctccgtctccggcgcccccggccaacgcataaccatctcctgcaccggctcctcctccaacatcggcgcctacgacgtccaatggtaccaacacctacccggcaccgcccccaaactcctcatctacaaaaacaccgaacgcccctccggcatccccgaccgcttctccggctccaaatccggcacctccgccaccctcgacatcaccggactccaaaccggcgacgaagccgactactactgcggcacctgggacacctccctctccgccggcggcgtcttcggcaccggcaccaaagtcaccgtcctc

SEQ ID NO: 56148 - RNA, 333 nt, synthetic construct
  misc_feature 1..333: note = derived and/or modified sequence opt11 from anti-HIV_048-141934_VR-Chain
  source 1..333: mol_type = other RNA
caatccgtcctcacccaacccccctccgtctccggcgcccccggccaacgcgtcaccatctcctgcaccggcaactcctccaacatcggagcctacgacgtccactggtaccaacaactccccggcaccgcccccaaactcatgatctacgaagtctccaaacgcccctcaggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtccta

SEQ ID NO: 56149 - RNA, 333 nt, synthetic construct
  misc_feature 1..333: note = derived and/or modified sequence opt11 from anti-HIV_048-141207_VR-Chain
  source 1..333: mol_type = other RNA
caatccgtcctcacccaacccccctccgtctccgccgcccccggccaaaaagtcaccatcgcctgctccggctcctcatccaacatcggcaacaactacgtctcctggtaccaacaactccccggcaccgcccccaaactcctaatctacgccaacaaccgccgcccctccggcatccccgaccgcttctccgcctccaaatccggcacctccgccaccctaggcatcaccggcctccaaaccggcgacgaagccgactactactgcggcacctgggacacctccctctccgccggcggcgtcttcggcaccggcaccaaagtcaccgtcctc

SEQ ID NO: 56150 - RNA, 333 nt, synthetic construct
  misc_feature 1..333: note = derived and/or modified sequence opt11 from anti-HIV_048-140796_VR-Chain
  source 1..333: mol_type = other RNA
caatccgtcctcacccaaccaccctccgtctccgccacccccggccaaaaagtcaccatctcctgctccggcacccgctccaacatcggcaacaactacgtctcctggtaccgacaattccccggcaccgcccccaaactcctcatctacgaagacaacaaacgcccctccggcatccccgcccgcttctccggctccaaatccggcacctccgccacactcggcatcaccggcctccaaaccggcgacgaagccgactactactgcggcacctgggacacctccctctccgccggcggcgtcttcggcaccggcaccaaagtcaccgtcctc

SEQ ID NO: 56151 - RNA, 333 nt, synthetic construct
  misc_feature 1..333: note = derived and/or modified sequence opt11 from anti-HIV_048-139893_VR-Chain
  source 1..333: mol_type = other RNA
caatccgtcctcacccaacccccctccgtctccgccacccccggccaaaaagtcaccttctcctgctccggctcctcctccaccatcggcaaaaactacgtctcctggtaccaagtcctccccggcaccgcccccaaactcctcatctacaaaaacaacaaacgcccctccggcatccccgaccgcttctccggctccaaatccggcacctccgccaccctcggcatcaccggcctccaaaccggagacgaagccgactactactgcggcacctgggactcctcactctccgccggcggagtcttcggcaccggcaccaaagtcaccgtcctc

SEQ ID NO: 56152 - RNA, 333 nt, synthetic construct
  misc_feature 1..333: note = derived and/or modified sequence opt11 from anti-HIV_048-138820_VR-Chain
  source 1..333: mol_type = other RNA
caatccgtcctcacccaaccaccctccgtctccggcgcccccggccaaaaagtcaccatctcctgctccggctccggctccaacatcggcaacacctacgtctcctggtaccaacacctccccggcaccgcccccaaactcctaatctacgaaaacaacaaacgcccctccggcatccccgaccgcttctccggctccaaatccgccacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56153 - RNA, 333 nt, synthetic construct
  misc_feature 1..333: note = derived and/or modified sequence opt11 from anti-HIV_048-135858_VR-Chain
  source 1..333: mol_type = other RNA
caatccgtcctcacccaacccccctccgcctcaggcacccccggccaacgagtcaccatctcctgctccggctcctcctcaaacatcggctcctcctacgtctactggtaccaacaattccccggccgctccccccgcctcctcatctaccgcaacaacgaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56154 - RNA, 333 nt, synthetic construct
  misc_feature 1..333: note = derived and/or modified sequence opt11 from anti-HIV_048-134968_VR-Chain
  source 1..333: mol_type = other RNA
caatccgtcctcacccaacccccctccgtctccgccgcccccggccaaaaagtcaccatcttctgctccggctcctcctccaacatcggcaaaaactacgtctcctggtaccaacaactccccggcaccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56155 - RNA, 333 nt, synthetic construct
  misc_feature 1..333: note = derived and/or modified sequence opt11 from anti-HIV_048-134312_VR-Chain
  source 1..333: mol_type = other RNA
caatccgtcctcacccaacccccctccgcctccggcacccccggccaacgcgtcaccatctcctgctccggctcctcctccaacatcggcaacaactacgtctcctggtaccgcctcctccccggcaccgcccccaaactcctcatctacaaaaacgacaaccgcccctccggcatccccgaccgattctccggctccaaatccggcacctccgcaaccctcggcatctccggcctccaaaccggcgacgaagccgactactactgcggcacctgggacacctccctctccggcggcggcgtcttcggcaccggcaccaaagtcaccgtcctc

SEQ ID NO: 56156 - RNA, 330 nt, synthetic construct
  misc_feature 1..330: note = derived and/or modified sequence opt11 from anti-HIV_048-132253_VR-Chain
  source 1..330: mol_type = other RNA
tccgccctcacccaacccgcctccgtctccggctccccaggccaatccatcgccatctcctgcaccggcacctcctccgacgtcggctacgacctcgtctcctggtaccaacaacaccccggcaccgcccccaaactcctcatctacgacaacaacaaacgcccctccggcatccccgaccgcttctccggctccaaatccggcacctccgccaccctcggcatcaccggcctccaaacaggcgacgaagccgactactactgcggcacctgggacacctccctatccgccggcggcgtcttcggctccggcaccaaagtcaccgtcctc

SEQ ID NO: 56157 - RNA, 333 nt, synthetic construct
  misc_feature 1..333: note = derived and/or modified sequence opt11 from anti-HIV_048-130710_VR-Chain
  source 1..333: mol_type = other RNA
caatccgtcctcacccaacccccctccgtcgccggcgcccccggccaacgcgtcaccatctcctgcaccggcaacacctccaacatcggcggctacgacgtccactggtaccaacaactacccggcaccccccccaaactcctaatcttcaaaaacaacgaacgcccctccggcatccccgaccgcttctccggctccaaatccggcacatccgccaccctcggcatcaccggcctccaaaccggcgacgaagccgactactactgcggcacctgggacacctccctctccgccggcggcgtcttcggcaccggcaccaaagtaaccgtcctc

SEQ ID NO: 56158 - RNA, 333 nt, synthetic construct
  misc_feature 1..333: note = derived and/or modified sequence opt11 from anti-HIV_048-128564_VR-Chain
  source 1..333: mol_type = other RNA
caatccgtcctcacccaacccccctccgcctccggcacccccggccaacgcgtcaccatctcctgctccggctcctcctccaacatcggctccaacaccgtcaactggtaccaacaactccccggcaccgcccccaaactcctcatctacaaaaacaccgaacgcccctccggcatccccgaccgcttctccggctccaaatccggcacctccgccaccctcgacatcaccggcctccaaaccggcgacgaagccgactactactgcggcacctgggacacctccctctccgccggcggcgtcttcggcaccggcaccaaagtcaccgtcctc

SEQ ID NO: 56159 - RNA, 333 nt, synthetic construct
  misc_feature 1..333: note = derived and/or modified sequence opt11 from anti-HIV_048-126702_VR-Chain
  source 1..333: mol_type = other RNA
caatccgtcctcacccaacccccctccgcctccgccgcccccggccaacgcgtcaccatctcctgctccggctccaactccaacatcggcaacaactacgtctcctggtaccaacaactccccggcaccgcccccaaactcctcatctacgacaactccaaacgcccctccggcatccccgaccgcttctccgcctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56160 - RNA, 333 nt, synthetic construct
  misc_feature 1..333: note = derived and/or modified sequence opt11 from anti-HIV_048-124521_VR-Chain
  source 1..333: mol_type = other RNA
caatccgtcctcacccaacccccctccgtctccggcgcccccggccaacgcgtcacaatctcctgcaccggctcctcctccaccttcggcggctacgacgtctactggtaccaacaaatccccggcaccgcccccaaactcctcatctacgaaaacaacaaacgcccctccggcatccccgaccgcttctccggctccaaatccggcacctccgccaccctcgccatcaccggcctccaaaccggcgacgaagccgactactactgcggcacctgggacggctccctctccaccggcggagtcatcggcaccggcaccaaagtcaccgtcctc

SEQ ID NO: 56161 - RNA, 333 nt, synthetic construct
  misc_feature 1..333: note = derived and/or modified sequence opt11 from anti-HIV_048-122740_VR-Chain
  source 1..333: mol_type = other RNA
caatccgtcctcacccaacccccctccatgtccgccgcccccggccaatccgtcaccatctcctgctccggatccaccttcaacatcgaaaaacaccaagtcacctggctccgccacctccccggcaccgcccccacctccgtcatcatcatgaactcccaacgaccctccggcacccccgaccgcttctccggctccaaatccggcacatccgccaccctcgccatcaccggcctccaaaccggcgacgaagccgactactactgcggcacctgggacggctccctctccaccggcggcgtcatcggcaccggcaccaaagtcaccgtcctc

SEQ ID NO: 56162 - RNA, 327 nt, synthetic construct
  misc_feature 1..327: note = derived and/or modified sequence opt11 from anti-HIV_048-119536_VR-Chain
  source 1..327: mol_type = other RNA
gaactcacccaatccccctccgtctccgcagcccccggcgaaaaagtcaccatctcctgctccggcaccaactccaacatcggctactactacgtctcctggtaccaacaattccccggcaccgcccccaaagtcgtcatctacgaaaacaccaaacgcccatccggcatccccgaccgcttctccggctccaaatccggcacctccgccaccctcggcatcaccggcctccaaaccggcgacgaagccgactactactgcggcacctgggacacctccctctccgccggcggcgtattcggctccggcaccaaagtcaccgtcctc

SEQ ID NO: 56163 - RNA, 333 nt, synthetic construct
  misc_feature 1..333: note = derived and/or modified sequence opt11 from anti-HIV_048-116929_VR-Chain
  source 1..333: mol_type = other RNA
caatccgtcctcacccaacccccctccgtctccggcgcccccggccaacgcgtcaccatctcctgcaccggatcctcctccaacatcggcgactacgacgtccactggtaccaacaactccccggcaccgcccccaaactcctaatctaccgcaacaaccaacgcccctccggcgtccccgaccgcttctccggctccaaatccggcacctccgccaccctcggcatcaccggcctccaaaccggcgacgaagccgactactactgcggcacctgggacgcctccctctccgccggcggcgtcttcggcaccggcaccaaagtcaccgtcctc

SEQ ID NO: 56164 - RNA, 333 nt, synthetic construct
  misc_feature 1..333: note = derived and/or modified sequence opt11 from anti-HIV_048-116577_VR-Chain
  source 1..333: mol_type = other RNA
caatccgtcctcacccaacccccctccgcctccggcacccccggccaacgcgtaaccatctcctgctccggctcctcctccaacatcggctccaactacgtctcctggtaccaagtcctacccggcaccgcacccaaactcctcatctacaaaaacaacaaacgcccctccggcatccccgaccgcttctccggctccaaatccggcacctccgccaccctcggcatcaccggcctccaaaccggcgacgaagcagactactactgcgccacctgggacacctccctctccgccggcggcgtcttcggcaccggcaccaaagtcaccgtcctc

SEQ ID NO: 56165 - RNA, 333 nt, synthetic construct
  misc_feature 1..333: note = derived and/or modified sequence opt11 from anti-HIV_048-116046_VR-Chain
  source 1..333: mol_type = other RNA
caatccgtcctcacccaacccccctccgtctccggcgcccccggccaacgcgtcaccatctcatgcaccggctcctcctccaacataggcggctacgacgtccactggtaccaacaattccccggcaccgcccccaaactcctcatctacgacaacgacaaacgcccctccggcatccccgaccgcttctccggctccaaatccggcacctccgccaccctcggcatcaccggcctccaaaccggcgacgaagccaactactactgcggcgcctgggacacctccctctccgccggcggcgtcttcggcaccggcaccaaagtcaccgtcctc

SEQ ID NO: 56166 - RNA, 333 nt, synthetic construct
  misc_feature 1..333: note = derived and/or modified sequence opt11 from anti-HIV_048-115875_VR-Chain
  source 1..333: mol_type = other RNA
caatcagtcctcacccaaccaccctcagtctccgccgcccccggccaacgcgtcaccgtctcctgctccggctcctcatccaacatcggcaacaacttcgtctcctggtaccaacacctccccggcaccgcccccaaactcctaatctacgacaactccaaccgcccctccggcatccccgaccgcttctccggctccaaatccggcacctccgccaccctcggcatcaccggcctccacaccggagacgaagccgactactactgcggcacctgggacacctccctctccgccggcggagtcttcggctccggcaccaaagtcaccgtcctc

SEQ ID NO: 56167 - RNA, 333 nt, synthetic construct
  misc_feature 1..333: note = derived and/or modified sequence opt11 from anti-HIV_048-115599_VR-Chain
  source 1..333: mol_type = other RNA
caatcagtcctcacccaacccccatcagtctccgccgccccaggccaaatggtcaccatctcctgctccggctcctcctccaacatcggctcccactccgtctcctggtaccaacacttccccggcaccgcccccaaactcgtcatcgaagaaaacgaccaacgcccctccggcatccccgaccgattctccggctccaaatccggcacctccgccaccctcggcataaccggcctccaaaccggcgacgaaggcgactactactgcggcacctgggacacctcactctccggcggcggcgtcttcggcaccggcaccaaagtcaccgtcctc

SEQ ID NO: 56168 - RNA, 333 nt, synthetic construct
  misc_feature 1..333: note = derived and/or modified sequence opt11 from anti-HIV_048-113988_VR-Chain
  source 1..333: mol_type = other RNA
caatccgtcctcacccaacccccctccgtctccgccgcccccggccaaatggtcaccatctcctgctccggctcctcacacaacatcggcgaaaactacgtctcctggtaccaacacctccccggcaccgcccccaaactcctcatcttcaaaaacaacgaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56169 - RNA, 333 nt, synthetic construct
  misc_feature 1..333: note = derived and/or modified sequence opt11 from anti-HIV_048-112989_VR-Chain
  source 1..333: mol_type = other RNA
caatcagtcctaacccaacccccaagcgcaagcggaaccccaggccaacgcgtaaccctcagctgcagcggcggctcaagcaacatcggaaacgacaacgtatactggtaccaacaaagacccggaaccacacccaaactcctaatctacaacgacaaccgacgcccaagcggaaccccagaccgattctccggctcaaaatcaggcacaagcgccaccctagccataaccggactccaaaccggagacgaagccgactactactgcggcacctgggacggaagcctaagcacaggcggagtcataggcacaggcacaaaagtaaccgtactc

SEQ ID NO: 56170 - RNA, 333 nt, synthetic construct
  misc_feature 1..333: note = derived and/or modified sequence opt11 from anti-HIV_048-112435_VR-Chain
  source 1..333: mol_type = other RNA
caatccgtcctcacccaacccccctccgtctccgccgcccccggccaaaaagtctccatctcctgctccggctcctcctccaacatcggcaaaaactacgtctcctggtaccaacaactccccggcaccgcccccaaactcctcatcttcaaaaacaacgaacgcccctccggcatccccgaccgcttctccggctccaaatccggcacctccgccaccctcggcatcaccggcctccaaaccggcgacgaagccgactactactgcgccacctgggacacctccctctccgccggcggcgtcttcggcaccggcaccaaagtcacagtcctc

SEQ ID NO: 56171 - RNA, 333 nt, synthetic construct
  misc_feature 1..333: note = derived and/or modified sequence opt11 from anti-HIV_048-111339_VR-Chain
  source 1..333: mol_type = other RNA
caatccgtcctcacccaacccccctccgtctccgccgcccccggccaaaaagtcaccatctcctgcaccggctcctcctccaacatcggcggctacgccgtccactggtaccaacaagtccccgccaccgcccccaaactcctcatctacgaaaacaacgaacgcccctccggcatccccgaccgcttctccggctccaaatcaggcacctccgccaccctcggcatcaccggcctccaaaccggcgacgaagccgactactactgcggcacctgggacacatccctctccgccggcggcgtcttcggcaccggcaccaaagtaaccgtcctc

SEQ ID NO: 56172 - RNA, 333 nt, synthetic construct
  misc_feature 1..333: note = derived and/or modified sequence opt11 from anti-HIV_048-111055_VR-Chain
  source 1..333: mol_type = other RNA
caatcagccctaacacaacccgcaagcgtaagcggaagcccaggccaaagcataaccataagctgcaccggaaccagaagcgacgtcggatacaactacgtaagctggtaccaacaacaccccggaaaagcacccaaactactaatctacgaaaacaccaaacgcccaagcggaatcccagacagattctcaggctcaaaatcaggcacaagcgcaaccctaggcataaccggactccaaaccggagacgaagccgactactactgcggaacctgggacacaagcctaagcgcaggcggagtcttcggctcaggcacaaaagtaaccgtactc

SEQ ID NO: 56173 - RNA, 333 nt, synthetic construct
  misc_feature 1..333: note = derived and/or modified sequence opt11 from anti-HIV_048-111027_VR-Chain
  source 1..333: mol_type = other RNA
caatccgtcctcacccaacccccctcagtctccgccgcccccggccaaaaagtcaccatctcctgctccggctccaactccaacctcggcaacaactacgtctcctggtaccaacacctccccggcaccgccccccgcctcctcatctacgaagacaaaaaacgcccctccggcatccccgaccgcttctccggctccaaatccggcgcctccgccaccctcgacatcaccggcctccaaaccggcgacgaagccgactactactgcggcatctgggacacctccctctccgccggcggcgtcttcggcaccggcaccaaagtcaccgtcctc

SEQ ID NO: 56174 - RNA, 333 nt, synthetic construct
  misc_feature 1..333: note = derived and/or modified sequence opt11 from anti-HIV_048-109721_VR-Chain
  source 1..333: mol_type = other RNA
caatccgtcctcacccaacccccctcagtctccgccgcccccggccaaaaagtcaccatctcctgctccggctcatcctccgacatcggctccaacttcgtctcctggtaccaacacctccccggcaccgccccccgcctcctcatctacgaaaacaaccgccgcccctccggcatccccgaccgcttctccggctccaaatcaggcacctccgcaaccctcgccatcaccggcctccaaaccggcgacgaagccgactactactgcggcacctgggacacctccctcaaccgcggcggcgtcttcggcaccggcaccaaagtcaccgtcctc

SEQ ID NO: 56175 - RNA, 333 nt, synthetic construct
  misc_feature 1..333: note = derived and/or modified sequence opt11 from anti-HIV_048-109666_VR-Chain
  source 1..333: mol_type = other RNA
caatcagtcctgacccagcccccgagcatgagcgcggcaccgggcgaacgcgtaaccataagctgcagcggaagctcaagcaacatcggaaaccaccacgtaagctggtaccaacaaaggcccgggaccgcgcccaaactcctgatctacgaaaacaacgaacgcccgagcggaatcccagacagattctcgggctcaaaatcaggatcaagcgcgaccctggccataaccggactccagaccggagacgaggccgactactactgcggaacctgggacggacgcctgaacataggcggagtcataggcacaggcacaaaagtaaccgtactc

SEQ ID NO: 56176 - RNA, 333 nt, synthetic construct
  misc_feature 1..333: note = derived and/or modified sequence opt11 from anti-HIV_048-109196_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaactccccggcaccgcccccaaactcctcatctacgaaaccaacaaacgcccctccggcatccccgaccgcttctccggctccaaatccggcacctcagccaccctcgccatcaccggcctccaaaccggcgacgaagccgactactactgcggcacctgggacacctccctctccggcggcggcgtcttcggcaccggcaccaaagtcaccgtcctc

SEQ ID NO: 56177 - RNA, 333 nt, synthetic construct
  misc_feature 1..333: note = derived and/or modified sequence opt11 from anti-HIV_048-109051_VR-Chain
  source 1..333: mol_type = other RNA
caatcagtcctcacccaacccccctccgtctccgccgcccccggccaaaaagtcaccatctcctgctccggcaacaactccaacatggtcaacaactacatctcctggtaccaactcctccccggcaccccccccaaactcctcatcttcaaaaacaacgaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56178 - RNA, 333 nt, synthetic construct
  misc_feature 1..333: note = derived and/or modified sequence opt11 from anti-HIV_048-108570_VR-Chain
  source 1..333: mol_type = other RNA
caatccgccctcacccaaccaccctccgtctccgccgcccccggccaaaaagtcaccatctcatgctccggcaaatcctccaacatcggcaccaacttcgtctcctggtaccaacaattccccgaagccgcccccaaactcctcatctacgacaacaacaaacgcccctccggcatccccgaccgcttctccggctccaaatccggcacctccgccaccctcggcatcaccggcctccaaaccggcgacgaagccgactactactgcggcacctgggacggctccctctccaccggcggagtcatcggcaccggcaccaaagtcaccgtacta

SEQ ID NO: 56179 - RNA, 327 nt, synthetic construct
  misc_feature 1..327: note = derived and/or modified sequence opt11 from anti-HIV_048-108033_VR-Chain
  source 1..327: mol_type = other RNA
gaactcacccaatccccctccgtctccgccgcccccggccaacgcgtcaccatctcctgctccggcaactcctccaacatcggcaacaactacgtctcctggtaccaactcctccccggcaccgcccccaaactcctcatctacaaaaacgacaaacgcccctccggcatccccgaccgcttctccggctccaaatccggcacctccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56180 - RNA, 333 nt, synthetic construct
  misc_feature 1..333: note = derived and/or modified sequence opt11 from anti-HIV_048-107279_VR-Chain
  source 1..333: mol_type = other RNA
caatccgtcctcacccaacccccctccgtctccgccgcccccggccaaaaagtcatcatctcctgctccggctcctcctccaacatcggcaaaaactacgtctcctggtaccaacacctccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggacgcctccctctccgccggcggcgtcctcggcaccggcaccaaagtcaccgtcctc

SEQ ID NO: 56181 - RNA, 333 nt, synthetic construct
  misc_feature 1..333: note = derived and/or modified sequence opt11 from anti-HIV_048-106271_VR-Chain
  source 1..333: mol_type = other RNA
caatcagtcctaacccaaccaccctccgtctccgccgcccccggccaaaaagtcaccatctcctgctccggctcccgctccaacatcggctccaactacatctcctggtaccaacaactccccggcaccgcccccaaactcctaatctacaaaaacgacaaacgcccctccggcatccccgaccgcttctccggctccaaatccggcacctccgccatcctcggcatcaccggcctccaaaccggcgacgaagccgactactactgcggcgcatgggacacctccctctccgccggcggagtcttcggcaccggcaccaaagtcaccgtcctc

SEQ ID NO: 56182 - RNA, 333 nt, synthetic construct
  misc_feature 1..333: note = derived and/or modified sequence opt11 from anti-HIV_048-106054_VR-Chain
  source 1..333: mol_type = other RNA
caatccgtcctcacccaacccccctccgtctccgccgcccccggccaacaagtcaccatctcctgctccggctccacatccaacatcggcaacaactacgtctcctggtaccaacaagtccccggcaccgcccccaaactcctcatctacgacaacaacaaccgcccctcaggcatccccgaccgcttctccggctccaaatccggcacctccgccaccctcggcatctccggcctccaaaccggcgacgaagccgactactactgcggaacctgggacacctccctctccggcggcggcgtcttcggcaccggcaccaaagtcaccgtcctc

SEQ ID NO: 56183 - RNA, 333 nt, synthetic construct
  misc_feature 1..333: note = derived and/or modified sequence opt11 from anti-HIV_048-104848_VR-Chain
  source 1..333: mol_type = other RNA
caatccgccctcacccaacccgcctccgtctccggctcccccggccaatccatcaccatctcctgcaccggcacctcatccgacgtcggctacaactacgtctcctggtaccaacaactccccggcaccgcccccaaactactcatcttcgacaacgacgaccgcccctccgaaatccccgaccgcttctccggctccaaatccggcacctccgccaccctcggcatcaccggcctccaacccggcgacgaagccgactactactgcggcacctgggactcctccctctccgccggcggcgtcttcggcaccggaaccaaagtcaccgtcctc

SEQ ID NO: 56184 - RNA, 333 nt, synthetic construct
  misc_feature 1..333: note = derived and/or modified sequence opt11 from anti-HIV_048-104638_VR-Chain
  source 1..333: mol_type = other RNA
caatccgtcctcacccaacccccctccgcctccggaacccccggccaccgcgtcaccatctcctgctccggcaactcctccaacatcggcggcaaccacgtctactggtaccaacaagtccccggcaccacccccaaactcctcatctaccgcaacaacgaacgcccctccggcatccccgaccgcttctccggctccaaatccggcacctccgccaccctaggaatcaccggcctccaaaccggcgacgaagccgactactactgcggcacctgggacacctccctctcagcaggcggcgtcttcggcaccggcacaaaagtcaccgtcctc

SEQ ID NO: 56185 - RNA, 333 nt, synthetic construct
  misc_feature 1..333: note = derived and/or modified sequence opt11 from anti-HIV_048-104567_VR-Chain
  source 1..333: mol_type = other RNA
caatccgtcctaacccaacccccctccgcctccggcacccccggccaacgcgtcaccatctcatgctccggctccaactccaacatcggcaccaacttcgtcaactggtaccaacacgtccccggccgcgcccccaaactcctaatctacaaaaacaccgaacgcccctccggcatccccgacagattctccggctccaaatccggcacctccgcaaccctcgacatcaccggcctccaaaccggcgacgaagccgactactactgcggcacctgggacacctccctctccgccggcggcgtcttcggcaccggcaccaaagtcaccgtcctc

SEQ ID NO: 56186 - RNA, 333 nt, synthetic construct
  misc_feature 1..333: note = derived and/or modified sequence opt11 from anti-HIV_048-102804_VR-Chain
  source 1..333: mol_type = other RNA
caatccgtcctaacccaacccccctccgtctccaccgcccccggccaaaaagtcaccatctcctgctccggctcctcctccaacatcggctactcctacgtctcctggttccaacacctccccggcaccgcccccaaactcctcatctacggcaactccaaccgaccctccggcgtccccgaccgcttctccggctccaaatccggcacctccgcctccctcgccatcaccggcctccaaaccggcgacgaagccgactactactgcggcacctgggactcctccctctccgccggcggcgtcttcggcaccggcaccaaagtcaccgtcctc

SEQ ID NO: 56187 - RNA, 333 nt, synthetic construct
  misc_feature 1..333: note = derived and/or modified sequence opt11 from anti-HIV_048-101676_VR-Chain
  source 1..333: mol_type = other RNA
caatccgtcctcacccaacccccctccgtctccggcgcccccggccaatccgtcaccatctcctgcaccggcacctcctccaacatcggcgacttcgacgtccactggtaccaacaactccccggcaccgcccccaaactcctcctctacgaaaacaacaaacgcccctccggcatccccgaccgcttctccggctccaaatccggcacctccgccaccctcgccatcaccggcctacaaaccggcgacgaagccgactactactgcggcacctgggacggctccctctccaccggcggcgtcatcggcaccggcaccaaagtcaccgtcctc

SEQ ID NO: 56188 - RNA, 333 nt, synthetic construct
  misc_feature 1..333: note = derived and/or modified sequence opt11 from anti-HIV_048-097603_VR-Chain
  source 1..333: mol_type = other RNA
caatccgtcctcacccaaccaccctccgtctccgccgcccccggccaaaaagtcaccatctcctgctccggctcatcatccaacatcggcaacaactacgtctcctggtaccaacaactccccggcaccgcccccaaactcctcatctacgacaccgtcaaacgcccctccggcatccccgaccgcttctccggctccaaatccggcacatccgccaccctcggcatcaccggcctccaaaccggcgacgaagccgactactactgcggaacctgggactcctccctctccggcggcggcgtcttcggcaccggcaccaaagtcaccgtcctc

SEQ ID NO: 56189 - RNA, 333 nt, synthetic construct
  misc_feature 1..333: note = derived and/or modified sequence opt11 from anti-HIV_048-097107_VR-Chain
  source 1..333: mol_type = other RNA
caatccgtcctcacccaacccccctccgtctccgccgcccccggccaaaaagtcaccatctcctgctccggctcctcctccaacatcgaaaacaactacgtctcctggtaccgccaagtccccggcaccgcccccaaactcctcatctacaaaaacgacaaccgcccctccggcatccccgaccgcttctccggctccaaatccggcacctccgccaccctcggcatcaccggcctccaaaccggcgacgaagccgactactactgcggcatctgggacacatccctctccgccggcggcgtcttcggcaccggcaccaaagtcaccgtcctc

SEQ ID NO: 56190 - RNA, 333 nt, synthetic construct
  misc_feature 1..333: note = derived and/or modified sequence opt11 from anti-HIV_048-096871_VR-Chain
  source 1..333: mol_type = other RNA
caacccgtcctcacccaacccccctccgcctccggcacccccggccaacgcgtcaccatctcctgctccggctcctcctccaacatcggctccaactacgtctactggtaccaacaactccccggcaccacccccaaactcctcatctaccgcaacaaccaacgcccctccggcatccccgaccgcttctccggctccaaatccggcacctccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56191 - RNA, 333 nt, synthetic construct
  misc_feature 1..333: note = derived and/or modified sequence opt11 from anti-HIV_048-096668_VR-Chain
  source 1..333: mol_type = other RNA
caatcagtcctcacccaacccccctccgtctccgccgcccccggccaaaaagtcaccatctcctgctccggctccggctccaacatcggcaacaactacgtctcctggtaccaacaactccccggcaccgcccccaaactcctcatctacaaaaacaccgaacgaccctccggcatccccgaccgcttctccggctcaaaatccggcacctccgccaccctcgacatcaccggcctccaaaccggcgacgaagccgactactactgcggcacctgggacacctccctctccgccggcggcgtcttcggcaccggcacaaaagtaaccgtcctc

SEQ ID NO: 56192 - RNA, 333 nt, synthetic construct
  misc_feature 1..333: note = derived and/or modified sequence opt11 from anti-HIV_048-095236_VR-Chain
  source 1..333: mol_type = other RNA
caatccgtcctcacccaacccccctccgtatcagccccccccggccaaaaagtcaccatctcctgctccggcaccacctccaacatcggctccaactacgtcgcctggtaccaacaactacccggcaccgcccccaaactcgtcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56193 - RNA, 333 nt, synthetic construct
  misc_feature 1..333: note = derived and/or modified sequence opt11 from anti-HIV_048-094155_VR-Chain
  source 1..333: mol_type = other RNA
caatcagtcctaacccaacccccaagcgtcagcgcagccccaggccaaaaagtaaccgtcagctgctccggcagctcatccgacatcggagaaaactacgtcagctggtaccaacaattccccgaaaccgcccccaaactcctaatctacgacaacaacaaacgccccagcggaatcccagacagattctcaggctcaaaatcaggcacaagcgccaccctcgccatcaccggactccaaaccggagacgaagccgactactactgcggcacctgggactcaagcctcagcgcaggcggagtcttcggcacaggcacaaaagtcaccgtcctc

SEQ ID NO: 56194 - RNA, 333 nt, synthetic construct
  misc_feature 1..333: note = derived and/or modified sequence opt11 from anti-HIV_048-093219_VR-Chain
  source 1..333: mol_type = other RNA
caacccctcctcacccaaccacccgccgtctccgccacccccggccaacgcgtcaccatctcctgcaccggctcctcctccaacatcggccgcaccttcgtcaactggtaccaacaactccccggcaccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56195 - RNA, 333 nt, synthetic construct
  misc_feature 1..333: note = derived and/or modified sequence opt11 from anti-HIV_048-092976_VR-Chain
  source 1..333: mol_type = other RNA
caatccgtcctcacccaacccccctccgtctccgccgcctccggccaaaaagtcaccatctcctgctccggctcctcctccaacatcggcaacaactacgtctcctggtaccaacacctccccggcaccgcacccaaactcctcatctacaaaaacgacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcacaggcaccaaagtcaccgtcctc

SEQ ID NO: 56196 - RNA, 333 nt, synthetic construct
  misc_feature 1..333: note = derived and/or modified sequence opt11 from anti-HIV_048-090866_VR-Chain
  source 1..333: mol_type = other RNA
caatccgtcctcacccaacccccctccgtctccgccgcccccggccaaaaagtcaccatctcctgctccggctcccgctccaacatcggctcaaactacatctcctggtaccaacaactccccggcaccgcccccaaactcctcatctacgacaacaacaaacgcccctccggcatccccgaccgcttctccggctccaaatccggcacctccgccaccctcggcatcaccggcctccaaaccggcgacgaagcctactactactgcggcacctgggacacctccctctccgccggcggcgtcttcggctccggcaccaaagtcaccgtcctc

SEQ ID NO: 56197 - RNA, 333 nt, synthetic construct
  misc_feature 1..333: note = derived and/or modified sequence opt11 from anti-HIV_048-090650_VR-Chain
  source 1..333: mol_type = other RNA
caatccgccctcacccaacccgcctccgtctccggctccctcggccaatccatcaccatctcctgctccggctcctcctccaccatcggcaacaactacgtctcctggtaccaagtcctccccggcgccgcccccaaactcctcatctgcaaaaacaacgaacgaccctccggcatccccgaccgcttctcaggctccaaatccggcacctccgccaccctcggcatcaccggcctccaaaccggcgacgaagccgactactactgcggcacctgggacacctccctatccgccggcggcgtcttcggcacaggcaccaaagtcaccgtcctc

SEQ ID NO: 56198 - RNA, 333 nt, synthetic construct
  misc_feature 1..333: note = derived and/or modified sequence opt11 from anti-HIV_048-089009_VR-Chain
  source 1..333: mol_type = other RNA
caatccgtcctcacccaacccccctccgtctccgccgcccccggccaaaaagtcaccatctcctgctccggcggctcctccaacatcggcaacaactacgtctcatggtaccaacaactccccgaaaccgcccccaaactcatcatctacgacaacaacaaacgcccctccggcatccacgaccgcttctcaggctccaaatccggcacctccgccaccctcgacatcaccgccctccaaaccggcgacgaagccgactactactgcggcacctgggacacctccctctccgccggcggcgtcttcggcaccggcaccaaagtcaccgtcctc

SEQ ID NO: 56199 - RNA, 333 nt, synthetic construct
  misc_feature 1..333: note = derived and/or modified sequence opt11 from anti-HIV_048-088654_VR-Chain
  source 1..333: mol_type = other RNA
caatccgccctcacacaaccccgctccgtctccgccgcccccggccaaaaagtctccatctcctgctccggccgctccaccaacctcggctacaactacgtctcctggtaccaacacctccccggcgccgcccccaaagtcctaatctacgaaaacaacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56200 - RNA, 333 nt, synthetic construct
  misc_feature 1..333: note = derived and/or modified sequence opt11 from anti-HIV_048-086513_VR-Chain
  source 1..333: mol_type = other RNA
caatccgccctcacccaacccccctccgtctccgccgcccccggccaaaaagtcaccatctcctgctccggctccacctccaacatcggcaacaactacgtctcctggtaccaacaactccccggcaccgcccccaaactcctcatctacaaaaacgacaaccgcccctccggcatccccgaccgcttctcatcctccaaatcaggcacctccgccaccctcggcatcaccggcctccaaaccggcgacgaagccgactactactgcggcatctgggacacctccctctccgccggcggcgtcttcggcaccggcaccaaagtcaccgtcctc

SEQ ID NO: 56201 - RNA, 324 nt, synthetic construct
  misc_feature 1..324: note = derived and/or modified sequence opt11 from anti-HIV_048-086024_VR-Chain
  source 1..324: mol_type = other RNA
ctcgcccaacccccctccgtctccggcacccccggccaacgcgtcaccatctcctgctccggctcctcctccaacatcggctccaacgccgtcaactggtaccaacaattccccggcaccgcccccaaactcctcatctacgacaccgacaaacgcccctccggcatccccgaccgcttctccggctccaaatccggcacctccgccatcctcggcatcaccggcctccaaaccggcgacgaagccgactactactgcggcgcctgggacacctccctctccgccggcggcgtcttcggcaccggcaccaaagtcaccgtcctc

SEQ ID NO: 56202 - RNA, 333 nt, synthetic construct
  misc_feature 1..333: note = derived and/or modified sequence opt11 from anti-HIV_048-085857_VR-Chain
  source 1..333: mol_type = other RNA
caatcagccctcacccaaccccgctccgtctccggctccctcggccaatccgtcaccatctcctgcaccggcacaacctccgacgtcggcttcgactacgtctcctggtaccaagtcctccccggcaccgcccccaaactcctcatctacaaaaacgacaaacgaccctccggcatccccgaccgcttctccggctccaaatccggcacctccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56203 - RNA, 333 nt, synthetic construct
  misc_feature 1..333: note = derived and/or modified sequence opt11 from anti-HIV_048-084277_VR-Chain
  source 1..333: mol_type = other RNA
caatccgtcctccgacaaccaccctccctatccggcgcccccggccaacgcgtcaccctctcctgcaccggctcctcctccaacatcggcggctacgacgtccactggtaccaacacgtccccggcaccgcccccaaactcctcatctacgaaaacaccaaacgcccctccggcatccccgaccgcttctccggctcaaaatccggcacctccgccaccctcggcatcaccggcctccaaaccggcgacgaagccgactactactgcggcacctgggacacctccctctccgccggcggcgtcttcggctccggcacaaaagtcaccgtcctc

SEQ ID NO: 56204 - RNA, 333 nt, synthetic construct
  misc_feature 1..333: note = derived and/or modified sequence opt11 from anti-HIV_048-084245_VR-Chain
  source 1..333: mol_type = other RNA
caatccaccctcacccaacccccctccgtctccgccgcccccggccaaaaagtcaccatctcctgctccggctccaactccaacatcggcaaacactacgtctcctggtaccaacaattccccggcgccgtccccaaactcctcatctacgaaaacaaaaaacgcccctccggcatccccgaccgcttctccggctccaaatccgacacctccgccaccctcgacatcaccggcctccaaaccggcgacgaagccgactactactgcggcacctgggacacctccctctccgccggcggcgtcttcggctccggcaccaaagtcaccgtcctc

SEQ ID NO: 56205 - RNA, 333 nt, synthetic construct
  misc_feature 1..333: note = derived and/or modified sequence opt11 from anti-HIV_048-082487_VR-Chain
  source 1..333: mol_type = other RNA
caatccctcctcacccaacccccctccgtctccgccgcccccggccaaaaagtcaccatctcctgctccggctcctcctccaccatcggcaacaactacgtctcctggtaccaagtcctccccggcgccgcccccaaactcctcatctgcaaaaacaacgaacgcccctccggcatccccgaccgcttctccggctccaaatccggcacctccgccaccctcggcatcaccggcctacaaaccggcgacgaagccgactactactgcggcacctgggacacctccctctccgccggcggcgtcttcggctccggcaccaaagtaaccgtcctc

SEQ ID NO: 56206 - RNA, 333 nt, synthetic construct
  misc_feature 1..333: note = derived and/or modified sequence opt11 from anti-HIV_048-081787_VR-Chain
  source 1..333: mol_type = other RNA
caatccgtcctcacccaaccaccctccgtctccggcgcccccggccaacgcgtaaccatctcctgcaccggctcctcctccaacatcggctcctacgacgtccactggtaccaacaactccccggcaccgcccccaaactcctaatctacgaaaactccaaacgcccctccggcatccccgaccgcttctccggctccaaatcaggcacctccgccaccctcggcatcaccggcctccaaaccggcgacgaagccgactactactgcggcacctgggacacctccctctccggcggcggcgtcttcggcaccggcaccaaagtcaccgtcctc

SEQ ID NO: 56207 - RNA, 333 nt, synthetic construct
  misc_feature 1..333: note = derived and/or modified sequence opt11 from anti-HIV_048-081062_VR-Chain
  source 1..333: mol_type = other RNA
caatccgtcctcacccaacccccctccgtctccgccgcccccggccaaaaagtcaccatctcctgctccggcacctcctccaacatcggcgccaactacgtctcctggtaccaacaagtccccggcaccgcccccaaactcctcatctacgaaaacaacaaacgcccctccggcacccccgaccgcttctccggctccaaatccggcacctccgccaccctcggcatcaccggcctccaaaccggcgacgaagccgactactactgcggcacctgggacacctccctctccgccggcggagtcttcggctccggcaccaaagtcaccgtcctc

SEQ ID NO: 56208 - RNA, 333 nt, synthetic construct
  misc_feature 1..333: note = derived and/or modified sequence opt11 from anti-HIV_048-079639_VR-Chain
  source 1..333: mol_type = other RNA
caatccgtcctcacccaaccaccctccgtctccgccgcccccggccaaaaagtcaccatctcctgctccggctcctcctccaacatcggcaaaaactacgtctcctggtaccaacacctccccggcaccgcccccaaactcctcatctacgaaaacaacaaacgcccctccggcatccccgaccgcttctccggctccaaatccggcaccgccgccaccctcggcatcaccggcctacaaaccggcgacgaagccggctactactgcggcacctgggacacctccctctccgccggaggcgtcttcggcaccggcaccaaagtcaccgtcctc

SEQ ID NO: 56209 - RNA, 333 nt, synthetic construct
  misc_feature 1..333: note = derived and/or modified sequence opt11 from anti-HIV_048-079126_VR-Chain
  source 1..333: mol_type = other RNA
caatccgtcctcacccaacccccctccgtctccgccgcccccggccaaaaagtcaccatctcctgctcaggctcctcctccaacatcggcaacaactacgtctcctggtaccaacacctacccggcaccccccccaaactcctcatcttcaaaaacaacgaacgcccctccggcatcccagaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56210 - RNA, 333 nt, synthetic construct
  misc_feature 1..333: note = derived and/or modified sequence opt11 from anti-HIV_048-073118_VR-Chain
  source 1..333: mol_type = other RNA
caatccgtcctcacccaacccccctccgtctccgccgccccccgccacaacgtcaccatctcctgctccggcggctcctccaacatcggcaacaacttcgtctcctggtaccaatacctccccggcaccgcccccaaactcctcatctacgacaacaacaaacgcccctccggcatccccgaccgcttctccggctccaaatccggcacctccgccaccctcggcatcaccggcctccaaaccggcgacgaagccgactactactgcgccacctgggacacctccctctccgccggcggcgtcttcggcaccggcaccaaagtcaccgtcctc

SEQ ID NO: 56211 - RNA, 333 nt, synthetic construct
  misc_feature 1..333: note = derived and/or modified sequence opt11 from anti-HIV_048-070264_VR-Chain
  source 1..333: mol_type = other RNA
caatccgtcctcacccaatccccctccgtctccgccgcccccggccaaaaagtcaccatctcctgctccggcacctcctcaaacatcggcaacacctacgtctcctggtaccaacaactccccggcaccgcccccaaactcctcatctacaaaaacgacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcacagtcctc

SEQ ID NO: 56212 - RNA, 333 nt, synthetic construct
  misc_feature 1..333: note = derived and/or modified sequence opt11 from anti-HIV_048-069426_VR-Chain
  source 1..333: mol_type = other RNA
caatcagtcctaacccaacccccctccgtctccgccgcccccggccaaaaagtcaccatctcctgctccggctcctcctccaccatcggcaacaactacgtctcctggtaccaacaactacccggaaccgcacccaaactcctcatctacaaaaacaacaaacgcccctccggcgtccccgaccgcttctccggctccaaatccggcacctccgcaacccccggcatcaccggcctccaaaccggcgacgaagccgactactactgcggcacctgggacacctccctctccgccggcggcgtcttcggcaccggcaccaaagtcaccgtcctc

SEQ ID NO: 56213 - RNA, 333 nt, synthetic construct
  misc_feature 1..333: note = derived and/or modified sequence opt11 from anti-HIV_048-068564_VR-Chain
  source 1..333: mol_type = other RNA
caatccgccctaacccaaccccgatccgtctccggctcccccggccaatccgtcgccatctcctgcaccggcacctcctccgacgtcggctacaactacgtctcctggtaccaagtcctacccggcaccgcccccaaactcctcatctacaaaaacaacgaacgcccctccggcatccccgaccgcttctccggctccaaatccggcacctccgccaccctcggcatcaccggcctccaaaccggcgacgaagccgactactactgcggaacctgggacacctccctctccgccggcggcgtcttcggcaccggcaccaaagtcaccgtcctc

SEQ ID NO: 56214 - RNA, 333 nt, synthetic construct
  misc_feature 1..333: note = derived and/or modified sequence opt11 from anti-HIV_048-068345_VR-Chain
  source 1..333: mol_type = other RNA
caatccgtcctcacccaaaccccctccgtctccgccgcccccggccaacgcgtcaccatctcctgctccggctccacctccaacatcggcaacaactacgtctcctggtaccaacaactccccggcaccgcccccaaactcctcatctacgaaaacaacaaacgcccctccggcatccgcgaccgcttctccgcctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56215 - RNA, 333 nt, synthetic construct
  misc_feature 1..333: note = derived and/or modified sequence opt11 from anti-HIV_048-067337_VR-Chain
  source 1..333: mol_type = other RNA
caatccgtcctcacccaacccccctcagtctccgccgcccccggccaaaaagtcaccatctcctgctccggcgcctcctacaacatcggcaaaaactccgtctcctggtaccaacaactccccggcaccgcccccaaactcctcatctacaaaaacgacaaacgcccctcaggaatccccgaccgcttctccggctccaaatccggcgcctccgccaccctcgacatcaccggcctccaaaccggcgacgaagccgactactactgcggaatctgggacacctccctctccgccggcggcgtcttcggcaccggcaccaaagtcaccgtcctc

SEQ ID NO: 56216 - RNA, 333 nt, synthetic construct
  misc_feature 1..333: note = derived and/or modified sequence opt11 from anti-HIV_048-067180_VR-Chain
  source 1..333: mol_type = other RNA
caatccgtcctcacccaacccccctccgtctccgccgcccccggccaaaaagtcaccatctcctgctccggctcctcccccaacatcggcaacaactacgtctcctggtaccaacgcctccccggcaccgcccccaaactcctcatctacgaaaacgaccaacgcccctctggcatccccgaccgcatctccggctccaaatcaggcacatccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56217 - RNA, 333 nt, synthetic construct
  misc_feature 1..333: note = derived and/or modified sequence opt11 from anti-HIV_048-063017_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaccaccccggcaaagcccccaaactcatgatctacgaagtctccaaacgaccctccggaatccccgaccgcttctccggctccaaatccggcacctccgccaccctcggcatcaccggcctccaaaccggcgacgaagccgactactactgcggcacctgggacacctccctaaaccgcggaggcgtcttcggcaccggcaccaaagtcaccgtcctc

SEQ ID NO: 56218 - RNA, 333 nt, synthetic construct
  misc_feature 1..333: note = derived and/or modified sequence opt11 from anti-HIV_048-061885_VR-Chain
  source 1..333: mol_type = other RNA
caatccgtcctcacccaacccccctccgtctccgccgcccccggccaaaaagtcaccatctcctgctccggctcctcctccaacatcggctcccactacatctcctggtaccaacaattccccggcgccgcccccaaactcctcatctacgaaaacgacaaacgcccctccggcatccccgaccgcttctccgcctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56219 - RNA, 333 nt, synthetic construct
  misc_feature 1..333: note = derived and/or modified sequence opt11 from anti-HIV_048-061671_VR-Chain
  source 1..333: mol_type = other RNA
caatccgtcctcacccaacccccctccgcctccggcacccccggccaacgcgtcaccatctcctgctccggctcccgatccaacatcggctccaactacgtctactggtaccaacaattccccggcacagcccccaaactcctcatctacgaaaacaacaaacgcccctccggcatccccgaccgcttctccggctccaaatccggcacctccgccaccctcggcatcaccggcctccaaaccggcgacgaagccgactactactgcgccacctgggacacctccctctccgccggcggcgtcttcggcaccggcacaaaagtcaccgtcctc

SEQ ID NO: 56220 - RNA, 333 nt, synthetic construct
  misc_feature 1..333: note = derived and/or modified sequence opt11 from anti-HIV_048-060700_VR-Chain
  source 1..333: mol_type = other RNA
caatcggtcctgacccagctcccgagcctgagcgcggccccgggccaaaaagtgaccataagctgcagcggaagctcaagcaacatcggaaacaactacgtaagctggtaccaacaactgcccgggaccgcacccaaactcctaatctacgaaaacaacaaacgaccgagcggaatcccggacaggttctcaggctcgaaatcaggcacaagcgcaaccctaggcataaccggactccagaccggagacgaggccgaatactactgcgcgacctgggacgcgagcctgagcggaggcggagtcttcggcacaggcacaaaagtaaccgtactc

SEQ ID NO: 56221 - RNA, 333 nt, synthetic construct
  misc_feature 1..333: note = derived and/or modified sequence opt11 from anti-HIV_048-060592_VR-Chain
  source 1..333: mol_type = other RNA
caatccgtcctcacccaacccccctccgtctccgccgcccccggccaaaaagtcaccatctcctgctccggctcctcctccaacatcggcaaaaactacgtctcctggtaccaacaattccccggaaccgcccccaaactcctcatctacgaaaacaacaaacgcccctccggcatccccgaccgcttctccgcctccaaatccgccacctccgccaccctcgtcatcaccggcctccaaaccggcgacgaagccgtctactactgcggcacctgggacacctcactctccgccggcggcgtcttcggctccggcaccaaagtcaccgtcctc

SEQ ID NO: 56222 - RNA, 333 nt, synthetic construct
  misc_feature 1..333: note = derived and/or modified sequence opt11 from anti-HIV_048-060300_VR-Chain
  source 1..333: mol_type = other RNA
caacccgtcctcacccaacccccctccgcctccggcacccccggccaacgcgtcaccatctcctgctccggctcctcctccaacatcggcaccaacaccgtcaactggtaccaacaattccccggcaccgcccccaaactcctcatctacaaaaacaacgaacgcccctccggcatccccgaccgcttctccggctccaaatccggcacctccgccaccctcggcatcaccggcctccaaaccggcgacgaagccgactactactgcggcacctgggacacctccctctccggcggcggcgtcttcggcaccggcaccaaagtcaccgtcctc

SEQ ID NO: 56223 - RNA, 333 nt, synthetic construct
  misc_feature 1..333: note = derived and/or modified sequence opt11 from anti-HIV_048-059141_VR-Chain
  source 1..333: mol_type = other RNA
caacccgtcctcacccaacccccctccgcctccggcacccccggccaacgcgtctccatctcctgctccggaaacttctccaacatcggctccaaatacgtctactggtaccaacaaatccccggcaccgcccccaacgtcatcatctaccgcaccaacctacgcccctccggcatccccgaccgcttctccgcctccaaatcaggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56224 - RNA, 333 nt, synthetic construct
  misc_feature 1..333: note = derived and/or modified sequence opt11 from anti-HIV_048-057777_VR-Chain
  source 1..333: mol_type = other RNA
caatccgtcctcacccaacccccctccctctccgccgcccccggccaacgcgtcaccatctcctgctccggctcctcctccaacatcggcaacaactacgtctcatggtaccaacaattccccggcaccgcccccaccctcctcatctacgaaaacgacaaacgcccctccggcatccccgaccgcttctccgcctccaaatccggcacctccgccaccctcggcatcaccggactccaagccggcgacgaagccgactactactgcggcacctgggacacctccctctccgccggcggcgtcttcggcaccggcaccaaagtcaccgtcctc

SEQ ID NO: 56225 - RNA, 333 nt, synthetic construct
  misc_feature 1..333: note = derived and/or modified sequence opt11 from anti-HIV_048-056928_VR-Chain
  source 1..333: mol_type = other RNA
caatccgtcctcacccaacccccctccgtatccgccgcccccggccaaaaagtcaccatctcctgctccggctcctcctccaccatcggaaacaactacgtctcctggtaccaactcctccccggcaccgcccccaaactcctcatctacgacaacgacaaccgcccctccgacatccccgaccgcttctccggctccaaatccggcacctccgccaccctcggcatcaccggcctccaaaccggcgacgaagccgactactactgcggcgcctgggacacctcactctccgccggcggcgtcttcggcaccggcaccaaagtcaccgtcctc

SEQ ID NO: 56226 - RNA, 333 nt, synthetic construct
  misc_feature 1..333: note = derived and/or modified sequence opt11 from anti-HIV_048-056131_VR-Chain
  source 1..333: mol_type = other RNA
caattcgtcctcacccaacccgcctccgtctccggatcccccggccaatccatcaccatctcctgctccggcacctcctccgacgtcggctacaactacgtctcctggtaccaacaactccccggcaccgcacccaaactcctaatctacgaaaacaccaaacgcccctccggcatccccgaccgcttctccggctccaaatccggcacctccgccaccctcggcatcaccggcctccaaaccggcgacgaagccgactactactgcggaacctgggacacctccctctccgccggcggcgtcttcggctccggcaccaaagtcaccgtcctc

SEQ ID NO: 56227 - RNA, 333 nt, synthetic construct
  misc_feature 1..333: note = derived and/or modified sequence opt11 from anti-HIV_048-055864_VR-Chain
  source 1..333: mol_type = other RNA
caatccgtcctcacccaacccccctccgtctccgtcgcccccggccaaaaagtcaccatctactgctccggctcctcatccaacatcggaaaaaactccgtctcctggtacgtccaagtccccggcaccgcccccaaattcctcatctacgaaaacaaccaacgcccctccggcatctccgaccgcttctccggctccaaatccggcacctccgccaccctcggcatctccggcctccaaaccggcgacgaagccgactactactgcggcacctgggacacctccctctccggcggcggcgtcttcggcaccggcaccaaagtcaccgtcctc

SEQ ID NO: 56228 - RNA, 333 nt, synthetic construct
  misc_feature 1..333: note = derived and/or modified sequence opt11 from anti-HIV_048-055094_VR-Chain
  source 1..333: mol_type = other RNA
caatccgtcctcacccaacccccctccgtctccggcgcccccggccaacgcgtcaccatctcctgctccgcctcatcctcctccatcggcaacgacttcgtctcctggtaccaacaactccccggcacagcccccaaactcctcatctccgaaaacaacaaacgcccctccggcatccccgaccgcttctccggctccaaatccggcacatccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56229 - RNA, 333 nt, synthetic construct
  misc_feature 1..333: note = derived and/or modified sequence opt11 from anti-HIV_048-054343_VR-Chain
  source 1..333: mol_type = other RNA
caatccgtcctcacccaaccaccctccgtctccggcgcccccggccaacgcgtcaccatctcctgcaccggctcctcctccaacatcggcggctacgacgtcaactggtaccaacaactccccggcaccgcccccaaactcctcatcttcaaaaacaacgaacgcccctccggcatccccgaccgcttctccggctccaaatccggcacctccgccaccctcggcatcaccggcctccaaaccggcgacgaagccgactactactgcggcacctgggacacctccctctcagccggcggcgtcttcggcaccggcaccaaagtcaccgtcctc

SEQ ID NO: 56230 - RNA, 333 nt, synthetic construct
  misc_feature 1..333: note = derived and/or modified sequence opt11 from anti-HIV_048-054193_VR-Chain
  source 1..333: mol_type = other RNA
caatccgtcctcacccaacccccctccgtctccgccgcccccggccaaaaagtcaccatctcctgctccggcggctcctcaaacatcggcaacaactacgtctcctggtaccaccaagtccccggcaccgcacccaaactcctcatcttcgaaaacaacaaacgcccctccggcatccccgaccgcttctccggctccaaatccggcacctccgccacactcggcatcaccggcctccaaaccggcgacgaagccgactactactgcggcacctgggacacctccctctccggcggcggcgtcttcggcaccggcaccaaagtcaccgtcctc

SEQ ID NO: 56231 - RNA, 333 nt, synthetic construct
  misc_feature 1..333: note = derived and/or modified sequence opt11 from anti-HIV_048-052521_VR-Chain
  source 1..333: mol_type = other RNA
caatccgtcctcacccaacccccctccgtctccgccgcccccggccaaaaagtcaccatctcctgctccggctcctcctccaacatcggccgccactccgtctcctggtaccaacaactccccggcaccgcccccaaactcctcatctacgacaccgacaaacgcccctccggcatccccgaccgcttctccggctccaaatccggcacctccgccaccctcggcatcaccggcctccaaaccggcgacgaagccgactactactgcggcacctgggacacctccctctccggcggcggcgtcttcggcaccggcaccaaagtcaccgtcctc

SEQ ID NO: 56232 - RNA, 333 nt, synthetic construct
  misc_feature 1..333: note = derived and/or modified sequence opt11 from anti-HIV_048-049037_VR-Chain
  source 1..333: mol_type = other RNA
caatccgtcctcacccaaccaccctccgtctccgccgcccccggccaaaaagtcaccatctcctgctccggctcctccttcaacatcggcaacaactacgtctcctggtaccaacacctccccggcaccgcccccaaactcctcatctacgccgccgtcacccgcccctccggcatccccgaccgcttctccggctccaaatccggcacctccgccaccctcgacatcaccggactccaaaccggagacgaagccgactactactgcggcacctgggacacctccctctccgccggcggcgtcttcggcaccggcaccaaagtcaccgtcctc

SEQ ID NO: 56233 - RNA, 333 nt, synthetic construct
  misc_feature 1..333: note = derived and/or modified sequence opt11 from anti-HIV_048-048720_VR-Chain
  source 1..333: mol_type = other RNA
caatccgtcctcacccaaccccccgccgtctccgccgcccccggccaacgcgtcgccatctcctgctccggcacctcctccaacatcggctccaacctcgtctcctggtaccaacaactccccggcaaagccccccgcctcctcatctacgacaactacaaacgcccctccggcatccccgaccgcttctccggctccaaatccggcacctccgccaccctcggcatcaccggcctccaaaccggcgacgaagccgactactactgcggcacctgggacacctccctctccaccggcggcgtcttcggcaccggcaccaaagtcaccgtccta

SEQ ID NO: 56234 - RNA, 333 nt, synthetic construct
  misc_feature 1..333: note = derived and/or modified sequence opt11 from anti-HIV_048-048542_VR-Chain
  source 1..333: mol_type = other RNA
caatccgtcctcacccaacccccctccgtctccgccgcccccggccaaaaagtcaccatctcctgctccggctcctcctccaacatcggaaacaacttcgtctcctggtaccaacaactccccggcaccgcccccaaactcctcatctacaacaacgaccgccgcccctccggcgtccccgaccgcttctccgcctccaaattcggcaccgccgccaccctcggcatcaccggcctacaaaccggcgacgaagccgactactactgcggcacctgggactcctccctctccgccggcggcgtcttcggcaccggcaccaaagtcaccgtcctc

SEQ ID NO: 56235 - RNA, 333 nt, synthetic construct
  misc_feature 1..333: note = derived and/or modified sequence opt11 from anti-HIV_048-047777_VR-Chain
  source 1..333: mol_type = other RNA
caatcagtcctcacccaacccccctccgcctccggcacccccggccaacgcgtcaccatctcctgctccggctcatccgccaacatcggcaccaactacgtcttctggtaccaacacctccccggcaccgcccccaaactcctcatctacgaaaacaacaaacgcccctccggcatccccgaccgattctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56236 - RNA, 333 nt, synthetic construct
  misc_feature 1..333: note = derived and/or modified sequence opt11 from anti-HIV_048-046841_VR-Chain
  source 1..333: mol_type = other RNA
caatccgtcctcacacaacccccctccgtctccgccgcactcggccaaaaagtcaccatcacctgctccggcgacaacggcaacatcggctaccactacgtctcctggtaccaacaagtcggccgcgccgcccccaaactcctcatctacgccaacaacaaacgcccctccggcatccccgaccgcttctccggctccaaatccggcacctccgccaccctcggcatcaccggcctccaaaccggcgacgaagccgactactactgcggcacctgggacacctccctatccgccggcggcgtcttcggctccggcaccaaagtcaccgtcctc

SEQ ID NO: 56237 - RNA, 333 nt, synthetic construct
  misc_feature 1..333: note = derived and/or modified sequence opt11 from anti-HIV_048-046202_VR-Chain
  source 1..333: mol_type = other RNA
caatccgtcctcacccaacccccctccgtctccgccgcccccggccaaaaagtcaccatctcctgctcaggctcctcctccaacatcggcaacaactacgtcagctggtaccaacacctccccggcaccgcccccaaactcctcatctacgacacctacaaacgccactcaggcgtccccgaccgcttctccaactccaaatccggcacctccgccaccctcgccatcaccggcctccaaaccggagacgaaggcgactactactgcggcgcctgggacacctccctctcagccggcggcgtcttcggcaccggcaccaaagtcaccgtcctc

SEQ ID NO: 56238 - RNA, 333 nt, synthetic construct
  misc_feature 1..333: note = derived and/or modified sequence opt11 from anti-HIV_048-046059_VR-Chain
  source 1..333: mol_type = other RNA
caatccgtcctcacccaacccccctccgtctccgccgcccccggccaaaacgtcaccatctcctgctccggcacctcctccaacatcgaaaacaactacgtctcctggtaccaaacactccccggcaccgcccccaaactcctcatctacgacaacaacaaacgcccctccggcatccccgaccgattctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56239 - RNA, 333 nt, synthetic construct
  misc_feature 1..333: note = derived and/or modified sequence opt11 from anti-HIV_048-043568_VR-Chain
  source 1..333: mol_type = other RNA
caatccgtcctcacccaaccaccctccgtctccgccgcccccggccaaaaagtcaccatctcctgctccggctccgactccaacatcggctccaactacgtctcctggtaccaacaactccccggcgccgcccccaaactcctcatctacaaaaacaacaaccgcccctccggcatccccgaccgcttctccggctccaaatccggcacctccgccaccctcggcatctccggcctccaaaccggcgacgaagccgactactactgcggcacctgggacacctccctatccggcggcggcgtcttcggcaccggcaccaaagtcaccgtcctc

SEQ ID NO: 56240 - RNA, 333 nt, synthetic construct
  misc_feature 1..333: note = derived and/or modified sequence opt11 from anti-HIV_048-042713_VR-Chain
  source 1..333: mol_type = other RNA
caatccgtcctcacccaacccccctccgtctccgccgcacccggccaaaaagtcaccatctcctgctccggctcatcatcaaacatcggccgccactacgtctcctggtaccaacaactccccggcaccgcccccaaactcctaatctacgacaacaactcccgcccctccggcatccccgaccgcttctccggctccaaatccggcacctccgccaccctcggcatcaccggcctccaaaccggcgacgaagccgactactactgcggcacctgggacacctccctcaaccgaggcggcgtcttcggcaccggcacaaaagtcaccgtcctc

SEQ ID NO: 56241 - RNA, 333 nt, synthetic construct
  misc_feature 1..333: note = derived and/or modified sequence opt11 from anti-HIV_048-042440_VR-Chain
  source 1..333: mol_type = other RNA
caatccgtcctcacccaacccccctccgcctccggcacccccggccaacgcgtcaccatctcctgctccggctcctcctccaacatcggcaccaacaccgtcaactggtaccaacaactccccggcaccgcccccaaactcctcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctcaggcaccaaagtcaccgtcctc

SEQ ID NO: 56242 - RNA, 333 nt, synthetic construct
  misc_feature 1..333: note = derived and/or modified sequence opt11 from anti-HIV_048-040511_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacacctccccggcaccgcccccaaactcctcatctacgaaaacaacaaacgctcctccggcatccccgaacgcttctccggctcccaatccggcacctccgccaccctcggcatcaccggcctccaaaccggcgacgaagccgactactactgcggcacctgggacacctccctctccaccggcggcgtcttcggcaccggcaccaaagtcaccgtcctc

SEQ ID NO: 56243 - RNA, 333 nt, synthetic construct
  misc_feature 1..333: note = derived and/or modified sequence opt11 from anti-HIV_048-039195_VR-Chain
  source 1..333: mol_type = other RNA
caatccgtcctcacccaacccccctccgtctccgccgcccccggccaacgcgtcaccatctcctgctccggctccacctccaacatcggcaaccactacgtctcctggtaccaacaactccccggcaccgcccccaaactcctcatctacgacaacggcaaccgcccctccggcatccccgaccgcttctccggctccaaatccggcacctccgccaccctcgacatcaccggcctccaaaccggcgacgaagccgactactactgcggcacctgggacacctccctcaaccgcggcggcgtcttcggcaccggcaccaaagtcaccgtcctc

SEQ ID NO: 56244 - RNA, 333 nt, synthetic construct
  misc_feature 1..333: note = derived and/or modified sequence opt11 from anti-HIV_048-036935_VR-Chain
  source 1..333: mol_type = other RNA
caatccgtcctcacccaaccaccctccatgtccgccgcccccggcgaacgcgtcaccatctcctgcaccggctcctcctccaacatcggcggctacgacgtccactggtaccaacaactccccggcatcgcccccaaaatcctcatctaccgcaactccatccgcccctccggcatccccgaccgcttctccggctccaaatccggcacctccgccaccctcggcatcaccggcctccaaaccggcgacgaagccgactactactgcggaacctgggacacctccctctccaccggcggcgtcttcggcaccggcaccaaagtcaccgtcctc

SEQ ID NO: 56245 - RNA, 333 nt, synthetic construct
  misc_feature 1..333: note = derived and/or modified sequence opt11 from anti-HIV_048-034478_VR-Chain
  source 1..333: mol_type = other RNA
caatccgtcctcacccaacccccctccgtctccgccgcccccggccaaaaagtcaccatctcctgcaccggctccggctccaacatcggcaacaacgacgtctcctggtaccaacaactccccggcaccgccccccgactcctcatctacggcgacaacaaacgcccctccggcatccccgaccgcttctccggctccaaatccggcacatccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56246 - RNA, 333 nt, synthetic construct
  misc_feature 1..333: note = derived and/or modified sequence opt11 from anti-HIV_048-031641_VR-Chain
  source 1..333: mol_type = other RNA
caatccgtcctcacccaacccccctccgtctccgccgcccccggccaaaaagtcaccatctcctgctccggcaacaactccaacatcggcaacaactacgtctcctggtaccaacaactccccggaaccgcccccaaactcctcatctacgaaaactccaaacgcccctccggcatccccgaccgattctccggctccaaatccggcacctccgccaccctcggcatcaccggcctccaaaccggcgacgaagccgactactactgcggcacctgggacacctccctctccgccggcggcgtcttcggctcaggcaccaaagtcaccgtcctc

SEQ ID NO: 56247 - RNA, 333 nt, synthetic construct
  misc_feature 1..333: note = derived and/or modified sequence opt11 from anti-HIV_048-029760_VR-Chain
  source 1..333: mol_type = other RNA
caatccgccctcacccaacccgcctccgtctccggctcctccggccaatccatcaccatctcctgcaccggcaccaactccgacgtcggctacgactacgtctgctggtaccaacaactccccggcaccgcccccaaactcctcatctacgaaaacaacaaacgcccctccggcatccccgaccgcttctccggctccaaatcaggcacctccgccaccctcggcatcaccggcctccaaaccggcgacgaagccgactactactgcggcacctgggacacctccctctccgccggcggagtcttcggcaccggcaccaaagtcaccgtcctc

SEQ ID NO: 56248 - RNA, 333 nt, synthetic construct
  misc_feature 1..333: note = derived and/or modified sequence opt11 from anti-HIV_048-027970_VR-Chain
  source 1..333: mol_type = other RNA
caatccgtcctcacccaacccccctccgtctccgccccccccggccaaaaagtcaccatctcctgctccggcaccacctccaacatcggctccaactacgtcgcctggtaccaacaattccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcgccacctgggacacctccctctccgccggcggcgtcttcggcaccggcaccaaagtcaccgtcctc

SEQ ID NO: 56249 - RNA, 333 nt, synthetic construct
  misc_feature 1..333: note = derived and/or modified sequence opt11 from anti-HIV_048-027337_VR-Chain
  source 1..333: mol_type = other RNA
caatccgtcctaacccaacccccctccgtctccgccgcccccggccaaaaagtcaccatctcctgctccggctcctactccaacatcggcaacaactacctctcctggtaccaacaactccccggaaccgcccccaaactcctcatctacaaaaacaacaaacgcccctccggcgtccccgaccgattctccggctccaaatccggcgcctccgccaccctcgacatcaccggcctccaaaccggcgacgaagccgactactactgcggcatctgggacacctccctctccgccggcggcgtcttcggcaccggcaccaaagtcaccgtcctc

SEQ ID NO: 56250 - RNA, 333 nt, synthetic construct
  misc_feature 1..333: note = derived and/or modified sequence opt11 from anti-HIV_048-027217_VR-Chain
  source 1..333: mol_type = other RNA
caatccgtcctaacccaaccaccctccgtctccgccgcccccggccaaaaagtcaccatctcctgctccggctcctcctccatcatcggcaacaactacgtctcctggtaccaacaactccccggcaccgcccccaaactcctcatctacgaaaacaacaaacgcccctccggcatccccgaccgcttctcaggctccaaatccggcacctccgccaccctcgccatcgccggcctccaaaccggcgacgaagccgactactactgcgccacctgggacacctccctctccgccggcggcgtcttcggcacaggcaccaaagtcaccgtcctc

SEQ ID NO: 56251 - RNA, 333 nt, synthetic construct
  misc_feature 1..333: note = derived and/or modified sequence opt11 from anti-HIV_048-026760_VR-Chain
  source 1..333: mol_type = other RNA
caatccgtcctaacccaaccaccctccgtctccgccgcccccggccaaaaagtcaccatctcctgctccggctcctcctccaacatcggcaacaactacgtctcctggtaccaacacctccccggcaccgcccccaaactcctcatctacgacaccgtcaaacgccactccggcgtccccgaccgcttctccggctccaaatcaggcacctccgccaccctcggcatctccggcctccaaaccggcgacgaagccgactactactgcggcacctgggacacctccctctccgccggcggcgtcttcggctccggcaccaaagtcaccgtcctc

SEQ ID NO: 56252 - RNA, 333 nt, synthetic construct
  misc_feature 1..333: note = derived and/or modified sequence opt11 from anti-HIV_048-024800_VR-Chain
  source 1..333: mol_type = other RNA
caatcagtcctaacccaacccccaagcgtaagcgcagccccaggccaaaaagtaaccataagctgcagcggaagctacagcaacatcggaaacaactacgtaagctggtaccaagtcctacccggaaccgcacccaaactcctcatctacaaaaacaacgaacgcccaagcggaatcccagacagattctcaggctcaaaatcaggcacaagcgcaaccctaggcataaccggactccaaaccggagacgaagccgactactactgcggaacctgggacacaagcctaagcgcaggcggcgtcttcggcacaggcacaaaagtaaccgtactc

SEQ ID NO: 56253 - RNA, 333 nt, synthetic construct
  misc_feature 1..333: note = derived and/or modified sequence opt11 from anti-HIV_048-024313_VR-Chain
  source 1..333: mol_type = other RNA
caatccgtcctcacccaaccaccctccgtctccgccgcccccggccaaaaagtcaccatctcctgctccggctcctcctccaccatcggcaactcacacgtctcctggtaccaaatcctccccggcaccgcccccaaactcctcatctacaaagacgacaaacgcccctccggcatccccgaccgcttctccggctccaaatccggcacctccgccaccctcggcatcaccggcctccaaaccggcgacgaagccgactactactgcggcacctgggacacctccctcaaccgcggcggcgtcttcggcaccggcaccaaagtcaccgtcctc

SEQ ID NO: 56254 - RNA, 333 nt, synthetic construct
  misc_feature 1..333: note = derived and/or modified sequence opt11 from anti-HIV_048-021748_VR-Chain
  source 1..333: mol_type = other RNA
caatcggtcttaacccagcccccgagcgtgagcgcggccccgggccagcgcgtgaccataagctgtagcgggagcacgagcaatatcgggaacaattacgtgagctggtaccagcaattgcccgggaccgcgcccaagctcttgatctatgaaaataacaagcgcccgagcgggatcccggacaggttctcgggctcgaaatcgggcacgagcgcgaccttgggcataagcgggctccagaccggggacgaggccgattactattgcgggacctgggactcgagcttgagcggaggcggggtctttggcacgggcacgaaagtgaccgtgctc

SEQ ID NO: 56255 - RNA, 333 nt, synthetic construct
  misc_feature 1..333: note = derived and/or modified sequence opt11 from anti-HIV_048-020991_VR-Chain
  source 1..333: mol_type = other RNA
caatccgtcctcacccaacccccctccgcctccggcacccccggccaaaaagtcaccatctcctgctccggctcctcctccaccatcggcaacaactacgtctcctggtaccaagtactccccggcaccgcccccaaactcctcatctacaaaaacgacaaacgcccctccggcatccccgaccgcttctccggctccaaatccggcacctcagccaccctcggcatcaccggcctccaaaccggcgacgaagccgactactactgcggcacctgggacacctccctctccaccggcggcgtcttcggcaccggcaccaaagtcaccgtcctc

SEQ ID NO: 56256 - RNA, 333 nt, synthetic construct
  misc_feature 1..333: note = derived and/or modified sequence opt11 from anti-HIV_048-020340_VR-Chain
  source 1..333: mol_type = other RNA
caatccgtcctcacccaacccccctccgtctccgccgcccccggccaacgcgtcaccatctcctgctccggctcctcctccaacgtcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggagacgaagccgactactactgcggcacctgggacgcctccctctccgccggcggcgtcttcggcaccggcaccaaagtcaccgtcctc

SEQ ID NO: 56257 - RNA, 333 nt, synthetic construct
  misc_feature 1..333: note = derived and/or modified sequence opt11 from anti-HIV_048-019993_VR-Chain
  source 1..333: mol_type = other RNA
caatccgtcctcacccaacccccctccgtctccggcgcccccggccaacgcgtcaccatctcctgcaccggctcctcctcctccatcggcggcttcgacgtccactggtaccaacgcctccccggaaccgccccccgcctcctcatctacgaaaacaacaaacgcccctccggcatcccagaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56258 - RNA, 333 nt, synthetic construct
  misc_feature 1..333: note = derived and/or modified sequence opt11 from anti-HIV_048-019947_VR-Chain
  source 1..333: mol_type = other RNA
caatcggtcttgacccagcccccgagcgtgagcgcggccccgggccagcgcgtgaccataagctgtagcgggagctcgagcaatatcgggagcaagtacgtgagctggtaccagcaattgcccgggaccgcgcccaagctcttgatctatgaaaacagcaagcgcccgagcgggatcccggacaggttctcgggctcgaaatcgggcacgagcgcgaccttgggcataaccgggctccagaccggggacgaggccgattactattgcgggacctgggacacgagcttaagcacgggcggggtctttggcacgggcacgaaagtgaccgtgctc

SEQ ID NO: 56259 - RNA, 333 nt, synthetic construct
  misc_feature 1..333: note = derived and/or modified sequence opt11 from anti-HIV_048-017871_VR-Chain
  source 1..333: mol_type = other RNA
caatccgtcctcacccaacccccctccgtctccgccgcccccggccaaaaagtcaccatctcctgctccggctcctcctccaacatcggcaaccgctacgtctcctggtaccaacaactccccggcaccgcccccaaactcctcatctacaaaaacaacaaacgcccctccggcatccccgaccgcttctccggctccaaatccggcacctccgccaccctcggcatcaccggcctacaaaccggcgacgaagccgactactactgcggcacctgggacggatccctctccaccggcggcgtcatcggcaccggcaccaaagtcacagtcctc

SEQ ID NO: 56260 - RNA, 333 nt, synthetic construct
  misc_feature 1..333: note = derived and/or modified sequence opt11 from anti-HIV_048-015931_VR-Chain
  source 1..333: mol_type = other RNA
caatccgtcctcacccaacccccctccgtctccgccgcccccggccaaaaagtcaccatctcctgctccggcggctcctccaacatcggctccacctacgtctcctggtaccaacaagtccccggaaccgcccccaaactactcatctacgaaaacaacaaacgcccctccggcatccccgaccgcttctcaggctcaaaatccggcacctccgccaccctcgacatcaccggcctccaaaccggcgacgaagccgactactactgcggcacctgggacacctccctctccggcggcggcgtcttcggcaccggcaccaaagtcaccgtcctc

SEQ ID NO: 56261 - RNA, 333 nt, synthetic construct
  misc_feature 1..333: note = derived and/or modified sequence opt11 from anti-HIV_048-015920_VR-Chain
  source 1..333: mol_type = other RNA
caatccctcctcacccaacccccctccgtctccgccgcccccggccaaaaagtcaccatctcatgctccggctcctcctccaccatcggaaacaactacgtctcctggtaccaagtcctccccggcaccgcccccaaactcctcatctacaaaaacaacgaacgcccctccggcatccccgaccgcttctccggctccaaatccggcacctcagccaccctcggcatcaccggcctccaaaccggcgacgaagccgaatactactgcgccacctgggacgcctccctctccggcggcggcgtcttcggcaccggcaccaaagtcaccgtcctc

SEQ ID NO: 56262 - RNA, 333 nt, synthetic construct
  misc_feature 1..333: note = derived and/or modified sequence opt11 from anti-HIV_048-013898_VR-Chain
  source 1..333: mol_type = other RNA
caatccgtcctcacccaacccccctccgtctccgccgcccccggccaaaaagtcaccatctcctgctccggctcctcctccaacatcggcaaacactccgtctcctggtaccaacaactccccggcaccgcccccgaactcctcatctacgacaacaacaaccgcccctccggcatccccgaccgcttctccggctcaaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56263 - RNA, 333 nt, synthetic construct
  misc_feature 1..333: note = derived and/or modified sequence opt11 from anti-HIV_048-013429_VR-Chain
  source 1..333: mol_type = other RNA
caatccgtcctcacccaaccaccctccgtctccgcagcccccggccaaaaagtcaccatctcctgctccggctcctcctccaacatcggcaacaactacgtctcctggtaccaacaactccccggcaccgcccccaccctcctcatctacgaaaacgacaaacgcccctccggcatccccgaccgcttctccggctccaaatccggcacctcagccaccctcggcatcaccggcctccaaaccggcgacgaagccgactactactgcggcacctgggactcctccctctccgccggcggcgtcttcggcaccggcaccaaagtcaccgtcctc

SEQ ID NO: 56264 - RNA, 333 nt, synthetic construct
  misc_feature 1..333: note = derived and/or modified sequence opt11 from anti-HIV_048-012358_VR-Chain
  source 1..333: mol_type = other RNA
caatcagtcctcacccaacccccctccgtctccgccgcccccggccaaaaagtcaccatctcctgctccggctccaactccgccatcggcaacaactacgtctcctggtaccaagtcctacccggcaccgcccccaaactcctcatctacaaaaacaacgaacgcccctccggcatccccgaccgcttctcaggctccaaatccggcacctccgccaccctcgacataaccggcctccaaaccggcgacgaagccgactactactgcggcacctgggacacctccctctccgccggcggcgtcttcggcaccggcaccaaagtcaccgtcctc

SEQ ID NO: 56265 - RNA, 333 nt, synthetic construct
  misc_feature 1..333: note = derived and/or modified sequence opt11 from anti-HIV_048-011158_VR-Chain
  source 1..333: mol_type = other RNA
caatccgtcctcacccaacccccctccgtctccgccgcccccggccaaaaagtcaccatctcctgctccggcatctcctccaacatcggcaacaacgacgtctcctggtaccaacaactccccggcaccgcccccaaactcctcatctacgacaacgacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56266 - RNA, 333 nt, synthetic construct
  misc_feature 1..333: note = derived and/or modified sequence opt11 from anti-HIV_048-010720_VR-Chain
  source 1..333: mol_type = other RNA
caatccgtcctcacccaacccccctccgtctccgccgcccccggccaaaaagtcaccatctcctgctccggctcatcctccaacatcggctcccactacgtctcctggtaccaacaagtccccggcaccgccccccgcctcgtcatctacgaaaactccaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggctccggcaccaaagtcaccgtcctc

SEQ ID NO: 56267 - RNA, 333 nt, synthetic construct
  misc_feature 1..333: note = derived and/or modified sequence opt11 from anti-HIV_048-009445_VR-Chain
  source 1..333: mol_type = other RNA
caatccgtcctcacccaacccccctccgtctccgccgcccccggccaaaaagtcaccatctcctgctccggctcctcctccaacatcggcaacaactacgtctcctggtaccaacaactccccggcaccgtccccaaactcctcatctacgacacctacacccgcccctccggcacccccgaccgcttctccggctccaaatccggcacctccgccaccctcgccatcaccggcctccaaaccggcgacgaagccgactactactgcggcacctgggacggctccctctccaccggcggcgtcatcggaaccggcaccaaagtcaccgtcctc

SEQ ID NO: 56268 - RNA, 324 nt, synthetic construct
  misc_feature 1..324: note = derived and/or modified sequence opt11 from anti-HIV_048-006126_VR-Chain
  source 1..324: mol_type = other RNA
cagagcgtgctcacgcaaccgccctcggtctcgggcgcgcccgggcaaaaggtcacaatctcgtgctcgggcataagctcgaactttggcataagctggtaccagcaagtgcccgggaccgcgcccaagctcttgatctatgaaaatgacaagcgcccgagcgggatcccggacagattctcgggctcgaaatcgggcacgagcgcgaccttgggcataaccgggctccagaccggggacgaggccgattactattgcgggacctgggacacgagcctgagcgcgggcggggtctttggcacgggcacgaaagtgaccgtgctc

SEQ ID NO: 56269 - RNA, 333 nt, synthetic construct
  misc_feature 1..333: note = derived and/or modified sequence opt11 from anti-HIV_048-005652_VR-Chain
  source 1..333: mol_type = other RNA
caatcggtcttgacccagcccccgagcgtgagcgcggccccgggccagaaagtgaccataagctgtagcgggagcaatagcgcaatcggaaacaattacgtgagctggtaccaggtcttgcccgggaccgcgcccaagctcttgatctatgacacgtacaagcgcgcgagcgggatcccggacaggttctcgggctcgaaatcgggcacgagcgcgaccttgggcataaccgggctccagaccggagacgaggccgattactattgcgggacctgggacacgagcttgagcgggggcggggtctttggcacgggcacgaaagtgaccgtgctc

SEQ ID NO: 56270 - RNA, 333 nt, synthetic construct
  misc_feature 1..333: note = derived and/or modified sequence opt11 from anti-HIV_048-005532_VR-Chain
  source 1..333: mol_type = other RNA
caatccgtcctcacccaacccccctccgtctccgccgcccccggccaaaaagtcaccatctcctgctccggcacctcctccaacatcggcaacacctacgtctcctggtaccaacaactccccggcaccgcccccaactacctcatctacaaaatcgacaaacgcccctccggcatccccgaccgcttctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56271 - RNA, 333 nt, synthetic construct
  misc_feature 1..333: note = derived and/or modified sequence opt11 from anti-HIV_048-005189_VR-Chain
  source 1..333: mol_type = other RNA
caatcggtcttgacccagcccccgagcgtgagcgcggccccgggccagaaagtgaccataagctgtagcgggagcgggagcacgatcgggaacaatgacgtgagctggtaccagcaattacccggggccgcgcccaagctcttgatctatgaagataacaagcgcccgagcgggatcccggccaggttctcgggctcgaaatcgggcacgagcgcgaccttacgcataaccgggctccagaccggggacgaggccgattactattgcgggacctgggactcgagcttgagcgcaggcggggtctttggcacgggcacgcgcgtaagcgtgctc

SEQ ID NO: 56272 - RNA, 333 nt, synthetic construct
  misc_feature 1..333: note = derived and/or modified sequence opt11 from anti-HIV_048-005088_VR-Chain
  source 1..333: mol_type = other RNA
caatccgtcctcacccaacccccctccgtctccgccgcccccggccaaaaagtcaccatctcctgctcaggctcctcctccaacatcggcaaaaactacgtctcctggtaccaacaactccccggaaccgcccccaaactcctaatctacgacaacaacaaccgcccctccggcatccccgaccgcttctccggctccaaatccggcacctccgccaccctcggcatcaccggcctccaaaccggcgacgaagccgactactactgcggcgcctgggacacctccctctccgccggcggcgtcttcggcaccggcaccaaagtcaccgtcctc

SEQ ID NO: 56273 - RNA, 333 nt, synthetic construct
  misc_feature 1..333: note = derived and/or modified sequence opt11 from anti-HIV_048-004023_VR-Chain
  source 1..333: mol_type = other RNA
caatcagtcctcacccaaccaccctccgtctccgccacccccggccaaaaagtcaccatctcctgctccggcggctcctccaacatcggcaaaaacgacgtctcctggtaccaacaactccccggaaccgcccccaaactcctcatctacgacaccaacaaacgcccctccggcatccccgaccgcttctccgccgcccgctccggcacctccgccaccctcgacatcaccggcctccaaaccggcgacgaagcagactactactgcggcacctgggacacctccctctccgccggcggcgtcttcggcaccggaacaaaagtcaccgtcctc

SEQ ID NO: 56274 - RNA, 333 nt, synthetic construct
  misc_feature 1..333: note = derived and/or modified sequence opt11 from anti-HIV_048-001580_VR-Chain
  source 1..333: mol_type = other RNA
caatccgtcctcacccaacccccctccgtctccgccgcccccggccaaaaagtcaccatctcctgctccggatcctcctccaacatcggcaacaactacgtctcctggtaccaacaactccccggcaccgcccccaaactcctcctctacgaaaacaacaaacgcccctccggcatccccgaccgcttctccggctccaaatccggcacctccgccaccctagccatcaccggcctccaaaccggcgacgaagccgcctactactgcggcacctgggacggctccctctccaccggcggcgtcatcggcaccggcaccaaagtcaccgtcctc

SEQ ID NO: 56275 - RNA, 333 nt, synthetic construct
  misc_feature 1..333: note = derived and/or modified sequence opt11 from anti-HIV_038-221120_VR-Chain
  source 1..333: mol_type = other RNA
caatcagtcctaacccaacccccaagcgtaagcgcagccccaggccaaaaagtaaccataagctgcagcggaagcacaagcaacatcggcaaaaactacgtgagctggtaccaacaactacccggaaccgcacccaaactcctgatctacgacaacaacgaacgcccaagcggaatcccagacagattctcaggatcaaaatcaggcacaagcgcaaccctaggcataaccggactccaaaccggagacgaagccgactactactgcgcaacctgggactcaagcctcagcggaggcggagtcttcggcacaggcacacgcgtaaccgtactc

SEQ ID NO: 56276 - RNA, 333 nt, synthetic construct
  misc_feature 1..333: note = derived and/or modified sequence opt11 from anti-HIV_038-197677_VR-Chain
  source 1..333: mol_type = other RNA
caatccgtcctcacccaacccccctcagtctccgccgcccccggccaaaaagtcaccgtctcctgctccggctccaactccaacatcggcaaccactacgtctcctggtaccaacaactccccggcaccgcccccaaactcctcatctacgacaacaacaaacgcccctccggcatccccgaccgcttctccggctccaaatccggcacctcagccaccctcggcatcaccggcctccaaaccggcgacgaagccgactactactgcggcacctgggactcctccctctccgccggcggcgtcttcggcaccggcaccaaagtcaccgtcctc

SEQ ID NO: 56277 - RNA, 333 nt, synthetic construct
  misc_feature 1..333: note = derived and/or modified sequence opt11 from anti-HIV_038-196765_VR-Chain
  source 1..333: mol_type = other RNA
cagagcgcgctcacgcaaccggcctcggtctcgggctcgcccgggcaatcgatcacgatctcatgcacgggcacgagcggggacgtgggctataacttggtctcgtggtatcaacagctcccgggcacggccccgaaagtgctcatatacgagaacaataaaaggccctcaggcatacccgatcgctttagcgggagcaagagcgggacctcggccacgctcgggatcacgggcttgcaaacgggcgatgaagcggactattactgtggcacgtgggatagctcgctctcggccgggggcgtgttcgggaccgggaccaaggtcacggtcttg

SEQ ID NO: 56278 - RNA, 333 nt, synthetic construct
  misc_feature 1..333: note = derived and/or modified sequence opt11 from anti-HIV_038-186200_VR-Chain
  source 1..333: mol_type = other RNA
caatccgtcctcacccaacccccctccgcctccggcacccccggccaacgcatcaccatctcctgctccggcacctcctccaacatcggctccaacatcgtctcctggtaccaacacctccccggcaccacccccaaactcgtcatcttccgcaacaaccaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56279 - RNA, 333 nt, synthetic construct
  misc_feature 1..333: note = derived and/or modified sequence opt11 from anti-HIV_038-126170_VR-Chain
  source 1..333: mol_type = other RNA
caatccgtcctcacccaacccccctccgtctccgccccccccggccaaaaagtcaccatctcctgctccggcaccacctccaacatcggctccaactacgtcgcctggtaccaacaactccccggcaccgcccccaaactcctcatctacgacaacgtcaaacgcccaacaaacatccccgaccgcttctccggctccaaatccggcacctccgccaccctaggcatcaccggcctccaaaccggcgacgaagccgactactactgcggcacctgggactcctccctctccgccggcggcgtcttcggcaccggcaccaaagtcaccgtcctc

SEQ ID NO: 56280 - RNA, 333 nt, synthetic construct
  misc_feature 1..333: note = derived and/or modified sequence opt11 from anti-HIV_038-108545_VR-Chain
  source 1..333: mol_type = other RNA
caatcagtcctgacccagcccccaagcgcaagcggaaccccaggccaacgcgtaaccataagctgcagcggaagctcaagcaacatcggatacaacaccgtaagctggtaccaacaactgcccggaaccgcacccaaactcctaatctacgaaaacaacaaacgcccaagcggaatcccagacagattctcaggctcgaaatcaggcacaagcgcaaccctgggcataaccggactccagaccggagacgaagccgactactactgcgggacctgggactcaagcctaagcgcaggcggagtcttcggcacaggcacaaaagtaaccgtactc

SEQ ID NO: 56281 - RNA, 333 nt, synthetic construct
  misc_feature 1..333: note = derived and/or modified sequence opt11 from anti-HIV_038-107263_VR-Chain
  source 1..333: mol_type = other RNA
caatcagtcctcacccaaccaccctccgcctccggcacccccggccaacgcgtcaccatctcctgctccggctcctcctccaacatcggctccaacaccgtcaactggtaccaacaagtacccggcaccgcccccaacctcctcatctactccaacgaccaacgcccctccggcatccccgaccgcttctccggctccaaatccggcacctccgcaaccctaggcatcaccggcctccaaaccggcgacgaagccgactactactgcggcacctgggactcctccctatccgccggcggcgtcttcggcaccggcaccaaagtcaccgtcctc

SEQ ID NO: 56282 - RNA, 333 nt, synthetic construct
  misc_feature 1..333: note = derived and/or modified sequence opt11 from anti-HIV_038-104530_VR-Chain
  source 1..333: mol_type = other RNA
caatcggtcttgacccagcccccgagcgtgagcgcggccccgggccagaaagtgaccataagctgtagcgggagctcgagcaatatcgggagcaattacgtgagctggtaccagcacttgcccgggaaagcgcccaagctattgatctatgacaataacaagcgcccgagcggaatcccggacaggttctcgggctcgaaatcgggcacaagcgcgaccttgggcataaccgggctccagaccggggacgaggccgattactattgcggaacctgggactcgagcttgagcgcgggcggggtctttggcacaggcacgaaagtgaccgtgctc

SEQ ID NO: 56283 - RNA, 333 nt, synthetic construct
  misc_feature 1..333: note = derived and/or modified sequence opt11 from anti-HIV_038-099169_VR-Chain
  source 1..333: mol_type = other RNA
caatccgtcctcacccaacccccctccgcctccggcacccccggccaacgcgtctccatctcctgctccggcatcacctcctccctcggctcaaaccacatgtcctggtaccaacaactccccggcaccgcccccaaactcctcatctacgaaaacaacaaacgcccctcaggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56284 - RNA, 333 nt, synthetic construct
  misc_feature 1..333: note = derived and/or modified sequence opt11 from anti-HIV_038-075067_VR-Chain
  source 1..333: mol_type = other RNA
caatccgtcctcacccaacccccctccgtctccggcgcccccggccaacgcgtcaccatctcctgctccggctcctcctccaccatcggcaacaactacgtctcctggtaccaactcctccccggcaccgcccccaaactactaatctacaaaaacaacaaacgcccctccggcatccccgaccgattctccggctccaaatccggcacctccgccaccctcggcatcaccggcctccaaaccggcgacgaagccgactactactgcggcacctgggacacctccctctccgccggcggcgtcttcggcaccggcaccaaagtcaccgtcctc

SEQ ID NO: 56285 - RNA, 333 nt, synthetic construct
  misc_feature 1..333: note = derived and/or modified sequence opt11 from anti-HIV_038-072368_VR-Chain
  source 1..333: mol_type = other RNA
caatccgtcctcacccaatccccctccgcctccggcacccccggccaacgcgtcaccatctcctgctccggctcctcctccaacatcggcaacaactacgtctcctggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56286 - RNA, 333 nt, synthetic construct
  misc_feature 1..333: note = derived and/or modified sequence opt11 from anti-HIV_038-068503_VR-Chain
  source 1..333: mol_type = other RNA
caatccgtcctcacccaacccccctccgtctccgccgcccccggccaaatggtcaccatctcctgctccggctcccgctccaacatcgaaaaccactacgtctcctggtaccaacacctccccggcgccgcccccaaactcctcatctacgacaacggcaaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56287 - RNA, 333 nt, synthetic construct
  misc_feature 1..333: note = derived and/or modified sequence opt11 from anti-HIV_038-068016_VR-Chain
  source 1..333: mol_type = other RNA
caatccgtcctcacccaacccccctccgcctccggcacccccggccaacgcgtcaccatctcctgctccggatcatcctccaacatcgaatccaacttcgtctactggtaccaacaattccccggcaccacccccaaactcctaatctaccgcgacggccaacgcccctccggcatccccgaccgcttctccggctccaaatccggcacctccgccaccctcggcatcaccggcctccaaaccggcgacgaagccgactactactgcggcacctgggactcctccctctccgccggcggcgtcttcggcaccggcacaaaagtcaccgtcctc

SEQ ID NO: 56288 - RNA, 333 nt, synthetic construct
  misc_feature 1..333: note = derived and/or modified sequence opt11 from anti-HIV_038-063958_VR-Chain
  source 1..333: mol_type = other RNA
caatccgtcctcacccaacccccatccgtctccggcgcccccggccaacgcgtcaccatctcctgcaccggctcctcctccaacatcggcaactccggcgtccactggtaccaacaactccccggcaccgcccccaaactcctcatctacgaaaacaacaaacgcccctccggcatccccgaccgcttctccggctccaaatccggcacctccgccaccctcggcatcaccggcctccaaaccggcgacgaagccgactactactgcggcacctgggactcctccctatccgccggcggcgtcttcggcaccggcaccaaagtcaccgtcctc

SEQ ID NO: 56289 - RNA, 333 nt, synthetic construct
  misc_feature 1..333: note = derived and/or modified sequence opt11 from anti-HIV_038-033733_VR-Chain
  source 1..333: mol_type = other RNA
caatccgtcctcacccaacccccctccgcctccggcacccccggccaacgcgtcaccatctcctgctccggctcctcctccaacatcggctccaaatacgtctactggtaccaacaactccccggcaccgcacccaaactcctcatctacgacaacgacaaacgcccctccggcatccccgaccgcatctcagcctccaaatccggcacctccgccaccctcgacatcacccgcctccaaaccggcgacgaagccgactactactgcggcacctgggactcctccctctccgccggcggcgtcttcggcaccggcaccaaagtcacagtcctc

SEQ ID NO: 56290 - RNA, 333 nt, synthetic construct
  misc_feature 1..333: note = derived and/or modified sequence opt11 from anti-HIV_038-030557_VR-Chain
  source 1..333: mol_type = other RNA
caatccgtcctcacccaacccccctccgtctccgccgcccccggccaaaaagtcaccatatcctgctccggctcctcctccaccatcggcaacaactacgtctcctggtaccaactcctccccggcaccgcccccaaactcctcatctacaaaaacaacaaacgcccctccggcatccccgaccgcttctccggctccaaatccggcacctccgccaccctcggcatcaccggcctccaaaccggcgacggcgccgactactactgcggcacctgggacacctccctctccgccggcggcgtcttcggcaccggcaccatcgtcaccgtcctc

SEQ ID NO: 56291 - RNA, 333 nt, synthetic construct
  misc_feature 1..333: note = derived and/or modified sequence opt11 from anti-HIV_038-024298_VR-Chain
  source 1..333: mol_type = other RNA
caatccgtcctcacccaacccccctccgtctccgccgcccccggccaaaaagtcaccatctcctgctccggctcctcctccaacatcggcaactcccacgtctcctggtaccaacaattccccggcaccggccccaaactcctcatctacgaaaacgccaaacgcccctccggcatccccgaccgcatctccggctccaaatccgacacctccgccaccctcggcatcaccggcctccaaaccggcgacgaagccgactactactgcggcacctgggactcctccctctccgccggcggcgtcttcggcaccggcaccaaagtcaccgtcctc

SEQ ID NO: 56292 - RNA, 333 nt, synthetic construct
  misc_feature 1..333: note = derived and/or modified sequence opt11 from anti-HIV_038-011154_VR-Chain
  source 1..333: mol_type = other RNA
caatccgtcctcacccaacccccctccgtctccgccgcccccggccaacgcatcaccatctcctgctccggctcctcatccaacatcggcaacaactacgtctcctggtaccaacaactacccggcaccgcccccaaactcctcatctacaaaaacaacaaacgcccctccggcatccccgaccgcttctccggctccaaatccggcacctcagccaccctcggcatcaccggcctccaaaccggcgacgaagccgactactactgcggcacctgggacacctccctctcagccggcggcgtcttcggcaccggcaccaaagtcaccgtcctc

SEQ ID NO: 56293 - RNA, 318 nt, synthetic construct
  misc_feature 1..318: note = derived and/or modified sequence opt11 from anti-HIV-1_LightChain
  source 1..318: mol_type = other RNA
gagatcgtgctcacgcaatcgcccgggaccttgagcctgagcccgggcgagcgcgcgaccttgagctgtcgcgcgagccagagcgtgagcaataactttctcgcgtggtatcaatataaaccgggccagcccccgcgcgtgctcatatacgggacctcgcgcagggcctcgggcatacccgatcgctttagcgggagcgggagcgggaccgatggctcgctcacgatctcgcgcttggaagcggaagatttcgcggtctattactgtcaacagtacgagttctttggccagggcacgcgcttggaaatgaaaaggacc

SEQ ID NO: 56294 - RNA, 318 nt, synthetic construct
  misc_feature 1..318: note = derived and/or modified sequence opt11 from anti-HIV-1_LightChain
  source 1..318: mol_type = other RNA
gaagtcgtcctcacccaatcccccggcaccctctccctctcccccggcgaacgcgccaccctctcctgccgcgcctcccaatccgtctcccgaaactacctcgcctggtaccaacaaaaactcggccacggcccccgcctcctcgtctacgccacctcccgccgcgccaccggcatccccgaccgcttcatcggctcccaatccggcaccgaatacaacctcaccatcacccgcctcgaccccggcgacttcgcccaatacttctgccaacaatacgaattcttcggccccggcacccgcctcgacatcaaacgcacc

SEQ ID NO: 56295 - RNA, 309 nt, synthetic construct
  misc_feature 1..309: note = derived and/or modified sequence opt11 from anti-HIV-1_LightChain
  source 1..309: mol_type = other RNA
gaagtcgtcctcacccaatcccccggcaccctctccctctcccccggcgaacgcgcctccttctcctgcaaatcctcccaatacggccacaccgcctggtaccaacaaaaactcggccacggcccccgcctcctcatctacgccacctcccgccgcgccaccggcatccccgaccgcttcatcggatcccaatccggcaccgaatacaacctcaccatcacccgcctcgaccccggcgacttcgcccactacttctgccaacaaaacgaattcttcggccccggcacccgcctcgacatgaaacgcacc

SEQ ID NO: 56296 - RNA, 306 nt, synthetic construct
  misc_feature 1..306: note = derived and/or modified sequence opt11 from anti-HIV-1_LightChain
  source 1..306: mol_type = other RNA
gaaatcgtcctcacccaatccccctcctccctctccctctcccccggcgaacgcgcctccctctcctgccgcggctcccacggccacgtcgcctggtaccaacacaaacccggccaaatcccccgcctcctcatctacgccacctccaaacgcgcctccggcatctccgaccgcttctccggctccggctccggcaccgacgccaccctatccatctcccgcctcgaacccgaagacttcgccgtctacttctgccaacaatacgaattcttcggccaaggcacccgcctcgaaataaaacgcacc

SEQ ID NO: 56297 - RNA, 306 nt, synthetic construct
  misc_feature 1..306: note = derived and/or modified sequence opt11 from anti-HIV-1_LightChain
  source 1..306: mol_type = other RNA
gaaatcatgctcacccaatcccccggcaccctctccctctcccccggcgaacgcgccaccctctcctgccgcggctcccacggccacgtcgcctggtaccaacaaaaacccggccgaatcccccgcctcctcatctacggcacctccaaacgcgcctccggcatccccgaccgcttctccggctccggctccggcaccgacgccaccctcaccatctcccgcctcgaatccgaagacttcgccgtctacttctgccaacaatacgaattcttcggccaaggcacccgcctcgacatcaaccgcacc

SEQ ID NO: 56298 - RNA, 309 nt, synthetic construct
  misc_feature 1..309: note = derived and/or modified sequence opt11 from anti-HIV-1_LightChain
  source 1..309: mol_type = other RNA
gaatccgtcctcacccaatcccccggcaccctctccctctcacccggcgaaaccgcctccctctcctgcaccgccgccctctacggccacatgacctggtaccaaaaaaaacccggccaaccccccaaactcctcctctacgcctcctccaaacgcgcctccggcatccccgaccgcttctccggctcccaattcggcaaacaatacaccctaatcatcaccaaaatggaacccgaagacttcgccgaatactactgccaacaattcgaagtcttcggccaaggcacccgcctcgacatgcgccgcacc

SEQ ID NO: 56299 - RNA, 306 nt, synthetic construct
  misc_feature 1..306: note = derived and/or modified sequence opt11 from anti-HIV-1_LightChain
  source 1..306: mol_type = other RNA
gaagtcgtcctcacccaatcccccggcaccctctccctctcccccggcgaacgcgccaccctctcctgccgcggctcccacggccacctctcctggtaccaatacaaacccggccaacccccccgcgtcctcatctacggcacctcccgccgcgcctccggcatccccgaccgcttctccggctccggctccggcaccgacggctccctcaccatctcccgcctcgaagccgaagacttcgccgtctactactgccaacaatacgaattcttcggccaaggcacccgtctcgaaatgaaacgcacc

SEQ ID NO: 56300 - RNA, 309 nt, synthetic construct
  misc_feature 1..309: note = derived and/or modified sequence opt11 from anti-HIV-1_LightChain
  source 1..309: mol_type = other RNA
gaagtcgtcctaacccaatccccaggcaccctctcactctcccccggcgaacgcgcctcactctcctgcaaatcctcccaatacggccacaccgcctggtaccaacaaaaactcggccaaggcccccgcctcctcatctacgccacctcacgccgcgccaccggcatccccgaccgcttctccggctcccaatccggcaccgaatacaacctcaccatcacccgcctcgaccccggcgacttcgcccaatacttctgccaacaatacgaattcttcggccccggcacccgcctcgacatcaaacgcacc

SEQ ID NO: 56301 - RNA, 306 nt, synthetic construct
  misc_feature 1..306: note = derived and/or modified sequence opt11 from anti-HIV-1_LightChain
  source 1..306: mol_type = other RNA
gaaatcatgctcacccaatcccccggcaccctctccctctcccccggcgaacgcgccaccctctcctgccgcggctcccacggccacgtcgcctggtaccaacaaaaaccaggccgcatcccccgcctcctcatctacggcacctccaaacgcgcctccggcatccccgaccgcttctccggctccggctccggcaccgacgccaccctcaccatctcccgactcgaatccgaagacttcgccgtctactactgccaacaatacgaattcttcggccaaggcacccgcctcgacatcaaacgcacc

SEQ ID NO: 56302 - RNA, 309 nt, synthetic construct
  misc_feature 1..309: note = derived and/or modified sequence opt11 from anti-HIV-1_LightChain
  source 1..309: mol_type = other RNA
gaatccgtcctcacccaatcccccggcaccctctccctctcccccggcgaaaccgcctccctctcctgcaccgccgcctcctacggccacatgacctggtaccaaaaaaaacccggccaaccccccaaactcctcatcttcgccacctccaaacgcgcctccggcatccccgaccgcttctccggctcccaattcggcaaacaatacaccctcaccatcacccgcatggaacccgaagacttcgccggctactactgccaacaagtcgaattcttcggccaaggcacccgcctcgaaatacgccgcacc

SEQ ID NO: 56303 - RNA, 309 nt, synthetic construct
  misc_feature 1..309: note = derived and/or modified sequence opt11 from anti-HIV-1_LightChain
  source 1..309: mol_type = other RNA
gacatccaaatgacccaatccccctcctccctctccgcctccgtcggcgaccgcgtcaccatcacctgccaagcctcccaagacatctccaactacctcaactggtaccaacaaaaacccggcaaagcccccaaactcctcatctacgacgcatccaacctcgaaaccggcgtcccctcccgcttctccggctccggcttccacaccaccttctccctcaccatctccggcctccaacgcgacgacttcgccacctacttctgcgccgtcctcgaattcttcggccccggcaccaaagtcgacttcaac

SEQ ID NO: 56304 - RNA, 309 nt, synthetic construct
  misc_feature 1..309: note = derived and/or modified sequence opt11 from anti-HIV-1_LightChain
  source 1..309: mol_type = other RNA
gacatccaaatgacccaatccccctcctccctctccgcctccgtcggcgaccgcgtcaccatcacctgccaagcctcccaagacatcaccaactacctcaactggtaccaacaaaaacccggccgcgcccccaaactcctcgtccacggcgcctccaacctccaacgcggcgtcccctcccgcttctccggctccggcttccacaccaccttcaccctcaccatctcctccctccaacccgacgacgtcgccacctacttctgcgaagtcttccaatggttcggccccggcacccgcgtcgacttcaac

SEQ ID NO: 56305 - RNA, 309 nt, synthetic construct
  misc_feature 1..309: note = derived and/or modified sequence opt11 from anti-HIV-1_LightChain
  source 1..309: mol_type = other RNA
ggcttccaactcacccaatccccctcctccctctccgcctccgtcggcgaccgcgtctccatcaactgccaagccggcgaaggcatcggctcctccctcaactggtaccaacaaaaacccggccgcgcccccaaactcctcgtccacggcgcctccaacctccaacgcggcgtcccctcccgattctccggctccggcttccacaccaccttcaccctaaccatctcctccctccaacccgacgacgtcgccacctacttctgcgaagtcttccaatggttcggccccggcacccgcgtcgacttcaac

SEQ ID NO: 56306 - RNA, 309 nt, synthetic construct
  misc_feature 1..309: note = derived and/or modified sequence opt11 from anti-HIV-1_LightChain
  source 1..309: mol_type = other RNA
ggcatccaactcacccaatccccctcctccctctccgtctccgtcggcgaccgcgtcaccatcacctgccgcgcctcccaaggcatcggcaactccctcaactggtaccaacaaaaacccggcaaagcccccaacctcatggtcttcggcaccaccaaactcaaccgcggcgtcccctcccgcttctccggctccggctccggcaccaccgccaccctcaccatcaactccctccaacccgaagacatcgccacctacttctgccaagtcttcgaattcctcggccccggcaccaaactcgacatgaaa

SEQ ID NO: 56307 - RNA, 309 nt, synthetic construct
  misc_feature 1..309: note = derived and/or modified sequence opt11 from anti-HIV-1_LightChain
  source 1..309: mol_type = other RNA
gacatccaaatgacccaatccccctcctccctctccgcctccgtaggcgaccgcgtcaccatcacctgccaagccggccaaggcatcggctcatccctcaaatggtaccaacaaaaacccggccgcgccccccgcctcctcgtccacggcgcctccaacctccaccgcggcgtcccctcccgcttctccggctccggcttccacaccaccttctccctcaccatctccggcctccaacgcgacgacttcgccacctacttctgcgccgtcctcgaattcttcggccccggcaccaaagtcgacttcaac

SEQ ID NO: 56308 - RNA, 309 nt, synthetic construct
  misc_feature 1..309: note = derived and/or modified sequence opt11 from anti-HIV-1_LightChain
  source 1..309: mol_type = other RNA
ggcatccaactcacccaatccccctcatccctctccgcctccgtcggcgaccgcgtcaccatcacctgccaagcctcccaaggcatcggctcctccctccaatggtaccaacaaaaacccggccgcgcccccaacctcctcgtccacggcgcctccaacctccaccgcggcgtcccctcccgcttctccggctccggcttccacaccaccttctccctcaccatctccggcctccaacgcgacgacttcgccacctacttctgcgccgtcctagaattcttcggccccggcaccaaagtcgaaatcaaa

SEQ ID NO: 56309 - RNA, 309 nt, synthetic construct
  misc_feature 1..309: note = derived and/or modified sequence opt11 from anti-HIV-1_LightChain
  source 1..309: mol_type = other RNA
ggcgtccaactcacccaatccccctcctccctctccgcctccgtcggcgaccgcgtctccatcaactgccaagccggccaaggcatcggctcctccctcaactggtaccaacaaaaacgcggcaaagcccccaaactcctcgtccacggcgcctccaccctccaacgcggcgtcccctcccgcttctccggctccggcttccacaccaccttcaccctcaccatctcctccctccaacccgacgacgtcgccacctacttctgcgaagtcttccaatggttcggccccggcacccgcgtcgacttcaac

SEQ ID NO: 56310 - RNA, 306 nt, synthetic construct
  misc_feature 1..306: note = derived and/or modified sequence opt11 from anti-HIV-1_LightChain
  source 1..306: mol_type = other RNA
tacatccaactcacccaatccccctcctccctctccgcctccatcggcgaccgcgtcaccatcgcctgccgcgcctcccaaggcatcggctacgtccactggtaccaacaaaaacgcggcaaaccccccaaactcctcatccacggcgcctccatcctcgaacgcggcgtcccctcccgcttctccggctccggctccggcaccctcttcaacctaaccgtctccggcctccaacccgaagacttcgccacctacatgtgccaagtcttcgaatccttcggccccggcaccaaagtccaaatgaaa

SEQ ID NO: 56311 - RNA, 309 nt, synthetic construct
  misc_feature 1..309: note = derived and/or modified sequence opt11 from anti-HIV-1_LightChain
  source 1..309: mol_type = other RNA
ggcatccaactcacccaatccccctcctccctctccgcctccctcggcgaccgcgtcaccatcacctgccaagcctcccaaggcatcggctcctccctccaatggtaccaacaaaaacccggcaaagcccccaaactcctcgtccacggcgcctccaaactccaccgcggcgtcccctcccgcttctccggctccggcttccacaccaccttctccctcaccatctcctccctacaacccgaagacttcgccacctacctctgccaagtcctcgaattcttcggccccggcaccaaagtcgacttcaac

SEQ ID NO: 56312 - RNA, 309 nt, synthetic construct
  misc_feature 1..309: note = derived and/or modified sequence opt11 from anti-HIV-1_LightChain
  source 1..309: mol_type = other RNA
ggcatccaactcacccaatccccctcctccctctccgcctccgtcggcgacaccgtcaccatcacctgccaagcctcccaaggcatcggctcctccctccaatggtaccaacaaaaacgcggccgcgcccccaaactcctcgtccacggcgcctccaacctccaaggcggcgtcccctcccgcttctccggctccggcttccacaccaccttcaccctcgccatccgcggcctccaacccgacgacttcgccacctacttctgccaatccctcgaattcttcggccccggcaccaaagtcgacatgaaa

SEQ ID NO: 56313 - RNA, 306 nt, synthetic construct
  misc_feature 1..306: note = derived and/or modified sequence opt11 from anti-HIV-1_LightChain
  source 1..306: mol_type = other RNA
tacatccaactcacccaatccccctcctccctctccgcctccgtcggcgaccgcgtcaccatcacctgccgcgcctcccaagacatcggctacgtctcctggtacgcccaaaaacgcggccgcgcccccaaactcctcatccacggcgcctccggcctcgaacgcggcgtaccctcccgcttctccggctccggctccggcaccctcttcaccctcaccatcgaatccctccaacccgaagacttcgccacctacatgtgccaagtcttcgaatccttcggccccggcaccaaagtcgaaatgaaa

SEQ ID NO: 56314 - RNA, 309 nt, synthetic construct
  misc_feature 1..309: note = derived and/or modified sequence opt11 from anti-HIV-1_LightChain
  source 1..309: mol_type = other RNA
ggcatccaactcacccaatccccctcctccctctccgcctccgtcggcgaccgcgtctccatcaactgccaagccggccaaggcatcggctcctccctcaactggtaccaacaaaaacccggccgcgcccccaaactcctcgtccacggcgcctccaacctccaacgcggcgtcccctcacgcttctccggctccggcttccacaccaccttcaccctcaccatctcctccctccaacccgacgacgtcgccacctacttctgcgccgtcttccaatggttcggccccggcacccgcgtcgacttcaac

SEQ ID NO: 56315 - RNA, 366 nt, synthetic construct
  misc_feature 1..366: note = derived and/or modified sequence opt11 from anti-HIV-1_HeavyChain
  source 1..366: mol_type = other RNA
agccagcaattggtccagagcgggacccaggtcaagaaaccgggcgcgagcgtacgcataagctgtcaagcgagcgggtacacgttcacggactatgtcctgcactggtggaggcaagcacccgggcaagggctcgagtggatgggctggatcaagcccgtgtacggggccaggaactatgccaggcgctttcaagggcgcatagacttcagcagggacatatacagggaaatagcctatatggatctctcgggcttgcgctcggacgataccgcgctctatttctgtgccagggacgggagcggggacgatacctcgtggcatctcgatccatggggccagggcacgctcgtgatcgtgagcgcg

SEQ ID NO: 56316 - RNA, 366 nt, synthetic construct
  misc_feature 1..366: note = derived and/or modified sequence opt11 from anti-HIV-1_HeavyChain
  source 1..366: mol_type = other RNA
tcgcaacagctcgtgcaatcgggcacgcaagtgaaaaagcccggggcctcggtcaggatctcgtgccaggcctcgggctatacctttaccgattacttgctccattggtggcgccaggccccgggccagcgcttggaatggatggggtggataaaaccggtctatggcgcgcgcaattacgcgcacaggttccagggcaggatcaatttcgatcgcgatatctatcgcgagatcgcgttcatggacttgagcgggctcaggagcgatgacacggccgtgtacttttgcgcgcgcgatggcgggggcgatgacaggacctggctcttggacacgtgggggcaagggaccttggtcgtggtctcgagc

SEQ ID NO: 56317 - RNA, 366 nt, synthetic construct
  misc_feature 1..366: note = derived and/or modified sequence opt11 from anti-HIV-1_HeavyChain
  source 1..366: mol_type = other RNA
caagtccacctcgaacaacccggctccgtcgtccgctggcccggcgcctccctcaccctctcctgcaccgcctccggctacatcttcgtcaactaccacatccactggctccgccaagcccccggccaacgcctcgaactcctaggcaccatcaaccccgtcggcggcgccacctcctacgcccaaaaattccgcggccgactcgtcctcacccgcgacatcggctcctccaccgtcaccctcctcctcaaccacctccgccgcgacgactccgccgtctacttctgcgcccgcgaatccaacgcctccggccgcggccgctccatggaccactggggccgcggctcccgcgtcatcgtctcccaa

SEQ ID NO: 56318 - RNA, 366 nt, synthetic construct
  misc_feature 1..366: note = derived and/or modified sequence opt11 from anti-HIV-1_HeavyChain
  source 1..366: mol_type = other RNA
caagtgcaattggtccagagcggggccgaggtcaagaaaccgggcgcgagcgtgcgcgtgagctgtcaagcgagcgggtacacgttcacgaactacatcttgcactggtggaggcaagcgcccgggcaagggctcgagtggatgggcttgatcaagcccgtgtacggggccgtgaactatgccaggcaatttcaagggcgcatacaattgaccagagacatatacagggaaatagcctttctcgatctctcgggcctgcgctcggacgataccgcagtctattactgtgccagagacgagagcggggacgatctcaagtggcatctccatccctggggccagggcacgcaagtgatcgtgagcccg

SEQ ID NO: 56319 - RNA, 366 nt, synthetic construct
  misc_feature 1..366: note = derived and/or modified sequence opt11 from anti-HIV-1_HeavyChain
  source 1..366: mol_type = other RNA
caggtccagctcgtgcaatcgggcgcggaagtgaaaaagcccggggcctcggtcaggatctcatgccaggcctcgggctatacctttaccgattacgtgctccattggtggcgccaggccccgggccagggcttggaatggatggggtggataaaaccggtctatggcgcgcgcaattacgcgcgcaggttccagggcaggatcaacttcgatcgcgatatctatcgcgagatcgcgtacatggacttgagcgggctcaggagcgatgacacggccaggtacttttgcgcgcgcgatggctcgggcgatgacacgagctggcacttgcacccgtgggggcaagggaccttggtcatagtctcggcc

SEQ ID NO: 56320 - RNA, 366 nt, synthetic construct
  misc_feature 1..366: note = derived and/or modified sequence opt11 from anti-HIV-1_HeavyChain
  source 1..366: mol_type = other RNA
tcacaacaactcgtccaatccggcacccaagtcaaaaaacccggcgcctccgtccgagtctcctgccaagcctccggctacaccttcaccaactacatcctccactggtggcgccaagcccccggccaaggcctcgaatggatgggcctcatcaaacccgtctacggcgccgtcaactacgcccgccaattccaaggccgcatccaactcacccgagacatctaccgcgaaatcgccttcctcgacctctccggcctccgcaccgacgacaccgccgtctactactgcgcccgcgacgaatccggcgacgacctcaaatggcacctacacccctggggccaaggcacccaagtcatcgtctccccc

SEQ ID NO: 56321 - RNA, 366 nt, synthetic construct
  misc_feature 1..366: note = derived and/or modified sequence opt11 from anti-HIV-1_HeavyChain
  source 1..366: mol_type = other RNA
caagtccacctcgaacaatccggctccgtcgtccgctggcccggcgcctccctcaccctctcctgcaccgcctccggctacatcttcgtcaactaccacatccactggctccgccaagcccccggccaacgactcgaactcatgggcaccatcaaccccgtcggcggcgccacctcctacacccaacgcttccgcggccgcctcgtcctcacacgcgacatcggctccaacaccgtcaccctcctcctcaaccacctccgctccgacgactccgccgtctacttctgcgcccgcgaatccaacgcctccggccgaggccgctccatggaccactggggccgcggctcccacgtcatcgtctcaccc

SEQ ID NO: 56322 - RNA, 366 nt, synthetic construct
  misc_feature 1..366: note = derived and/or modified sequence opt11 from anti-HIV-1_HeavyChain
  source 1..366: mol_type = other RNA
tcccaacacctcgtccaatccggcacccaagtcaaaaaacccggcgcctccgtccgcgtctcctgccaagcctccggctacaccttcaccaactacatcctccactggtggcgccaagcccccggccaaggcctagaatggatgggcctaatcaaacccgtctacggcgccgtcaactacgcccgacaattccaaggacgcatccaactcacccgcgacatctaccgcgacatcgccttcctcgacctctccggcctccgctccgacgacaccgccgtatactactgcgcccgcgacgaatccggcgacgacctcaaatggcacctccacccctggggccaaggcacccaagtcatcgtctccccc

SEQ ID NO: 56323 - RNA, 366 nt, synthetic construct
  misc_feature 1..366: note = derived and/or modified sequence opt11 from anti-HIV-1_HeavyChain
  source 1..366: mol_type = other RNA
tcccaacaactcgtccaatccggcacacaagtcaaaaaaccaggcgcctccgtccgcatctcctgccaagcctccggctacaccttcaccgactacgtcctccactggtggcgacaagcccccggccaaggcctcgaatggatgggctggatcaaacccgtctacggcgcccgcaactacgcccgccgcttccaaggccgcatcaacttcgaccgcgacatctaccgcgaaatcgcctacatggacctctccggcctccgatccgacgacaccgcccgctacttctgcgcccgcgacggctccggcgacgacacctcctggcacctccacccctggggccaaggcaccctcgtcatcgtctccgcc

SEQ ID NO: 56324 - RNA, 366 nt, synthetic construct
  misc_feature 1..366: note = derived and/or modified sequence opt11 from anti-HIV-1_HeavyChain
  source 1..366: mol_type = other RNA
caagtccacctcgaacaacccggctccgtcgtccgctggcccggcgcctccctaaccctctcctgcaccgcctccggctacatcttcgtaaactaccacatccactggctacgccaagcccccggccaacgcctcgaactcctcggcaccatcaaccccgtcggcggcgccacctcctacgcccaaaaattccgcggccgactcgtcctcacccgcgacatcggctcctccaccgtcaccctcctcctcaaccacctccgccgcgacgactccgccgtctacttctgcgcccgcgaatccaacgcctccggccgcggccgctccatggaccactggggccgcggcaaacccgtcatcgtctccccc

SEQ ID NO: 56325 - RNA, 321 nt, synthetic construct
  misc_feature 1..321: note = derived and/or modified sequence opt11 from anti-HIV-1_HeavyChain
  source 1..321: mol_type = other RNA
gaaatcgtcatgacccaatcccccgccatcctctccgtctcccccggcgaccgcgccaccttctcctgccgcgcctcccaatccgtcaaaaacaacctagcctggtaccaaaaacgccccggccaagccccccgcctcctcatcttcgacgcctcctcccgcgcctccggcatccccgcccgcttctccggcggcggctccggcaccgaattcaccctcaccgtcaactccatgcaatccgaagacttcgccacctactactgccaacaatacgaagaatggccccgcaccttcggccaaggcaccaaagtcgaaatcatg

SEQ ID NO: 56326 - RNA, 321 nt, synthetic construct
  misc_feature 1..321: note = derived and/or modified sequence opt11 from anti-HIV-1_HeavyChain
  source 1..321: mol_type = other RNA
caaatcgtcctcacccaatccccccccaccctatccctctcccccggcgaacgcgccaccctctcctgccgcgcctcccaatccgtcaaaaacaacctcgcctggtaccaaaaacgccccggccaagccccccgcctcctcatcttcgacacctcctcccgcgcctccaacatccccgcccgattctccggcggcggctccggcaccgaattcaccctcaccgtcaactccatgcaatccgaagacttcgccacctactactgccaacaatacgaagaatggccccgcaccttcggccaaggcaccaaagtcgaaatcatc

SEQ ID NO: 56327 - RNA, 321 nt, synthetic construct
  misc_feature 1..321: note = derived and/or modified sequence opt11 from anti-HIV-1_HeavyChain
  source 1..321: mol_type = other RNA
gaaatcgtcatgacccaatcccccgccgtcctctcagtctcccccggcgaccgcgccaccctctcctgccgcgcctcccaatccgtcaaaaacaacctcgcctggtaccaaaaacgccccggccaagccccccgcctcctcatcttcgacacctcctcccgcgcctccaacatccccgcccgcttctccggcggcggctccggcaccgaattcaccctcaccgtcaactccatgcaatccgaagacttcgccacctactactgccaacaatacgaagaatggccccgcaccttcggccaaggcaccaaagtcgaaatcaac

SEQ ID NO: 56328 - RNA, 321 nt, synthetic construct
  misc_feature 1..321: note = derived and/or modified sequence opt11 from anti-HIV-1_HeavyChain
  source 1..321: mol_type = other RNA
gaaatcgtcctcacccaatccccccccaccctctccgtctcccccggcgaagccgccaccctctcctgccgcgcctcccaatccgtcaaaaacaacctcgcctggtaccacctcaaagccggccaagccccccgcctcctcatcttcgacgcctcctcccgcgccggcgacgcccccgcccgcgtatccggctccggctacggcaccgaattcaccctcaccgtcaactccgtccaatccgaagacttcggcgactactactgccaacaatacgaagaatggccccgcaccttcggccaaggcaccaaagtcgacctccgc

SEQ ID NO: 56329 - RNA, 321 nt, synthetic construct
  misc_feature 1..321: note = derived and/or modified sequence opt11 from anti-HIV-1_HeavyChain
  source 1..321: mol_type = other RNA
gaaatcgtcatgacccaatccccccccaccctctccgtctcccccggcgaaaccgccaccctctcctgccgcgcctcccaaaacgtcaaaaacaacctcgcctggtaccaactcaaacccggccaagccccccgcctcctaatcttcgacgcctcatcccgcgccggcggcatccccgaccgcttctccggctccggctacggcaccgacttcaccctcaccgtcaactccgtccaatccgaagacttcggcgactacttctgccaacaatacgaagaatggccccgcaccttcggacaaggcaccaaagtcgacctccgc

SEQ ID NO: 56330 - RNA, 321 nt, synthetic construct
  misc_feature 1..321: note = derived and/or modified sequence opt11 from anti-HIV-1_HeavyChain
  source 1..321: mol_type = other RNA
gaaatcgtcatgacccaatcccccgccgtcctctccgtctcccccggcgaccgcgccaccctctcctgccgcgcctcccaatccgtcaaaaacaacctcgcctggtaccaaaaacgccccggccaagccccccgcctcctcatcttcgacacctcctcccgcgcctccaacatccccgcccgcttctccggcggcggctccggcaccgaattcaccctaaccgtcaactccatgcaatccgaagacttcgccacctactactgccaacaatacgaagaatggccccgcaccttcggccaaggcaccaaagtcgaaatcatc

SEQ ID NO: 56331 - RNA, 399 nt, synthetic construct
  misc_feature 1..399: note = derived and/or modified sequence opt11 from anti-HIV-1_HeavyChain
  source 1..399: mol_type = other RNA
gaagtacacctccaagaatccggccccggcctcgtccgccccctcgaaaccctctccctcacctgcaccgcctccggcgcctccatccgcggcggcgaatggggcgacaacgactaccactggggctgggtccgacactcccccgaaaaaggcctcgaatggatcggctccatccactggcgcggcaccacccactacaacgcccccttccgcggccgcgccaccctctccatcgacacctcccgcaaccaattcttcctccgcctcacctccatgaccgccgacgacaccgccgtctactactgcgtcaaacacaaataccacgacatcgtcatggtcgtccccatcgccggctggttcgacccctggggccaaggcctccaagtcaccgtctccgcc

SEQ ID NO: 56332 - RNA, 399 nt, synthetic construct
  misc_feature 1..399: note = derived and/or modified sequence opt11 from anti-HIV-1_HeavyChain
  source 1..399: mol_type = other RNA
gaagtccacctccaagaatccggccccggcctcgtccgccccctcgaaacactctccctcacatgcaccgcctccggcgcctccatccgcggcggcgaatggggcgacaacgactaccactggggctgggtccgccactcccccgaaaaaggcctcgaatggatcggctccatccactggcgcggcaccacccactacaacgcccccttccgcggccgcgccaccctctccatcgacacctcccgcaaccaattcttcctccgcctcacctccatgaccgccgacgacaccgccgtctactactgcgtcaaacacaaataccacgacatcgtcatggtcgtccccatcgccggctggttcaacccctggggccaaggcctccaagccaccgtcccctcc

SEQ ID NO: 56333 - RNA, 399 nt, synthetic construct
  misc_feature 1..399: note = derived and/or modified sequence opt11 from anti-HIV-1_HeavyChain
  source 1..399: mol_type = other RNA
caagtccaactcaaagaatccggccccggcctcgtcaaaccctccgaaacactctccctaacctgcaccgtctccggcggctccatgcgcggcaccgactggggcgaaaacgacttccactacggctggatccgccactcctccgccgaaggcctcgaatggatcggctccatccactggcgcggcaccacccactacaaaatgtccttccgctcccgcgccaccatctccatcgacacctccaacaaccgattctccctcatgttctccttcgtcaccgccgaagacaccgccgtctactactgcgcccgccacaaataccacgacatcttccgcgtcgtccccgtcgccggctggttcgacccctggggccaaggcctcctcgtcaccgtctcctcc

SEQ ID NO: 56334 - RNA, 399 nt, synthetic construct
  misc_feature 1..399: note = derived and/or modified sequence opt11 from anti-HIV-1_HeavyChain
  source 1..399: mol_type = other RNA
gaagtccacctccaagaatccggccccggcctcgtccgccccctcgaaaccctctccctcacctgcaccgcctccggcgcctccatccgcggcggcgaatggggcgacaacgactaccactggggctgggtccgccactcccccgaaaaaggcctcgaatggatcggctccatccactggcgcggcaccacccactacaacgcccccttccgcggccgcgccaccctctcaatcgacacctccaaaaaccaattctcactccgcctcacctccatgaccgccgacgacaccgccgtctactactgcgtaaaacacaaataccacgacatcgtcatggtcgtccccttcgccggctggttcgacccctggggccaaggcctccgcgtcaccgtctccgca

SEQ ID NO: 56335 - RNA, 399 nt, synthetic construct
  misc_feature 1..399: note = derived and/or modified sequence opt11 from anti-HIV-1_HeavyChain
  source 1..399: mol_type = other RNA
gaagtgcatctgcaagagagcgggcccggactcgtgcgaccgctcgagaccttgagcttgacctgtaccgcgagcggggcctcgatcaggggcggggaatggggcgataacgattaccactgggggtgggtacgacatagcccggaaaagggcctggaatggatcgggagcatacactggcgcgggaccacgcactataacgcgccctttcgcgggcgcgcgaccctgagcatagacacgagcaagaaccagttctttctcaggctcacgagcatgaccgcggacgatacagcggtctattactgtgtcaagcacaagtaccatgacatatgcatggtcgtgcccatagccgggtggtttgacccgtgggggcaaggactccaggtcacggtctcgcaa

SEQ ID NO: 56336 - RNA, 399 nt, synthetic construct
  misc_feature 1..399: note = derived and/or modified sequence opt11 from anti-HIV-1_HeavyChain
  source 1..399: mol_type = other RNA
caagtccacctccaagaatccggccccggactcgtccgccccctcgaaaccctctctctcacatgcaccgcatccggcgcctcaatccgaggcggagaatggggagacaacgactaccactggggctgggtccgccactcccccgaaaaaggcctcgaatggatcggctccatccactggcgcggcaccacccactacaacgcccccttccgcggccgcgccaccctctccatcgacacctcccgcaaccaattcttcctacgcctcacctcaatgacagccgacgacaccgccgtctactactgcgtcaaacacaaataccacgacatcgtcatggtcgtccccatcgccggctggttcgacccctggggacaaggcctccaagtcacagtctcctca

SEQ ID NO: 56337 - RNA, 399 nt, synthetic construct
  misc_feature 1..399: note = derived and/or modified sequence opt11 from anti-HIV-1_HeavyChain
  source 1..399: mol_type = other RNA
caagtgcatctgcaagagagcgggcccggactcgtgcgcccgctcgagaccctgagcctgacctgcaccgcgagcggggcctcaatcaggggcggggaatggggcgataacgattaccactgggggtgggtgcgccacagcccggaaaagggcctggaatggatcgggagcatacactggcgcgggaccacgcactataacgcgcccttccgcgggcgcgcaaccctgagcatagacacgagcaggaaccagttcttcctcagactcacgagcatgaccgcggacgataccgcggtctattactgtgtcaagcacaagtaccacgacatagtcatggtcgtgcccatagccgggtggtttgacccgtgggggcaagggctaagggtcacggtctcgcaa

SEQ ID NO: 56338 - RNA, 399 nt, synthetic construct
  misc_feature 1..399: note = derived and/or modified sequence opt11 from anti-HIV-1_HeavyChain
  source 1..399: mol_type = other RNA
caagtgcacttacaagagagcgggcccgggctcgtgcgcccgctcgagaccttgagcctaacctgtaccgcgagcggggcctcgatcaggggcggagaatggggcgataacgattaccattgggggtgggtgcgccacagcccgggcaagggactggaatggatcgggagcatacactggcgcgggaccacgcactacaacgcgccctttcgcgggcgcgcgaccctgagcatagacacgttcaggaaccagttctttctcaggctcacgagcatgaccgcggacgataccgcggtctattactgtgtcaagcacaagtaccatgacatagtcatggtcgtgcccatagccgggtggtttgacccgtgggggcaagggctccaggtcacggtctcgcaa

SEQ ID NO: 56339 - RNA, 399 nt, synthetic construct
  misc_feature 1..399: note = derived and/or modified sequence opt11 from anti-HIV-1_HeavyChain
  source 1..399: mol_type = other RNA
gaagtgcacttacaagagagcgggcccgggctcgtgcgcccgctcgagaccttgagcttgacctgtaccgcgagcggggcctcgataaggggcggggaatggggcgataacgattaccattgggggtgggtgcgccatagcccggaaaagggcttagaatggatcgggagcatacactggcgcgggaccacgcactataacgcgccctttcgcgggcgcgcgaccttgagcatagacacgagcaggaaccagttcttcctaaggctaacgagcatgacagcggacgataccgcggtctattactgtgtcaagcacaagtaccatgacatagtcatggtcgtgcccatagccgggtggtttgacccgtgggggcaagggctcaggggcacggtctcggcc

SEQ ID NO: 56340 - RNA, 393 nt, synthetic construct
  misc_feature 1..393: note = derived and/or modified sequence opt11 from anti-HIV-1_HeavyChain
  source 1..393: mol_type = other RNA
caagtgcaattggtccagagcggggccgtgatcaagaccccgggctcgagcgtgaaaataagctgtcgcgcgagcgggtacaatttcagggactatagcatacactgggtcaggctcataccagataaagggttcgagtggataggctggatcaagcccttgtggggcgccgtgagctatgccaggcaattgcaagggcgcgtgagcatgaccaggcaattgagcagggacccggacgatcccgattggggcgtcgcgtacatggaatttagcgggctcacgcccgcggacacggccgagtacttttgcgtacgcagggggtcgtgcgattactgtggggatttcccgtggcagtactggggccagggcacggtcgtggtcgtgagctcggcc

SEQ ID NO: 56341 - RNA, 393 nt, synthetic construct
  misc_feature 1..393: note = derived and/or modified sequence opt11 from anti-HIV-1_HeavyChain
  source 1..393: mol_type = other RNA
caagtgcaactggtccagagcggggccgtgatcaagaccccgggctcgagcgtgaaattgagctgtcgcgcgagcgggtacaatttcagggactatagtatacactgggtcaggctcatacccgataaagggttcgagtggataggctggataaagcccttgtggggcgccgtgagctatgccaggcaattgcaagggcgcgtgagcatgaccaggcaattgagccaggacccggacgatcccgattggggcgtcgcgtacatggaatttagcgggctaacgcccgcggacacggccgagtacttttgcgtgcgcagggggtcgtgcgattactgtggggatttcccgtggcagtactggggccagggcacggtcgtggtcgtgagctcggcc

SEQ ID NO: 56342 - RNA, 303 nt, synthetic construct
  misc_feature 1..303: note = derived and/or modified sequence opt11 from anti-HIV-1_LightChain
  source 1..303: mol_type = other RNA
accgccggcctcacccaatcccccggcaccctctccctctcccccggcgaacgcgccatcctctcctgccgcacctcccaatacggctccctcgcctggtaccaacaacgccccggccaagccccccgcctcgtcatctacgccggcctcacccgcgccaccggcatccccgaccgcttctccggctcccgctggggcgccgaatacaacctcaccatctccaacctcgaatccgaagacttcggcgtctactactgccaacaatacgacttcttcggccaaggcaccaaagtccaagtcgac

SEQ ID NO: 56343 - RNA, 378 nt, synthetic construct
  misc_feature 1..378: note = derived and/or modified sequence opt11 from anti-HIV-1_HeavyChain
  source 1..378: mol_type = other RNA
caggtgcagttagtgcagagcgggagcggggtgaagaagttgggggcgagcgtgagggtgagctgttggacgagtgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggatagggacctgagcacggcgcatatggatataagggggttgacgcaggacgatacggcgacgtatttctgtgcgaggcagaagttcgcgaggggagaccaggggtggttctttgacttgtgggggagggggacgttgatagtggtgagtagcgcg

SEQ ID NO: 56344 - RNA, 384 nt, synthetic construct
  misc_feature 1..384: note = derived and/or modified sequence opt11 from anti-HIV-1_HeavyChain
  source 1..384: mol_type = other RNA
caggtccagctcgtgcaatcgggctcgggcgtgaaaaagctcggggcctcggtcagggtctcatgctggacatcggaagatatctttgaaaggaccgagctaatacactgggtcaggcaagcgcccgggcaagggctcgagtggataggctgggtcaaggccgtgaccgggaccgtgaactttggctcgctcaatttcaggcaaagggtctcgctcacgcgcgatcgcgatctctttacagcgcacatggacatacgcgggctcacgcaaggggacacggcaacgtacttttgcgcgcgccagaaatttgaaaagtacacgggcgggcaagggtggtatttcgatctatggggcaggggcacgctcatagtcgtgagctcggcc

SEQ ID NO: 56345 - RNA, 378 nt, synthetic construct
  misc_feature 1..378: note = derived and/or modified sequence opt11 from anti-HIV-1_HeavyChain
  source 1..378: mol_type = other RNA
caagtccaactcgtccaatcaggctcagccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctcaggcaccgtcaacttcgcctccctcgacttccgcaaccgcatctccctctcccgcgaccgcgacctcttcaccgcccacatggacatccgcggcctcacccaaggcgacaccgccacctacttctgcgcccgccaaaaattctacgccggcggccaaggctggtacttcgacctctggggccgcggcaccctcatcgtcgtctcctccgcc

SEQ ID NO: 56346 - RNA, 387 nt, synthetic construct
  misc_feature 1..387: note = derived and/or modified sequence opt11 from anti-HIV-1_HeavyChain
  source 1..387: mol_type = other RNA
caggtccagctcgtgcaatcgggcgcggaagtgaaaaagcccggggcatcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctctcgcgcgatcgcgatctatcgaccgcgcacatggacatacgcgggctcacgcaagatgacacggccacgtacttttgcgcgcgccagaaatttgaatcgcgctataccgggggccagggctggtactttgacttgtgggggcgcgggacccatatcgtggtctcgagcgcg

SEQ ID NO: 56347 - RNA, 387 nt, synthetic construct
  misc_feature 1..387: note = derived and/or modified sequence opt11 from anti-HIV-1_HeavyChain
  source 1..387: mol_type = other RNA
caagtccaactcgtccaatccggctccgccatgaaaaaacccggcgcctcagtccgcgtctcctgctggacctccgaagacatcttcgaacgcaccgaactcatctactgggtccgccaagcccccggccgcggcctcgaatggatcggctgggtcaaaaccgtctccggcaccgtcaacttcggctcatccgacttccgcaaccgcatctccctcacccgcgaccgcgacctctccaccgcccacatggacatccgcggcctcacccaagacgacaccgccacctacttctgcgcccgccaaaaattcgaatccctctactccgacgaccaaggctcctacttcgacctctggggccgcggcaccctcatcatcgtctcctccgcc

SEQ ID NO: 56348 - RNA, 387 nt, synthetic construct
  misc_feature 1..387: note = derived and/or modified sequence opt11 from anti-HIV-1_HeavyChain
  source 1..387: mol_type = other RNA
caagtccaactcgtccaatccggactcgaagtcaaaaaaccaggcgcctccgtccgcgtctcctgctggacctccgaagacatcttcgacaccaccgaactcatctactgggtccgccaagcccccggccaaggcctcgaatggatcggctgggtcaaaatcgtatccggcaccgtcaacttcgcctccctcgacttccgcaacagaatctcactctcccgcgaccgcgacctatccaccgcccacatggacatccgcggcctcacccaagacgacaccgccacctacttctgcgcccgccaaaaattcgcctcccgctactccggcgaccaaggctcctacttcgacctctggggccgcggcaccctaatcatcgtctcctccgcc

SEQ ID NO: 56349 - RNA, 387 nt, synthetic construct
  misc_feature 1..387: note = derived and/or modified sequence opt11 from anti-HIV-1_HeavyChain
  source 1..387: mol_type = other RNA
caagtccaactcgtccaatccgcatccggcgtccgccgccccggcgcctccgtccgagtctcctgctggacctccgaagacatcttcgaacgctcagaactcatctactgggtccgacaagcccccggccgcggcctcgaatggatcggctggatcaaactcgtctccggcgccgtaaacttcggctcagtcgacttccgcgaccgcgtctccctaacccgcgaccgcgacctcttcaccgcccacatggacatccgaggcctcacccaagacgacaccgccacctacttctgcgcccgccaaaaattcgcctcccgctactcaggcgaccaaggctcctacttcgacctctggggccgcggcaccctcatcatcgtctcctccgcc

SEQ ID NO: 56350 - RNA, 375 nt, synthetic construct
  misc_feature 1..375: note = derived and/or modified sequence opt11 from anti-HIV-1_HeavyChain
  source 1..375: mol_type = other RNA
caagtgcaattggtccagagcggaagcggggtcaagaaaccgggcgcgagcgtgcgcgtgagctgttggacgagcgagggcatattcgagaaatcggaattgatccattgggtgcgccaggccccgggccagggcttggaatggatcgggtgggtgaaaacggtcacgggcgcggtcaatttcgggcaccagatctcggacagggtctcgctcacgcgcgatcgagatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcggcc

SEQ ID NO: 56351 - RNA, 378 nt, synthetic construct
  misc_feature 1..378: note = derived and/or modified sequence opt11 from anti-HIV-1_HeavyChain
  source 1..378: mol_type = other RNA
caggtgcagctggtgcagagcggggcggaggtgaagaagccgggggcgagcgtgagggtgagctgttggacgagcgaggacatattcgagaagagcgagttgatacattgggtgaggcaggcgccggggcaggggttggagtggatagggtgggtgaagacggtgacgggggcggtgaatttcgggagcagtgattttaggcagagggtgagcctgacgagggacagggacttgttcacggcgcatatggatataagggggttgacgcagggggatacggcgacgtatttctgtgcgaggcagaagtttgagaggggggggcaggggtggtattttgacttgtgggggagggggacgttgatagtggtgagtagtgca

SEQ ID NO: 56352 - RNA, 378 nt, synthetic construct
  misc_feature 1..378: note = derived and/or modified sequence opt11 from anti-HIV-1_HeavyChain
  source 1..378: mol_type = other RNA
caggtgcagttggtgcagagcggggcggaggtgaagaggccgggggcgagcgtgaaggtgagctgttggacgagcgaggacatattcgagaggacagagttgatacattgggtgaggcaggcgccggggcaggggttggagtggatagggtgggtgaagacggtgagtggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagtgcg

SEQ ID NO: 56353 - RNA, 378 nt, synthetic construct
  misc_feature 1..378: note = derived and/or modified sequence opt11 from anti-HIV-1_HeavyChain
  source 1..378: mol_type = other RNA
caggtgcagctggtgcagagcgggagcggggtgaagaagccgggggcgagcgtgagggtgagctgttggacgagcgaggacatattcgaggggagtgagttgatacattgggtaaggcaggcgccggggcaggggttggagtggatagggtgggtgaagacggtaacgggggcggtgaatttcgggagcgcgtactttaggcatagggtgagcttgacgagggacagggacttgttcacggcgcatatggatataagggggttgacgcagggggatacggcgacgtatttctgtgcgaggcagaagttcatgagcggggggcaggggtggtactttgacttgtgggggagggggacggtgatagtggtgagtagtgcg

SEQ ID NO: 56354 - RNA, 387 nt, synthetic construct
  misc_feature 1..387: note = derived and/or modified sequence opt11 from anti-HIV-1_HeavyChain
  source 1..387: mol_type = other RNA
caagtgcaattggtcccgagcgggagcggggtcaagaaaccgggcgcgagcgtgcgagtgagctgttggacgagcgaggacatattcgagcgcacggaattgatccattgggtgcgccaggccccgggccagggattggaatggatagggtgggtgaaaacggtaacgggcgcggtcaatttcgggagcttggactttcgacatagaatcagcttgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtagtgagctcggcc

SEQ ID NO: 56355 - RNA, 378 nt, synthetic construct
  misc_feature 1..378: note = derived and/or modified sequence opt11 from anti-HIV-1_HeavyChain
  source 1..378: mol_type = other RNA
caggtgcagttggtgcagagcgggagcggggtgaagaaggtgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggacagggacttgttcacggcgcatatggatataagggggttgacgcaggacgatacggcgatatatttctgtgcgaggcagaagttctatgcgggggggcaggggtggtactttgacttgtgggggagggggacgttgatagtggtgagtagcgcg

SEQ ID NO: 56356 - RNA, 387 nt, synthetic construct
  misc_feature 1..387: note = derived and/or modified sequence opt11 from anti-HIV-1_HeavyChain
  source 1..387: mol_type = other RNA
caagtccaactagtccaaagcggagccgaagtcaaaaaaccaggctcaagcgtacgcgtaagctgctggaccagcgaagacatattcgaacgcacagaactaatccactgggtacgccaagccccaggccaaggcctcgaatggatcggatgggtaaaaacagtcacaggcgcagtcaacttcggcagcccaaacttccgccaccgcgtcagcctaaccagagacagagacctattcacagcccacatggacatcagaggcctaacccaaggcgacaccgcaacctacttctgcgccagacaaaaattcgaaagccgatactcaggcgaccaaggaagctacttcgacctctggggcagaggcacactcataatcgtcagctcggcc

SEQ ID NO: 56357 - RNA, 375 nt, synthetic construct
  misc_feature 1..375: note = derived and/or modified sequence opt11 from anti-HIV-1_HeavyChain
  source 1..375: mol_type = other RNA
caagtgcaattggtccagagcggggccgaggtcaagaaaccgggcgcgagcgtgaaagtgagctgtaaagcgagcgggtacacgttcacgagctattacatgcactgggtcaggcaagcgcccgggcaagggctcgagtggataggctgggtcaagcccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatattacgcgggcgggcaagggtggtatttcgatctctggggcaggggcacgctcatagtcgtgagctcggcc

SEQ ID NO: 56358 - RNA, 375 nt, synthetic construct
  misc_feature 1..375: note = derived and/or modified sequence opt11 from anti-HIV-1_HeavyChain
  source 1..375: mol_type = other RNA
caagtgcaattggtccagagcggggccgaggtcaagaaaccgggcgcgagcgtgcaagtgagctgtaaagcgagcgggtacccgttcacgaaatattacatgcactgggtcaggcaagcgccagggcaagggctcgagtggataggctgggtcaaggccgtgagcggggccgtgaactatggctcgctcgatttcaggcacagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggaacgctcatagtcgtgagctcggcc

SEQ ID NO: 56359 - RNA, 375 nt, synthetic construct
  misc_feature 1..375: note = derived and/or modified sequence opt11 from anti-HIV-1_HeavyChain
  source 1..375: mol_type = other RNA
caagtgcaattggtccagagcggggccgaggtcaagaaaccgggcgcgagcgtgaaagtgagctgtaaagcgagcgggtacacgttcacgggctattacatgcactgggtcaggcaagcgcccgggcaagggctcgagtggataggctgggtcaagaccgtgagcggggccgtgaactttggctcgctcaatttcaggcacagggtctcgctcacgcgcgatcgcgatctctttaccgcgcacatggacatacgcgggctcacgcaaggggacacagccacgtacttttgcgcgcgccagaaatttgccaggggcgatcaagggtggtttttcgatctctggggcaggggcacgctcatagtcgtgagctcggcc

SEQ ID NO: 56360 - RNA, 402 nt, synthetic construct
  misc_feature 1..402: note = derived and/or modified sequence opt11 from anti-HIV-1_HeavyChain
  source 1..402: mol_type = other RNA
caagtccaactcgtccaatccggctccggcgtcaaaaaacccggcgcctcagtccgcgtctcctgccgcgcctccgaagacctcttcggcgacgaaatcatctacgacgacgaagtcatccactggctccgccaagtccccggccaacgccccgaatggatgggctggatacgccccaaaaccggcgcccgcaaccaagcccgccaattccaaccccgcatctccctcacccgcgaccgcgcactctccaccgcctacctcgacctaaactccctcaccagcgccgactccggcacatacttctgcgcccgccaaaccttcaaacccgacttctacttcgccgaccaaggatggtcattcaacctctggggccgcggcgcccacttcatcgtctcctcagca

SEQ ID NO: 56361 - RNA, 381 nt, synthetic construct
  misc_feature 1..381: note = derived and/or modified sequence opt11 from anti-HIV-1_HeavyChain
  source 1..381: mol_type = other RNA
caagtgcaattggtccagagcgggggcggggtcaagaaaccgggcgcgagcgcgagctttagctgtcgcacgagcgaggacccgttcgataacgagttctttgactcggaatttatgcattgggtgcgcttgaccccgggccagcgcccggaatggatggggtggatgaacccgcgctcgggcggggtaaattacgcgggccagttcaggcccaggatgtcaatgtggcgcgatcgcgagctctcgaccgcgtacatggaattgcgagatctcacgttcgcggacacgggcttgtacttttgcgcgcgcaggaaagaggacgattacgattggtattacgatctctggggcaggggcgcgcacataatcgtgagcgcggcc

SEQ ID NO: 56362 - RNA, 384 nt, synthetic construct
  misc_feature 1..384: note = derived and/or modified sequence opt11 from anti-HIV-1_HeavyChain
  source 1..384: mol_type = other RNA
caggtgcagttggtgcaggcgggggggggggtgaagaagccgggggcgagtgtgacgttgagctgtaagacggcggatgaggatgtgtttgatgcggcgtatatgcattgggtgagacaggcgccggggcagacgtttgagtggttggggtggatgaagccggtgacgggggcggtgaattatgcgaggaagtttcaggggagggtgagtttttataggacgagggagttggggatagcgtatatggatctgaggaatttgaggtttgatgatacggcggtgtatttttgtgcgaggaagacggcgggggatgtgagcggggataagagggggtttttttttgatttgtgggggagggggagtagggtgatagtgagtagtgcg

SEQ ID NO: 56363 - RNA, 384 nt, synthetic construct
  misc_feature 1..384: note = derived and/or modified sequence opt11 from anti-HIV-1_HeavyChain
  source 1..384: mol_type = other RNA
caggtccagctcgtgcaatcgggcgcggaagtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctatggggcaggggctcgcgcgtgatcgtgagctcggcc

SEQ ID NO: 56364 - RNA, 384 nt, synthetic construct
  misc_feature 1..384: note = derived and/or modified sequence opt11 from anti-HIV-1_HeavyChain
  source 1..384: mol_type = other RNA
caagtgcaattggtccagagcgaggccgaggtcaagaaaccgggcgcgagcatgaccgtgagctgtgaaacggccgatgaagatatatttgacgcggcctatatgcattgggtgcgccaggccccgggccagacctttgaatggctcgggtggatgaaaccggtcacgggcgcggtcaattacgcgagaaagttccagggcaggatctcgttctatcgcacgcgcgagctcgcgatcgcgtacatggacctgcgcgatctcaggttcgatgacacggccgtgtacttttgcgcgcgcaagaccgcgggcgatgtctcgggcgataacaggggctatttctttgacttgtgggggcgcgggagcagggtcatagtctcgagcgcg

SEQ ID NO: 56365 - RNA, 420 nt, synthetic construct
  misc_feature 1..420: note = derived and/or modified sequence opt11 from anti-HIV-1_HeavyChain
  source 1..420: mol_type = other RNA
caatcccacctcgaacaatccggatccgccatgaaaaaacccggcgcctccgtccgcgtctcctgctggacctccgaagacatcttcgacaccaccgaactcctctgggtccgccaagcccccggccaaggactcgaatggatcggctgggtcaaaatcgtctccggcaccgtcaacttcgcctccctcgacttccgcaaccgcatctccctctcccgcgaccgcgacctctccaccgcccacatggacatccgcggcctcacccaagacgacaccgccacctactactgcgcccgccaaaaattcgcatcccgctacagcggcgaccaaggctcctacttcgacctctggggccgcggcaccctcatcatcgtctcatccgcctccaccaaaggcccctccgtcttcccccacgacctc

SEQ ID NO: 56366 - RNA, 417 nt, synthetic construct
  misc_feature 1..417: note = derived and/or modified sequence opt11 from anti-HIV-1_HeavyChain
  source 1..417: mol_type = other RNA
cagagccatctcgagcaatcgggctcggccatgaaaaagcccggggcctcggtcagggtctcatgctggacctcggaagatatctttgaaaggaccgagctcatatactgggtcaggcaagcgcccgggcgcgggctcgagtggataggctgggtcaagaccgtgagcgggaccgtgaactttggctcaagcgatttcagaaacaggatctcgctcacacgcgatcgcgatctctttaccgcgcacatggacatacgcgggctcacgcaaggggacacggccacgtacttttgcgcgcgccagaaatttgaaaggggcgggcaagggtggtatttcgatctctggggcaggggaacgctcatagtcgtgagctcggcctcgaccaatggcccgatcgggctcccgcccaggagcgcg

SEQ ID NO: 56367 - RNA, 423 nt, synthetic construct
  misc_feature 1..423: note = derived and/or modified sequence opt11 from anti-HIV-1_HeavyChain
  source 1..423: mol_type = other RNA
caagcccacctcgaacaatcaggctcaggcgtcaaaaaacccggcgcctccgtccgcgtctcctgctggacatccgaagacatcttcgaaaaatccgaactcatccactgggtccgccaagcccccggccaaggcctcgaatggatcggctgggtcaaaaccgtcaccggcgccgtcaacttcggctcctccgacttccgccaacgcgtatccctcacccgcgaccgcgacctattcaccgcccacatggacatccgcggcctcacccaaggcgacaccgccacctacttctgcgcccgccaaaaattcgaatccctctactccgacgaccaaggctcctacttcgacctctggggccgcggaaccctaatcatcgtctcctccgcatccaccaaaggcccctcatcctccccaaccatctgc

SEQ ID NO: 56368 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggagcctcggtcagggtctcgtgctggacctcggaagatatctttgaaaggaccgagctcatacactgggtcaggcaagcgcccgggcaagggctcgagtggataggctgggtcaagaccgtgagcggggccgtgaactttggctcgccaaatttcaggcacagggtctcgctcacgcgcgatcgcgatctctttaccgcgcacatggacatacgcgggctcacgcaaggggacacggcaacgtacttttgcgcgcgccagaaatttgaaaggggcgggcaagggtggtatttcgatctctggggaaggggcacgctcatagtcgtgagctcggcctcgaccaagggcccgagcgtgttcccgcacgatctcagg

SEQ ID NO: 56369 - RNA, 411 nt, synthetic construct
  misc_feature 1..411: note = derived and/or modified sequence opt11 from anti-HIV-1_HeavyChain
  source 1..411: mol_type = other RNA
caagcacacctagaacaaagcggaagcggagtcaaaaaaccaggcgccagcgtccgagtaagctgctggacaagcgaagacatattcgaacgcacagaactaatccactgggtccgccaagccccaggccaaggcctagaatggatcggctgggtaaaaacagtctcaggcgcagtcaacttcggcagcccaaacttccgccaccgcgtcagcctaacccgagacagagacctattcacagcccacatggacatcagaggcctaacccaaggcgacaccgccacctacttctgcgccagacaaaaattcgaacgcggcggccaaggctggtacttcgacctatggggccgcggaaccctaatcgtagtctcaagctcactacaccaaggaccctcaggcctaccccacgac

SEQ ID NO: 56370 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagagtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggcaacgtacttttgcgcgcgccagaaattttacgcgggcgggcaagggtggtatttcgatctctggggcaggggcacgctcatagtcgtgagctcagcctcgaccaagggaccgagcgtgttcccgcacgatctcagg

SEQ ID NO: 56371 - RNA, 426 nt, synthetic construct
  misc_feature 1..426: note = derived and/or modified sequence opt11 from anti-HIV-1_HeavyChain
  source 1..426: mol_type = other RNA
caagcccacctagaacaatccggctccggcgtcaaaaaacccggcgcctccgtccgcgtctcctgctggacctccgaagacatcttcgaacgcaccgaactaatccactgggtccgccaagcccccggccaaggcctcgaatggatcggctgggtcaaaaccgtctccggcgccgtcaacttcggctcccccaacttccgccaccgcgtatccctcacccgcgaccgcgacctcttcaccgcccacatggacatccgcggcctcacccaaggcgacaccgccacctactactgcgcccgccaaaaattcgaatccctctactccgacgaccaaggctcatacttcgacctctggggccgaggcaccctcatcatcgtctcctcagcctccaccaaaggccccagcgtcttcccccacgacctacgc

SEQ ID NO: 56372 - RNA, 384 nt, synthetic construct
  misc_feature 1..384: note = derived and/or modified sequence opt11 from anti-HIV-1_HeavyChain
  source 1..384: mol_type = other RNA
caggtgcacttggagcagagcgggagcggggtgaagaagccgggggcgagcgtgagggtgagctgttggacgagcgaggacatattcgagaagagtgagttgatacattgggtgaggcaggcgccggggcaggggttggagtggatagggtgggtgaagacggtgacgggagcggtgaatttcgggagcagtgactttaggcagagggtgagcctgacgagggacagggacttgttcacagcgcatatggatataagggggttgacgcagggggatacggcgacgtatttctgtgcgaggcagaagttcgagagcaggtacacgggagggcaggggtggtatttcgatttgtgggggagggggacgcacatagtggtgagcagt

SEQ ID NO: 56373 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccggggccggggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacttgcgcaatctcaggttcgatgacacggccgtgtacttttgcgcgcgcaagaccgcgggcgatgtctcgggcgataaaaggggctttttctttgacttgtgggggcgcgggagcagggtcatagtctcgagcgcgagcacgaaagggccctcggtctttccccatgacttgcgc

SEQ ID NO: 56374 - RNA, 414 nt, synthetic construct
  misc_feature 1..414: note = derived and/or modified sequence opt11 from anti-HIV-1_HeavyChain
  source 1..414: mol_type = other RNA
caagcccacctcgaacaatccggctccggcgtcaaaaaacccggcacctccgtccgcgtctcctgctggacctccgaagacatcttcgaacgcaccgaactcatccactgggtccgccaagcccccggccaaggcctcgaatggatcggctgggtcaaaaccgtaaccggcgccgtcaacttcggctcccccaacttccgccaccgcgtctccctcacccgcgaccgcgacctattcaccgcccacatggacatccgcggcctcacccaaggcgacacagccacctacttctgcgcccgccaaaaattcgcccgcggcgaccaaggctggttcttcgacctctggggccgcggcaccctcatcgtcgtctcctccgcctccaccaaaggcccctccgtcttccccaccatctgc

SEQ ID NO: 56375 - RNA, 411 nt, synthetic construct
  misc_feature 1..411: note = derived and/or modified sequence opt11 from anti-HIV-1_HeavyChain
  source 1..411: mol_type = other RNA
caagtgcaactggtccagagcggggccgaggtcaagaaaccaggcgcgagcgtgaaagtgagctgtaaagcgagcgggtacacgttcacgagctattacatgcactgggtcaggcaagcgcccgggcaagggctcgagtggataggctgggtcaagcccgtgaccggggccgtgaactttggctcgcccaatttcaggcacagggtctcgctcacgcgcgatcgcgatctcttcaccgcgcacatggacatacgcgggctcacgcaaggggacacggccacgtacttttgcgcgcgccagaaatattacgcgggcgggcaagggtggtatttcgatctctggggaaggggcacgctcatagtcgtgagctcggcctcgaccaagggaccggtcgtgttcccgaccatatgc

SEQ ID NO: 56376 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56377 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggagtgaaaaagcccggggcctcggtcagagtctcatgctggacctcggaagatatctttgaaaggaccgagctcatacactgggtcaggcaagcgcccgggcaagggctcgagtggataggctggatcaagaccgtgaccggggccgtgaactttggctcgctcgatttcaggcacaggatctcactcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56378 - RNA, 420 nt, synthetic construct
  misc_feature 1..420: note = derived and/or modified sequence opt11 from anti-HIV-1_HeavyChain
  source 1..420: mol_type = other RNA
cagagccatctcgagcaatcgggctcggccatgaaaaagcccggggcctcggtcagggtctcgtgctggacctcggaagatatctttgaaaggaccgagctcatatactgggtcaggcaagcgcccgggcgcgggctcgagtggataggctgggtaaagaccgtgagcgggaccgtgaactttggctcgagcgatttcaggaacaggatctcgctcacgcgagatcgcgatctctcgaccgcgcacatggacatacgcgggctcacgcaagatgacacggccacgtacttttgcgcgcgccagaaatttgaaaggggcgggcaagggtggtatttcgatctatggggcaggggcacgctcatagtcgtgagctcggcctcgaccgagggcccgagcaggagctttccccagatcttgcgc

SEQ ID NO: 56379 - RNA, 414 nt, synthetic construct
  misc_feature 1..414: note = derived and/or modified sequence opt11 from anti-HIV-1_HeavyChain
  source 1..414: mol_type = other RNA
caggcgcacctggagcagagcgggagtggggtaaagaagccgggggcgagcgtgagggtgagctgttggacgagcgaggacatattcgagaagagtgagttgatacattgggtgaggcaggcgccggggcaggggttggagtggatagggtgggtgaagacggtgacgggggcggtgaatttcgggagcagtgactttagacagagggtgagcttgacgagggacagggacttgttcacggcgcatatggatataagggggttgacgcagggggatacggcgacgtatttctgtgcgaggcagaagttctatgcgggggggcaggggtggtactttgacttgtgggggagggggacgttgatatgtgtgagtagcgcgagcccgagggcgcacaggagcagtccgaggagcgca

SEQ ID NO: 56380 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcactcacgcgcgatcgcgatctctttaccgcgcacatggacatacgcgggctcacgcgcggggacacggccacgtactattgcgcgcgacagaaatttgaatcgcgctataccgggggccagggctggtactttgacttgtgggggcgcgggacccatatcgtagtctcgagc

SEQ ID NO: 56381 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcaggctcgggcgtgaaaaagcccggggcctcggtcagagtctcgtgctggagctcggaagatatctttgaaaggaccgagctaatacactgggtcaggcaagcgcccgggcaagggctcgagtggataggctgggtcaagaccgtgaccggggccgtgaactttggctcgctcgatttcaggcacaggatctcgctaacgcgcgatcgcgatctctttaccgcgcacatggacatacgcgggctcacgcaaggggacacggccacgtacttttgcgcgcgccagaaatttgaatcgcgctataccgggggccagggctggtactttgacctgtgggggcgcgggacccatatcatagtctcgagc

SEQ ID NO: 56382 - RNA, 423 nt, synthetic construct
  misc_feature 1..423: note = derived and/or modified sequence opt11 from anti-HIV-1_HeavyChain
  source 1..423: mol_type = other RNA
caatcccacctcgaacaatccggctccgccatgaaaaaacccggcgcctccgtccgcgtctcctgctggacctccgaagacatcttcgacaccacctccatcttcatcggctgcgaccgccccctcgacaaagactggtccggcctcggcggatccaaactctccctcgccccctccatcttcgcctccctcgacttccgcaaccgcatctcactctcccgcgaccgcgacctctccaccgcctacatggacatccgcggcctcacccaagacgacaccgccacctacttctgcgcccgacaaaaattcgcctcccgctactccggcgaccaaggctcctacttcgacctctggggccgcggcaccctaatcgtcgtctcctccgcctccaccaaaggcccctccgtcttcccccacgacctc

SEQ ID NO: 56383 - RNA, 399 nt, synthetic construct
  misc_feature 1..399: note = derived and/or modified sequence opt11 from anti-HIV-1_HeavyChain
  source 1..399: mol_type = other RNA
agggaatatctcgagcaatcgggcgggggcgtgaaaaagctcggggcctcggtcagggtctcgtgcagggcctcggaagatctcttcggcgatgaagtgatctacgacgatgaactgatccactggctgcgccaggtcccgggccagcgcccggaatggatggggtggatacgcccaaaaacgggcgcgcgcaatcaagcacgccagttccagcccagaatcaatctctcacgcgaccgcgcgctaaataccgcgtacttggacctgagctcgctcacgagcgcggactcggccacgtacttttgcgcacgccagacctttaaaccggacttttactttgccgaccaaggatggtcattcaacctctggggcaggggcgcgcgcgtgatcgtgagctca

SEQ ID NO: 56384 - RNA, 384 nt, synthetic construct
  misc_feature 1..384: note = derived and/or modified sequence opt11 from anti-HIV-1_HeavyChain
  source 1..384: mol_type = other RNA
caggtccatctcgtgcaatcgggcgcggaagtgaaaaagcccgggagctcggtcagggtctcgtgctggacctcggaagatatctttgaaaggaccgagctcatacactgggtcagacaagcgccagggcaagggctcgagtggataggctgggtaaagaccgtgaccggggccgtgaactttggatcgcccaatttcaggcacagggtctcgctcacgcgcgatcgcgatctctttaccgcgcacatggacatacgcgggctcacgcaaggggacacggccacgtacttttgcgcgcgccagaaatttgaatcacgctatagcggggaccagggctcgtactttgacctgtgggggcgcgggaccttgatcatagtctcgagc

SEQ ID NO: 56385 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggagcgagcgtgcgcgtgagctgttggacgagcgaggacatattcgagcgcacggaattgatccattgggtgcgccaggccccgggccagggcttggaatggatcgggtgggtgaaaatagtctcgggcgcggtcaatttcgggagcccgaactttcgccagcgcgtgagcttgacaagggacagggacttattcacggcccatatggatatcaggggcctgacccagggagataccgcgacctatttctgtgccaggcaaaagttcgagcgcgggggccagggctggatctttgacctgtgggggcgcgggaccttgatcgcggtctcgagcgcgagcacgaaagggccctcggtctttcccacgatctgt

SEQ ID NO: 56386 - RNA, 441 nt, synthetic construct
  misc_feature 1..441: note = derived and/or modified sequence opt11 from anti-HIV-1_HeavyChain
  source 1..441: mol_type = other RNA
cgcgaattcctcgaacaatcaggcggcggcgtcaaaaaactcggcgcctccctccgcgtctcatgccgagcctccgaagacctattcggcgacgaattcatctacgacgacgaagtcatccactggctacgccaagtccccggccaacgccccgaatggatgggctggatccgccccaaaaccggcgcacgcaaccaagccacccaattccaaccccgaatctccctcacccgcgaccgcgccctctccaccgcctacctcgacctcaactccctcacctccgccgactcaggcacctacttctgcgcccgccaaaccttcaaacccgacttctacttcgccgaccaaggctggtccttcaacctctggggccgcggcgcccacttcatcgtctcctccgcctccaccaaaggcccatccgtcttcccccacgactccgcc

SEQ ID NO: 56387 - RNA, 399 nt, synthetic construct
  misc_feature 1..399: note = derived and/or modified sequence opt11 from anti-HIV-1_HeavyChain
  source 1..399: mol_type = other RNA
cgcgaatacctcgaacaatccggaggcggcgtcaaaaaactcggcgcctccctccgcgtctcctgccgagcatccgaagacctcttcggcgacgaaatcatctacgacgacgaagtcatccactggctccgccaagtccccggccaacgccccgaatggatgggctggatccgccccaaaaccggcgcccgcaaccaagcccgacaattccaaccccgcatctccctcacccgcgaccgcgccctctccaccgcctacctcgacctcaactccctcacctccgccgactccggcacctacttctgcgcccgccaaaccttcaaacccgacttctacttcgccgaccaaggctggtcattcaacctctggggccgcggcgcccacttcatcgtctcctcc

SEQ ID NO: 56388 - RNA, 384 nt, synthetic construct
  misc_feature 1..384: note = derived and/or modified sequence opt11 from anti-HIV-1_HeavyChain
  source 1..384: mol_type = other RNA
caggcgcacttggaacagagcgggagcggggtaaagaagccaggggcgagcgtgagagtgagctgttggagtagcgaggacatattcgagaggacggaattgatacattgggtgagacaggcgccgggacagggattggaatggatagggtgggtgaagacggtgacgggagcggtaaatttcgggagtctggactttagacatagaataagcctgacaagggacagggacttgttcacggcacatatggatataaggggattgacacagggagatacagcgacgtatttctgtgcaaggcagaagttcgagagcaggtacacgggagggcaggggtggtatttcgatctgtggggaagggggacgcacatagtagtgagctcg

SEQ ID NO: 56389 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggagggggcgtgaaaaagcccggggcctcggtaacgctctcgtgcaagaccgcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56390 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggcacgggcgtgaaaaagcccggggcctcagtcagggtctcttgctggacatcggaagatatcttcgaaaagagcgagctcatacactgggtcaggcaagcgcccgggcaagggctagagtggataggatgggtcaagatcgtgagcggggcagtgaactttggaagtcccaatttcagacaaagggtctcgctcacgcgcgatcgcgatctattcaccgcgcaaatggacataagagggctaacgcaaggggacacggccacgtacttttgcgcgcgacagaaatttgaaaggggcgggcaagggtggatattcgatctctggggaaggggaacgctcatagccgtgagctcggcctcgaccaagggcccgagcgtgttcccgcacgatcta

SEQ ID NO: 56391 - RNA, 399 nt, synthetic construct
  misc_feature 1..399: note = derived and/or modified sequence opt11 from anti-HIV-1_HeavyChain
  source 1..399: mol_type = other RNA
caagcgcacttggaacagagcgggagcggggtcaagaaattgggcgcgagcgtgcgcgtgagctgttggacgagcgaggacatattcgagcgcacggaattgatccattgggtgcgacaggccccgggccagggcttggaatggatcgggtgggtgaaagcggtctcgggcgcggtcaattacgggagcttggactttcgacatcgcgtgagcttgaccagggacagggacctgagcacggcccatatggatatcaggggcttgacccaggacgataccgcgacctatttctgcgccaggcaaaagttcgcgcgaggggaccagggctggttctttgacttgtgggggcgcgggaccttgatcgtggtctcgagcgcgagcacgaaagggccctcgggc

SEQ ID NO: 56392 - RNA, 414 nt, synthetic construct
  misc_feature 1..414: note = derived and/or modified sequence opt11 from anti-HIV-1_HeavyChain
  source 1..414: mol_type = other RNA
caagcccacctcgaacaatcaggctccggcgtcaaaaaacccggcgcctccgtccgcgtctcctgctggacctccgaagacatattcgaacgcaccgaactaatccactgggtccgccaagcccccggccaaggcctagaatggatcggctgggtcaaaaccgtcacaggcgccgtaaacttcggctcccccaacttcagacaccgcgtctccctcacccacgaccgcgacctcttcacagcccacatggacatccgcggcctcacccaaggcgacaccgccacctacttctgcgcccgacaaaaattctacgccggcggccaaggctggtacttcgacctctggggccgcggaaccctcatctgcgtctcctccgcctccaccaaaggcccatccggcctccccccccgctcc

SEQ ID NO: 56393 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaactcggcgcctccgtccgcgtctcctgctggacctccgaagacatcttcgaacgcaccgaactcatccactgggtccgccaagcccccggccaaggcctcgaatggatcggctgggtcaaagccgtctcaggcgccgtcaactacggctccctcgacttccgccaccgcgtctccctcacccgcgaccgagacctctccaccgcccacatggacatccgcggcctcacccaagacgacacagccacatacttctgcgcccgccaaaaattcgaatccctctactccgacgaccaaggctcatacttcgacctctggggccgcggcaccctcatcatcgtctcctccgcctccaccaaaggcccctcagtcttcccccacgacctacgc

SEQ ID NO: 56394 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttagaatggatcgggtgggtgaaaacagtctcgggcgcggtcaatttcgggagcccgaactttcgccatcgcgtgagcctgaccagggacagggacttgttcacggcccatatggatatcaggggcttgacccagggcgataccgcgacctattactgtgccaggcaaaagttcgagcgagggggccagggctggtactttgacttgtgggggcgcgggaccctgatcgtggtctcgagcgcgagcacgaaagggccctcggtctttcccacgatctat

SEQ ID NO: 56395 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggtcgagcgaggacatattcgagcgcacggaattgatccattgggtgcgacaggccccgggccagggcttggaatggatcgggtgggtgaaaacagtcacgggcgcggtcaatttcgggagcttggactttagacatcgcatcagcttgaccagggacagggacttgttcacggcccatatggatataaggggcttgacccagggcgataccgcgacctattactgtgccaggcaaaagttcgagagcaggtacacgggcgggcaagggtggtatttcgatctctggggcaggggcacgcacatagtcgtgagctcg

SEQ ID NO: 56396 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggagtgaaaaagcccggggcctcggtcagggtctcgtgctggacctcggaagatatctttgaagggagcgagctcatacactgggtcaggcaagcgcccgggcaagggctcgagtggataggctgggtcaagaccgtgaccggggccgtgaactttggctcggcctatttcaggcacagggtctcgctcacgcgcgatcgagatctctttaccgcgcacatggacatacgcgggctaacgcaaggggacacggccacgtactattgcgcgcgccagaaattttacaagggcgggcaagggtggtatttcgatctctggggcaggggcacgctcatagtcgtgagctcggcctcgaccaagggaccgagcgtgttcccgaccatatgc

SEQ ID NO: 56397 - RNA, 399 nt, synthetic construct
  misc_feature 1..399: note = derived and/or modified sequence opt11 from anti-HIV-1_HeavyChain
  source 1..399: mol_type = other RNA
agggaatatctcgagcaatcgggcgggggcgtgaaaaagccaggggcctcggtcagggtctcgtgcagggcctcggaagatctctttggcgacgaaataatctatgacgatgaagtgatccattggctgcgccaggtcccgggccagcgcccggaatggatggggtggatacgcccgaaaaatggcgggcgcaatcaagcgcgccagttccagcccaggatctcgctcacgcgcgatcgcgcgctcaacaccgcgtacttggacttgaactcactcacgagcgcggactcgggaacgtacttttgcgcgcgccagacctttaaaccggacttttactttgccgatcaagggtggtcgttcaatctatggggcaggggcgcgcgcgtgatcgtgagctcg

SEQ ID NO: 56398 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtaaattacgggagcttggactttcgccatcgagtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgcgggacattgatcgtggtctcgagc

SEQ ID NO: 56399 - RNA, 420 nt, synthetic construct
  misc_feature 1..420: note = derived and/or modified sequence opt11 from anti-HIV-1_HeavyChain
  source 1..420: mol_type = other RNA
caggtctatatggagcaagcgggcgggggagtgaaaaagcccggggcctcggtcacgctctcgtgcaagaccgcggacgaggacgtgttcgatgccgcgtacatgcactgggtcaggcaagcgcccgggcaaacgttcgagtggctgggctggatgaagcccgtgaccggggcagtgagctatgccaggaaatttcaagggcgcgtgagcttttacatgaccagggaattgggcatggcctatatggatctcaggaacttgcgatttgacgataccgcggtctatttctgtgccaggaaaacggccggggacgtgagcggggacaatcgcgggtactttttcgatctctggggcaggggctcgcgcgtgatcgtgagctcggcctcgaccaagggcccgagcgtgttcccgaccatatgc

SEQ ID NO: 56400 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggatcgggcgtgaaaaagcccggagcctcggtcagggtctcgtgctggacctcggaagatatctttgaagggagcgagctcatacactgggtcagacaagcgcccgggcaagggctcgagtggataggctgggtcaagaccgtgaccggggccgtgaactttggctcggcctatttcaggcacagggtctcgctcacgcgcgatcgcgatctctttaccgcgcacatggacatacgcgggctaacgcaatcggacacggccacgtacttttgcgcgcgccagaaattttacgcgggcgggcaagggtggtatttcgatctctggggcagaggcacgctcatagtcgtgagctcggcctcgaccaagggcccgagcgtgttcccgcacgatctcaga

SEQ ID NO: 56401 - RNA, 426 nt, synthetic construct
  misc_feature 1..426: note = derived and/or modified sequence opt11 from anti-HIV-1_HeavyChain
  source 1..426: mol_type = other RNA
caatcgcacttggaacagagcgggagcgcgatgaagaaaccgggcgcgagcgtgcgcgtgagctgttggacgagcgaggacatattcgagcgcacggaattgatctattgggtgcgccaggccccgggcagaggcctggaatggatcgggtgggtgaaaacggtctcgggcacggtcaatttcgggagctcggactttcgcaatcgcatcagcttgaccagggacagggacttgagcacggcccatatggatataaggggcctgacccaggacgacaccgcgacctatttctgtgccaggcaaaagttcgagagcttgtactcagacgatcaagggagctatttcgatctctggggcaggggcacgctcataatcgtgagctcggcctcgcccaagggaccgagcgggctcccgcccaggagcgcg

SEQ ID NO: 56402 - RNA, 411 nt, synthetic construct
  misc_feature 1..411: note = derived and/or modified sequence opt11 from anti-HIV-1_HeavyChain
  source 1..411: mol_type = other RNA
caggtccagctcgtgcaatcgggcgcggaagtgaaaaagcccggggcctcggtcaaggtctcgtgcaaggcctcgggctatacctttaccacgtacgggatctcgtgggtacgccaggccccgggccagggcttggaatggatcggatgggtgaaaacggtcacgggcgcggtcaatttcgggcaccagatctcggacagggtctcgctcacgcgcgatcgagatctctttacagcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 56403 - RNA, 417 nt, synthetic construct
  misc_feature 1..417: note = derived and/or modified sequence opt11 from anti-HIV-1_HeavyChain
  source 1..417: mol_type = other RNA
caggcccagctcgagcaatcgggctcgggcgtgaaaaagcccggggcctcggtcagggtatcgtgctggacctcggaagatatctttgaaaggaccgagctaatacactgggtcaggcaagcgcccgggcaagggctcgagtggataggctgggtcaagaccgtgaccggggccgtgaactttggctcgagcgatttcaggcaaagggtctcactcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcggcatcgaccaagggcccgagcgtgttcccgcacgatctcagg

SEQ ID NO: 56404 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtattactgtgcgaggcagaagttcgagaggggggggcaggggtggtactttgacttgtgggggagggggacgttgatagtggtgagtagc

SEQ ID NO: 56405 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggacgagcgaggacatattcgagaaatcggaattgatacattgggtgcgccaggccccgggccagggcttggaatggatcgggtgggtgaaaacggtcacgggcgcggtcaatttcgggagctcggactttcgccagcgcgtgagcctgaccagggacagggacttgttcacggcccatatggatatcaggggcttgacccagggagataccgcgacctattactgtgccaggcaaaagttcgagagcaggtacacgggcggacaagggtggtatttcgatctatggggcaggggcacgcacatagtcgtgagctcg

SEQ ID NO: 56406 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcaggctcgggcgtgaaaaagccaggggcctcggtcagggtctcatgctggacctcggaagatatctttgaaaggaccgagctcatacactgggtcaggcaagcgcccgggcaagggctcgagtggataggctgggtcaagaccgtgaccggggccgtgaactttggctcacccaatttcaggcacagggtctcgctcacgagagatcgagatctctttaccgcgcacatggacatacgcgggctcacgcaaggggacacggccacgtacttttgcgcacgccagaaatttgaaaggggcgggcaagggtggtatttcgatctctggggcaggggcacgctcatagtcgtgagctcggcctcgaccaagggcccgagcgtgttcccgaccatatgc

SEQ ID NO: 56407 - RNA, 381 nt, synthetic construct
  misc_feature 1..381: note = derived and/or modified sequence opt11 from anti-HIV-1_HeavyChain
  source 1..381: mol_type = other RNA
caggtccagctcgtgcaatcgggcgcggaagtgcaaaagcccggggcctcggtcacggtctcgtgcaaggcctcgggctataccttgatctcatacgggatctcgtgggtgcgccaggccccgggccagggcccggaatggatggggtggatacgcccgaaaacgggcgcgcgcaatcaagcgcgccagttccagcccaggatctcactcacgcgcgatcgcgcgctctcgaccgcgtacttggacctgaactcactcacgagcgcggactcgggcacgtacttttgcgcgcgccagacctttaaaccggacttttactttgccgatcaagggtggtcgttcaatctctggggcaggggcgcgcactttatcgtgagctca

SEQ ID NO: 56408 - RNA, 414 nt, synthetic construct
  misc_feature 1..414: note = derived and/or modified sequence opt11 from anti-HIV-1_HeavyChain
  source 1..414: mol_type = other RNA
caggcccatctagagcaatcgggctcgggcgtgaaaaagcccggggcctcggtcagggtctcgtgctggacctcggaagatatcttgcgaaagaaagagctcatacactgggtcaggcaagcgcccgggcaagggctcgagtggataggctgggtcaagaccgtgaccgggaccgtgaactttggctcgagcgatttcaggcaaagggtctcgctcacgcgcgaccgcgatctctttaccgcgcacatggacatacgcgggctcacgcaaggggacacggccacgtacttgtgcgcgcgacagaaatttgaaaggggcgggcaagggtggatattcgatctctggggcaggggcacgctcatagccgtgagctcggcatcgaccaagggcccgagcgtgttcccgcacgatctc

SEQ ID NO: 56409 - RNA, 426 nt, synthetic construct
  misc_feature 1..426: note = derived and/or modified sequence opt11 from anti-HIV-1_HeavyChain
  source 1..426: mol_type = other RNA
caggcccatctcgagcaatcaggctcgggcgtgaaaaagccaggggcctcggtcagggtctcgtgctggagctcggaagatatctttgaaaggaccgagctaatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgacagaaatttgaatcgcgctataccgggggccagggctggtactttgacttgtgggggcgagggacccatatcgtggtctcgagcgcgagcacgaacgggcccataggcttgccccatcgctcggcc

SEQ ID NO: 56410 - RNA, 384 nt, synthetic construct
  misc_feature 1..384: note = derived and/or modified sequence opt11 from anti-HIV-1_HeavyChain
  source 1..384: mol_type = other RNA
caagcacacctggaacagagcggaagcggggtaaagaaaccaggcgcaagcgtgcgcgtaagctgctggacgagcgaggacatattcggaaaatcggaactaatccactgggtgcgccaggccccgggccagggcctggaatggatcggatgggtgaaaacggtcacgggcgcggtcaatttcgggagctcggactttcgccagcgcgtgagcctgaccagggacagggacttgttcacggcccatatggatatcagaggcctgacccagggcgacacagcgacctacttctgcgccagacaaaagttcgagagcctgtactcagacgaccaagggagctatttcgacctatggggcagaggcacgctcataatcgtgagctcc

SEQ ID NO: 56411 - RNA, 417 nt, synthetic construct
  misc_feature 1..417: note = derived and/or modified sequence opt11 from anti-HIV-1_HeavyChain
  source 1..417: mol_type = other RNA
caggcgcacttggagcagagcgggagcggggtgaagaagccgggggcgagtgtgagggtgagctgttggacgagcgaggacatattcgagaggacggagctgatacattgggtgaggcaggcgccggggcaggggctggagtggatagggtgggtgaagatagtgagtggggcggtgaatttcgggagtccgaactttaggcagagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagcgcgagcacgaaagggccgagtgggttgccgcatgggagtgcg

SEQ ID NO: 56412 - RNA, 423 nt, synthetic construct
  misc_feature 1..423: note = derived and/or modified sequence opt11 from anti-HIV-1_HeavyChain
  source 1..423: mol_type = other RNA
caggtccagtacgggcgcgaggccggggccgggatgaagaaaccgggcgcgagcatgaccgtgagctgtaaaacagccgacgaagatatctttgacgcggcctatatgcaccgcgtacgccaggccccaggccagacctttgaatggctcggatggatgaaaccggtcacgggcgcggtcaactacgcgcgccagttccagggcagggtctcgttctatcgcacgcgagagctcgggatcgcatacatggacctacgcgatctcaagttcgatgacacggccgtgtacttttgcgcgcgaaagaccaagggcgatgtctcgggcgatgacaggggcttcttctttgacctgtgggggcgcgggaccagagtcatagtctcgagcgcgagcacgaaagggccctcggtctttcccacgatctat

SEQ ID NO: 56413 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcgagcgtgcgcgtgagctgttggacgagcgaggacatattcgagcgcacggaactgatccattgggtgcgccaggccccgggccagggcttggaatggatcgggtgggtgaaaacggtcacgggcgcggtcaatttcgggagcctggactttcgccatcgcatcagcttgaccagggacagagacttgttcacggcccatatggatataagaggcttgacccagggcgatacagcgacctatttctgtgccaggcaaaagttcgagagcaggtacacgggcgggcaaggatggtatttcgatctatggggcaggggcacgcacatagtagtgagctcggcctcgaccaagggcccaagcgtgttcccgcacgatctcagg

SEQ ID NO: 56414 - RNA, 423 nt, synthetic construct
  misc_feature 1..423: note = derived and/or modified sequence opt11 from anti-HIV-1_HeavyChain
  source 1..423: mol_type = other RNA
caagtccaactcgtccaatccgaagccgaactcaaaaaacccggcgcctccgtctcagtctcctgcaaagcctccggctactccttcacctcatacggcatctcctgggtccgccaagtccccggccaaggcctagaatggatcgcatggatccgccccaaaaccggcgcccgcaaccaagcccgacaattccaaccccgcatctccctcacccgcgaccgcgccctctccaccgcctacctcgacctcaactccctcacatccgccgactccggcacctacttctgcgcccgccaaaccttcaaacccgacttctacttcgccgaccaaggctggtccttcaacctctggggccgcggcgcccacttcatcgtctcctccgcctccaccaaaggcccctccgtcttcccccacgacctccgc

SEQ ID NO: 56415 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgagtaagctgttggacgagcgaggacatattcgagcgaacggaattgatccattgggtgcgccaggccccgggccagggcttggaatggatcgggtgggtgaaaacggtcacgggcgcggtcaatttcgggagcccgaactttcgacatcgcgtgagcttgaccagggacagggacctgttcacggcacatatggatatcaggggcttgacccagggcgatacagcgacatattactgtgccaggcaaaagttcgagcgcgggggccagggctggtactttgacttgtgggggcgcgggaccttgatcgtggtctcgagcgcgagcacgaaagggcccagtgtatttccccatgacttg

SEQ ID NO: 56416 - RNA, 381 nt, synthetic construct
  misc_feature 1..381: note = derived and/or modified sequence opt11 from anti-HIV-1_HeavyChain
  source 1..381: mol_type = other RNA
caggtccagctcgtgcaatcgggcgcggaagtgcaaaagcccggggcctcggtcacggtctcgtgcaaggcctcaggctataccctgatctcgtacgggatctcgtgggtacgccaggccccgggccagggcccagaatggatgggatggatacgcccgaaaacgggcgcgcgcaatcaagcgcgccagttccagcccaggatctcgctcacgcgcgaccgcgcgctctcgaccgcgtacctggacttgaactcgctcacgagcgcggactcgggcacgtactattgcgcgcgccagacctttaaaccggacttttacttcgccgatcaagggtggtcgttcaatctctggggcaggggcgcgcactttatcgtgagctcg

SEQ ID NO: 56417 - RNA, 414 nt, synthetic construct
  misc_feature 1..414: note = derived and/or modified sequence opt11 from anti-HIV-1_HeavyChain
  source 1..414: mol_type = other RNA
caggcgcacttggagcagagcgggagcggggtgaagaagttgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggacagggacctgttcacggcgcatatggatataagggggttgacgcaggacgatacggcgacatatttctgtgcgaggcagaagttcgcgaggggggaccaggggtggttctttgacttgtgggggagggggacattgatagtggtgtcgagcgcgagcacgaaggggccgagtgtgtttccgcagatatgt

SEQ ID NO: 56418 - RNA, 378 nt, synthetic construct
  misc_feature 1..378: note = derived and/or modified sequence opt11 from anti-HIV-1_HeavyChain
  source 1..378: mol_type = other RNA
caggcgcacttggagcagagcgggagcggggtgaagaagccgggggcgagtgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagagaggggggcaggggtggtactttgacttgtgggggagagggacgttgatatgtgtgagtagcgcg

SEQ ID NO: 56419 - RNA, 438 nt, synthetic construct
  misc_feature 1..438: note = derived and/or modified sequence opt11 from anti-HIV-1_HeavyChain
  source 1..438: mol_type = other RNA
caaggctacctcgcccaatccggcggcggcgtcaaaaaacccggcacctcagcctccttctcctgccgtacctccgacgacatctacgacaacgaattcttcgactccgccttcatgcactgggtccgcctcatccccggccaacgacccgaatggatgggctggatgaacccccgctccggcgccgtcaactacgcccgccaactccaaccacgcgtctccatgtaccgcgaccgcgacctctccaccgcctacctcgacctaaactccctcacctccgccgactccggcacctacttctgtgcccgccaaaccttcaaacccgacttctacttcgccgaccaaggctggtccttcaacctatggggccgcggcgcccacttcatcgtctcatccgcctccaccaaaggcccctccgtcctaccacacgacctccgc

SEQ ID NO: 56420 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggcgtgaaaaagcccggggcctcggtcagggtctcgtgctggacctcggaagatatctttgaaaggaccgagctcacgcactgggtcaggcaagcgcccgggcaagggctcgagtggataggctgggtcaagatcgtgagcggggccgtgaactttggctcgcccaatttcaggcaaagggtctcgctcacgcgcgatcgcgatctctttacagcgcacatggacatacgcgggctaacgcaaggggacacggccacgtacttttgcgcgcgccagaaatttgaaaggggcgggcaagggtggatattcgatctctggggcaggggcacgctcatagccgtgagctcggcctcgaccaagggcccgagcgtgttcccgcgctcggcc

SEQ ID NO: 56421 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggcgtgaaaaagcccggggcctcggtcagggtctcgtgctggacctcggaagatatctttgaaaagaaagagctcatacactgggtcaggcaagcgcccgggcaagggctcgagtggataggctgggtcaagaccgtgaccggggccgtgaacttcggctcgagcgatttcaggcaaagggtctcgctcacgcgcgatcgcgacctctttaccgcgcacatggacatacgcgggctaacgcaaggggacacagccacgtacttttgcgcacgccagaaattttacgcgggcgggcaagggtggtatttcgatctctggggcaggggcacgctcatagtcgtgagctcggcctcgaccaagggcccgagcgtgttcccgcacgatctc

SEQ ID NO: 56422 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgacaggccccgggccagggcttggaatggatcgggtgggtgaaaacggtcacgggcgcggtcaatttcgggagcttggactttcgccatcgcatcagcttgaccagggacagggacttgttcacggcccatatggatataaggggcttgacccagggcgataccgcgacctattactgtgccaggcaaaagttcgagagcaggtacacgggcgggcaagggtggtatttcgatctctggggcaggggaacgcacatagtcgtgagctcg

SEQ ID NO: 56423 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggcgtgaaaaagcccggggcctcggtcagggtctcgtgctggacatcggaagatatctttgaaaagagcgagctcatacactgggtcaggcaagcgcccgggcaagggctcgagtggataggctgggtcaagaccgtgaccggggccgtgaactttggctcaagcgatttcaggcaaagggtctcgctaacgcgcgatcgcgatctctttaccgcgcacatggacatacgcgggctcacgcaaggggacacggccacgtactattgcgcgcgccagaaattttacgcgggcgggcaagggtggtatttcgatctctggggcaggggcacgctcatagtcgtgagctcggcctcgaccaagggcccgagcgtgttcccgaccatatgc

SEQ ID NO: 56424 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggcgcgagcgtgcgagtgagctgttggacgagcgaggacatattcgagcgcacggaattgatccattgggtacgccaggccccgggccagggcctggaatggatcgggtgggtgaaagcggtctcgggcgcggtcaattacgggagcttggactttcgccatcgcgtgagcttgaccagggacagagacctgagcacggcccatatggatatcaggggcttgacccaggacgataccgcgacctatttctgtgccaggcaaaagttcgagagcctgtactcggacgatcaagggagctatttcgatctatggggcaggggcacgctcataatcgtgagctca

SEQ ID NO: 56425 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacctccgaagacatcttcgaaggctcagaactcatccactgggtccgccaagcccccggccaaggcctcgaatggatcggatgggtcaaaaccgtcaccggcgccgtcaacttcggctccgcctacttccgccaccgcgtctccctcacccgcgaccgagacctcttcacagcccacatggacatccgcggcctcacccaaggcgacaccgccacctacttctgcgcccgacaaaaattcgaatcccgctacaccggcggccaaggctggtacttcgacctatggggccgcggcacccacatcgtcgtctcctccgcctcaaccaaaggcccctccgtcttcccccacgacctccgc

SEQ ID NO: 56426 - RNA, 408 nt, synthetic construct
  misc_feature 1..408: note = derived and/or modified sequence opt11 from anti-HIV-1_HeavyChain
  source 1..408: mol_type = other RNA
caagtccaactcgtccactccggcgccgaagtcaaaaaacccggcgcctccatgaaagtctcctgcaaaacctccggatactcattcaccggctactacatgcactgggtccgccaagcccccggccaaggcctcgaatggatgggctggatcaacccctcctccaacgacaccaactacgcccaaaaattccaaggccgcgtcaccatgacccgcgacacctccatcaacaccgcctacatggaactctcccgcctccgctccggcgacaccgccatctacttctgcgcccgccaaaaattctacgccggcggccaaggctggtacttcgacctctggggccgcggcaccctcatcgtcgtctcctccgcctcaaccaaaggcccatccgtcttccccaccatctgc

SEQ ID NO: 56427 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcagggggaggggtgaagaagccgggggcgagtgtgacgctgagttgtaagacggcggatgaggatgtgtttgatgcggcgtatatgcattgggtgaggcaggcgccggggcagacgtttgagtggttggggtggatgaagccggtgacgggggcggtgagctatgcgaggaggtttcaggggagggtgagcttttacatgacgagggagttggggatggcgtatatggatctgaggaatttgaggtttgatgatacggcggtgtatttttgtgcgaggaagacggcgggggatgtgagcggggataatagggggtatttctttgatctgtgggggagggggagtagggtgatagtgagcagt

SEQ ID NO: 56428 - RNA, 414 nt, synthetic construct
  misc_feature 1..414: note = derived and/or modified sequence opt11 from anti-HIV-1_HeavyChain
  source 1..414: mol_type = other RNA
caagggaccttggaacagagctggagcgaggtcaagaaattgggcgcgagcgtgcgcgtgagctgttggacgagcgaggacatattcaagaccgagctcatacactgggtcaggcaagcgccagggcaagggctcgagtggataggcgggatgaaggccgtgagcggggccgtgaactatggctcgctcgatttcaggcacagggtctcgctcacgcccgatcgagatctctcgaccgcgcacatggacatacgcgggctcacgcaagatgacacggccacgtacttttgcgcgcgccagaaatttgccaggggcgatcaagggtggtttttcgatctctggggcaggggaacgctaatagtcgtgagctcggcctcaacaaagggaccgagcgtgttcccgcacgatctcagg

SEQ ID NO: 56429 - RNA, 423 nt, synthetic construct
  misc_feature 1..423: note = derived and/or modified sequence opt11 from anti-HIV-1_HeavyChain
  source 1..423: mol_type = other RNA
caagcccacctagaacaatccggctccggcgtcaaaaaacccggcgcctccgtccgcgtctcctgctggacctcagaagacatcttcgaaaaatcagaactcatccactgggtccgccaagcccccggccaaggcctcgaatggatcggctgggtcaaaaccgtcacaggcgccgtaaacttcgcctccctagacttccgaaaccgcatctccctctcccgcgaccgcgacctctccaccgcctacatggacatccgcggcctaacccaagacgacaccgccacctacttctgcgcccgccaaaaattcgcctcccgctactccggcgaccaaggctcatacttcgacctctggggacgcggcaccctcatctgcgtctcatccgcatccacccgagcccaccgcctccccccccgctccgcc

SEQ ID NO: 56430 - RNA, 414 nt, synthetic construct
  misc_feature 1..414: note = derived and/or modified sequence opt11 from anti-HIV-1_HeavyChain
  source 1..414: mol_type = other RNA
caagcgcacttagaacagagcgggagcggggtcaagaaaccgggcgcgagcgtgcgcgtgagctgttggacgagcgaggacatattcgagcgcacggaattgatccattgggtgcgccaggccccgggccaaggcttggaatggatcgggtgggtaaaaacggtcacgggcgcggtcaatttcgggagcccgaactttcgccatcgagtgagcttgaccagggacagggacttgttcacggcccatatggatatcaggggcttgacccagggcgataccgcgacctatttctgtgccaggcaaaagttcgcgcgcggagaccagggctggttctttgacttgtgggggcgagggaccttgatcgtggtctcgagcgcgagcccgcgcgcgcacaggagctcgcccaggagcgcg

SEQ ID NO: 56431 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaagagcgagctcatacactgggtcagacaagcgcccgggcaagggctcgagtggataggctgggtcaagaccgtgaccggggccgtgaactttggatcgagcgatttcaggcaaagagtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacactcatagtcgtgagctcggcctcgaccaagggcccgagcgtgttcccgcacgatagcgcg

SEQ ID NO: 56432 - RNA, 414 nt, synthetic construct
  misc_feature 1..414: note = derived and/or modified sequence opt11 from anti-HIV-1_HeavyChain
  source 1..414: mol_type = other RNA
caagcgcacttggtccagagcgggagcggggtcaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcaagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggaacgctaatagtcgtgagctcggcctcgaccaagggcccgagcgtgttcccgcacgatctcagg

SEQ ID NO: 56433 - RNA, 414 nt, synthetic construct
  misc_feature 1..414: note = derived and/or modified sequence opt11 from anti-HIV-1_HeavyChain
  source 1..414: mol_type = other RNA
caagcgcaactggaacagagcgggagcggggtcaagaaaccgggcgcgagcgtgcgcgtgagctgttggacgagcgaggacatattcaagaccgagctcatacactgggtcaggcaagcgcccgggcaagggctcgagtggataggctgggtaaagaccgtgaccggggccgtgaactttggctcgcccaatttcaggcacagggtctcgctcacacgcgatcgcgatctatttaccgcgcacatggacatacgcgggctcacacaaggggacacggccacgtacttttgcgcgcgacagaaatttgaaaggggcgggcaagggtggtatttcgatctctggggcaggggaacgctcatagtcgtgagctcggcctcgaccaagggcccgagcgtgttcccgcacgacctaagg

SEQ ID NO: 56434 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcgggcagggaagtgaaaaagcccggggcctcggtcagggtctcgtgctggacctcggaagatatctttgaaaagagcgagctcatacactgggtcaggcaagcgcccgggcaagggctcgagtggataggctgggttaagacagtgaccggggccgtaaactttggctcgagcgatttcaggcaaagagtctcgctcacgcgcgatcgagatctctttaccgcgcacatggacatacgagggctcacgcaaggggacacggccacgtacttttgcgcgcgccagaaattttacgcgggcgggcaaggatggtatttcgatctctggggcaggggaacgctcatagtcgtgagctcggcctcgaccaagggcccgagcgtgttcccgcacgatctcagg

SEQ ID NO: 56435 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggggtcaagaaaccgggcgcgagcgtgcgagtgagctgttggacgagcgaggacatattcgagcgaacggaactgatccattgggtgcgccaggccccgggccagggcctggaatggatcgggtgggtgaaaacggtctcgggcgcggtcaatttcgggagcccgaactttcgccatagaataagcctgaccagggacagggacttgttcacggcccatatggatatcaggggcctgacccagggcgataccgcgacctattactgtgccaggcaaaagttcgagagcaggtacacgggcgggcaagggtggtatttcgatctctggggcagaggcacgcacatagtcgtgagctca

SEQ ID NO: 56436 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgaggggagtgagttgatacattgggtgaggcaggcgccggggcaggggttagagtggatagggtgggtgaagacggtgacgggggcggtgaatttcgggagcgcgtactttaggcatagggtgagcttgacgagggacagggacttgttcacggcgcatatggatataagggggttgacgcagggggatacggcgacgtattactgtgcgaggcagaagttctataagggggggcaggggtggtactttgacttgtgggggagggggacgttgatagtggtgagtagc

SEQ ID NO: 56437 - RNA, 381 nt, synthetic construct
  misc_feature 1..381: note = derived and/or modified sequence opt11 from anti-HIV-1_HeavyChain
  source 1..381: mol_type = other RNA
caagtccaactcgtccaatccggcgcagaagtcaaaaaacccggcgcctcagtcaaagtctcctgcaaagcctccggctacaccttcaccgactactacctccactgggtccgccaagcccccggccaaggcctagactgggtcggctggatcaaccccaactccggcggcaccaactacgcccaaaaattccaaggccgcgtcgccatgacccgcgacacctccctctcctccgtatacctcgacctcaactccctcacctccgccgactccggcacctacttctgcgcccgccaaacattcaaacccgacttctacttcgccgaccaaggctggtccttcaacctctggggccgcggcgcccacttcatcgtatcctcc

SEQ ID NO: 56438 - RNA, 414 nt, synthetic construct
  misc_feature 1..414: note = derived and/or modified sequence opt11 from anti-HIV-1_HeavyChain
  source 1..414: mol_type = other RNA
caggccgatctcgagcaatcgggctcgggcgtgaaaaagcccggggcctcggtcagggtctcgtgctggacctcggaagatatctttgaaaggaccaattacgtgcactgggtcaggcaagcgcccgggcgcgggctcgagtggataggctggagcaagaccgtgaccggggccgtgaactttggctcgcccaatttcaggcacagagtctcgctcacgcgcgatcgcgatctctttaccgcgcacatggacatacgagggctcacgcaaggggacacggcaacgtacttttgcgcgcgccagaaatttgaaaggggcggacaagggtggtatttcgatctctggggcaggggcacgctaatagtcgtgagctcggcctcgaccaagggcccgagcgtgttcccgcacgacctc

SEQ ID NO: 56439 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagcatgacggtgagttgtaagacggcggatgaggatatatttgatgcggcgtatatgcattgggtgaggcaggcgccggggcagacgtttgagtggctggggtggatgaagccggtgacgggggcggtgaattatgcgaggcagtttcaggggagggtgagtttttataggacgagggagttggggatagcgtatatggatctgagggatctgaagtttgatgatacggcggtgtatttttgtgcgaggaagacgaagggggatgtgagcggggacgatagggggtttttttttgatttgtgggggagagggacgagggtgatagtgagtagt

SEQ ID NO: 56440 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgaaaggaccgagctcatatactgggtcaggcaagcgcccgggcgcgggctagagtggataggctgggtcaagaccgtgagcgggaccgtgaactttggctcgagcgatttcaggaacaggatctcgctcacgcgcgatcgcgatctctcgaccgcgcacatggacatacgcgggctcacgcaagatgacacggccacgtacttttgcgcgcgccagaaatttgaatcgctctatagcgatgaccagggctcgtactttgacttgtgggggcgcgggaccttgatcatagtctcgagc

SEQ ID NO: 56441 - RNA, 414 nt, synthetic construct
  misc_feature 1..414: note = derived and/or modified sequence opt11 from anti-HIV-1_HeavyChain
  source 1..414: mol_type = other RNA
caggcccacctagagcaatcgggctcgggcgtcaaaaagctcggggcctcggtaagggtatcatgctggacctcggaagatatctttgaaaggaccaacctcatacactgggtcaggcaagcgcccgggcaagggctcgagtggataggctgggtcaaggccgtgagcggggccgtgaactatggctcgctcgacttcaggcacagggtctcgctcacgcgagatcgcgatctctcaaccgcgcacatggacatacgcggactcacgcaagatgacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctc

SEQ ID NO: 56442 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcgggggaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagc

SEQ ID NO: 56443 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgaaaggaccgagctcatatactgggtcaggcaagcgcccgggcgcgggctcgagtggataggctgggtcaagaccgtgagcgggaccgtgaactttggctcgagcgatttcaggaacaggatctcgctcacacgcgatcgagatctctcgaccgcgcacatggacatacgcgggctcacgcaagatgacacggccacgtacttttgcgcgcgccagaaatttgaatcgctatatagcgatgaccagggctcgtactttgacttgtgggggcgcgggaccttgatcacggtctcgagc

SEQ ID NO: 56444 - RNA, 429 nt, synthetic construct
  misc_feature 1..429: note = derived and/or modified sequence opt11 from anti-HIV-1_HeavyChain
  source 1..429: mol_type = other RNA
caagcccacctcgaacaatccggctccggcgtcaaaaaacccggcgcctccgtccgcgtctcctgctggtcatccgaagacatcttcgaacgcaccgaactcatccactgggtacgccaagcccccggccaaggcctcgaatggatcggctgggtcaaaaccgtcaccggcgccgtcaacttcggctccctcgacttccgccaccgcatctccctaacccgcgaccgcgacctcttcaccgcccacatggacatccgaggcctcacccaaggcgacaccgccacctacttctgcgcccgccaaaaattcgaatcccgctacaccggcggccaaggctggtacttcgacctctggggccgaggcacacacatcgtcgtctcctccgcctccaccaaaggcccctccggcctcccccccaccatctgccgc

SEQ ID NO: 56445 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggagtgaaaaagcccggggcctcggtcagggtctcgtgctggacctcggaagatatctttgaaaagagcgagctcatacactgggtcagacaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggagacacggccacatacttttgcgcgcgccagaaatttgccaggggcgatcaagggtggtttttcgatctctggggcaggggcacgctcatagtcgtgagctcggcctcgaccaagggcccgagcgtgttcccgcacgatctcagg

SEQ ID NO: 56446 - RNA, 417 nt, synthetic construct
  misc_feature 1..417: note = derived and/or modified sequence opt11 from anti-HIV-1_HeavyChain
  source 1..417: mol_type = other RNA
caagcacacctagaacagagcggaagcggagtcaaaaaaccgggcacaagcgtacgcgtaagctgctggacaagcgaagacatattcgaacgcacagaactgatacactgggtgcgccaggccccgggccagggcctagaatggatcggatgggtaaaaacagtcacgggcgcggtaaacttcggaagcccgaacttccgccaccgcgtaagcctaaccagagacagggacctattcacggcccacatggacatcagaggcctaacccagggcgacaccgcaacctacttctgcgccagacaaaaattcgaacgaggaggccagggctggtacttcgacctgtggggacgcgggaccctgatcgtagtctcaagcgcaagcacaaaagggccctcagtcttcccccacgacctgcgc

SEQ ID NO: 56447 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtatcgtgctggacctcggaagatatctttgaaaggaccgagctcatacactgggtcaggcaagcgcccgggcaagggctcgagtggataggatgggtcaagaccgtgaccggggccgtgaacttcggctcgcccaatttccggcacagggtctcgctcacgcgcgggcgcgacctctttaccgcgcacatggacatacgcgggctcacgcaaggggacacggccacgtactattgcgcgcgccagaaatttgaaaggggcgggcaagggtggtatttcgatctatggggcaggggcacgctcatagtcgtgagctcggcatcgaccaagggcccgagcgtgttcccgcacgatctcagg

SEQ ID NO: 56448 - RNA, 411 nt, synthetic construct
  misc_feature 1..411: note = derived and/or modified sequence opt11 from anti-HIV-1_HeavyChain
  source 1..411: mol_type = other RNA
caagcgcacttgggcgcgaactggagcggggtcaagaaattgggcgcgagcgtgcgcgtgagctgttggacgagcgaggacatattcgagcgcacggaattgatccattgggtgcgccaggcaccgggccagggcttggaatggatcgggtgggtgaaagcggtctcgggcgcggtcaattacgggagcttggactttcgccatcgcgtgagcttgaccagggacagggacttaagcacggcccatatggatatcaggggcttgacccaggacgataccgcgacctatttctgtgccaggcaaaagttcgcgcgcggggaccagggatggttctttgacttgtgggggcgcgggaccttgatcgtggtctcgagcgcgagcacgaaagggccctcggtctttccccagatc

SEQ ID NO: 56449 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgacttcaggcaaagggtctcgctcacgcgcgatcgagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56450 - RNA, 423 nt, synthetic construct
  misc_feature 1..423: note = derived and/or modified sequence opt11 from anti-HIV-1_HeavyChain
  source 1..423: mol_type = other RNA
caagcgcaattggaacagagcggggtcggggtcaagaaaccgggcgcgagcgtgcgcgtgagctgtctcgcgagcgaggacatattcaagaccgagctcatacactgggtcaggcaagcgcccgggcaagggctcgagtggataggctgggtcaagaccgtgaccggggccgtgaactttggctcgcaaatattcagacacagaatctcgctcacgcgcgatcgcgatctatttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagcgcgagcacgaaagggccctcggtctttccccatgacttgcgc

SEQ ID NO: 56451 - RNA, 411 nt, synthetic construct
  misc_feature 1..411: note = derived and/or modified sequence opt11 from anti-HIV-1_HeavyChain
  source 1..411: mol_type = other RNA
caagcgcacttggaacagagcggaagcggggtcaagaaaccgggcgcgagtgtgcgcgtgagctgttggacgagcgaggacatattcgagaaatcagaattgatccattgggtgcgccaggccccgggccagggcttggaatggatcgggtgggtgaaaacggtcacgggcgcggtcaatttcgcgcaccagatctcggacagggtctcgctcacgcgcgatcgcgatctctttaccgcgcacatggacatacgcgggctcacgcaaggggacacggccacgtacttttgcgcacgacagaaattttacgcgggagggcaagggtggtatttcgatctctggggaaggggcacgctcatagtcgtgagctcggcctcgaccaagggcccgagcgtattcccgaccatatgc

SEQ ID NO: 56452 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggagcgagctcatacactgggtcaggcaagcgcccgggcaagggctagagtggataggctgggtcaagaccgtgaccggggccgtgaactttggctcgccaaatttcaggcacagagtctcgctcacgcgcgatcgcgatctctttaccgcgcacatggacatacgagggctcacgcaaggggacacggccacgtacttttgcgcgcgccagaaatattacgcgggcgggcaagggtggtatttcgacctctggggcaggggaacgctcatatgcgtgagctcg

SEQ ID NO: 56453 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagctgatacattgggtgagacaggcgccggggcaggggttggagtggatagggtgggtgaagacggtgagtggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtaagtagc

SEQ ID NO: 56454 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagtggggtgaagaagttgggggcgagcgtgagggtgagctgttggacgagcgaggacatattcgagaggacggagttgatacattgggtgaggcaggcgccgggaagggggttggagtggatagggtgggtgaaggcggtaagtggggcggtgaattacgggagcttggactttaggcatagggtgagcttgacgagggacagggacttgttcacggcgcatatggatataagggggctgacgcaggacgatacggcgacgtatttctgtgcgaggcagaagttcgcgagaggggaccaggggtggttctttgacttgtgggggagggggacgttgatagtggtgagtagc

SEQ ID NO: 56455 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcggatgagggggtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgagatttgatgatacggcggtgtatttttgtgcgaggaagacggcgggggatgtgagtggggataagagggggtttttttttgatttgtgggggagggggagtagggtgatagtgagtagt

SEQ ID NO: 56456 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagcgggagcggggtgaagaagccgggggcgagcgtgagggtgagttgttggacgagtgaggacatatttgaggggagtgagttgatacattgggtgaggcaggcgccggggcaggggttggagtggatagggtgggtgaagacggtgacgggggcggtgaatttcgggagtgcgtactttaggcatagggtgagcttgacgagggacagggacttgtttacggcgcatatggatataagggggttgacgcagggggatacggcgacgtatttctgtgcgaggcagaagtattatgcgggggggcaggggtggtactttgacttgtgggggagggggacgttgatagtggtgagtagc

SEQ ID NO: 56457 - RNA, 378 nt, synthetic construct
  misc_feature 1..378: note = derived and/or modified sequence opt11 from anti-HIV-1_HeavyChain
  source 1..378: mol_type = other RNA
caagtgtacatggaacagcccggggtcgaggtcacgaaaccgggcgcgagcgtgaccttgagctgtaaaacggccgaggacgtgttcgatgccgcgtacatgcactgggtcaggcaagcgcccgggcaaacgttcgagtggttgggctggatcaagcccgtgaccggggccgtgaactatgcaaggaaatttcaagggcgcgtgagcttttacaggaccagggaattgggcatagcctatatggatctcaggaacttgcgctttgacgataccgcggtctatttctgtgccaggaaaacggccggggacgtgagcggggacaagcgcgggttctttttcgatctctggggcaggggctcgcgcgtgatcgtgagctcg

SEQ ID NO: 56458 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaagagtgagttgatacactgggtgaggcaggcgccggggcaggggttggagtggatagggtgggtgaagacggtgacgggggcggtgaatttcgggagcagtgactttaggcagagggtgagtttgacgagggacagggacttgttcacggcgcatatggatataagggggttgacgcagggggatacggcgacgtatttctgtgcgaggcagaagttcgagaggggggggcaggggtggatatttgacttgtgggggagggggacgttgataatagtgagtagc

SEQ ID NO: 56459 - RNA, 384 nt, synthetic construct
  misc_feature 1..384: note = derived and/or modified sequence opt11 from anti-HIV-1_HeavyChain
  source 1..384: mol_type = other RNA
caagcccacctcgtccaatccggctccgaagtcaaaaaacccggcgccttcgtccgcgtctcctgctggacctcagaagacatcttcgaagaaaccgaactcatccactgggtccgacaagcccccggccaaggcctcgaatggatcggctgggtcaaaacagtcaccggcgccgtcaacttcggctccctcgacttccgccaccgcatctccctcacccgcgaccgcgacctcttcaccgcccacatggacatccgcggcctcacccaaggcgacaccgccacctacttctgcgcccgccaaaaattcgaatcccgctacaccggcggccaaggctggtacttcgacctctggggccgcggcacccacatcgtcgtctcctcc

SEQ ID NO: 56460 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgtaaagcgagcgaggacatattcgagcgaacggaattgatccattgggtgcgccaggccccgggccagggcttggaatggatcgggtgggtgaaaacggtcacgggcgcggtcaatttcgggagcccgaactttcgccatcgcgtgagcctgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56461 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcgaggtgaagaagccgggggcgagcgtgagggtgagctgttggacgagcgaggacatattcgagaggacggagttgatacattgggtgaggcaggcgccggggcaggggttggagtggatagggtgggtgaagacggtgagtggggcggtgaatttcgggagcccgaactttaggcatagggtgagcttgacgagggacagggacctgttcacggcgcatatggatataagggggttgacgcagggggatacggcgacgtatttctgtgcgaggcagaagttcgagaggggagggcaggggtggtactttgacttgtgggggagggggacgttgatagtggtgagtagc

SEQ ID NO: 56462 - RNA, 375 nt, synthetic construct
  misc_feature 1..375: note = derived and/or modified sequence opt11 from anti-HIV-1_HeavyChain
  source 1..375: mol_type = other RNA
caggcccatctcgtgcaatcgggatcgggcgtgaaaaagcccggggcctcggtcagggtctcgtgctggacctcggaagatatatttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggaacgctcatagtcgtgagctcg

SEQ ID NO: 56463 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagtttggactttaggcatagggtgagcttgacgagggacagggacttgagcacggcgcatatggatataagggggttgacgcaggacgatacggcgacgtatttctgtgcgagacagaagttcgagaggggggggcaggggtggtactttgacttgtgggggagggggacgttgatatgtgtgagtagc

SEQ ID NO: 56464 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccagggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacagccacgtacttttgcgcgcgccagaaattttacgcgggcgggcaagggtggtatttcgatctctggggcaggggcacgcttatagtcgtgagctcg

SEQ ID NO: 56465 - RNA, 381 nt, synthetic construct
  misc_feature 1..381: note = derived and/or modified sequence opt11 from anti-HIV-1_HeavyChain
  source 1..381: mol_type = other RNA
caggtccagctagagcaagcgggcgcgggcgtgaaaaagcccgggccctcggtcacgctctcgtgcaagaccgcggacgaggacgtgttcgatgccgcgtacatgcactgggtcaggcaagcgcccgggcaaacgttcgagtggttgggctggatgaagcccgtgacaggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgagggtactttttcgatctctggggcaggggctcgcgcgtgatcgtgagctcg

SEQ ID NO: 56466 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagacagtgagcggggccgtgaactttggctcgcccaatttcaggcaaagggtctcgctcacgcgcgatcgcgatctctttaccgcacacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56467 - RNA, 381 nt, synthetic construct
  misc_feature 1..381: note = derived and/or modified sequence opt11 from anti-HIV-1_HeavyChain
  source 1..381: mol_type = other RNA
caagtgttcatggaacaggccggggccgggatgaagaaaccgggcgcgagcatgaccgtgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctaccgcacgcgcgagctcgggatcgcgtacatggacttgcgcaatctcaggttcgatgacacggccgtgtacttttgcgcgcgcaagaccgcgggcgatgtctcgggcgataaaaggggctttttctttgacttgtgggggcgcgggagcagggtcatagtctcgagc

SEQ ID NO: 56468 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggcgagctgttggacgagcgaggacatattcgagaggacggagttgatacattgggtgaggcaggcgccggggcaggggttggagtggatagggtgggtgaagatagtgagtggggcggtgaatttcgggagcccgaactttaggcagagggtgagcttgacgagggacagggacttgttcacggcgcatatggatataagggggttgacgcagggggatacggcgacgtatttctgtgcgaggcagaagttcgagaggggggggcaggggtggatatttgacttgtgggggagggggacgttgatagcggtatcgagc

SEQ ID NO: 56469 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagcatgacggtgagttgtaagacggcggatgaggatatatttgatgcggcgtatatgcattgggtgagacaggcgagggggcagacgtttgagtggctggggtggatgaagccggtgacgggggcggtgaattatgcgaggcagtttcagggaagggtgagtttttataggacgagagagttggggatagcgtatatggacttgagagatttgaagtttgatgatacggcggtgtatttttgtgcgaggaagacgaagggggatgtgagtggggatgacagggggtttttttttgacttgtgggggagggggacgagggtgatagtgagtagc

SEQ ID NO: 56470 - RNA, 384 nt, synthetic construct
  misc_feature 1..384: note = derived and/or modified sequence opt11 from anti-HIV-1_HeavyChain
  source 1..384: mol_type = other RNA
caggcccatctagagcaatcgggcgcgggcgtgaaagagcccggggcctcggtcagggtctcgtgctggagctcggaagatatctttgaaaggaccgagctcatacactgggtcaggcaagcgcccgggcaagggctagaatggataggctgggtcaagaccgtgaccggggccgtgaactttggctcgctagatttcaggcacaggatctcgctcacgcgcgatcgcgatctcttgaccgcgcacatggacatacgcgggctaacgcaaggggacacggccacgtacttttgcgcgcgccagaaatttgaatcacgctataccgggggccagggctggtactttgacttgtgggggcgcgggacccatatcgtggtctcgagc

SEQ ID NO: 56471 - RNA, 384 nt, synthetic construct
  misc_feature 1..384: note = derived and/or modified sequence opt11 from anti-HIV-1_HeavyChain
  source 1..384: mol_type = other RNA
caagtccaactcgtccaatccggctccgccatgaaaaaacccggagcctccgtcagagtctcctgctggacctccgaagacatcttcgaacgcaccgaactcatctactgggtccgacaagcccccggccgcggcctcgaatggatcggctgggtcaaaaccgtctccggcaccgtcaacttcggctcctccgacttccgcaaccgcatctccctcacccgcgaccgcgacctctccaccgcccacatggacatccgcggcctcacccaagacgacaccgccacctacttctgcgcccgccaaaaattcgaatccctctactccgacgaccaaggctcctacttcgacctctggggccgcggcaccctcatcatagtctcctcc

SEQ ID NO: 56472 - RNA, 384 nt, synthetic construct
  misc_feature 1..384: note = derived and/or modified sequence opt11 from anti-HIV-1_HeavyChain
  source 1..384: mol_type = other RNA
caagcgcacttggtccagagcgcgagcggggtcaagcgcccgggcgcgagcgtgcgcgtgagctgttggacgagcgaggacatattcgagcgcacggaattgatctattgggtgagacaggccccgggccagggcttggaatggatcgggtgggtgaaaacggtctcgggagcggtcaatttcgggagccaggactttcgccatcgcatcagcttgacaagggacagggacttgttcacggcccatatggatataaggggcttgacccagggcgataccgcgacctatttctgtgccaggcaaaagttcgagagcaggtacacgggcgggcaagggtggtatttcgatctctggggcagaggcacgcacatagtcgtgagctcg

SEQ ID NO: 56473 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaggcgggggggggggtgaagaagccgggggcgagtgtgacgctgagttgtaagacagcggacgaggatgtgttcgatgcggcgtatatgcattgggtgaggcaggcgccggggcagacgtttgagtggttggggtggatgaagccggtgacgggggcggtgagttatgcgaggaagtttcaggggagggtgagcttttacatgacgagggagttggggatggcgtatatggatctgaggaatttgagatttgacgatacggcggtgtatttttgtgcgaggaagacggcaggggatgtgagtggggataagagggggtttttttttgatttgtgggggagggggagtagggtgatagtgagcagt

SEQ ID NO: 56474 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcgagggctatatgatacactgggtcaggcaagcgcccgggcaagggctagagtggataggctgggtcaagaccgtgaccggggccgtgaactttggctcggcctatttcaggcacagggtatcgctcacgcgcgatcgcgatctctttaccgcgcacatggacatacgcgggctcacgcaaggggacacggccacgtacttttgcgcgcgccagaaattttacaagggcgggcaagggtggtatttcgatctctggggcaggggcacgctcatagtcgtgagctcg

SEQ ID NO: 56475 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcgcgggctcgagtggataggctgggtcaaggccgtgagcggggccgtgaactatggctcgctcgatttcaggcacagggtctcgctaacgcgcgatcgcgatctctttaccgcgcacatggacatacgagggctcacgcaagatgacacggccacgtacttttgcgcgcgccagaaatttgccaggggcgatcaagggtggtttttcgatctctggggcaggggcacgctcatatgcgtgagctcg

SEQ ID NO: 56476 - RNA, 375 nt, synthetic construct
  misc_feature 1..375: note = derived and/or modified sequence opt11 from anti-HIV-1_HeavyChain
  source 1..375: mol_type = other RNA
caggcccatctcgtgcaatcgggctcgggcgtgaaaaagagcggggcctcggtcagggtctcgtgctggacctcggaagatatctttgaaaagagcgagctcatacactgggtaaggcaagcgcccgggcaagggctcgagtggataggctgggtcaagaccgtgaccggggccgtgaactttggctcgagcgatttcaggcaaagggtctcgctcacgcgagatagagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56477 - RNA, 378 nt, synthetic construct
  misc_feature 1..378: note = derived and/or modified sequence opt11 from anti-HIV-1_HeavyChain
  source 1..378: mol_type = other RNA
caggtctatatggagcgcgcgggcgcgggcgtgaaaaagcccggggcctcggtcacgctctcgtgcaagaccgcggacgaggacgtgttcggggcctatatgcattgggtgcgccaggccccgggccagacctttgaatggctcgggtggatgaaaccggtcacgggcgcggtctcgtacgcgcgcaagttccagggcagggtctcgttctatatgacgcgcgagctcgggatggcgtacatggacttgcgcaatctcaggttcgatgacacggccgtgtacttttgcgcgcgcaagaccgcgggcgatgtctcgggcgataacaggggctatttctttgacttgtgggggcgcgggagcagggtaatagtctcgagc

SEQ ID NO: 56478 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagtgtgagggtgagctgttggacgagcgaggacatattcgaggggagtgagttgatacattgggtgaggcaggcgccggggcaggggttggagtggatagggtgggtgaagacggtgacgggggcggtgaatttcgggagcgcgtactttaggcatagagtgagcctgacgagggacagggacttgttcacggcgcatatggatataagggggttgacgcagggggatacggcgacgtatttctgtgcgaggcagaagttctataagggggggcaggggtggtactttgacttgtgggggagggggacgttgatagtggtgagtagc

SEQ ID NO: 56479 - RNA, 375 nt, synthetic construct
  misc_feature 1..375: note = derived and/or modified sequence opt11 from anti-HIV-1_HeavyChain
  source 1..375: mol_type = other RNA
caatcgcacttggaacagagcgggagcgcgatgaagaaaccgggcgcgagcgtgcgcgtgagctgttggacgagcgaggacatattcgagcgcacggaattgatctattgggtgcgccaggccccgggcaggggcttggaatggatcgggtgggtgaaaacggtctcgggcacggtcaatttcgggagctcggactttcgaaatcgcgtgagcctgacaagggacagggacttgttcacggcccatatggatatcagaggcttgacccaggacgataccgcgacctatttctgtgccaggcaaaagttcgcgcgcggggaccagggctggttctttgacttgtgggggcgcgggaccttgatcgtggtctcgagc

SEQ ID NO: 56480 - RNA, 384 nt, synthetic construct
  misc_feature 1..384: note = derived and/or modified sequence opt11 from anti-HIV-1_HeavyChain
  source 1..384: mol_type = other RNA
caagcgcacttggtccagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcgcgggcgcagtcaatttctcgagcctggactttcgccatcgcatcagcttgaccagggacagggacttgttcacggcccatatggatataaggggcttgacccagggcgatacagcgacctatttctgtgccaggcaaaagttcgagagcaggtacacgggcgggcaagggtggtatttcgatctctggggcaggggcacgcacatagtcgtgagttcg

SEQ ID NO: 56481 - RNA, 384 nt, synthetic construct
  misc_feature 1..384: note = derived and/or modified sequence opt11 from anti-HIV-1_HeavyChain
  source 1..384: mol_type = other RNA
caggcgcacctggaacagagcgggagcggggtaaagaaaagtggggcgagcgcgagggtgagctgttggtcgagcgaggacatattcgagagaacggaactgatacattgggtgagacaggcaccaggacagggattggaatggatagggtgggtgaaaacggtaacaggcgcggtaaatttcgggagcttggactttagacatagaataagcctgacaagggacagggacttgttcacggcacatatggatatcaggggactgacacagggagatacagcgacatatttctgtgcaaggcaaaagttcgagagcaggtacacgggagggcaagggtggtatttcgatctatggggaaggggaacgcacatagtagtgagcagt

SEQ ID NO: 56482 - RNA, 369 nt, synthetic construct
  misc_feature 1..369: note = derived and/or modified sequence opt11 from anti-HIV-1_HeavyChain
  source 1..369: mol_type = other RNA
ttgctccagctcgtgcaatcgggagcggaagtgaaaaagcccggggcctcggtcaaggtcacgtgcaaggcctcgggctatacctttaccgggtacatacactgggtcaggcaagcgccagggcaagggctcgagtggataggctgggtaaaggccgtgagcggggccgtaaactatggctcgctcgatttcaggcacagggtctcgctcacgcacgatcgagatctatcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56483 - RNA, 369 nt, synthetic construct
  misc_feature 1..369: note = derived and/or modified sequence opt11 from anti-HIV-1_HeavyChain
  source 1..369: mol_type = other RNA
caagtgcaattggtccagagcggggccgaggtcaagaaaccgggcgcgagcgtgaaagtgagctgtaaagcgagcgggtgcacgttcacgggctattacatgcactgggtcaggcaagcgcccgggcaagggctcgagtggatgggctggatcaatcccaatagcgggggcacgaactatgcccagaaatttcaagggcgcgtgaccatgaccagagacacgagcataagcacggcctatatggagctctcgcgcttgcgctcggacgataccgcggtctattactgtgccaggcaaaagttcgcgcgcggggaccagggctggttctttgacttgtgggggcgcgggaccttgatcgtggtctcgagc

SEQ ID NO: 56484 - RNA, 369 nt, synthetic construct
  misc_feature 1..369: note = derived and/or modified sequence opt11 from anti-HIV-1_HeavyChain
  source 1..369: mol_type = other RNA
caagtccaactcgtccaatcaggcaccgaactccgcaaacccggcgcctcagtcaaagtctcctgcaaagcctcaggctacaccttctccggcagctacatccactgggtccgccaagcccccggccaaggcctagaatgggtcggctggatcaaccccagctccggcgccacccaatgcgccaaaaaattccaagacaaagtcaccatgacacgcgacaccacaaacaacaccgtctacatggaagtcaaccgactcatatcagacgacaccgccacctacttctgcgcccgccaaaaattcgcccgcggcgaccaaggctggttcttcgacctctggggcagaggcaccctcatcgtcgtctcctcc

SEQ ID NO: 56485 - RNA, 372 nt, synthetic construct
  misc_feature 1..372: note = derived and/or modified sequence opt11 from anti-HIV-1_HeavyChain
  source 1..372: mol_type = other RNA
caagtgctcttggtccagagcggggccgaggtcaagaaaccgggctcgagcgtgaaagtgagctgtaaaacgagcggggactcgctcacgaaatatgccctgcactgggccaggcaagcgcccgggcaagggctagagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56486 - RNA, 372 nt, synthetic construct
  misc_feature 1..372: note = derived and/or modified sequence opt11 from anti-HIV-1_HeavyChain
  source 1..372: mol_type = other RNA
caagtgcaactggtccagagcgggaccgaggtcaagaccccgggcgcgagcgtgaaagtgagctgtaaagcgagcgggtacacgttcacgaactatgacataaactgggtcaggcaagcgcccgggcaagggctcgagtggataggctgggtaaagaccgtgaccggggccgtgaactttggctcgagcgatttcaggcaaagggtctcgctcacgcgagatcgcgatctctttaccgcgcacatggacatacgcgggctcacgcaaggggacacggccacgtacttttgcgcgcgccagaaattttacgcgggcgggcaagggtggtatttcgatctctggggaaggggcacgctcatagtcgtgagctcg

SEQ ID NO: 56487 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggacgaggtcaagaaaccgggcgcgagcgtgaaagtgagctgtaaagcgagcgggaaagggttcccgacctcgctagtgacctgggtaaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56488 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggctcgagcgtgaaagtgagctgtaaaacgagcggggacatactcacgaactatggcctgaactgggtcaggcaagcgcccgggcaagggctcgagtggataggctgggtcaaggccgtgagcggggccgtgaactatggctcgctcgatttcaggcacagggtctcgctaacgcgcgatcgcgatctctcgacagcgcacatggacatacgcgggctcacgcaagatgacacggcaacgtacttttgcgcgcgccagaaatttgccaggggcgatcaagggtggtttttcgatctctggggcaggggcacgctcatagtcgtgagctcg

SEQ ID NO: 56489 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgagagtgagctgtaaaacgagcgggtacccgttctcgcgctatggcataagctgggtcaggcaagcgcccgggcaagggctcgtgtggatggcctgggtcaaggccgtgagcggggccgtgaactatggatcgctcgatttcaggcacagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56490 - RNA, 372 nt, synthetic construct
  misc_feature 1..372: note = derived and/or modified sequence opt11 from anti-HIV-1_HeavyChain
  source 1..372: mol_type = other RNA
cgcgagcaactggtccagagcggggccgaggtcaagaaaccgggcgcgagcgtgaaagtgagctgtaaaacgagcgggaacacgttcgggagctatgactttaactgggtcaggcaagcgcccgggcaagggctcgagtggataggctgggtcaagatcgtgagcggggccgtgaactttggctcgcccaatttcaggcaaagggtctcgctcacgcgcgatcgagatctctttaccgcgcacatggacatacgcgggctcacgcaaggggacacggccacgtacttttgcgcgcgccagaaatttgaaaggggcgggcaagggtggatattcgatctctggggcaggggaacgctcatagccgtgagctcg

SEQ ID NO: 56491 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggtacacattcacgagctattacatgcactgggtcaggcaagcgcccgggcaagggctcgagtggataggatgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatattacgcgggagggcaagggtggtatttcgatctctggggcaggggcacgctcatagtcgtgagctcg

SEQ ID NO: 56492 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggtacacgttcacgagctattacatgcactgggtcaggcaagcacccgggcaagggctcgagtggataggctgggtcaagaccgtgaccgggaccgtgaactttggctcgctaaatttcaggcaaagggtctcgctcacgcgcgatcgcgatctctttaccgcgcacatggacatacgcgggctaacgcaaggggacacggccacgtacttttgcgcgcgccagaaatttgaaaggggcgggcaagggtggtatttcgatctctggggcaggggcacgctcatagtcgtgagctcg

SEQ ID NO: 56493 - RNA, 372 nt, synthetic construct
  misc_feature 1..372: note = derived and/or modified sequence opt11 from anti-HIV-1_HeavyChain
  source 1..372: mol_type = other RNA
caagtgcaattgggccagagcggggccgagatgaagaaaccgggatcgagcgtgaaagtgagctgtaaagcgagcgggggcacgttcaggcactcgcccataagctgggtcaggcaagcgcccgggcaagggctcgagtggataggctgggtcaaggccgtgagcggggccgtgaactatggctcgctcgatttcaggcacagggtctcgctcacgcgcgatcgcgatctctcgacagcgcacatggacatacgcgggctcacgcaagatgacacggccacgtacttttgcgcgcgccagaaatttgccaggggcgatcaagggtggtttttcgatctctggggcaggggaacgctcatagtcgtgagctcg

SEQ ID NO: 56494 - RNA, 369 nt, synthetic construct
  misc_feature 1..369: note = derived and/or modified sequence opt11 from anti-HIV-1_HeavyChain
  source 1..369: mol_type = other RNA
caagtccaactcgtccaatccggcgccgaagtccgcacccccggcgcctccgtcaaagtctcctgcaaagcctcaggctacaacttcatcgcctaccacgtccactgggtccgccaagcccccggccaaggcctcacctggatgggctggatcaaccccgactccggcgacaccgtctacgcccaaaacttcgtcgaccgcgtcatgatgacccgcaacacctccatccaaaccgtctacctcgaactcaacgtactcaccctcgaagacaccgccacctacttctgcgcccgccaaaaattcgcccgcggcgaccaaggctggttcttcgacctctggggccgcggcaccctcatagtcgtctcctcc

SEQ ID NO: 56495 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggtacacgttcacggtctattacatgcactgggtaaggcaagcgccagggcgcgggctcgagtggataggctgggtcaaggccgtaagcggggccgtgaactatggctcgctcgatttcaggcacagggtctcgctcacgcgcgatcgcgatctctttaccgcgcacatggacatacgcgggctcacgcaagatgacacggccacgtacttttgcgcgcgacagaaatttgccaggggcgatcaagggtggtttttcgatctctggggcaggggcacgctcatagtcgtgagctcg

SEQ ID NO: 56496 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagtgtgagggtgagctgttggacgagcgaggacatattcgagaggacggagttgatacattgggtgaggcaggcgccggggcaggggttggagtggatagggtgggtgaaggcggtgagtggggcggtgaattacgggagcctggactttaggcatagggtgagcttgacgagggacagggacttattcacggcgcatatggatataagagggctgacgcagggggatacggcgacgtatttctgtgcgaggcagaagttcgagaggggggggcaggggtggtactttgacctgtgggggagggggacgttgatagtggtgagtagc

SEQ ID NO: 56497 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggtacacgttcataggctattacatgcactgggtcaggcaagcgcccgggcaagggctagagtggatgggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56498 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcagggactggagtggatagggtgggtgaagacggtgagtggggcggtgaatttcgggagcttgaactttaggcatagggtgagcttgacgagggacagggacttgttcacggcgcatatggatataagggggctgacgcagggggatacggcgacgtatttctgtgcgaggcagaagttcgcgagaggggaccaggggtggttctttgacttgtgggggagggggacgttgatagtggtgtcgagc

SEQ ID NO: 56499 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagtggggtcaagaaattgggcgcgagcgtgcgcgtgagctgttggacgagcgaggacatattcaaggacaggatcgatcactgggtcaggcaagcgcccgggcaagggctcgagtggataggctgggtcaaggccgtgagcggggccgtgaactatggctcgctcgatttcaggcacagggtctcgctcacgcgagatcgcgatctctttaccgcgcacatggacatacgcgggctaacgcaagatgacacggccacgtacttttgcgcgcgacagaaatttgccaggggcgatcaagggtggtttttcgacctctggggcaggggcacgctcatagtcgtgagctcg

SEQ ID NO: 56500 - RNA, 375 nt, synthetic construct
  misc_feature 1..375: note = derived and/or modified sequence opt11 from anti-HIV-1_HeavyChain
  source 1..375: mol_type = other RNA
caggtccagctcgcgcaatcgggcgcggaagtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttacagcgcacatggacatacgcgggctcacgcaagatgacacggccatatacttttgcgcgcgccagaaatttgccaggggcgatcaagggtggtttttcgatctctggggcaggggcacgctcatagtcgtgagctcg

SEQ ID NO: 56501 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacataagcaaggccgagctcatacactgggtcaggcaagcgcccgggcaagggctcgagtggataggctgggtcaagaccgtgagcggggccgtgaactttggctcgcccaatttcaggcacagggtctcgctcacgcgcgatcgcgatctctttaccgcgcacatggacatacgcgggctaacgcaaggggacacggccacgtacttttgcgcgcgccagaaatttgaaaggggcgggcaagggtggtatttcgatctctggggcaggggcacgctcatagtcgtgagctcg

SEQ ID NO: 56502 - RNA, 372 nt, synthetic construct
  misc_feature 1..372: note = derived and/or modified sequence opt11 from anti-HIV-1_HeavyChain
  source 1..372: mol_type = other RNA
accgcgcacttggaacagagcgggagcggggtcaggcgcccgggcgcgagcgtgcgcgtgagctgttggacgagcggggacatattcaagagcgagctcatacactgggtcaggcaagcgcccgggcaagggctagagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56503 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagcgcccgggcgcgagcgtgcgcgtgagctgttggacgagcgaggacatattcaataccgagctcatacactgggtcaggcaagcgcccgggcaagggctagagtggataggctgggtcaagaccgtgagcggggccgtgaactttggctcgctcaatttcaggcacagggtctcgctaacgcgcgatcgcgatctctttaccgcgcacatggacatacgcgggctcacgcaaggggacacggcaacgtacttttgcgcgcgccagaaatttgccaggggcgatcaagggtggtttttcgatctctggggcaggggcacgctcatagtcgtgagctcg

SEQ ID NO: 56504 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcaagaccgagctcatacactgggtcaggcaagcgcccgggcaagggctcgagtggataggctgggtcaaggccgtgagcggggccgtgaactatggctcgctcgatttcaggcacagggtctcgctaacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctaatagtcgtgagctcg

SEQ ID NO: 56505 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggcagaggtcaagaaaccgggcgcgagcgtgcgcgtgagctgtaaagcgagcgggtacacgttcacggcctattacatacactgggtcaggcaagcgccagggcaagggctcgagtggataggctgggtcaagaccgtgagcggggcagtgaactttggctcgcccaatttcaggcacagggtctcgctcacgcgagatcgcgatctctttacagcgcacatggacatacgcgggctcacgcaaggggacacggccacgtacttttgcgcgcgccagaaatttgaaagaggcgggcaagggtggtatttcgatctctggggcaggggcacgctaatagtcgtgagctcg

SEQ ID NO: 56506 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcgagagcaagaaaccgggcgcgagcgtgcgcgtgagctgttggtcgagcgaggacatattcaagaccgagctcatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56507 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagcgggagcgaggtgaagaagccgggggcgagtgtgagggtgagctgttggacgagtgaggacatattcgagaagagcgagttgatacattgggtgaggcaggcgccggggcaggggttggagtggatagggtgggtgaagacggtgacgggggcggtgaatttcgggagcagcgactttaggcagagggtgagtttgacgagggacagagacttgtttacggcgcatatggatataagggggttgacgcagggggatacggcgacgtatttctgtgcgaggcagaagttctatgcgggggggcaggggtggtattttgacttgtgggggagggggacgttgatagtggtgagcagc

SEQ ID NO: 56508 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacaggtctgggccggggtcaagaaattgggcgcgagcgtgcgagtgagctgttggacgagcgaggacatattcaagaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctcgaccgcgcacatggacatacgcgggctcacgcaagatgacacggccacgtacttttgcgcgcgccagaaatttgcaaggggcgatcaagggtggtttttcgatctctggggcaggggcacgctcatagtcgtgagctcg

SEQ ID NO: 56509 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagtgtgcgcgtgagctgttggacgagcgaggacatattcgagcgctcggaattgatccattgggtgcgccaggccccgggccagggcttggaatggatcgggtgggtgaaaacggtcacgggcgcggtcaatttcgggagcaatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcagaggcacgctcatagtcgtgagctcg

SEQ ID NO: 56510 - RNA, 375 nt, synthetic construct
  misc_feature 1..375: note = derived and/or modified sequence opt11 from anti-HIV-1_HeavyChain
  source 1..375: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctagaatggatcggctgggtcaaaatcgtctccggcaccgtcaacttcgcctccctcgacttccgccaccgcgtctccctcacccgcgaccgcgacctctccaccgcccacatggacatccgaggcctcacccaagacgacaccgccacctacttctgcgcccgccaaaaattcgcccgcggagaccaaggctggttcttcgacctctggggccgcggcaccctcatcgtcgtctcctcc

SEQ ID NO: 56511 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcacgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatttctgtgccaggcaaaagttcgcgcgcggggaccagggctggttctttgacttgtgggggcgcgggaccctgatcgtggtctcgagc

SEQ ID NO: 56512 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcggggggatattcgagaggacggagttgatacattgggtgaggcaggcgccggggcaggggttggagtggatagggtgggtgaagacggtgacgggagcggtgaatttcgggagcccgaactttaggcatagggtgagcttgacgagggacagggacttgttcacggcgcatatggatataagggggttgacgcagggggatacggcgacgtatttctgcgcgaggcagaagttcgagaggggggggcaggggtggtactttgacttgtgggggagggggacgttgatagtggtgagtagc

SEQ ID NO: 56513 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggtcgagcgaggacatattcgagcgcacggaattgatccattgggtgcgccaggcaccgggccagggcttggaatggatcggatgggtgaaaacggtcacgggcgcggtcaatttcgggagcctggactttcgccatcgcatcagcttgaccagggacagggacttgttcacggcccatatggatataaggggcttgacccaggacgataccgcgacctatttctgtgccaggcaaaagttcgcgcgcggggaccagggctggttctttgacttgtgggggcgcgggacattgatcgtggtctcgagc

SEQ ID NO: 56514 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcgagcgatttcaggcaaagagtctcgctcacgcgcgatcgcgacctatttaccgcgcacatggacatacgcggactaacgcaaggggacacggccacgtacttttgcgcgcgccagaaatttgaaaggggcgggcaagggtggatattcgatctctggggcaggggcacgctcatagccgtgagctcg

SEQ ID NO: 56515 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaggcccggggcctcggtcagggtctcgtgctggacctcggaagatatctttgaaacgaccgagctcatacactgggtcaggcaagcgcccgggcaagggctcgagtggataggctgggtcaagaccgtgagcggggccgtaaactttggctcgctcaatttcaggcacagggtctcgctaacgcgcgatcgcgatctatttaccgcgcacatggacatacgagggctcacgcaaggggacacggccacgtacttttgcgcgcgccagaaatttgccaggggcgatcaagggtggtttttcgatctctggggcaggggcacgctcatagtcgtgagctcg

SEQ ID NO: 56516 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctaggggcctcggtcagggtctcgtgctggacctcggaagatatctttgaaaggaccgagctaatacactgggtcaggcaagcgcccgggcaagggctagagtggataggctgggtcaaggccgtgagcggggccgtgaactatggctcgctcgatttcaggcaaagggtctcgctaacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcattgtcgtgagctcg

SEQ ID NO: 56517 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggacagggcttggaatggatcgggtgggtgaaaacggtcacgggcgcggtcaatctagtgcaccagatctcggacagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56518 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgggcgagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56519 - RNA, 375 nt, synthetic construct
  misc_feature 1..375: note = derived and/or modified sequence opt11 from anti-HIV-1_HeavyChain
  source 1..375: mol_type = other RNA
caagcgcacttagaacagagcggggccggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggacattgatcgtggtctcgagc

SEQ ID NO: 56520 - RNA, 375 nt, synthetic construct
  misc_feature 1..375: note = derived and/or modified sequence opt11 from anti-HIV-1_HeavyChain
  source 1..375: mol_type = other RNA
caatcccacctcgaacaatccggctccgccatgaaaaaacccggcgcctccgtccgcgtctcctgctggacatccgaagacatcttcgacaccaccgaactaatccactgggtccgccaagcccccggccaaggcctcgaatggatcggctgggtcaaagccgtctccggcgccgtcaactacggctccctcgacttccgccaccgcgtctccctcacccgcgaccgcgacctctccaccgcccacatggacatccgcggcctcacccaagacgacaccgccacctacttctgcgcccgccaaaaattcgcacgcggcgaccaaggctggttcttcgacctctggggccgcggcaccctcatcgtcgtctcctcc

SEQ ID NO: 56521 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcaagaccgagctcatacactgggtcagacaagcgcccgggcaagggctcgagtggataggctgggtcaagaccgtgagcggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaattcgaaaggggcgggcaagggtggtatttcgatctctggggcaggggcacgctcatagtcgtgagctcg

SEQ ID NO: 56522 - RNA, 375 nt, synthetic construct
  misc_feature 1..375: note = derived and/or modified sequence opt11 from anti-HIV-1_HeavyChain
  source 1..375: mol_type = other RNA
caagtgcacttggaacagagcgggagcggggtcaagaaattgggcgcgagcgtgcgcgtgagctgttggacgagcgaggacatattcgagcgcacggaactgatccattgggtgcgacaggccccgggccagggcttggaatggatcgggtgggtgaaagcagtctcgggcgcggtcaattacgggagcttggactttcgacatcgcgtgagcttgaccagggacagggacttgttcacggcccatatggatatcaggggcttgacacaggacgataccgcgacctatttctgtgccaggcaaaagttcgcgcgcggggaccagggctggttctttgacttgtgggggcgcgggaccttgatcgtggtctcgagc

SEQ ID NO: 56523 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgcgagcggggtcaagcgcccgggcgcgagcgtgcgcgtgagctgttggacgagcgaggacatattcgagcgctcggaactgatctattgggtgcgccaggccccgggccagggcttggaatggatcgggtgggtgaaaacggtctcgggcgcggtcaatctcgcgcccaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56524 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtaaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcgagtgatttcagacaaagggtctcgctcacgcgcgatggcgatctctttaccgcgcacatggacatacgcgggctcacgcaaggggacacggccacgtacttttgcgcgcgacagaaattttacgcgggcgggcaagggtggtatttcgatctctggggcaggggcacgctcataatcgtgagctcg

SEQ ID NO: 56525 - RNA, 375 nt, synthetic construct
  misc_feature 1..375: note = derived and/or modified sequence opt11 from anti-HIV-1_HeavyChain
  source 1..375: mol_type = other RNA
caggcacacctagagcaaagcggaagcggagtgaaaaagctgggggcaagcgtaagggtaagctgctggacgagcgaagacatattcgaaagaacagagctaatacactgggtaaggcaggcaccagggcaagggctagagtggataggatgggtaaaggcagtgagcggggcagtgaactacggaagcctagacttcaggcacagggtaagcctgacgagcgacagagacctaagcacagcgcacatggacataagagggctgacgcaagacgacacggcaacgtacttctgcgcgagacagaaattcgcaaggggagaccaagggtggttcttcgacctatggggaaggggaacgctaatagtagtgagcagc

SEQ ID NO: 56526 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtatcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56527 - RNA, 372 nt, synthetic construct
  misc_feature 1..372: note = derived and/or modified sequence opt11 from anti-HIV-1_HeavyChain
  source 1..372: mol_type = other RNA
caagcgcacctggaacagagcgggagcggggtcaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56528 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcgagaaatcggaattgatacattgggtgcgccaggccccgggccagggcttggaatggatcgggtgggtgaaaacggtcacgggcgcggtcaatttcgggcaccagatctcggacagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56529 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaagagtgagttgatacattgggtgaggcaggcgccggggcaggggttggagtggatagggtgggtgaagacggtgacgggggcggtgaatttcgggagcagtgactttaggcagagggtgagcttgacgagggacagggacttgttcacggcgcatatggatataagggggttgacgcaggacgatacggcgacgtatttctgtgcgaggcagaagtttgcgaggggggaccaggggtggttctttgacttgtgggggagggggacgttgatagtggtgagtagc

SEQ ID NO: 56530 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaattgggcgcgagcgtgcgcgtgagctgttggacgagcgaggacatactcaagaccgagctcatacactgggtcaggcaagcgcccgggcaagggctcgagtggataggctgggtcaaggccgtgagcggggccgtgaactatggctcgctcgatttcaggcacagggtctcgctaacgcgcgatcgagatctctttaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56531 - RNA, 372 nt, synthetic construct
  misc_feature 1..372: note = derived and/or modified sequence opt11 from anti-HIV-1_HeavyChain
  source 1..372: mol_type = other RNA
gtcaggagcgtggtccagtgcgaggccggggtcaagaaaccgggcgcgagcgtgaaaataagctgtgccacgagcgggtacgcgttcacgctctattacttgcactgggtcagacaagcgcccgggcaagggctcgagtggataggctgggtcaagaccgtgaccggggccgtgaactttggctcggcctatttcaggcacagggtctcgctcacgcccgatcgcgatctctttaccgcgcacatggacatacgcgggctcacgcaaggggacacggccacgtacttttgcgcgcgccagaaattttacaagggcgggcaagggtggtatttcgatctctggggcaggggcacgctcatagtcgtgagctcg

SEQ ID NO: 56532 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgagtgagctgtctcgatagcgaggacatattcgagcgcacggaattgatccattgggtacgccaggccccgggccagggcttggaatggatcgggtgggtgaaagcggtctcgggcgcggtcaattacgggagcttggactttcgacatcgagtgagcttgaccagggacagggacttgttcacggcccatatggatatcaggggcttgacccaggacgatacagcgacctatttctgtgccaggcaaaagttcgcgcgcggggaccagggctggttctttgacttgtgggggcgcgggaccttaatcgtggtctcgagc

SEQ ID NO: 56533 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaacttcgcctcgctcgatttcaggaacaggatctcgctctcacgcgatcgcgacctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56534 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgaagagtagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcctgacgagggacagggacttgagcacggcgcatatggatataagggggttgacgcaggacgatacggcgacgtatttctgtgcgaggcagaagttcgcgaggggagaccaggggtggttctttgacttgtgggggagggggacgctgatagtggtgagtagc

SEQ ID NO: 56535 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcgcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttaccgcgcacatggacatacgagggctcacgcaaggggacacggccacgtacttttgcgcgcgacagaaatttgaaaggggcgggcaagggtggatattcgatctatggggcaggggcacgctcatagccgtgagctcg

SEQ ID NO: 56536 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgagacaggcgccggggcaggggttggagtggatagggtggatgaagacggtgacgggggcggtgaatttcgggagcccgaactttaggcatagggtgagcttgacgagggacagggacttgttcacggcgcatatggatataagggggctgacgcagggggatacggcgacgtatttctgtgcgaggcagaagttcgagaggggagggcaggggtggtactttgacttgtgggggagggggacgttgatagtggtgagtagc

SEQ ID NO: 56537 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcgaggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagagacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56538 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagcggggcgggggtgaagaagctgggggcgagtgtgagggtgagctgttggacgagcggggacatattcgagaggacggagttgatacattgggtgaggcaggcgccggggcaggggttggagtggatagggtgggtgaaggcggtgagtggggcggtgaattacgggagcttggactttaggcagagggtgagtttgacgagggacagggacttgttcacggcgcatatagatataagggggttgacgcagggggatacggcgacgtatttctgtgcgaggcagaagttcgagaggggggggcaggggtggatatttgacttgtgggggagggggacgttgatagcggtgagtagc

SEQ ID NO: 56539 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaactgggcgcgagcgtgcgcgtgagctgttgggcgagcgaggacatattcgagagaacggaattgatccattgggtgcgccaggccccgggccagggcctggaatggatcgggtgggtgaaagcggtctcgggcgcggtcaattacgggagcttggactttcgccatcgcgtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgagggaccttgatcgtggtctcgagc

SEQ ID NO: 56540 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggctggagtggatagggtgggtaaagacggtgacggggacggtgaatttcgggagccagaactttaggcagagggtgagcttgacgagggacagggacttgttcacggcgcatatggatataagggggttgacgcagggggatacggcgacgtatttctgtgcgaggcagaagttcgagaggggggggcaggggtggatatttgacttgtgggggagggggacgttgatagcggtgagtagc
